United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 6

SEQ ID NO: 20697 - DNA, 913 bp, Glycine max
  Peptide Sequence Number=SeqID_137475
tcgccgcactctcgcctccgtcaatagcctctctccgcgttctacccgatccactttgcccacaccgcaacgcactttcaaataccctaattcgcgcctcgtcgtgtcttccatgagcaccgaaacagccgtcaaaacttcatccgcctccttcctcaaccgcaaggagtccggcttcctccatttcgccaagtaccacggcctcggaaacgacttcgttttgattgacaacagagactcctccgagcccaagatcagtgctgagaaagcggtgcaactgtgtgatcggaacttcggcgttggagctgacggagttatctttgtcttgcctggcatcagtggcaccgattataccatgaggatttttaactctgatggtagtgagcctgagatgtgtggcaatggagtgcgatgctttgccaaatttgtttctcagcttgagaatttacatgggaggcatagttttaccattcatactggtgctggtctgattattcctgaagtcttggaggatggaaatgtcagagttgatatgggggaaccaattcttaaagcctcagatgtgcctactaaattacatgcaaataaggataatgctgttgttaaatcagaactagttgtagatggagttatctggcatgtgacctgtgtcagcatgggaaatccacactgtgtaactttcagtagagaaggaagccagcggggagcaggagcaaccctagcctgtggaactggagcttgtgctactgttgttgcagcagttcttgagggtcgtgctgggaggcgcagggtagccacaattgcactcttagggcatttttgcaccgacgactctaaagtccctcagaaattcctaaaataccctcaactatcattaaggttttttggggttttgacaatgtttttaggttag

SEQ ID NO: 20698 - DNA, 228 bp, Glycine max
  Peptide Sequence Number=SeqID_137476
atgggtaaccatcgccattttctaccgccttatggcttatatgcttcttcaactgctattgttaggaacttgttttctctatcctctccagctggtataacaagagaaaataacacaaataagaaactggtttatggagctaaagcagaagctgcaatagcaattggatttgatgatatcattgctgatgcactgaaggacacggtgtttatgagaagctcaacttag

SEQ ID NO: 20699 - DNA, 1023 bp, Glycine max
  Peptide Sequence Number=SeqID_137477
atgggtgacaccgcaagaggaagttcacagaagcagcttgtattgaacccaaaaagtagcagtcattttccaaattcagacacagcaaacccactttttggttgcgtatttgcatctctaaatatgattactgagaataagagcaatgaggatattaaccacaggcttgtctgtgccaagcttgaactgatagcagcaaaaatggaagccaatgctaagataaagaaatatgaggagacagttaaacacttgtataaacttttaaagaaagtttgccaggaaagagatgaagcaagagaccagcttcaattgataaggaatttccaagcatctactccagctgagacaagcagtactgttccacaagttgatcatcatgcatgcctccaatacaaaacaaagccatcattgaatagcaccaaggtatcatattcaagttccaaagtattctcaaatcatccatgtgatttatccttgtcaagtctcctgccaaatgagaaacattcttccacaagaattgctgaaccaagcaacttgaccttaccaaagcaaccaaaccatatgaaagcagacataggtgcttcaagagataataataataatatggttgatggtgcttcgctagtgtttgataaacttgtttgtgggaaacccttgcctcaaaagggtagattgttgcaaagtgtaacagaagctggacctttgcttcaaacacttctagttgctcctgctccacagtggcaaaatcctccttctttatcttcctctggccttacacttggtacacaagacaatagctcctctactactaacaccgatgataaggcaagtgttaatccaaatggattcattccaacttctttgagtttggcatttccagggaattctcatggaccttctcagatgtcttctgcgtccggtttcggattagcgctaaagaatgaacaggtgtcatatgaggatatggattccaatatgatgcacaatcatgcattaaccggaaaaaagagaaaacttttgtga

SEQ ID NO: 20700 - DNA, 369 bp, Glycine max
  Peptide Sequence Number=SeqID_137478
atggtcggttcagaaacaccgaattggggggaaaattcccaatttgaaaccctagtatgggatcggatgagatctgagctgaagcagaggggtggagaaggaggaggatggagagagaaagagacagagaaggagcagagcttaaccgtggttaaccgaatggagaacgttgcaaacccatggttaggagttggaaatgtggccagtgggtaccaggggagaagttgcggcgatgttatggtgtttggacatgatggtggctgggctgatgagggtcacacgctcgcgaatttggagttgggaacggagatggtggcttacgacctaggtgcagtggtgatgggttggatgggggtgagaataagatga

SEQ ID NO: 20701 - DNA, 978 bp, Glycine max
  Peptide Sequence Number=SeqID_137479
atggtttcaacagttatgcatgatttatgcttgattcacactgatttgaagccagagaacattcttcttatttcatcagaattcattaaagtgccagactataagtttctatcacggaatacaaaagatggctcctatttcaagaatctacccaagtcaagtgccattaagctcattgatttcgggagtacatcatttgaacatcaggatcacagttatgttgtttcaacaagacactatcgtgcaccagaagttatcttaggtcttgggtggaactatccttgtgatctttggagtgtgggctgcatactggttgagctttgctctggagaggcacttttccaaacacatgagaacttggaacatcttgccatgatggaaagagttctagggccactacctccccatatggtggtcagggccgatcgtcgagctgaaaagtattttaaaagaggtacacgattaagttggcctgatagttcaacttcaagagaaagcatgagagcagtttggaaattgccacggttgccgttctatgtcctgttgatatttttcttccatctacttgctactgtttgcaatggccatttcttactccatgctttatggcctctttattttcgtaaagagaatcatgtggatatcgcttgtgatcggtgcataacaggctggattgatcagatgcatgtgaaagtgtttgaccttgtgatcatgttagaattagatttacaattttgttccatcaacatgacagaacctgaaatgatatttaatgcaatcccttacctttataatttctctaatattcccctgcagaacctcataatgcagcatgttgatcattctgctggcgatttgattgacctcctgcaagggctcctaaggtacgacccttcagaacggcttaaagctaaggaagcattgagacatcccttcttcttcacaagagatactaaaagatatggctaccctttataa

SEQ ID NO: 20702 - DNA, 375 bp, Glycine max
  Peptide Sequence Number=SeqID_137480
atgggaattcggtgtggagcggagatggatattgtctccctagtttcccatctcaactctcaacatatgctcgcattcgtccttgatattcgatgtgtaaaaatttattatctcatttccatatccattgagtattgggtgcacccaattgaggaccttttggtgcttccacctccgctcaacaattcggattcctattttctcgaagcaaatcttggcgaaatagcatacaagatcctcgtagagaattgtcggagtttggaattggcgatgaggggatcaaaagtgtgcgtcggtgccaacgttgtattggtcattgactttggtggcagcaaacaaggtgaaggcaacaccgagactcaaagcaaagcgtga

SEQ ID NO: 20703 - DNA, 288 bp, Glycine max
  Peptide Sequence Number=SeqID_137481
atgacgatgcaggtggtttcgaggaggggggagaggaaggagggtgaggaggaggctctgatggagggtaacctaaacgacgacgaaggaaaatggggtggcggtaaagagcggaaggagagggaagaggataagggagtgggaaatggagaagggtggcgcaatttgggaagagaatccatgggtaaggccctggaagaaggagaagtgagtgtgaacattgatttgggtacttactgcaacacacacaaggaagaagaagaagaagaagaagaggctttaggctaa

SEQ ID NO: 20704 - DNA, 285 bp, Glycine max
  Peptide Sequence Number=SeqID_137482
atgacacacgtgcatgcatgtgatgtgcgcagtttggaaggagttagagaaggagaacaaggagttcttcgaggcatacacgaggagcagagtagagaaagcttcggagagagagacaaggcaaaggatccagaacgtggtttcagattcttccgaagaacgagtttagatttcagacgcaacaaaattaatcaagtaaacgcaggaaaagatgctaatgatggatgggaacgtacatcggaagcaagggaaactaaaacaaacacagatttacagggtgtttaa

SEQ ID NO: 20705 - DNA, 396 bp, Glycine max
  Peptide Sequence Number=SeqID_137483
atggcgactgcgcagtccaacgagcccttgaaaagtttgttgaagagagtggaagaagcaattgaggtgtgcaaaaagcaaaagaaggattccgatgttagagacttcaggctcttgattgcgcagattaaagtcatggaaggagattacactgaagcactcaaggcttatcaggaattggtgaaggaagagcctagggattttagaccttacttgtgtcagggtattatttatactctccttaggaagaaagatgaagctgataaacaattcaataagtttcgcaggcttgttcccaaggaccatccttacaaggactatttcgaggacaacatgttcgctaccaagttcttctcgcagaaattggagagggagggagctggtgctaggggctga

SEQ ID NO: 20706 - DNA, 2517 bp, Glycine max
  Peptide Sequence Number=SeqID_137484
atgaagaagttattagcagaagaactgtcccaagaaactgaacccaaaagaagagctccaggtgtcataggcaaattaatgggtcttgatgggtttccattgcagttgcctacatataagcatcataagggtgtgtcagaaaacaatacaaaagggacaacacaggcggtaaaaactcgaagcagtggtacattatctggcggtcgattgtctaggagaaactcaaagcatcagcaagagtttaaggatgtgtttgaggtctcagagatcccaaagatagatagctgtaggtattcattgcaaggatctgtagggttgaagatcaccaatgctgggatgtcatttgttgaacagaagctcatggatgccaaacgccgagcaacttatcaggatttacaatcttcgcaggattcccatgatacacttgagattcttgactctaaccatgatcttcagcaaaaatactttaagaggccagattctttgtttaaaaggcatctagatgatctgcaagctgccccttcccaatcacattttggtcacgttgaaggtacaaaattatcaaacatagtgaactgtgaacacaatgacttcagccggaagccagataaggagatgaaatggttgaattacaatagatctaaccagaagcatgatgatggttattcttgtcattttgtcagaagacatgctattcacagttctccgaaatcatcaaggaatcagtttaagggaaaaaatgtgcccaatgcagtcccaacaaggattgttgtactaaaacccaatcttgaaaaagtgcaaagtcctaccaaaattggttcatcaccttgttctccatatgctttcctgtctcaatgtggaaagcatgctgaattttcagatatcagatttagggaaactggactgaatcaaaggaaaaatttgactgctaatgcctggcattcaaagcaaaattctttggaatcaagagaaattgcaaaggaaatcacaagccaaatgaaaaataatttgaatattggctccatgatattttcatcttctagatttagaggatatacttgggatgatagctcatgtagtctttctgggaatcaatctcctgatgaatcagaggtgacacctgcaaccttggaaaagtcatttgaaatatgtaatactattagtccatcatcttgttttagtgaatcatttgtgagtagagaggcaaagaagagattatcagagaggtggaaaatgtcgctgaagtttcaacaaggcaattccatctccaggagtggcacactggctgaaatgctcgctatccctaacaaggaaatgaaggcatctaaatttgacagcatctcttgtggggaaggttcacacgataaaatatctagcaatggtaaacctgctgggtgggtcgaaccattgggtgttagcagtaaggatggatatattggaagtttaccaaggtctaaatcacttcctgcttcatctactacctttggaagtcccagaacaatattgcaccatgaagcactttgtgatgatcgatttatgatgccaaaggaagctagtaaacaggaaaagaaaaaagtagtgaagcttcttgatcagagaccgtgtacaaataccaaaaggtcaaaatctggtcacaagaagtgttccccatacttaaatacaattcaaaacaaagtgaagattaatcttgaagagaatttgcccaagcaagaagtgttgattgctgaatcattagctgagatcctcagagatacaagtgcagttactgaagaagttgttggtgtgaccaatgaaaatgcagttggttcatctgaatcttctattaaggtgcttcctaatcccgatccaacaatgggagcatgggattatcccaaggttcttgtagtgtggttctcccaagggcttcgaatgcaactccagttgctgaagctggaatctgaagattttgtggaagaacccgtgctaattcaaagtgatgaagatggtatggaggcatctactggaatttcagaagacagtggattgcttcagactacagatagctgggagtcttcctacacgattgatgtcttgtatgaatctggtattgatagagctcaacctgatgcatttttggaagttggggattctagagaataccctgttagtctttcagtgtttgatgaacttgaaaagaggtactctgattggactaattgttcaaggtctgaaaggagattgctttttgatcgtataaatttgggaattatcagtatatacgagcaattcacgagtgtacaaccatgggtaagctctactacatccttaaatctttgttctaaattgattaaaaatggactccaagactgtcttaacatgatgctggggagccaaggaaaagcaaagtataccgcaatgggaaaggtgctggttagcgaattgcagtggttgagcttaagagatgacattgatggaataggtagggaagttgagagcttgctactagatgatctggtggcagagatagccgttacatag

SEQ ID NO: 20707 - DNA, 327 bp, Glycine max
  Peptide Sequence Number=SeqID_137485
atgcaagaagttgctctactcgagaataagaatgatttttcaaaagctaaaacaaatacttttaacaaaaataaaggcaactttttcgatcagatcaagccaagatgggccaaaacaaattatttcagaccatttgtgtccgacccatcaaactatacccattttcacactgcacctccacattttgcttcctgcacctcattgcattacggaaagccacaggaagcaaaatacggaggcgcaggaagcagcagtctaacattcgtcatggcatcattggttaacctccaattccacgggccaacacataaaattgtacctatttaa

SEQ ID NO: 20708 - DNA, 285 bp, Glycine max
  Peptide Sequence Number=SeqID_137486
atggcgagaaaggtagccagaaacatgcgcagttctaggcaaaggaaggaaacatacaacgatcaccacagccgtgttgcctcactatcatcagtataccttgacataccactgaacgacaagaaatggttcactgaagcttgggtaaggcgtttgaaaaaccttgcatggtttgatagagtcgaagacgacccattgtgggattttggagcagacataactccaaagtacatgggggatgacatgatactgttacttgggctcacggatgccaaagcagaatga

SEQ ID NO: 20709 - DNA, 846 bp, Glycine max
  Peptide Sequence Number=SeqID_137487
atggaatccagcctacgtacgggtcacagactagcttgggtccagtgctggggcatttcgctactagcctgggagacgacatacatccagaagattttggctgccatcggggatatggtggaggtcgatgacgatgtcgacaaggttcggaaggtggacagagcaaaggtaatggaagaatgcagccaaagcaccgagacatgtcattgccggcgtaggagtgcgctgtggtcgtcggatgaaatcgagtccgacgagagttgttgtggaaccccggtatcaggaacaagatacgcgtcatacagggatgacgaggcgcaagtcataacgttgccgacaaacatggctgacccacgacggacctccttcgtgaccaatgccgggagagacgaccatgggaccgcggctttactcagtggtttaatgacacaaaatagaccattgggtaaccacattaacccacgaacacagcaccacagtccgacaaggggcagaacggctaccatcgcagaccaggatgacgaacaggtggcgcgtcacgggttggtggcaaaaaagaccaacccagtccaagaaagatgcaaaaagaatggggtgcaagttgtcgggagtgatgattcatttgaggaggagagcttcgttcacaaaatgggaaatatagcagctggaaaagaagatgacgtggcaggggcgcaggctttttctggggagaagacacgtgacctacagctggatggaggagagggtaatagtgggttgggctttcctgtccacaccccccctaaagcaaaaggtcattttagtaccagcccacaaataaaaaagaatgcactcagcagcgattag

SEQ ID NO: 20710 - DNA, 475 bp, Glycine max
  Peptide Sequence Number=SeqID_137488
gtgaggattggggcaaaggaggagatagaggcactggtagaagaagcgacagtgatgtggagttggatgtggggccccctgaactcgtatcggagggcgatcatgctctcggagaggaggttggagaagaaggcttcgaaccagtgctaggaattgtagttaacgtggatgaaaaggctaaaatgcccttcattctttcatataaaaagcgtacagtgatccgtccgtacgagtcactgttcattcttcacttccacacattatttcttcttcttcctcttttcttcttcttccaaaccgcttcttctccctcttttccgcatgtggtggttggttgtccgtggttgctggttgcggcttttcttcttgttggtgctggtgcgtcttcttactgtggtggtttcgtcttgttgatcgccttcgaggttaatggatattcttcctcttgtggtgcttcttcttccttgttatggtg

SEQ ID NO: 20711 - DNA, 168 bp, Glycine max
  Peptide Sequence Number=SeqID_137489
atgaggatcctcgatggacacacgccggaaacagggatggacaacagcaaggctacaatcgagcaaattggagggacaagaaggacatatcatccttctatttcacacgatttttctgaggatgtcacagagaaagaactgtggtaccatttcaagaagtggggtgat

SEQ ID NO: 20712 - DNA, 327 bp, Glycine max
  Peptide Sequence Number=SeqID_137490
atggtcgaagatcagtggatgtatgaaggtataatgcctgaagaagttggtatggatgaaaatgaagaagaatatggtgtgtttgacaaacgtgaggatgttttgtggtgggctcgatccgttgcttgtgaaaatggatttgtggcgatgattgtaaggtctgacataaacacaggtagtagaggaaggacttcgtttgtgttaattggttgtgaaaggagtgacgagtataggtgtaggaagaaagaatttgttagaagagacactgggactaggaaatatgggtgtcccttcaagcttcgtggtaagccagtggttggaggataa

SEQ ID NO: 20713 - DNA, 273 bp, Glycine max
  Peptide Sequence Number=SeqID_137491
atgggttttgaaaaatgggctaggccgaaaatgcataataagaaacctggtcagggcgacccgacccaacctgctattatgcaacagggttggaaaaccctagttgcctcgcacaaagaacaacgcggtcaatatgaaaacccccacgaagggtggcatgctgcctgtggcaccattggtgcaaagtctagtggtgcgagtccgtcacaaggccagtggcgacacgacaacgatggcagcagaagtttcacagtggtgcaaacaaataaatag

SEQ ID NO: 20714 - DNA, 891 bp, Glycine max
  Peptide Sequence Number=SeqID_137492
atggacaaaaccaaaactatgggagtaaaaaacccttcttactcctcaaccttagaaagtgaaacttcccactcgccccctcctaaaaaccaagataatggaaaaagcaagggaatagaggtgtcatctaagtttgatttagaggctaccatgacaatcacaccctatcgtgccaagagcattatgattgtgtcaccaaggaagagatgctctaagaaggaaggtaaattagggaagaataggaaaagtgacaagagattgacggaaaaatttgacaacagttgggacaacaagaagcaacaacttcccattgaaggccaccttaacgaaactaagattctaatctcaaaacaacttcttgctgatcttttggtagttcctatttatagttctaggctttatgatgattgttttgatatcatgggccttaaaaagataaagatcatgaataaattcttagaggataaggatgatgacttcaactccactactctaacatcctttggaaggattgcccattggatcagcatgcactctgtgttaccaagggcacatttcaagaagatgaacctaaggatgatgaggttctatcttgggggaaaagaatgttacagctctaaagctgaacccctaacatggtatgaagaaagccgaacaagagatccttaccccttctcattgatctcatcaaaagttaaaagagaccattttgaggaagctcaaaatgaggaacaaaaggaactatcccctcagcatgcaaaggaagagtcagaggaagacccttctaagaagccattggattatggctcttttcgtgagacctcagaacaatttttaagaaaaagaagaaggatgaggaagaccattataagcatcagaataaggtgttag

SEQ ID NO: 20715 - DNA, 311 bp, Glycine max
  Peptide Sequence Number=SeqID_137493
atgtctcctttgccttccaaagacaatcaagtccatcggcacgcagagacaatcaagtcctctttgccttctagagacattcaagtccgttggcatgaggagacaatcaatgtcatccactttcgttgttttcaaagactatcagagtctttcgtcgagacttcaaatgtctcctttactttgcaagacttcaaggtttcactgaatgggctttcactagtagctggtcagatgccactgggcccacctgggcaagttgagctcgcctgggtgagcaagttacttaaggaggaagcaagcagcttgcctag

SEQ ID NO: 20716 - DNA, 216 bp, Glycine max
  Peptide Sequence Number=SeqID_137494
atggccaaaaagtggaggtttggctcaaaaggcctacggaaggtgggacatgatgattgtaacccgggaaaagttggtaaccgagattacactttatcgaaaggaataaaaggcgtgcgaatgaaaatacataagatccaagttccaaagagttttgagggcttttgctgtgagaagactggcaaagaactgagcgagaagaggaagccatcctga

SEQ ID NO: 20717 - DNA, 787 bp, Glycine max
  Peptide Sequence Number=SeqID_137495
atgggcgattaccatttcgtgtacaaggatttagaaggagcctctactcaatgggatgatattcagagaaagctcggaaatttgcctccgaaggcaccagctttcaagcccccacctttcacccctgatgcctctgatgatcaacccaaagacaaaacatggattgattccaaaacctcggaggaactcgaagacctcgaagatgacctcgacgacgatcgcttcctccaagaatatagggtttctattaagtgggtcggttttgtttttgcccaagggggtggaggatggataaagaagaagaggctggctgagatgcaagaggcagcaaaagtattgaggtttgggtcagtgattctcatttcaggatctgattttgttcgggaggtgtcacaagctccatctgatgtttgggtggttgtcatcctatacaaagaagggattcctgaatgtgggttgttgatgcaaagcattgaagaattggcagtaagatatccttcaacaaaatttgtgaagataatatctactgattgcataccgaactacccggatcggaatcttcccactttgttggtgtacaacaacggagcagtcaaaggaaattatgtgggtttgcatagtttcgggcgaagatgcactcctgaaggtgttgcattagtgttgtgccaatcagatcctgtacttaatgatggtcataatggaaatgaggctattattgaaggagtccgcaaacggtttatagagaaagttgttgctgatcatgaagagggtgatgatgattactcta

SEQ ID NO: 20718 - DNA, 384 bp, Glycine max
  Peptide Sequence Number=SeqID_137496
atgcagttcacaacaccattccacaatgataggaacatcatagtggtgccttcattttaccaccaacaatgggcaccagaataccctgactttgtctatatcagatatgatggaacaacataccaaatcagactaagacagcatctcgacaaaatatacttcgctgacagactaaaccaattcaggaaagatttagtgatttatgaatctgtcaccattaacttcttggcttgtgacaacaaatccatatttgaccttcatttctctctctcactagaacaccagacttgtggaagaccatggccgtctataaaaccctataccccaatgccacatcctatcagagcgttgtgtcccgacgtccttcagcacatggttccttaa

SEQ ID NO: 20719 - DNA, 144 bp, Glycine max
  Peptide Sequence Number=SeqID_137497
atggatcggagaaaaagaaaacctaagtatctagtgaaaaaagaaagccacaactttgggaatctggatgatgatgagtctgagctcatcgttgtcccagttgaagtggaggatgagtctaaactcatggtcgcagtggtctga

SEQ ID NO: 20720 - DNA, 312 bp, Glycine max
  Peptide Sequence Number=SeqID_137498
atggcacgtgctcctgataacatcaagtctattaatggatcaaaagaggcacttaaacttgccataagaattactgatctttggttcgttgggactccaaacagatctgaacaagcagaaatggtcataattgattctcatgagggtgatattgatttgaatgtttctcctctagctcttgataagttgttgggttatgtccttgcatttaaaatcaaagttcaacctaagtttaacaatgttgttgttcttagatactcgaatgacttagatttgatcaatgttgtggtggacatgctgcctgatgctgag

SEQ ID NO: 20721 - DNA, 447 bp, Glycine max
  Peptide Sequence Number=SeqID_137499
atggctccgaagaagcttccaaccaagaggtccaagaaacatgccactagagagggttctagtgcggccccacaggtggaggtggactttgatggacatagggagaggctagtccaattgagggacgaagattatgttgagtttcaagaagaaatcgcccagaggcaatggactcagctggtgtcacccatggctaagtatgacccagagataatcatggagttctatgccaacgcctggcccacggaggagggattcaaggacaaacactcctgggtgagggatccaatgaggatgccattaactagtttctggggcgtccaccggtcttggaagaaggccagcgctgtgagtttagccagaggaggagccaagcctcaggcttcgacgaggaggctattagccagttgctatgcgtttcggggtaggactttgcccggagcgtag

SEQ ID NO: 20722 - DNA, 618 bp, Glycine max
  Peptide Sequence Number=SeqID_137500
atgaagatggtaactgctttcaccggcaacatgaagaaagctgctgctggacttagacgcattaatcttgatggtcttcgatggagggtttttgatgcaaagggccaggttcttgggaggttagcatctcaaatagctactgtagttcaaggaaaggataagccaacttacacacctaatcgtgatgatggagacatgtgcattgttcttaatgcaaaagatatttgtgtgactgggagaaaacttacagacaaggtctactactggcatacagggcaatattatccagtctattttgacattaggtcactgactctaaaggatcaaatggccaaagaccctactgaagtcattcgcaaagctgttctgcgtatgctccctagaaacaaactacgtgatgacagggatcgaaaattaaggatctttcctggcagtgagcacccgtttgttgatcgcccacttgaaccttatgtgatgcctcctagaagtgtacgagaaatgaggccgcgagcaaggcgtgccatgattcgagcacagaagaaggctgagcagcaacaacagaaggctgatggaatgaagaagggcaaaaatggagaagcccaggaagaaagtgcatga

SEQ ID NO: 20723 - DNA, 138 bp, Glycine max
  Peptide Sequence Number=SeqID_137501
atgcctaaggaacctgtagcaacacagatgagcagcctgaaagaactatgcgactatgctaagtgcgaagaggaaggtgttcttcgcgttcactatcacgggttcagaaagcagtattcttcagggttcggcgaatga

SEQ ID NO: 20724 - DNA, 417 bp, Glycine max
  Peptide Sequence Number=SeqID_137502
atggcatgtgaacacagatggatttttaacctccatttcactcctccgctggaacaacaagcatgcggcagatccctactagcagctagaatgcatgtctggactcttgaactcacacagtccttgcttggtgatcctaaaccattggtgcttccacctcttgcaacaatacatcttccttcttgtggttttcatatgacgattttaagaaggttcgaccctccattgcaatggcctgtccttccagttgaccttggctttcatgacaagtgtgttgcccaaccatggtaccggtttctcgctgaaggtgattttgtgcatggagacgagctttcattctactataggccttttgacgatatttgggaagtagttattaggaaacaaagaaattggggtgacagtgatagtgactga

SEQ ID NO: 20725 - DNA, 1305 bp, Glycine max
  Peptide Sequence Number=SeqID_137503
atgaagaataatggcacagacggatcattgaatttagaagtggtgtctcccactctgttagtagcagaaaaggaagaagccaaggctgtgttgaccttgtttttaaagaaacaaggtttgagcaatgctattgccactagaaccagcaagaagtcagatcattttattgatcaccttgtctcaaggcttcactctaaacacaaatcttggtatcttgcagggagagagctaacgactctagagatcagggacacacttatcccttatcttgaatctcttttcgaagagcatggagacatcctagtgaatgtagtggaaaactatccaaatccacctggtaaggataaatcagctgtgccgattcctccttctaatccagtgtcagactctaagaagcttaaagctgtgtctcgagtgagtgagacagacccagatggtggcaatcttcgccctcatattgtctatctcatggaccttggtatggatattgagcagattaggagtatcacacgacgatttccatcttttgcctactatagcttggagggtaaaattaagccagtggttgagttttttcttgaacttggagtgccaaaagagaacattcttactatcctcactaaaagacctcaattatgtggaatcagtctatctgaaaatcttaaacccaccatgaagttctttgaatctttgggtgttgacaaaaaccaatggccaaaggtgatctatcgcttcccagcactgctaacttatagcaggccgaaagtgatggaaagcatagattttctccttgaattaggcctctcagaagagagtataggtaagattttaactcgctgccccaacattgttagttacagtgtagaggacaatctccgacccacggctaagtacttccattctttgggggttgaagttggcgttcttctcttcagatgccctcaaaattttggtcttagcattgagaacaacctaaagcctgcaacagaatttttcttggagcggggatacactttggaagaaattgggaccatgatttcaagatatggagccttgtatactttcagcttgactgaaaatttgattccaaaatgggatttcttcttgaccacaggttacccaaaatctgagttggttaagttccctcaatattttggatacaatttagaggaaagggttaaacctagattcacaattatgaaaaaatatggagtgaagttactgctgaatcaggttctttcactgtcaagcagcaactttgatgaagccttgaaaaagaaaatgaagaaaatgcaagttagttag

SEQ ID NO: 20726 - DNA, 600 bp, Glycine max
  Peptide Sequence Number=SeqID_137504
atggcagttaatcatagtctcgggggaggaagacattctgatgagttgtccttcctctacgccatatgtggaagccgtggaggattccttggaaacatcatttcaaactttggaagtgggcatgggtatgagcccggaatgggtttggattggaatggcgatggcgtggcaagcttggtagagttcaagaagagccatggaaggttcaagctaggatataagcctatatgccgatgtgaggagaagtgccctagaaaggatggcgtgggatggatgtgtgaagggcgagtcgccatggtccatgataaagtccctcaagagacatcaaactgggtgcggtcgtgccctcctgagttcgagttgggaaactggcaaattgtcgaacaacctagaatttctgtggcgaacacaatttttgttgcgattaaacggtacaaattcgacaatgagtcttgtgaaggtactaatacagaggacccagacgtcgattttgagcaaatagtaaaccaagccaaggatgaagaagatgaagatcgggggcttcccccagagctaaaaaggatggtcgaacaggaagaccgagaagtgaagccacactaa

SEQ ID NO: 20727 - DNA, 477 bp, Glycine max
  Peptide Sequence Number=SeqID_137505
atgagtttcctcagttggaactatcgggagctaggcaatccgtacgtgattcctatcctccatgacctcgttcaaaccgaacatttggacttcattttcctttctagaactttagttggttctggccgtatggaagaaataagaaatcaactaagctttgattcatgtttcgcaattgatcctattggtagaagtggtggcttggctaaactccgaagaaatccttttgattggcagttgattaatttctcatctaatttcatctctgtcaaagtacatcgtgaaggaaaaccagtttggtgcttaacaggtttttatgcaattgaagaaaaacttgacctagcacttgcaacaactagatatggagcaatggggaaagtaaattccaagtccaacctagaacaaaaattgatgatgtacatgctcaaatgggcaagtgcgcatgttgagaggcgagcaggcaataattcagtttga

SEQ ID NO: 20728 - DNA, 249 bp, Glycine max
  Peptide Sequence Number=SeqID_137506
atgcgggaaaaagaaagggttttgggaggaggagaagggaaaatgaaattgagaggaagagaaagcacagagactatcgtcagtctaaaacctgacctaacatgcaaggaggttcctacagagggttgtaagggatatagaatgagggaggaaaatgatttgctggcaggattgctccttgttttctacaactgcttggagatcaaggaagtaagactgtttgagcctgaaacagatgaaaaatactaa

SEQ ID NO: 20729 - DNA, 99 bp, Glycine max
  Peptide Sequence Number=SeqID_137507
atggcacgcaaaccgaggcagaattttagcgtttcaaagccaaaagggaaagtgggcccttctagctccactcaaatggagacatgtggcatagcttaa

SEQ ID NO: 20730 - DNA, 285 bp, Glycine max
  Peptide Sequence Number=SeqID_137508
atgacagtagctacactttttggaaagctaagggagtatgagttagagcttgggagactaaaggatgaagaagaagttaacaagaacaataagggattagccttgaagacaagaacttcattgaaatcacacttgaagggggttgtatatcggcttgatggctccacaaaagaatctcacttcacgtactctaatgttgtccttctgctcccacaaacaaaggtttccgatcatcacaggtaccaatcatacggtacaaaaattgcaaggatgagtttattataa

SEQ ID NO: 20731 - DNA, 417 bp, Glycine max
  Peptide Sequence Number=SeqID_137509
atggaggaagtcgctattgttgtgaattatgatggtgatgtggtatcaacttctaaggaggtattgtttgaatgtcctaatagtcctaaattcattaaaattagtgaagaaatgtcatttgttgctttgaggaaagtagttatagatgtcatcgaaggtggaagaaggttatttgagggttttggttgtgttgagtttggctgtatggaacttaaagacaacaatcaagtgtggaagatgtttttcatctttttgcaaattagttctaaaggtcttatcgagttgtattcagtggttggtcgatctccagaaaaaatccttgtcttgctatgtaaaccaagaaaaccaagacttgccaaagtgatcattgctctgatgtgtggattaacgaccagaacaagctctaatgaagattag

SEQ ID NO: 20732 - DNA, 2055 bp, Glycine max
  Peptide Sequence Number=SeqID_137510
atgggagaaaagtctgagaagccgccaatgttcaatggatttgcagatcctaatcagacactatccatgaatttttccattgattcctttttcaccactctgacaaggttgaccagcttaagggttcttagcttggtgtccttggggatttgggggccacttcctgataagattcaccgtttctcttctcttcaagttttggacttgagctccaatttcatatttggagccatcccacaaaaattatccacaatggtaaagcttcatgcactgacccttgatgacaattattttaacaccactatgcctgattggtttgattccttgtctaatctaaatatcttgagtgtgaagagcaatggtttaaagggttcattcccctcctcactatgcaaaattaagacacttgaagtgatttccttgtcccacaatgagctgtctggggaattacctgatctgggttctctcactggtctacatgttctggatttaagagaaaaccatttagaatctgaactaccgttgtttcctaaatcagtggtcacagttttgcttagcaataactcattctcaggagatatacctaagcagtttggtgaattagatcagcttcaacatctagatctgtcttcaaatcacctcagtaagacaccgccatctaccttgttttcttcgcccaaaataagttatttgaatctggcaaacaatgtgctaagtggggccctccaagacaaacttagctgtgggggcaaacttgggtttgtggacatttctagtaacaagttaagtggtggacttccttcttgcttggccaatactactgatggtagagttgtcagatatgctggaaactgtttatctctgaattctcagaaccaaaatagtgggtcttattgtagagaatctagctctggatggaagaacttgaagaaatggaaagtagctgcagcaatggccatcattgttggacttgttcttgtggttttggtgtctggagtcttcttatggaaaaaatatcattccagaaagaaaactgggcaggaagtgttgctaaaaattgttcacgataactccacaactggggttccatctgagatccttgcaaatgctagatttatttctcaaacagtgaagctagggacacaaactacttcaacctgtcgacatttttcgatagaggaattgaaggaagccacaaaaaactttgacttgtcaacttatattggtcaaggctccatagggaagctgttcaaaggtaaactagagaatggatcctacgtggcgatacgatctttggctctgtcaaagaaatgctctattcaaaatcttagagctaaattggatttactctcaaagcttcaacatccaaatttggttagccttttgggccattgtattgatggtggtggacaagatgatcccaattcccacaagcttcatcttgtatatgagtatgtgccaaatgggaattatcgtacacatctctcagaattttctgtagataaggcacttaagtggtctgatagattgacaattttaattggaattgcaaaggcagtgcatttcttacatactggtgttatacctggctgttttagtaaccaactaaagacaaagaatgtcttacttgatgaacaccgcattccaaaactgagtgactatggtatgtccatcatcacagaagaaattgaaaattttgaggcaaagggtgagaaaccaaaaccatgcccacggaccaaagcggacgatgatgtttataattttggattcatattgtttgaatcacttgttggacccatagcatgcgacaaaggtgaaacattttttctaaatgaaaaggcatcctttggcagtcaagatggtcgaagaaagattgtggatcctatagtgttgaccacttgctctcaagagtcattatcaattgcaatctcaataacaactaaatgcatatctccagaatcttcatttcgtccctcttttgaggatgtcctatggaacttacagtatgcagctcaagtccaagccacaacagatgctgaccacaaatcagattaa

SEQ ID NO: 20733 - DNA, 771 bp, Glycine max
  Peptide Sequence Number=SeqID_137511
atgattcatcggagtgttacatgtccaccagcttttgcccgattcatccttgatccacgtcgtattaggagagaggtttactttgatgtcatttgtaacgcctctgattgtcaacttctcgatgaattttacaccacaacactttactcaacttcttggttgattagaaccttccaccagtcagaaccctccataggatcaatgactgttcccataaaccaacacgagacttttcaacgttctttgtcctcactcatgtggtttttggaaaaattccccgagggtcacccatcccacaactactactttaagccaaacatgtttaactatggagttcttaatctcatatttgcacaacctttggatccccctctttctggtgtgattcatcgaggtgttagatgctcaccagcttccgctcaaatcgtccttaaaccacactgtactagaagagatatttgctctagtaccatttgtaacacccctaattatcgacttcttaacgaatctctcactacgacacttcacacggtgacacttcactcaacttccttgttgatcagaaccttccaccaatcagaactctccatagggctctcattgactatcacaaatacaaagcttgaagcaaggaattccatgatccaatgtatcgacttgtcccaagaactcaatctttgccttttcaaaattcattttaaagagcaagccttgttttttcttcctcttcgcctcatccactacttcataagtcacaatcacgctatgtaa

SEQ ID NO: 20734 - DNA, 330 bp, Glycine max
  Peptide Sequence Number=SeqID_137512
atgacaaagcacgctgaaaagtcttgtgttgatttgtggggacaatcattgatcctgaaatgtcataatgtgagagccatcaagaagttgacagtcaagggtgttatattcatgcattctaaggtgcttagaatgatggtcaaaaaggttgtcttagaatatctgtcaagagtgaagaactcaaaagattccttgaagcttatctacatgatgaagaatgctccctctaagtacttggttttgacaaagaacaaggcaacaaagcctcacatagaagactcaacaagccttactcagaagattcccaacatcagaatgaagctatattag

SEQ ID NO: 20735 - DNA, 297 bp, Glycine max
  Peptide Sequence Number=SeqID_137513
atggcccgaggagtcacctcaaattccttgacttttgagtcctttagcctagccattaacttggcttacataaagaagaacagctggaacttggacgacccaacggtcagctttccagggacccttcccactactttcggtccctccactcagagcacagacctcatgatggcaatgttgcagagcattcaccagggtcaatacatggtgatgcagagtttgcatagtttggctcagcatcagccaattatgagcatggagcagttttctttgcaggtggcctggccaagagtctag

SEQ ID NO: 20736 - DNA, 288 bp, Glycine max
  Peptide Sequence Number=SeqID_137514
atggcaagatccttctctaccagagaaaatgtgtgcaatcctaacaccttaagatgttggccatttctatctcaggaggaagtgttggctgccattggttggcctactacttttggggaccaggcttcagaaggccaaaggagtagtgaggcaaccaatggagttggagatggagttgaagatgttgttgatgctggtggatttaaagagggaactgatgttgggaccaccactgccactgttgttgttaatgatgaagctggagcaaaggaagagagtgctccttga

SEQ ID NO: 20737 - DNA, 2427 bp, Glycine max
  Peptide Sequence Number=SeqID_137515
atggctttcctagtgcaaatctctacgcttcagatattaaatcctggatgtgttgatgtgactggagcatacagtgctcagaagactgagttgaacataagcttgacagcagttggacttctgtggactatgactgatttcattgcaaagggccttctcaatggaccttttgaagaaaaggaagcaggtgttggttccacagtgaagcagatagacagcaaaaagatggaggatcaaacacgtatttctaataatgtgagagaccaggcttctgtagatggtgttgattttgagaagcttctattctctgtattctcattacttcaaaaccttggggcagatgagagaccagaggtgaggaattctgctgtcaggacactgttccaaactttaggaacgcatgggcaaaagctttcaaagagcatgtgggaagattgtctttggaattatgtatttcctacattggatcgtgcttctcatatggctgctacgtcatcaaaagatgaatggcaagggaaagaacttggaacccgaggaggaaaagcagttcacatgctcatacatcatagttccgaccttcttaagaactacatttggaagcttcaaaccaacaatattggagacacagagaaacacaagggccagtacatctgggaaatagacggggccagtgcatctaggataaagacggggccagtgcataaaataaggcctgacaaacgaagtggcccgaaactgaatggcctttgtgagcctgatggagatgggaaatgtggctggacatgccgccacatgccagggaagcaccgacaagagggggatccagatccagttggtgatcgccggagttgcaccaatgattggagaagaagccagaaaattcatcggaatgcagaaacaggtcatgggaagaagggtgatgagctgaaaggtccaccgaggatcataggtcaccagtggggcacgattttcattattcctatgtcaggatctagataccatgtcaaaataggagaaaacaaagagaaattgagtaaaaactgtctgtcaaatcgtaacacggctcagaagcagtgggatgaaactcttgtgcttgttttgggtggaattgcacgtatattacggttgttctttccttttttcacaagcttaagtaacttctggtctggctgggaatcattgcttcaatttgttgagaatagcattttaaatggaagtaaagaggtagcacttgcagcaataaattgtttgcagacaactgttaactctcattcgtcgaagggacatatgccaatgccttaccttatttcagtaattgatgtttacgagcttgttctgagaaagccttctagttaccgtggcaatgctgctgataaagtgatgcaggagattttgcatggtcttggagagctttatgtgcaggctcaaggattattcaatgatgttgcatacacgcagttgatagcaatcatagatttggctgtgaagcaagccatgttaactaatgataactttgaaatggaatttgggaatgtcccacctgtgctacggactatactggaaatcttaccactgttacgtccaacagagcacatatcttctatgtggcctgttcttcttcgagagtttctgcagtatcttcctagacaagattcatatttacagaatgaggatgattctcaggtgaactatgatgcacctaatggtgctactccaatatcacccaacaaaatagcagtatctccaggttctggatcaactgcagccataacagccattcctagttacatatttgcagaaaagctagttcccgtgctagtagatcttttcttgcgggcacctactgtcgaaaagtatattatataccctgaaattattcaaagccttggaaggtgtatgacaacaagaagagacaatccagatagtgcactttggaggttagctgttgaagctttcaaccatgttcttattgactatgttaccaaattaatcaatggaggtccagattcgaccattagcaaacctgtcagaacacgaatatggaaagaaattgcagatgtttatgaaatattcctagttggatattgtggacgagctcttccttcaaattccctctcagcagtggtgctagaggctgatgagtcccttgagatgtcaatattaaatattcttggtgacacaatccttaagctgccagttgacactcctttggatatttgtatgttgctacttgctagtttgagtttgactaggctgatcaggcttcatgaagaaaacgacattcttgatttaccagctagaagcaaaaacatttacgctgccaatagttttcaagttactgttagacctcctattacaaaggtgtacaatgggaagggtgataagaggaccatggaaccaacccaccttggcaatggtggtagctga

SEQ ID NO: 20738 - DNA, 630 bp, Glycine max
  Peptide Sequence Number=SeqID_137516
atgacaagatctgaagtcagcaaaatctcaattacagtgctcatgaccagatgtgaatacatcttgagcaggtttctgacagatgaaaatggcttaggtgactgtccattaccaaaagcaagacttgatgaaattatttatgttctccaagaactggcacatcttgtaattcatccagatgcagcacccattctccctttacacccattgttgagaactggcctagcagaggaaaaggagaagcatgacaaccgtccccatctgtttgtgctattaccatccctttgtgaacttgtcacatcaagagaattaagaatacgggagctggtgcaagtactgcttcgattagtcaccaaggaatgtctctggaaaagctcagcttggcaaactacactagaaccacctataggagattttcacagtcttctcttctctgttgcctgtcataaattatggtcaaccatactttctcagctccatcagatttctccaacccaatacaatggagcagctgacagaattgtgtggttttcacaaccagatattctaaaggcgggaacagcaaagaagaggaagaaatctgttaaaatggtccaatgtatgtataatatcttattgattgtagactga

SEQ ID NO: 20739 - DNA, 1433 bp, Glycine max
  Peptide Sequence Number=SeqID_137517
atggatcgcttttcttccagtaccattctccccgaagcgtttcaaggtgccaaagatgacttcaccatgcagcttgcattggtgtggaaccaaatcaaagcgccactgattgtcccgttgctgagactagcagtgtttctgtgcttgatcatgtcggtgatgatgttcattgagagagtctacatgggcattgtcatcactctggtgaagttgtttgggagaaagccagagaaacgttacaagtgggagccaatgaaggacgacattgagttgggaaactcttgttacccaatggttcttgttcaagtccccatgtacaacgaaagagaggtttatcagttgtctattggagcagcatgtgggctttcttggccttcagataggatcatcatacaagtccttgatgactccactgacccaacaatcaaggagttggtgcagcttgaatgccaaagatgggcaagcaaaggggtgaacataaagtatgaggttagggacaataggaatgggtacaaagcaggggctctcaaagaaggcatgaagcgtagctacgtgaaacaatgtgattgtgttgctatctttgacgctgattttcaaccagagcctgatttcctgtggcggaccgttccatttctcgtgcacaatcccgaattagccctcattcaagcacggtggaaatttgtgaatgccgatgaatgtttgatgacccgaatgcaagagatgtcactagattaccattttactgtggaacaagaagtggggtcttccacttacgccttctttggtttcaacgcgggagtatggagaatttcggcgcttaatgaggctggtggatggaaggataggaccacagtggaagatatggacttggccgtgcgagccagtctcaaaggatggaaattcttatacttgtctgacttgaaggttaaaaatgagttgccaagtactttcaaggcctaccgctaccaacagcaccgttggtcttgtggtccagccaatctttttaggaaaatggtcatggagatcataaataacaagaaagtgtcattgtggaagaagatacatgtgatttacagcttcttctttgttcggaaggtcgtagcacacataaacacgtttgtgttttattgcattgtattacctgcaacagttttggtgcctgaggttgtggtcccaaagtggggagctgtctatatcccttccatcatcactattcttaatgcagttggaactccaaggtcactccatttgatggtcttctggattctctttgagaatgtcatgtctctgcatcgaacaaaggcaacgattattggtttacttgaggcaagtcgagtgaacgaatgggttgtcactgaaaaacttggtgatgctctcaagactaaagcaggaggtaaagcacctaaaaagcctcgattcaggattggagacag

SEQ ID NO: 20740 - DNA, 2487 bp, Glycine max
  Peptide Sequence Number=SeqID_137518
atgagtgagagagtgaagaaagaaaaacaaacgggggacaaaagggagaggatgaagaacatcttcaagaagcttcacataggtagcagccacgatcctcatcgatccaatgagccttcgcctcctgtgccgtcgccttcgtgcgccaccgatcagtctcagagctccgccgccactccgccgagtccttcttcggcgtcgccgtcgccgtcgccgtccacgctggtggtaactcccagctgcggcggcggcggcgcgagtccggtggtgaatcggcaggactttttctcgtcggaggaagagtttcaggtgcagctagccctagctatcagcgcttccaattcggagttccgcgaggatcctgagaaggatcagatccacgcggcgacgctgttgagcttgggaggccatcgaatcgattcgacgaggaacaaggacgatgtggcggaggctctgtcgaggcagtactgggaatataatgtgcttgactatgaggagaaagtggtagatggtttttatgatgtatacgggccctataatgattcagtaatgcaaggaaagatgccatctcgaacagatcttgaagcaaaccctggaggttctgagttggtcattgttaatcaaacaattgatcctgctctggaagaactgatacaaattgcacaatgtattgcattagactgccctgtctctagtttggtacaaaggcttgctgaacttgttacaagtcatatgggtggtcctgtaaaggatgctggtatcatgttagcaagatggaccgaaacaagagcagagttaaggacatctcttcacacaattgtattgcctcttgggtccttaaatattgggctctctaggcatcgtgctttgctattcaaggtattagctgacaacattaatatgccttgtagactgttaaaaggtagtcattacactggtgtggaggatgatgctgtcaacattataaagttggagggtgaaagggagtttttggttgatctcatggctgctccagggacacttatcccagctgatattttaagcaccaaggatagtgcctttaagtcttacaatcccaagattttgccaagtttaccctccactaaggataatgaattttcttactcaagacctatccaaccatttcatggtgaaggtagtagtcaaaattctgtgataaaagattattcactgccctggaatggaaaaccatattttgagaagtcagagccttcaaacttaggtttgagtagagagagtggcactggtccttctaaaattcctaataaagggactcctaaccaactagacaatttgccagccttgtctggtgcttctctgtacaaagggacacttggaatgaatacagttggtgatgggacaagattgaatgtcaatgttgtaccatatactaatatcagccccaatgactctcggaacctttttgcagatcttaacccattccaaataaaaggaatggggaaagcccctgtgcataacaaacctgtggaaaataaacctcctgagcttaaaagtactaaaaacaatactgtttctggtagacccccagtgccactgatgtggaagaatcgtcctgcttacaatgaagaccccaggaaaactaatcataaccctaatgattacaaccctcccttatttgtttccaatggttcttctacgtctgaaaatattgaccttagtagttccaaaccattgtataattcaaatataaataatgatgtaaatgctcaaactttggcgcaagttactggttcagtttcaccacctactgtacctaaactgaaccagattgaggatctcaatgcagattttaaccaggggggtttggaagattctcaatatgtcatggtagaggcagttagagaacctgaaaatgttgaaatcagacatcatgatcagaggaagtgtacatatgacagattcatgggaagcaatttgaaattaaaagatccagagagtcctagctcatcaattgattccatcacaaacaggattgatccaatattggatgatgtagatgttggtgaatgtgagattccatgggaggatctggttcttggtgaaagaattggtataggttcatatggagaggtataccatgccgactggaatggcacagaggttgctgtgaagaaatttttggatcaggatttttcaggtgctgcattgtcagaattcaaaagagaagtacggataatgcgtaggttacgtcatccaaatattgttctttttatgggtgctgttactcgtcctcccaatctctcaatcatttcagagtatctaccaaggtgtctcaccagtgttactaatgtaccattttgcagaggaagcttgtaccgaattcttcatcgctctaattatcagattgatgagaaacgaagaataaaaatggctctggatgtggttatactatttgcttattctttattatcgcataacataactaaagagtgccataaaaagtag

SEQ ID NO: 20741 - DNA, 144 bp, Glycine max
  Peptide Sequence Number=SeqID_137519
gaggttcctgactatggaaaactaaatcctctgttggatcttccctgtaggtacctgattggaaactggtctgattctaaagtccttgatagtaagggactaagttgttgtgctatcacgaggaatcggggtacaaggacttag

SEQ ID NO: 20742 - DNA, 2244 bp, Glycine max
  Peptide Sequence Number=SeqID_137520
atgaagaattccagttccagcaatgtgaattacatagcagaaggggttttggcgcgccatacaatgggatttggagctcgttctgctctccgtcttcgtcccaattcgcatttcaacaattccatttgcttcttctgctcccaatcactcacactctgtgaatccgatccccaataccagaatcgccttcaaaaggttcaaaaactcgaaaccttactaaaccgcggtcgcacggtcaccgcaagaaggttcctcagatcccttcttctcaccaaaaccgcattctcttctctctccgaactccacgcgcacgtctccaaacccctcttttcggacaccctcttatggctctgttccgtttccaaaatgctcgacgaagccactgacttgtactcttccatgcgaaaagacggttttatcccttccacccgttccgtcaatcgcttgctccgaaccctggtggattcccgacacttcgagaaaaccctccctgtcttcgccgacgttgtcgattctggtattcgacccgatgctgtcacttacggaaaggctgttcaggcggcagtgatgttgaaggacctcgacaagggttttgagttgatgaaatccatggaaaaggatggaatgggcccttctgtgttcgcttataacttgatactgggtggattgtgtaaagtgagaaggatcaaggatgctcggaagctgttcgataaaacgattcagagaaacgtggttccgaatactgttacttataacacgctcattgatgggtactgtaaggtgggtgatatagaggaagcttttggcttcaaggagaggatgagggaacaaaatgtggagtgtaatcttgttacatataattccttgttaaatggtctttgtggttcggggagggtggaggatgcgaaggaggtgttgttagagatggaggacagtggttttttgcctggtgggtttttgagttttgtgtttgatgatcattcgaatgttgctggtgacgacagtttgtttgatggaaaagaaataaggatcgatgagcaaacttattgtattttgttgaatggactatgcagggttgggagaattgaaaaggctgaagaggttctggccaaactagtggaaaatggagttacttcaagcaagatttcatataacatattggtgaatgcatattgccaagaggggttggagcctaatcgaatcacttttaatactctgattagcaagttctgtgaaactggggaggtggaccaggcagagacatgggttaggagaatggtagagaagggtgtttccccgactgtggaaacctataacttattgattaatggttatggccagaggggccattttgtcaggtgttttgagtttcttgatgaaatggacaaggcagggataaagcctaatgtcatcagccatggttctctaataaattgtctttgcaaagatcgtaaacttattgatgctgagattgtgcttgcagatatgataggtcgtggggtttctccgaatgcagaaagatataatatgctcattgaagctagttgctcattgagtaaattgaaagatgctttcagattttttgatgaaatgatacaaagtggaatagacgcaactcttgtgactcacaatactttgataaatggactcggaagaaatggaagagtaaaggaagctgaggatttgtttctccaaatggcaggcaagggatgtaacccggatgtaataacataccattctctgatctcaggatatgccaagtcagtaaacacccagaaatgccttgaatggtatgataagatgaagatgctaggcataaaacctacagttgggacttttcaccctttgatctgtgcatgcaggaaggaaggcgtagtgaaaatggagaaaatgtttcaagaaatgttacaaatggatttagtcccagatcaatttgtatataatgaaatgatttacagttatgctgaagatggaaatgttcctaaggcaatgtctttgcaccagcagatggttgatcagggagttgattccgacaaggtgacttacaactgcttgattctagcatatcttagagatagaagggtttctgaaacgaagcatcttgttgatgatatgaaggctaaaggactggttccaaaagttgatacttataacattctgtatgtgctaccagctaatttccgggctaagagaggagggaatgctgcgagaggctcaaattgtatcctcagaattgagcagtag

SEQ ID NO: 20743 - DNA, 99 bp, Glycine max
  Peptide Sequence Number=SeqID_137521
atggatgggattctcatttctagtgtggtgttgttggctgattcacgattcactcgaccggatatgggtttcacccaacaaactcaatttcgtgcctag

SEQ ID NO: 20744 - DNA, 1710 bp, Glycine max
  Peptide Sequence Number=SeqID_137522
atgttggacaaactttcacccaaggggctgggggggctttgtactcaaagaaaaatcaagaaactcaaggaggcaatgaaggtatggaacagggtgcagtatggagatacattcaacaaggtacaaagaattgagacagatttaaacagattggaagatgtcagtattaacaggcagctgacctcccaagaatttatgacccgcaaaaaactacaggaggaattatgggctgcagcactctcacatgagtctttgatgagacaaaaggttgatcaccccttaagagtgaaagaggaggtccgccgctttttcagcaacagattcagcgaacctgagcagtgcagaccagtccttaatggagtcagattctgtggtattggacaacaccaaaatgacatgttggtgggagttttcaatgaggaagaaataagggcggcattctgggaagtactaaagtctgacatcagccggttccttgctgaattccatgcaaatgggatcttcccgaggggcaacaatgcatcatttattgccctgatcccaaagttgaaagatccgcgaaatcttaacgaatatagacctatctcactaataggctgtgtttataagattgtggcaaagctcctaacgaacagactgaagaaggtgatgtcagacataattgatgagagacagtctacattcataagtggaagacacttgttgcatagcgtgttgatagctaatgaggcagtgaaggaagcaaataggcgccctaagccatttctggtgttcaaagtggactatgaaagagcatatgactcagtctcatgggctttccgatcatatatgatgaagagattaggattctgccctaagtggatatgctggatagagggatgtcttaaatcagcctcggtttctgtcctggttaatgacagccccacaaatgaattcataccacacagaggcctcaggcaaggtgaactactagcacctcttcttttcaatattgtcgctgaaggtttaactgacttgatgagagaagcactagataagagcctcttcaatagcttccttgtgggaaaaaaacacacaccagtcaacatactacagtacgcagatgacaccatattttttggggaggcaacaatgcagaatgtgaagacaattaagtccattttgagaagtttcaaacttgtatccgggctaaagttaaatttcgcaaagagcagttttgggacaatcgggaagcctgagcaatgggggattgaggcagctaaataccttaattgtagaatcttatttttgcctttcacgtacttgggtctccctattggggataacccaagacgtagtgaactttgggatcctctaatcagaaagggatcagagcataggaagattgcatgggtcaactggaagacggtatgtcaaccaaaagacaaaggtggccttggaatcaaagacctcaggacatttaattcagctctgatggggaaatggcgttgggatgtcttttacaagcaggaggaaccatgggcaaaaataatcaactcgaagtatggcggatggagggcattggaggaaggcacaagaggaaatcatgaatccacgtggtggaaggacctggtctcaattcagcaacagcagcaaaacatagtaatcaaaagggaaactgtttggaaggtgggtggtggtgataagtttagattttggaaagatccttag

SEQ ID NO: 20745 - DNA, 1590 bp, Glycine max
  Peptide Sequence Number=SeqID_137523
atggctaccttcgcggttgcaacaacactttcgacatcttctatcgctccccttaatgcacgacgtggttttggttttggttttggctccttcctttctccaaccacaaaaccaaaacgcccctcaatcaccactaccctcgctgtcgccaccgactcttccgtttgtttcaatcccaaccccaaccctaaccctaatcccaatcagcttgttctcccttccaacgaatcatcggagatgcttctcagaatccgccacacgagtgcgcatgtgatggcaatggctgttcaaaagctttaccctgatgcaaaagtcacaattgggccttggatagaaaatgggttttattatgacttcgacatggagcctttgactgataaagatttgaagagaattaagaaagagatggatcgaattattggaaaaaatttgccacttgtaagagaagaagtttcaagaggcgaagctcatagaagaatatcggctctgaatgaaccatacaagttggagattttggaaagcattaaggatgatcccatcaccatttatcacatcggtgatgagtggtgggacctctgtgctggacctcatgttgattctactggacatatcaataagaaagcagttgaacttgagtctattgctggtgcatactggagaggagatgaaaggaagccaatgttgcaacggatatacggtactgcatgggagaatgaagagcagttgaaagcttaccttcacttcaaagaggaagccaagcgtcgagatcacaggcgcctagggcaagatcttgatttgttttctatacaggatgatgctggtgggggtctagttttctggcacccaaagggtgctatggtcagacacataattgaagatttctggaaaaaaattcacatgaaacgtggctatgatctactgtacacaccgcatgtggcaaaagctgatctttggaagatcagtggtcatttggatttctacaaagagaatatgtatgatcagatgagcgttgaggatgagctttatcagcttcggccaatgaattgtccttatcatattttggtgtacaaaagcaagcttcattcctatcgtgatttccctatcagggtagcagaattaggaactgtttatagatatgaactatctggaagtttacatggccttttccgtgttagaggtttcacacaggatgacgcacatatattttgtttagatgaccagattaaagatgagatcaggggtgtcctagatcttactgaagaaatactattgcaatttggttttgaaaagtatgaagtaaatttatctacaaggcctgaaaaggctgtgggagacgatgatatatgggaaaaagctacctctgctttagaagatgctttggatgataaaggttggacctatcaaattgatgatggaggaggtgccttttatgggccaaaggttgatatcaagattgaggatgctcttggtaggaatggtcaggagtatatccttgcttcccctggcatggtggcacctgctgctcatttagaactaggtacatttggcctctacattgtccattctttaagcccaaagaatctcccatga

SEQ ID NO: 20746 - DNA, 813 bp, Glycine max
  Peptide Sequence Number=SeqID_137524
atgccaccggtgccactatgtagtaactgtttgttcacttcatatcttgggttgggggtgtggaagttgaatgaaggtgttgaggtgaaaaatggagaatctctcaaggttgatccaggagatgacaagattatccacctttcaaatgcatgcatgggggatgtcactaaggatataggaggtggaccagtagccctgtatgtgaagtttgatattgatgaagatattccagttagtgcagtcaatggtaaacccgaggttggcgtcaaacctgatgcaaatgaagctaaacagaagaagatagcagatccaagaaagagggatgcaaatggtgaagatgacgattcatccgaatctgattctgatgatgattcaagtgaagataagtgcccggaggctccttgctatgtgaaggtatgggtgagggtcattcccacagcgaatggcgacatagaaagtagtgaaggtgatgatgatagcgatgatgatgaggaggaggagggggatgatgaatctgatgaggagacagccaagaagattgaagcaagcaataagaggggtattgagtcttctaagaaaacacctgttcctgtgaagaagacaaagtttgttactcctcaaaagactgatagcaagaatgttgtccatgctgcaactcctcacccttctaagcaggctggtaaagcaactgcaaataacaagctgcagtctccgaagtcaggtggagattacagctgcaagccttgcaacaggttatttaagacagaagatgccttaagttctcataacaaggccaagcacagtgctaagtga

SEQ ID NO: 20747 - DNA, 2274 bp, Glycine max
  Peptide Sequence Number=SeqID_137525
atggaaatgcctgccagaagatccggcaactacaccctcctcagtcaaactcctgacgacaacttaacggcgccgttgttcggttgctcctccggcgacggtcaaatcaacagcagcaagttcgagagagtctccgattgggactccggcgtcgaacaccgacaggggaatcggatcgggaatttgcactcctcgttcgggatgcagcggcagtccagcgagggcagtttcggcgagagctctctctccggcgagttctacgcgccgactctgtcggctatcgcggcgaatgagatcgacggattcagaggcacgtttgcgggaaattcggcggcgaggagcggaggttcctccggcaagagctgggcgcagcagacggaggagagttaccaattacagttggcactggctcttcggctttcctcggaggccacgtgtgctgatgatcccaattttctggatcccgtgcccgacgaatccgcgttgaggtctttatcctcgttttccgcagaggcagtgtcgcataggttttgggaaaatggccgaattccttcgcttgagacactaaaatctataaatccttctgattcttcacttgaagtagtttttgtggatagacgtaatgatcctagcttacgagaactgcaaaacaaagtacaagacatttcttgttgctgcatagcaacaactgatgttgtagaccagcttgcgaagctggtttgcaattgtatggggggctcagcttctgtatgggaagatgatctttttcctatatggagggagcgcattaatgatctaagagattgcttaggatctgtcgttgtaccaattggaagtctatctactggactttgcaggcatcgtgctgtactagctgacaccattgatttgccatgccgaattgctaagggctgtaaatattgttcaagagatgatgcctcctcatgtcttgttcgatttggacttgacagggaatacatggttgatcttattgggaagccgggttgcttatgcgagcctgattccttggtcaatggtccatcttccatttcattttcttcacccttgtgctttccgagacataaaccagctgaacctaccattgatttcaggtcactggccaaacaatatttctcggattgtatgtctgctgagcttgtcttcgatagtagttctgcagaacagtatgaaaggcagtacagggacaggaaccctgggtcaattccaaatgataacaacagaagttctctcgttcctctgcatccacaaccttatcgttcaagtgcacatgatcgaggctatgaaacatttaaatcaggtaagcctcctcagaatgctgtagagccgaccatgacaagccgggattcattgcctttaaagcataaccgtcctggtcatagagatacacagacccgactactgattcctagcaaaccaactagagagttttcccttgatatggaggatttggacatatcgtggactgatcttgttttgaaagggagaattggatcaggttcttttggaactgtacatcacgcagagtggaatggctcggaggttgctgtgaaaattctgatggaacaagacttcaaaggtgaacgcttcaaggaattcctgagggaggttgcaataatgaaaggcttacggcatccaaacattgttttacttatgggtgcagtcactaagcctcctaatttatcaattgtcacggaatatttgtcaaggggtagcttgtacaggctgttgcataaacctggcgctacagagatgttggatgagagacgtaggcttagtatggcttatgatgtggctaagggaatgaattatcttcataaacgcaatcctcccattgttcatagagatctgaaatctccaaaccttcttgttgacaagaaatatacagtgaaggttgatcagattcagtcacagcaggagccaaaggccttgcaagtgtaccaaatgaggaatacggttggtgattttgggctttcccgactaaaggcaaatacatttctctcatccaagtcagctgctgggactcctgagtggatggctccagaagttcttcgtgacgagccatccaatgagaagtcagatgtttacagctttggtgtcatcttgtgggagatcgcaacattgcaacagccttggagtaatttgaatccaccacagaaatctgaaaatgattgcaagagatgtatattggtggaagcatgtattgtactggccaatgataacaagatgagtttggagttttactctgtttcatga

SEQ ID NO: 20748 - DNA, 3066 bp, Glycine max
  Peptide Sequence Number=SeqID_137526
atggagagatcgttggacagatcgagagaacccggtcccaagaagcctcgattaatcgaggaactcagcgcccgacaattacctctacgccctgcggcagttactacgttgccgtctacgaggttccgagcatatgacagagactccggcggcggcggagggtatcagccgcagcctccgccgcaccaagagcttgtgattcagtacaagaccgcgcttgctgagctcactttcaattcgaagccaataattaccaacttgactattattgctggagagaacttgtctgctgccaaggcaattgctgccaccgtttgtgctaatattatagaggggattgagaatcctgctgtttcccttgttttcatatgtcagggaaatcttatttctctcatggcgtctttgtattatggaaaaaaggttccgagtgatcaaaaactgccatctctttatctcttagacagtattgtgaagaacattggacgggattatataaaatattttgcttccagactacctgaggtattctgcaaggcttacagacaggttgatccttgtgttcattcaagtatgaaacatctttttggaacttggaaaggagtctttcctcctcagtcccttcagatgattgagaaggaacttggctttgcacctgcagtcaatagttcagcttcagtatctgctacagtcaggagtgatttgcagtcacaacgcccacctcatagtatccatgtgaatcccaagtatttagaaaggcagcgtcttcagcagtcaagtaggagtaaaggagtagttaatgatatgactgaagctgttttaaactcaaatgaggatttggagaggccagatagagctttgagtgctgctcgaccatggctggatcctaggattaacatgcttaataatcagcacacacatagagatgcatttaatgattctgttcctgaaaagagcatggatgggtcatcatacggaggcagtgaatatagttctgtcatttcaagtaatttgggttcaggggctggaagaactggaagtaagctcattgatttaggacatgacagaacatggttcaaaacagatggtggtgatgcagatactacatctgggcaaagaaatggtttcaatctgaagcatagtttttctaatcatgaagcaccaaagtccatgaatttggatgcacattgtcagccgagacaaagcataactaacaaacagaacgatgtgatgtcatgtaactggaaaacttctgaagaagaggagttcatgtgggatgagattgacaatggtttgattgatcatggacccaatgtatcaaaaactttgagcacggacacatggatggcagatgttgaaaatttggaaggtgaagatcacctccaaattacacgcccttttggggcaaaggtcaatagagaaatatccactgttaagaatcaattacctggtttggggggccatccaccatcatcgtggcaattgcagaatctaaagccaggctactcagaaggatttgtgtcctctcatagtgccttaccagccaatgcaagttctttgactgtcaagaaggggaaccaatcctttatgtcgaattcggtagtaggaagggtcaaatttgtgggacaacaatttgattctggggaaactgaatccccttcttggcagtcacctttgcggcaacagtctccatcactgccaggaacagtacaccaccctcattcaatgcaaaattttgctgaccaagaattaccccagaatctcaaaacctctcaatttttgggaggtccgataactcagcatattagagatcactcccttacgctacgcccgattgttcaggttggtaacttgcgaagatcacaggaaaaggacatgcagggcccgttatcttccatgacttcttttcgaccaaagcttcagcaaaagcagctggacccgtctcagtctaaagtttctttaaccagagaaacttcagcacagttgaccacaaataatttgtcagctgcacctgtcaagagtggagtcatccccaagaaatcaattacctgtgatccggatccaaggaagcatccatctcagactggggttcagcctactcagtctggtagacctaccacattagatcctctgcataatgactcatctacactgccaaaaaacactcaaggaaaggctggacaaccaccacaaaggctttctactcaaccacccgcttcctctaacattagcagttcctcagctccgaccttaaatactgccaaaaataataaactaaatccaatttcaaaccttttaagctcattggttgcaaagggtttgatatctgcagaaacagaatcaccaactatggtaccaagtgaggttccgaagggatccaaagatcaaactgaaataattaccaccagttgttctttaccagttacatcaatttctggttctgcagctgtcccagtatcgtcttccggagatgaggtagattctgctacaaaaacctctctcgcctcacctcaatcaactagcacggaaatcagaaatcttgttggctttgattttagacctaatgtaattcgagaattccacccatcagtaattagggaattatgggatgatttccctcataattgcaaagtttgtggtattaagcttaaacaagaagaactgtttaatagacatttggagtggcatgccacaagagaacatggtccaattaaggcatcaagaagttggtatgctgagtctagtgactggattgctggcaaggcagaatattcatctgagtctgggtttaatgattctgttgatgtacacgaacaaaaaacagacagcagtcaattggatacgatggttctagcagatgaaaaccagtgtctgtgtgtattgtgtggcgagctatttgaagatgcgtactgtcatgaaaggaacgagtggatgttcaaaggggccgtttacatgaactattcagatgtcaactgtgagatggaaagtagaaatgtgggtcccatcattcatgccaaatgcttatcagagaactcaatcgtcaccaatttggtaaggcctattatctga

SEQ ID NO: 20749 - DNA, 378 bp, Glycine max
  Peptide Sequence Number=SeqID_137527
atgatcggatccagcgacggatcgtcgacgaggtcgaatgtcttggaaaaaagtgccggaaccgggttcccttgcaagcattcaagtggccgtggcaaactatttaccgtctcaaaatcaggacttgaggaaggtaactgggaagaagacatggtcgagaatgcttcaaaggaagagaaggtaaagagggtaacggcaatgcttgatcagaacgaaagagtggtagggaacacaactggtccctctgacaccttctctcgtctctttggctcaaacctctctaccataataacggaaaattgctctcactctttcccctctgttgccacgtctacagccaacattggatggacccatattactctcatggcccattag

SEQ ID NO: 20750 - DNA, 297 bp, Glycine max
  Peptide Sequence Number=SeqID_137528
atggcaatggggcggggcggggtcgggttttgtttaccccaccctcgcccccgactccccatttccctctccgcccctgcccctaaaaccgacgggggtgtatatttacacctcatcaccgtccccgacaggggtcggtgggacgggttcgggtacgggttcgaggcgggtattgagaatctcatccccgaccccgaatccgaatttgactatcggagaaaacccgaccccgatctcggtcaactcagattttacccatcaaaattgggatggatttgggcccattaccatgcctag

SEQ ID NO: 20751 - DNA, 459 bp, Glycine max
  Peptide Sequence Number=SeqID_137529
atggagagatcgttggacagatcgagagaacctggtcccaagaagcctcgattgatcgaggaactcaacgcccgacagttacctcaacgccctacggcagttactacgttgccgtctacgaggtttcgagcatatggcagagactccgaaatcagcgatttgggtcgtggcggtggcggcgggtaccagccgcagcctccgccgcaccaagagcttgtgactcagtacaagactgcgcttgctgagctcactttcaattcgaagccgataattaccaacttgactattattgccggagagaacctttctgctgccaaggcaattgctgctgctgtttatgataatattctagagaaagagcaatccgagttaatctctctgactagtgaggagtggtgttattgtttgccatgctatacgttgatgaattgggttagtgttgtacctagatggaaatga

SEQ ID NO: 20752 - DNA, 117 bp, Glycine max
  Peptide Sequence Number=SeqID_137530
atggtggcagaggaaagcaaaccaccccaccatgaacctctgcaaaatctcaaaatcattgttaaccacacacaccatgaacctccacaaaccgcccctacctccaaaccacagtga

SEQ ID NO: 20753 - DNA, 432 bp, Glycine max
  Peptide Sequence Number=SeqID_137531
atggaactactccttttgagagctgggcttagggaggaggaaagaacaagtattgctaggttccttagtgggcttaatatggaagtgagggacaaggttgagctccttccatataaggacctagatgacctagtccaactttgcataagggtagagcaacaacttaaaaggaagcctacttcaaaatcttatgactctcactcttatccaaagaaagaccaaggtcaaggcaccttaggggctgcaccttctaagcccgaagatgataagggaaagacaacagaaaagcaaccccctaaggctagtatgcaagagaagactagctctataaagtgctttaaatgtcttggaagaggacacattacttctcaatgccccaccaagaaaaccatgattatgagaggccaagacatttatagtagccaagatgag

SEQ ID NO: 20754 - DNA, 342 bp, Glycine max
  Peptide Sequence Number=SeqID_137532
atgggcaaaattgtccttgcgttaaaaaaaataatttcttcttccggaagaaggttcttccggaaatcttctagaagaaggttcttccggaaacttttcggaagaaccttcttccggaagaacaatttgtgttctaccggaagaacctttttccggaagctttccgaaagaaccttcttccggaagctttccggaagaaggttcttccggaagaacaaattgttgttcttccggaagaaggttcttccggatgaacaatttgttctaccgaaagaaccttcttccggagaagttaccggaagaacttcttccggtaacctctatagaagaaggttcttctga

SEQ ID NO: 20755 - DNA, 292 bp, Glycine max
  Peptide Sequence Number=SeqID_137533
atgagagaaaacgtgatgctcacaagcctgcaactagttgagcttgtagaaatgctcaaacaacaaaaaacaatgcttgaagaacacccaaaactgatcgtgaacctgcgaacaaaaaaggatgatgctcaaaatgagcacttgaatgtgatagaagatgaaggaaatcaggattaccatacaaatgagcttctgcttcgattacagcagtcggaggaaaaattggaggaatctcaggaaactgctagaaatggcgctatcgatgtcggaagacacgtgagcatgcttagag

SEQ ID NO: 20756 - DNA, 786 bp, Glycine max
  Peptide Sequence Number=SeqID_137534
atggccgaaatcgaaccatgtcccttccttctcctcgcactcttctcatgcaccctcttcaacgcttcctccaccgccaaaattggcgtcaactacggcaccgtcgcggacaacctccctccgccgtcaaccgtcgcagccttcctcatatcccaaaccaccatcgaccgcgtcaaactcttcgacgccaaccccgccattctccgcgccttcgccggcaccggaatctctgtcaccgtcacagtccccaacgccgacatcccctccctctccacactccccgccgcacaagcctggctctccgccaacctcctccccttcctcccggccacctccgacaaaaccctaatttcgcacattctccccaccatgaaatcgctccacgaagccctaacaatctcaaacctcaccacaatccaaagccatcttcgcgccaattttaaacttccaccgcgaaacgaaatcccctttcatgataaacccgtacccgttcttcggattctccccgacccgagaccctcgcctaaaccaaacggcggcgttttggaccatctcacgggttttaactacagcaacatgttcgatgcccagatggacgctgttttctctgcgatgaagaggctcgggtttgctgacgtggagcttatcgtggcaaaacgggttggtcctctatgggtgacccgaatcaaccggaatctcaagcctactgtttctgagcggaattctgggttgtttaagcctgatcttactccggtttatcacgttgccgtctacactgccaaacag

SEQ ID NO: 20757 - DNA, 300 bp, Glycine max
  Peptide Sequence Number=SeqID_137535
atggaagatgaggctttgattgattataagagtgaaggtgttgaaggaagaataaaatgtgaaaatggttgcagtgatgagagttttgctgatttgattaaaaaaaaggttggagagagcagttccaactctgaaattttgttatctgagatgacagaacttgatgaaaagggtggagagaagagttccagctttgaggtgatgacagaacttgatggccagagtcaaggaagtgctgaagtttcatcttcatcaacttcaatggtgtgtcaggttcaggaaatgcctacatctgaatga

SEQ ID NO: 20758 - DNA, 264 bp, Glycine max
  Peptide Sequence Number=SeqID_137536
atgggtgcggtgcgttggtgcaacagtgcggtgtggcacgatggtcgtcaagatgaagagaacggtcgagagaataaagatgagcgtgaagagaagtggctgagattttatagggtttacacaaaatcggtcgagtctagccgggtcatcctgggccaaatgcatggccagtccaataaccaaatcggcccaattatgccaccaagtcccggttggactggtccgaccggacgagccagactagttttttcaactatggtttaa

SEQ ID NO: 20759 - DNA, 216 bp, Glycine max
  Peptide Sequence Number=SeqID_137537
atgtgtatttattgtgataaacgagttaagggaggtggtactaataggtttaaggctcacttggctagacaaaaaggccaagaagaagcttacaagaaggttcctactgatgttcaacatgaaatgaagtgtgttgaaattataggagaagtgtactgtagtggagttggtgagctagcccatgatgatgatcatgctgtagatggagagctttag

SEQ ID NO: 20760 - DNA, 591 bp, Glycine max
  Peptide Sequence Number=SeqID_137538
atggaaattgaatggagaagaaggaaaggtgattggagacactccttcaaggagaagataagtcaagaacaagctcaccaccataggaagctatggataagagagcttgaagagggctcacacttagcccattggcccaaaatctaccctaaggctcatgagaccctagggccttctcctgcatctctggctcaatcttcttggagtcttctatccaatgcattggggggtaagattgcatcactctgttaccttagaaatgacaacaatagagataccggtcattatggtagtggtgatggtggtggcggtggtattgatgcagatggtggtggtagtgacgatgtggtagtggtagagatgttggtggtggcaaccaatggtggtgatgttggtggtggcagtaacggtagtgggggtggtggtggtggcagcaagtggtggtggttgcatgaagaaggtggtgttgttgggagtgatggtagtggtgacaatgacgatgttgatgacattgatggttgtcgtggtggtagcaattccaatggtgatggtgatgagttcaatttcatttttgccaaacacgtgtattga

SEQ ID NO: 20761 - DNA, 240 bp, Glycine max
  Peptide Sequence Number=SeqID_137539
atgtgtgaagattatcttaaggtgaacaaacttacagaagtgatctacaccattgggatttgtgagataatattcctagagagagaaaaaggaatcgaacaaagacagtacaagtggaggcttcaatcccttctctatctctctgatgtttgggaactctatcagagcagtcggaggaaaaactggaggaatctcaggaaatcactagagatgccgctatcgatgttggaagacatgtga

SEQ ID NO: 20762 - DNA, 164 bp, Glycine max
  Peptide Sequence Number=SeqID_137540
atggagaatgagattgtagaattccacatgggccatgtaccatatgattttgcaccaatgtatagagttctgggtcatcttcatgtgaagatgggtattgattatctgggtgtaaaaatagcaatagctggatgtgaggaagtcctcgcttttgaaattcaatt

SEQ ID NO: 20763 - DNA, 537 bp, Glycine max
  Peptide Sequence Number=SeqID_137541
atgacagaaaacctgctgttgaaagattacatttccatcttccaggccaacagtgttgtcgatgaagaccatgacgatattgatgatgtgttgtctaagccaagcatctctgattcaaagtttatttcatggatgaacaccaaccaaaactctgttgaaggaagaagtcttacttacgcagaatttgtttttaagtttgtatatagtaaaaagaaaagatgttggcagcttaggaagaaaggctacaccattggcaggttactatgggtcccaccaattacaggcgaattattttacttaaggatgatgcttactatttgcaaaggacctacctcatttgaggacttaagaacaattgcattacagcttagtgataacagtcttaaaaatttggtgttgcttgaaattgaacaactattgcaaacaaatcaaagatcacttagagactatccttcaatgtcatatccaaaagatgcgaattgccctacctatctagacaatagccttatattaactgaactcaattacaacaattaa

SEQ ID NO: 20764 - DNA, 471 bp, Glycine max
  Peptide Sequence Number=SeqID_137542
atgacctacacttgcaatctcggaactagaatgggagtttactctgattttctattatatgttatgttggaagggtcatggctcgtggcttactttattgatgcttttgacttggcaggttcaaaaggaaggggtgggagtgggaacatttctgccttgttgagtggtgttccgtgggatgttaatatgcaactgttacaagtaacctcaggaatgacctttagcagtaagacaattggcggcaatttgaattctaaggttaaatttgttgtgatgaagggttcaacactaatgaaacctactgctagtctgttggctaagcaaaatcagccccatccaattgttagctcaaggttattagaagtaaatttgcccccatgtttggctggtagcatggaagttggtgatgtgaagcagcaagttaattttgtccacaaggcacctaagaagttacaagatatatatgattag

SEQ ID NO: 20765 - DNA, 360 bp, Glycine max
  Peptide Sequence Number=SeqID_137543
atggcttcgacaatggggttggttgaggatgtgtctgaggtccgcaactttgacaaggatatattgatgcttcctatgaaggttagtgataccattgatgaaacgacgacgactaatactactcttccggtggagcccaagaagatacccgtgttgaaggagaagattccccttcctcctattacccttccgagctatatgttggtggaagaggaggtaggtgctttcttctcttgttacatccatgaatcggatatgactaaccgtcttagctggttgccgataagtaatatcccgaaaccaaagcattgtctagttaccctcagtactgtttggttggatgtcacccctcctccatag

SEQ ID NO: 20766 - DNA, 246 bp, Glycine max
  Peptide Sequence Number=SeqID_137544
atgcagcacagcagaaggaatgctacacgaacaaaagatataagatggagctattggtggatagccctcacaaggaccatatggcaacatagaaataaggtggtctttgataaccaaacttttaatgcaagcaagctgatggatgaagcgcttcttctagtctggtccgggcttaaagctatggagaaagatttcgatacacattttaatcagtggtcttccaatttgacagatgcctttgtgtaa

SEQ ID NO: 20767 - DNA, 315 bp, Glycine max
  Peptide Sequence Number=SeqID_137545
atggcttggtttagagagctaccaactggagtattggaccctctttcgctagagcaggtgatgcaatcccagtcagaagaagaatgtgctcagcttatgaggcttcttcctccaacagaagctactttgctagattgggcaataaacttaatggcaaatgttgctcaaatggaaaacttgaacaacatgaatgcacgtaatattgcaatggtttttgcaccaaacatgactcaaagttctactcttagctctaatttttgttattcaattcataccagtcaaattcatcttattggatataacatcaatgagtaa

SEQ ID NO: 20768 - DNA, 189 bp, Glycine max
  Peptide Sequence Number=SeqID_137546
atggttctactagtaaaaatcatcaaaggacaagcaatctcaactagagcatatagtatagcttgtagtgtatccgtactatctatgtatgtagaacatgatttagatggtaatgaagatgtgagccagcgacaacacgttcaagtgtctggtttttacttcgcctatttgtccaacaactcaaattaa

SEQ ID NO: 20769 - DNA, 183 bp, Glycine max
  Peptide Sequence Number=SeqID_137547
atgctttcaggaggaggggtctacaaagttgttggaatatttggagtcccctactatgctacaactaagattctacttgctgataaagagcagaaaggtaaaaagagaaccagaaagtcattccctagcaaatctcctgggaaagcatctacagagacacctgccaagtgccatatgttgtag

SEQ ID NO: 20770 - DNA, 816 bp, Glycine max
  Peptide Sequence Number=SeqID_137548
atggagcagtgtgtggcgaggttagatgtggctatgttcaatgccattcttcgcgaatctgctgatgatataccaactgatcctgtatctgatgctattagtgatcccaacgttctccccattccacctggaaaatcaagcttcggagctggtgcacagctaaaaactgtgattgggacctggtctagatggttgactgatctatttggcatggatgatgttgactcaattgaagataaagctgaccctgatcacaatgaagagagagaaaatacattctttaagtccttcagtattctcaatgcactaagtgacctcttgatgcttcctaaggatatgctgttaagtgcatccataaggaatgaggtgtgcccaatgtttaatgcaacacttatcaagaagattctagacaactttgtcccggatgagctttgccctgatcctgttccctctaatgtttttgaagctttgaactcagagaatgaaatggaagatggaaaggagtatgtcaacaactttccatgcattgcagctcccattgcctattcaccaccaccagcaacttccattgcaagcattgttggggagataggaagcaaatctcaactaagaagaaacaaatcttctgttgttaggaagtcacacacaagtgatgatgagctcgatgaattgaagtccccattgtcttcaatattcttcagtgtttcctcatccccaaaagttttaacaaaatccagcttgaagttcaaagaaattcgcaaccaatctcctgtcagatatgaactccttagggatgtatggatgaaaagcgattag

SEQ ID NO: 20771 - DNA, 636 bp, Glycine max
  Peptide Sequence Number=SeqID_137549
atgatttatgtgggaggagagcatttcaatgatagttgtcatctctactccatggaaaattcttggtgggagcaagagttacatccttacaatcaatatgaagaaaaaaaaagactttctaatcttgagaatgtgttgatgcaattcatggaaacatctgaagctaactttaaagccaatcaacatgcaattcaaaatctggagattcaagttggtaagctagcaaaagaagtggctaaaataccctttttagtcacaagagaagaaaaatttgaagaggttaaagctcatgaggagagtcttgtagaagagcatgattcaagagaaagagatgaacaaaaagaagaaaaaagtaaggagagaacacaacaacagtggaagaaatgctcacaagtagaaattcaacaacaagaacgcattctccaagtcaatacccctcctcatcaactgattggcaaggaagaaagacatgtagaatttaataaatctttaagtgtcattctctccttgaacaccaacacttctcttgcaatggtatggaaggcgtttccaagatacatgagtttcatggagtctctatctaaggggagaaagtgcaaggaagatgtgttctatgtgaccttcatgtcaccttga

SEQ ID NO: 20772 - DNA, 111 bp, Glycine max
  Peptide Sequence Number=SeqID_137550
atggctcgcttagtgcgcataagtgacttttggcttagtgccagtcttcttgctcaatgcagaggattgcaggcgccaacagtggttgcgcttagcggattgctcgcttag

SEQ ID NO: 20773 - DNA, 237 bp, Glycine max
  Peptide Sequence Number=SeqID_137551
atgaggtgtctccgtgtgtcatcggacttggcatctctggatgacaaaggcaggaataaccatgaggtgtctccgtgtgctatcagactcgattgtctttggatagcaaaggactttgagtcctctaaaggtgaggactttctgaaggcgaggactttgagtcctctgaaggctaggaatttgagccttctaaagcaaaggacgttgagtcctatgaaacaagccaatgggcactag

SEQ ID NO: 20774 - DNA, 678 bp, Glycine max
  Peptide Sequence Number=SeqID_137552
atggatgttatgtcattcggtttgaagaatgcctcttcagaactccaaaaaatcatgaatgatatcttcaatccatattcaaaattttccattgtttacattgatgatgtcttaatatttcctcaaaccattgaccaacattttaaacacctgcatatctttattaatatcatcaaacaaaatggtcttgcaatttctcaaactaaaattaatctttttcaaacaaagatcagattccttggtcacaatatccaccagggaacaattataccaatagacaggtcaatagagtttgctaacaaattcccaaaccaaatcttggacaaaacccaactacaaagatttttaggatgtctgaattatgtcggagaatttgtatcctacttgaacaatattgtcaaaccactacacgataggtcgagaaagaatcctcctccttggactgatattcacacccaagtagttaaggacatcaaactcaaaagtatctcaagggcacttcaaactctttacctgactatcttacccgcgaattcttaccgaaaaattgtcaatgcctccttacgaggaggaagaggtagtgagaaaggtttcaaattggctctctcagagccatccccaaaaagggtttcaccctccaaaactgggttatcaacccaatctgtgttatctacctag

SEQ ID NO: 20775 - DNA, 477 bp, Glycine max
  Peptide Sequence Number=SeqID_137553
atgtcgcatgttgctttcgtgaactttgctttgcgtgcaacttcagttagggtttatgttgattgtgcactttggtctgaatttactctgtttgattcgtgtaagacagagaatgtttgtgttaattcctcaacaaagataaagaaaaaaacatggatgtgcatgttgaggatgcaatgcattgtgtttatagcaattgtggtgaagttagatatgagtgtaaaggatgctaacatggactgtgatgttgttgaagtgcaacaaaatgtctctaatttggcagaggatacagtaaaaaagaattggatgcaatgcattgtgtgtatagcaattgtgaagttagatatgagtgtaaaggctgttaacagggattgtgatgttgttgaagtgaaacaaaatatgtctaatttggcagaggatatagtaaagagagtgggtggttacgatgtgtttgtccaactaattaaggttaaatga

SEQ ID NO: 20776 - DNA, 969 bp, Glycine max
  Peptide Sequence Number=SeqID_137554
atgatggaaattgatagagatataaaagcttcacttatggatattattaacaagagagacaaagcgctaaaggcgggtgaagccactaaaaataacttattagatatacttctggagtcaaatcacaaggaaattgaagaacaggggaacaataagaatgttggaatgaatcttgaggaagttattgaagaatgcaagcttttctactttgcagggcaggacaccacttcagttttgcttgtttggacaatgatattattgagtaggtaccctgattggcaagcacgcgcaagggaggaagtctcacaagtttttggcaaccaaaaaccgacttttgatggactgaatcaattaaagattgttactatgattttgtatgaggttcttagattataccctccaggagttggtgttcctcgaaaagttatcaaagatgtgaaacttggaaacctatcatttcctgatggagtggagattttcatatcaacaattttggttcaccatgatagtgagctctggggtgatgatgctaaggagttcaaacctgagagattttctgaaggagttctgaaggccacgaatggtagattttcatttttcccctttggaggaggtcctagaatatgcatcgcacaaaattttgctttgttggaagcaaagattgctttgtcgatgattttacaatgtttctcgtttgaactttctccaacctatactcatgctccaactttggtgatgactattcaaccccaatatggcgctcctgtcattctacataaggacatgaccaagagcaagggcaaggatccacttgaaggacttggagggcctatgacaagggctagagcaagaaaagccaaggaagcttttcaacaagtgttgtccatactatttgaatacaaacccaagtttcaaggagaagagtccaaggttgtgagttgtatcatggcccaaatggaggaggactaa

SEQ ID NO: 20777 - DNA, 453 bp, Glycine max
  Peptide Sequence Number=SeqID_137555
atggaagcagcatgggtcaatattctgatgctgatactgatactgactctgatatgggcatggaagaagctcaactcattatggctcacgccaaagaggcttgaaaagatcttaagagaacaaggccttcgaggcagtccatacaggtttaaggttggggacacgaaggagacattgaagatgcaaatgcaagccatgtccaaacccatgaatctcttctctaatgacataggaccgcgcaaaaattcttttatttggaatggacagaaaccaagggtgaccctcacagatcccgagctaatcaaagatgtattcaacaagatttatgactttggaaagcctaatatgggcccaaatatcagatcacttattcctggtcttgcaatgcatgagggagaaaagtggagcatgcatagaaagataatcaaccccgcatttaatttagaaaagtag

SEQ ID NO: 20778 - DNA, 300 bp, Glycine max
  Peptide Sequence Number=SeqID_137556
atggaagcagcatgggtcaatattctgatgctgatactgatactggctctgatatgggtatggaagaagttcaactcattatggctcacgccaaagaggcttgaaaagatcttaagagaacaaggccttcgaggcagtccatacaggtttaaggttggggacacgaaggagacattaaagatgcaaatgcaagccatgtccaaacccatgaatctcttctctaatgacataggaccgcagagaaaagtgagaaagaatgaaattgggaggatatatagaaatataagggaaatagagtag

SEQ ID NO: 20779 - DNA, 101 bp, Glycine max
  Peptide Sequence Number=SeqID_137557
ggccctatacccgggttcgtgggaacataaggagtggagtatgttcttcgaaggggatgatacctctagaaaccatcaagagagatatgactaccttgggg

SEQ ID NO: 20780 - DNA, 276 bp, Glycine max
  Peptide Sequence Number=SeqID_137558
atgggcgtcgtcaagtacatgaccatggatgaattaaagcgcctaggcatcccctcagaaatgcttaaattctttaaccattctagtttcccacacaagggacatccgacaagtaacaacatctcaaatcaatatcatcataaatatcaacatcaccacatatcaattaaagtcatcaataacaacatcaacagtaagttgcattccgtatgtacatatttctttcatgtctgggattcacactccccaggtcttcaaacaacacaagtcaaataa

SEQ ID NO: 20781 - DNA, 294 bp, Glycine max
  Peptide Sequence Number=SeqID_137559
atggctaatggacagggtgttatggaatcacagaaaacttggtgtgtggcaaagccttcatcagatcaagcaacccttttggccaacctcaattatgcctgctctcaagttgattgcaggattctgcagaaaggatgcccctgctcttaccctgacaatctcatgaaccatgcttccatagccatgaatctctattaccaatctagggggaaaaaccactggaattgtgatttcagggcctctggccttgttgttgtcactgatccaagttatggtaattgcatttatgcatag

SEQ ID NO: 20782 - DNA, 160 bp, Glycine max
  Peptide Sequence Number=SeqID_137560
atggaagaaagaattgaggggttgttctccaccgaatccttgaggtggattttgaggattctgctccgattaaaacgttcctctcgatgtggtggttcagcgacaaagcaacaatggttttgtggtggccaccggtggtcgtgggtggaggaggagggag

SEQ ID NO: 20783 - DNA, 201 bp, Glycine max
  Peptide Sequence Number=SeqID_137561
gtgaaggctgttgttcgagacaaaaaggaggagttagttctcgataatagcttaggtaattgttcaatgaaagaggtaaacaaggtgttcaacattgcaatgatgtgtcttgaaccagatcccttgaagaggccaaccatggctgaagttgtcactttgcttgagcaaacagaaccagataaactcattactgcatcatga

SEQ ID NO: 20784 - DNA, 264 bp, Glycine max
  Peptide Sequence Number=SeqID_137562
atggtaactaaaaatgaggaagatgaagcagcttgtgcaaggaaatggggttgccttctactgctcttgtgtgaagagaaatgcataggggtggctgataagagtgagaaagagtggtcattgctgaatggaagtgttgaatttgagattcttttaagaacaacaattctggtggagtttgtggatggtgaaaagtatagcgatgtggaagctgctacagctccaagcattttaaggactaggattgtgtatgctcagcaatga

SEQ ID NO: 20785 - DNA, 687 bp, Glycine max
  Peptide Sequence Number=SeqID_137563
atggtagcaaaattatcccagtctaactttaatctgaaactattggcagctgcaaatgccgaatacgtggaggaaccagcaacaaatgtgaaattccagacatctttgaattttcctggttgctcaaattcattaactttgtttggaacaggatacagggagaaagtttttgcaattattggtgtcaaggtctatgctgcaggtttgtatctagatcaatctgtcacccaggaattgaatgcttggaaagggcaatcaaaagatgctattcaagggaattcttccttgttcgagaccattttccaatcttcctttgagaaatcattgcaaattgttcttgtcagagatgttgatggtaaaactttttgggatgccttaagtgatgccatatcaccaagaattccacaacccacaactacagatgaaactgctttgaccactttccgtggtgtctttctagatcgccctcttaagaaaggagctatcataattttgacttggttgacccctccagattgcttatttcaggtttctgtctcctcaaatgggtttccatctactgtggatgctacaatcgaatctgcaaacgtggcttcggctctttttaatgtattccttggagatagtcctgtttctccctccttgaaagcttcagtggctgaaggcttgtcaaaagtactcaaataa

SEQ ID NO: 20786 - DNA, 900 bp, Glycine max
  Peptide Sequence Number=SeqID_137564
atgggacaatctggtgcagtcttgctggggagattctcctttgaccaaggtggagaaagtatatggatgtcaacactagtacaaactgtggcattcccaatcgttttcttctcactcttctttcctcaccccaaatacaattctggcaccactgacctcaccatgcactcttctactcacactctcatcatggtttacttcctcttaggtatcctcttagctggagataacttgattgacacaatagggcttcttctataccttcctgtgcctacttactccctcatttgtgcatcacaacttgctttcaatgccatcttttccattcttatcaatgctgagaaactcacccatgataacactaagaatgctacaaaaaacaagcacatggttggtatttggtgcactcttggtgcatcagcaggatatgctcttttgctgtgcctcatgcagctatcattagaaagggtcttgaagagggaaacattttctgttgtcctggaaatgcaaatttggacatctcttgttgcttcatgtgtttgcatagtggggcttttttccagtggagaagggaagggtttggaggatgaaatgaggaggttcaaagcaggaagagaggtttacatgttgactcttgttggaactgctttggcttggcagatttgttctgttggagttgtgaggctaatctatttggtgtctactttgttctccaatgttatgagcatgctgagtttgccacttgttcctgttgctgcagtgcttctttaccatgaacaaatggaaggtgtcaagattgtggccatgttgttggccatcttgggtttaatgcagtgtgttaagatggaagctatgttcatcttcagaagcagtcatggaaaccagaaattgaagatttga

SEQ ID NO: 20787 - DNA, 795 bp, Glycine max
  Peptide Sequence Number=SeqID_137565
atgtcttcgtcgaaagatgcagacccaagcctgggttacctgactcgcaaggacacggaggtgaagcttccgcgtccaaccagggtcaagaacaaaacccccgctcccattcaaatcaccgccgagcagattctccgcgaggcacgtgagcgtcaagaggccgagatccgccctcccaagcagaagatcaccgaccccaccgagctcggtgagtaccgtctccgcaagcgcaaggagttcgaagacttaatccgccgcgttcgatggaacatcggcgtctggatcaagtacgcgcagtgggaggaatcgcagaaggacttcaaacgcgcgcgttccgtctgggagagagcgttggaggtggattacaagaaccacaccctgtggctcaaatacgctgaggtggagatgaagaacaagttcataaaccacgcaaggaacgtctgggaccgcgccgtgacgcttctgcccagggtggatcagttatggtacaagtacattcacatggaggagatgcttggcaatgtcgccggcgccaggcaggttttcgagcggtggatgaagtggaccccagaccaactttcacctcttctcctttatcttctgctacatctccatggtggaaaatcaccattgaaactcaaagatctagcctctatagaagcttctcaagcaagcttccatcaagagcctttgggaactttgtttgatgttgcttcccatagatgcaatgctcacaaaatgaagaggttccaccttgtgatttccaaggaagcctcgattgctcagaatatctag

SEQ ID NO: 20788 - DNA, 474 bp, Glycine max
  Peptide Sequence Number=SeqID_137566
atgtgcaaacatcatcctccgaaacatgaacttgggtttggatacaggttcctcgtcaaaagcatcaccaaatgcgggatcggcagaaacatttacactccaagaaacatcatggcgggaagagaagcattttgcactattgaagattccctcaaagaaatggacgacataatgttcaacacatttgacatcctcttcaataacaacactgctttcttctctccctctcacatagacatccttgttgtaaatgagccaatgtttgcatctgttccttttttcacatctcgcatcataaacaggtacaaattgaggcagaatatcatggccttcaaccttagtggaatggagtgttccggaagtgtaattgctattagtttggtgcaacaactttttaggacagacaaaaactcttttgctatagttgtgagcacagagggtgcattatggtattttgttatgcattttagttag

SEQ ID NO: 20789 - DNA, 213 bp, Glycine max
  Peptide Sequence Number=SeqID_137567
atgttagagctttcaagaccaccatggcgaatgtctggaaagctaaagagtgacatggagaaacctgttaggaatgatccatggaattttgaccaacgcatattgattctaaaggatctaaatccacaagagtcaccaaagaacattgaccttagatggtgtcatttttggcttcagggggaggatatccctccagaatgtagaacaaactag

SEQ ID NO: 20790 - DNA, 324 bp, Glycine max
  Peptide Sequence Number=SeqID_137568
atgcctttcgcaaaatccgcctttgaaatcaaagtcatcaaaatagaggttaaagagaattgcgagaacaaaggaaaagagattggcctcgctcggcacaaaatctgcaaccttaaccctaatcgaatggcctcgctccagcatcaacagagcagttctgatcggaagcttctcgagatccatgatggatggctaatggttcgacacgaagtggaacccaacattggtgatgtacgtgtgcaaaccagagaagatggagaaatcatcgacaacgaacacaatcatgttgttcaacatcacgagttccgcgttcttcatcactaa

SEQ ID NO: 20791 - DNA, 558 bp, Glycine max
  Peptide Sequence Number=SeqID_137569
atgagaatcatcaaagaagggttgcaaggagaacggtgggctgtaaatgagaatatcatcaaagaacactgccatgaatttgtgaaggaagggttgcaggaggtcattcatggtggtctggaacgaggagggggcattgtagagcccaaatggcatgactttgaattcataatgaccccgatgtgtgtgaaacacagtcttagggatatcagcttctgccattcttatctgatggaatccctgatgcaaatccagtttggtgaactaggaagcacgaccaagttcatcaagcaattcattgatagttggcactggaaaatgcatataacatcgtggccacctgcttctcaagctcattcttctagcaacaggggtagcgtgtggtgggagttagtgaggttcccaaaaaatatcaccgaaaaacgaagaagaaggtcaataagggtggggttgaagtgtctggagggggtggtgaaaaggaaaacaagtgggcttgatcaggggtgtgggaaatatgaaacaaggctgaaatgttgcgttgaggcctgggtgagctaa

SEQ ID NO: 20792 - DNA, 642 bp, Glycine max
  Peptide Sequence Number=SeqID_137570
atgagtgaaatagtggaggtgcaagagcaaatgaaggccgacatggaggccatgaaagagcaaatagccacaatggtggaagccatgatgagtatgaaaagaatgatggaggtcaatgcggctatgggcaaggaggcgaagcatgaggaagtacgggcagtccccattttgtgcaagttcaaaacaagcattccttcccaccatatgccttgcctcccaactatacaccacccggtgttgcacacactcccgataagaatgtcaataactccactcccatactcattgagagacaacaaccccaatatgatcatgcacatgtatctcaacccatggggggcacgtgaagaatcccaggaccacgctctggccgacttcgagccttaccccggacatgccattgaggggcaagcatttggtggcggagattatgcttttgctgacatggcagagttgtgcctagtgcctgatgtcgtcatccctccaaagctcaaagtgttggattttgataagtacaaggggactacttgccccatgaatcacctgaaaatgtacagcaggaaaatgggggcatactcgaaaaatgaaaaattgttgatgcatttcttccaggaaagtcttactgaggcagccatcacctga

SEQ ID NO: 20793 - DNA, 180 bp, Glycine max
  Peptide Sequence Number=SeqID_137571
atgtcagtgaaaaacctcattgggctcccagaagtacatgacaagatagaatacacactggatcagcatagacttcaaggaacattcaaaccgagtgtatttacccctaaggcctacactccgaagagttcgtcagggcctctccttactgattcgggtccaacccagaaaacattttag

SEQ ID NO: 20794 - DNA, 717 bp, Glycine max
  Peptide Sequence Number=SeqID_137572
atgaggacgtactctagggatgagaagcttttgatgcatttcttccaagatagcggtaccaatataacactcaaatggctctcgacagatgtgattagagctattgagcccaaggtgtcaaacggacatcgcttcatcttggtcaccattgactacttcatcaaatgggttgaagcgacttcttacacgagtgtgacaaggagcgtggtggttaggttcatcaagaaagagataatctaccgatatagattaccaaggaacattatcactgacatcgccaccaatctaaacaacaaaatgatgaaagagatgtatgaggatttcaaaatccaacatcacaattccacgccttatagacccaagatgaatggggcagttgaggcagcaagcaaaaacatcaagaagatcgttcagaaaatgatcgtgtcatataaggattggcatgagatgctccctttcacactgcacggttatcaaacctcaatacacacatcaactagggcaactccgttttcaatggtatatgggatggaagtcgtgttgccatttgaagtagaggtcccttctttaagaattctggtagagtctgggttaaaagagttagaatgggcccaaacacgctttgatcagctaaaccttatagaaggtaagagactggcagccatgagccacgagcgattatatcaaagacgggtgaagaatgctttcgacaagaag

SEQ ID NO: 20795 - DNA, 345 bp, Glycine max
  Peptide Sequence Number=SeqID_137573
atggcatttccttggccaaatgttgatccagatatcagcctttctcttaaacagaaccctgcttcttatacacaagttttgaatgcttcctctagagggttgcacagaatgagaactgtattcagttatcttcccatatccatggcaactgaacctgctgcagatgacttaatactttcactgctaagggttttctggcccatcttggagaaactttttggctctgagcatatggagaatgggaatttatccgtagcagcttgccgagctctttcactagctgttcgatcttcaagtttacccacttggacacatttgttgacagttcatcggttccccttgtga

SEQ ID NO: 20796 - DNA, 291 bp, Glycine max
  Peptide Sequence Number=SeqID_137574
atgaccggagagatgagaggatcctttgagcttcttggcgaggtcggcagtggcagagtcgttgggagcctccttgacgaggtagacgtaggcgaagccaccttccccgagctagcgcatgatgccaaagcggttctcgttgatccaaacatcacctccgctgttcagagtcgtaaagagcccattcaaagaattctaggcgacgaagcgagtgcccctgcccaacaagagagagaaagtgaaaaggttacgctgcccaatgaaagaatgagagcgcgagaaaaagtgtaa

SEQ ID NO: 20797 - DNA, 321 bp, Glycine max
  Peptide Sequence Number=SeqID_137575
atgctcacgttgttcaataatggctttagtgtagaggctttgatggaattattaaagtctgggatgtatctagcaaaaattggactggataacctagaagaagctttactacttcaggctgatatgatggatcttaaagcacgaattcatgggcctgctcaagcatatgtgatggaagcgagacttgacgaaggacgggtggaagtggtccaaggtgatgctaggaacgtgttgtgcatttgtattggttttgggaagccaaggctacagagttatcaaaagttgccaaatttaagtggtgatatttccatcatgtattaa

SEQ ID NO: 20798 - DNA, 405 bp, Glycine max
  Peptide Sequence Number=SeqID_137576
atggcgagggaatggaaaccagtgttcaagatgttgatccaatggaaatcagtgtttgaggaggaccattttgttggcgatggtagatttggtgtctcatcgtatccaatgcctggttatatgcgggttccgattacttttccttcttcaccttcccactcttcatcattggcagcttttgtggccgatatcgccatgatggtggaggaaatctttgctcaatcgattgtgagggagtacattctaccatctcccgacaacaagattcccttgtctacatatcggtcatacaatctagactatgtcgatgatattggtgatgaggaggaggatcgttccaaggacgtgagcaatgtgagggagatattggagatcaaggaagatccgttagaggattcttcttaa

SEQ ID NO: 20799 - DNA, 195 bp, Glycine max
  Peptide Sequence Number=SeqID_137577
atggaaggtgacaacatcataggactcaaaaatgaaatgggaattggatttttggaattaggttttcagcctaaatggagactggaagacgtacctggagtgcctaaggtcaacctggaattcagttctgaagcagacatgatcaacaaaatgtgtgccagtattgctttgcagccggtttcagaagtatgttga

SEQ ID NO: 20800 - DNA, 321 bp, Glycine max
  Peptide Sequence Number=SeqID_137578
atggagaccaaacaacctaatttggatcccaagcaagatcatgcgaaggatgttatgccaactatggagtggactttacttatagaagtggaaattgaactaaaggcaaccaccaatgggagcttcgagcttgaggggcttagagcctatgccttggagacacccataaatgcaatcatagtgaggagtgacggcaagagagtgcctaaacttgtaattaagcgaggggttacaattggtacttcgggtatggaggtgaggaccaagatggtccttgaggatcagaaatggcgtgaacttgtgatacctcaacaaggctag

SEQ ID NO: 20801 - DNA, 279 bp, Glycine max
  Peptide Sequence Number=SeqID_137579
atgaatacaacgcaacagggcaataagagtcccgaggagtttgcggagcaagttgtgaaagaggcagatgagtataatggctttaaccttgtattagctgatatttgcacctccagcatggtttatgtctttaatagaccaaaccaagatcatctttctcttgcacaagttgttgttacccctggaattcacgttttgactaatgcagccctcgacgctccatggccaaaggttgaaaaatatcataaaaaggagttcgttcatttgagtttcctatag

SEQ ID NO: 20802 - DNA, 297 bp, Glycine max
  Peptide Sequence Number=SeqID_137580
atgttacatagaagggaacccgtccaatcttatgaggtggagcttgacagcacaaaattccatcagctaaaacctcaacaggaacctccacttccccaaacatacaggaccagttacattttgccaccacagcttgacattttaaaaatgttccaacaatcaacacctatatttaaaccagaatggcaaatagaaaaagtgggcaaaaacgaagaagaaatcaaggcccagcccaatgtcgcgctcagtgcgctactcgcgctaagcgagcagcacgagaagcaacagactagctaa

SEQ ID NO: 20803 - DNA, 384 bp, Glycine max
  Peptide Sequence Number=SeqID_137581
atgcaatcacagggacttgcactacctccggagcctgaggttggtccctcaactgctcgtgtcagcacaaaggagagttttgttgatccctcagggaacgatccagagacgggtgactcagacaaatgcgggttgtacatcaaagaaaatcctccccgcctgattgtcctaggaagagtttatgagggatccacaactgttcacaacatccctttgttgcatgatcaagtgaaggtcggtgttgaggaggttaaagatgcagatgctcccgttcctgtacccactgacgaggttaacttagtgggacaggcacttaacaccttccttgcttggctgacacatctcgtgaagcgtttatcagaacatgtattttgctttcattaa

SEQ ID NO: 20804 - DNA, 459 bp, Glycine max
  Peptide Sequence Number=SeqID_137582
atggaagtgggcacgtgcatgcaaaaagtgcagtgtgagatcgcaggccatgaaaatattccagttgcacagggaagccctgagccgttgaagggtggaatgccttgtgttgctgattttgttcatggtaaagatggactagggaacacattcctaccctcacctaaaggtgagaaaattgagaagagtgctagtgagtttttggttgagaaagtctctgaatatcccagtgaagcaatcaatggagattctacgtttgcaagcaaagtgaagagaatagttatacttggtggtgcattctttgccttggggaatgtgaatcctgctgcagaagcaaatgacgatctaatagttaaggagtctgagactgtagttttactagaacatgtttgggtgtatgtgaaaaaagagagggttttgggagaggaaaaatggagaacgaatttgggagggaaatag

SEQ ID NO: 20805 - DNA, 425 bp, Glycine max
  Peptide Sequence Number=SeqID_137583
atggaaatgccacactctcaaccagtgacttcaagtttagaacaggagaatctcacactgtctccacaccagccacatgggaaggcaaaatctggggctgcactcgttgttccatcaactcagccattggaagtttctcatgtgttactggtgattgtggctctggcaatatggaatgcagcaaaaaagacaaatcgccacagagtggattcaatgtgcatagttcccgttggcattcttggaagtggctatagcagtactgggtgcctgaaggaactgaacatgttgtgtccaccagaattggcacttgaggttgtgggaaagaaattccttgtgctacttggtttattcattgatcttcgagcaagtgttctcacaagctttgatcttcgatcaggtgttgcaacacgttctggaggtagcag

SEQ ID NO: 20806 - DNA, 1743 bp, Glycine max
  Peptide Sequence Number=SeqID_137584
atggtttatggactctatctttgtcgtggcgatgtgaacaccagcctttgccactcatgtgttcaaaactctagcatattgctcaagcagcactgccccaacactgcctcagctattttgtggtaccccttttgtcttctgaggtactcaaaccagaatttctttggcaacctcaccttaacgcctaggattccgatgtttgacgccacgcaaaattttactagtgctggagagtttgacagtgatgccagggttttgatgaatggtttaatacaaatggggtcagaggaacccttgatgtttgggacacatatgttcaatataaatggcactcaaagaaggtatggttgggtacagtgcagcagagatattacaactgaggaatgcagaacatgtttgagcaatatgcttgaagatgttgagaattgctgtgaggagaagaaggtgtggcgtgtcttttctccaagttgtattgtgatgtatgaaactcagccattttttttgaatggaacttctgagccaacgcctcagcaagacgaagatggggataacagaaggtggttgattatagtaatcatttctgtatctggagttgtggtagtagctctattgtctatcagcacatactacttctggtgtttgaaatggaaaaaagacaaacaagctattcaagaggatggactaaattcaatgttttctcaagatcaaacggacaaggaggagagtatgaatgctgaccttcctatgatgcctctgagtactattctaaaaagtacaaataatttttctgatgagcataaactagggaaaggtggatttggccctgtctataagggagttttaccagatggaaggcaaattgctgttaaaaggctttcaaaaacttctgttcaaggtgtggaggaattcaaaaatgaagtaatattgatagcaaaattacagcatcgcaaccttgtgagactgttggcttgctgcattgagcaaaatgaaaagcttcttgtctatgaattcatgccaaattcaagccttgatttccacttatttgatatggagaagggtgaacatctggaatggaaaaaccgattaaacattattaatgggattgctaaagggcttctatatctacatgaagactctaggctaagggttattcacagagacctgaaagctagtaacattctattagatcatgaaatgaatccaaaaatttcagactttggattggcaagaacatttggaggagaccagaagcaggcaaatacaattagagttgtgggaacttatggatacatggctcctgagtatgctatggaaggcttgttttcagtaaagtcagatgttttcagctttggtgttcttttgttagagatcatcagtggaaaaaggagtagtaaattctatctgtcagaccaaggccaaagccttctcatatatgcatggaacctctggtgtgagaggaaaggtttggaattgatggatccaataatagaaaagtcatgcgtacgtagtgaagttctgaagtgtatgcacattggactattgtgtgtacaagaagatgcagcagatagaccaaaaatgtcaagtgttgttcatatgcttgcaagtgacacagtgagtctttccgtccccacacgccctgcattttctgttggaagagctgtcactgaacgcgagtgttcatcaaacacttctatgcattactctgtcaatgaagcaacagtctctgaagtgataccaaggtga

SEQ ID NO: 20807 - DNA, 219 bp, Glycine max
  Peptide Sequence Number=SeqID_137585
atggaaaccctgtgcgaggtccattttggagaaccaggtggcgtgatggaggtcgtccaagaggtaagaggtgaatttggtggtcgtggagtctcgggggaggcagggaaatgggctattggaatagggctgaataggactgaagggggttctggagggcttgtgggtactttagaagatggaacagaaattgctgtcaaaagactctctaaaacataa

SEQ ID NO: 20808 - DNA, 1251 bp, Glycine max
  Peptide Sequence Number=SeqID_137586
atgtgtccgaaaaagcgtgttcataatcacctgaaacaaagaaggggtattgcaaagcctgaaaggcatgacctaaaactcataatggccatggtgagttctgaagagatcgagtttggaaaaccagtgtgcaccacccagttcatcaaggagctcatcaattgtcagaatgggaaaatggtccttgatggttatcgcgttgagggcgcaataatctgcacaaaactgccatgtgtcattgcgcttcttaaccagaagaataggagaggaaaatgggctggtattgggatgaacattgacaggttcagctgtgggaatgaggtggatattgtgattggttgggcgagatggaggacagggatgaagtttgggttcaaggaagatggcatgaaggctggagtccatgtctcccttcagttcaataaggtggccctctcgaatgaatttcatggtcaaatcgttgtagtccagcatgctctgaatggtcactgcaacattcttacaaaggagattgcactggagctggtgatcgttgcccaccatgacccgttgatttgggttggagccgggtcagttgttccccatggttccgcggggtgggttcaaaaggggaacttctggcgaaacatcatcatcttcatccgcaatcaaaaggaaggctctaaaagcacaacgatggccacgatggaacttctcatcacaggagcaatggtggaagagggggtggtcctgctaaagtggcaggtggcggtgcaggggaaaatgatgaatggccatgcagtgacctacgaaggtcaaggaacttttcctcctgcaggcatgccaaccccgcggcctgagctaacatcaaaggttgtagggcttggaccttgccacgtatctcacaggtcagtcccaagacaaaacaactcaaaaggaatagcggtggaagcaacacgctggtggggtcatcatattaggaaggggcaaagtgagcctgaagagcttgtaaaaagattggccaggaggggtcgagtgatactcgaagaattgattaattttgaagatccacctaagaggttcatacccatcaaactttggggcttcaagtttcatacgaggggtatgaggggcaattgggttttgtggtggggtggtcgaggtgaacgccgagcaatggcttcctcaatcctatccatgttggattttgagcgggtggaattggccatagaggacaacaagagcaccaatgttaggagcacaaacagttaa

SEQ ID NO: 20809 - DNA, 450 bp, Glycine max
  Peptide Sequence Number=SeqID_137587
atggcatgcctcgaagcatggtttctgacagagaccctattttcatcagccgattttggaagaaagtggtcacacaatacttctaaacattcaggattaggcctatcaccttatgaggtgacttttgacattgctatcaccccattaccgttaccagcaaagagcattgataatcaaccagtccttactcctttggtgatattaagcacacgttggcaatcttttgatactgaaccaaagttgcaagtccttgtgcaatgggaaggattaacaccagatgatacatcatgggaagattgggagctgttaaagagtgattgtcaccttgagaacaaggtgtttttccatgccgaagggaatgataggaagaagaacttacaggggaagaacacaaatctgagacccaaaagaatcacaacaccaccaaaatatcttcaagattttgtgtaa

SEQ ID NO: 20810 - DNA, 303 bp, Glycine max
  Peptide Sequence Number=SeqID_137588
atggaggaggaaatgaagagtgggaagtggagggttgctactcactggaccccaaattcaggggataagactatacttcagtatgatgatgtgatgaaattagattttggtacccatgttgatggatatatagttgattgtgcttttaccatggcattcaaccccatgtttgatccactacttgaagcctcttgtgaagcaaccaatatgggtattaaggaagaagaacttacaggggaagaacacaaatcgagacccaaaagaatcacaacaccactaaaatatcttcaagattttgtgtaa

SEQ ID NO: 20811 - DNA, 897 bp, Glycine max
  Peptide Sequence Number=SeqID_137589
atgcgcaaagatgttcaattctacatcaggtcttgctctgactgcctgcacaataaatacgtgccacaaaaaccacctgggttactccaacctattttccctccgttcagaccatgggaagacctagctttggattttgttacaagattaccgatgtatcagggtgctacggtcattctcgcagtagtagaccgcttctcgaaaggtgcacattttggtatgttacccacacacttcactgctcatcatgtttcacatctattcatcgacatggtctcacgacaagaaactttcaggtttcttcgtaaggaattagagcacgctcaagctagtatgaagaaaattgttgatgctcaccataaggatgtcacattcaccgtgggcaattgggtctatgtgaagttaagaccttatcaacaatcatctgtttcaggccacaagcatcataaacagggaaaaagatatttttggccctacaaaattgttgagagagtgggaccagtagcttacaaactggtgctactcgaatcttccaaaatacatcttgtatttcactgctcattgttgaagccacacttcgggccaattcactcagacaaccactttccacctgtgtcattagaagaaaaacccattatacaaccacttgtagtattggatagtaagtgggactcatccacctcgccccgaaagttggtcctggttcagtggcttggattgcaaccagagaactctacttgggaagactggattgagctggaagatacttatcaccttgaggacaaggtgtttttccaagggccaaggggtgatagcaatttgcaccagagtgattgtggccacaggcccaagcgaatgggtaagaagcctcaagggtgggaggactatgtccattag

SEQ ID NO: 20812 - DNA, 429 bp, Glycine max
  Peptide Sequence Number=SeqID_137590
atgtatgtgagaaatcaagccactgcctacccttcagggttgtacatctctaaggccaccaatatcaaggatgatgctaaaatgaaaggattcaatctacactacactgaagaaatgctctcaaggcaaatgaagtggaaaaagcttgttcatgctccagatgcttataatgcaagaaccttttggaatcagatcatgttggctgacaccttgaaggcctccacatccgattatgatggaagtgacaatgttgttcaccgtgacattattcaagtgttacattcagtcaggaagtatcactttaattgtgcttgcatctgcgtaacaaagatgcctacaactactcattcatttagcgtcttctacgatatcccactattcaatacaaaaggacttaaaatccctttaagaggagtgatgaacatatga

SEQ ID NO: 20813 - DNA, 798 bp, Glycine max
  Peptide Sequence Number=SeqID_137591
atgaagcgcgtggaaggggacaacgtcacttacttcgacgctttgcactctaaagctgctcaagttgcagtggtgccaaaaagacatgtttggattcaaggggataacatttatgcttcccgtgattcacggcattttggtcctgttccatacggtcttatagaaggaaaagtgtttttccgggaaggttattgtattcaaggttctgggaaccaaggtggtgctctcaagcgaattgattaccaaggcaactgggtgaatgccgacaaagcaggtgaccagaagactatagtttacaacctgatgtgtgataaggccaagatttgggccaacattcttaataaaagtgttctccacaaagtaggatcaaagaaatctgtgttgaatctccacaaatttgtgttatttcacttgatggggaatcttccatttgacatgcctcacactatctacatcaacattttgagaggtctaaagggcttaggtggtctggacgacatctactatgctaccctaatcaagaaggtgctatgtgatcaaggcatctatcatgtctttgacaagatggacgataactttaagcacaccattatagccaaaggatcagttattgctaagcaacaaaaatatagcaaaactaacttgaaagctatgaaggttgctttgaaacaaaacctcaagaaagctcttcaggtggacctagatgcaatagacaagaggaagcaaaagagccttgccaaggccatcacagatgaagacagaggtcttaacagctttggcattgcaaagaagatttag

SEQ ID NO: 20814 - DNA, 267 bp, Glycine max
  Peptide Sequence Number=SeqID_137592
atgaaagacaaacacatgcgttatgcaacaaatactctagactcaagcctacatgcgatgtggtaccatttttcagtgaaaaacctcgtcgggcgcctaggagtacatgacaggacatgcctcacaatggggagaccagtcagggtcacgctgttttgcgagaatgctccaaccatgtgggatcggcacagacttacaggagcactcaaaccggatgacccccaaggcctacactccgaagagtccgtcagggcctctccctcctga

SEQ ID NO: 20815 - DNA, 972 bp, Glycine max
  Peptide Sequence Number=SeqID_137593
atggtagacagaggtagaggtggtggtcgcaaatcatttaatcatggtagaagatgtggtgttagtttgagagctccaattacaaccaaccctttcacctcttccattcacatatcaacctcagagttgatgattcaagtcattgcgttggcaccaaacacacttcctatagctcaagaccaaccaaattcgacctttgtaagggagttaattcccactacccctattggagatgcttcaccttcaacatcaaatgattctcttacacttgagtatccacctaatccaaattatgaacatactgttgatcataggcctttcatttgtgcatataaaggagagtttcaaccaacatatggatgttctaatatcatattagatatcattagggaaaaatttgatgaactagttgcaagttggttgaagaaagagtataggtggttcctagcaaaagagcgagccattagagctatttttgagacaaaaggttcacacattttgaaaagtgaaatgaacaagatcaaaaatggtcaagataaaggaaagtggataacaaccaatgttcgagcagccttgggcgaacgtccaaattacaaagggaacgtgtacaagctaagtactttgagcaaaaggtttaattcctcaaaatcagctccatctacttctattggtcttgtgaaaatgtgtgagataattaataaattgaatgttgaacttttggcaaaggcagataaggagaagacacttgaggaaaagatgctgcagctgatggagaattatgagcaccaaagtcaagagatgcgacaacaagtgcaagaacaaaatgagcaaatgcagcgtatattacaacacttgtatattcagtgtatcatgtcagctcctagtccatcaattaccatagcagatgaaattgagcaccatgttgatgatgctcaggttgatcgttctcatgacatgtcaaaggaccattga

SEQ ID NO: 20816 - DNA, 279 bp, Glycine max
  Peptide Sequence Number=SeqID_137594
atgacgcaccggtatttcaacttgcatcacttatccgcatccagtaccgatatacttcatctatatgtgtcgaaagcatccaagtcttttaaaaaatttataaaaattcaacgcagtatgagacatagaagcattgacggaaggacgaaaaggagtttgtttgataactcattcacggagttgaggactacttcttccttggagaaagagcatgcagattatggtggatgcaaagaagttcctttctatgattttcttggtggtagtgttgatgagtag

SEQ ID NO: 20817 - DNA, 258 bp, Glycine max
  Peptide Sequence Number=SeqID_137595
atgtttggacaaaatggaattgactatcaagtatcaggagtatttgaagaaatgaagaggtccaggtttgtgcctgagagggacactttcaacactctgataagtgcgtatggtaggtgtggttcctttgaccaagcaatggctgcttataagagaatgctggaggctggagtgagtcctgatgtttggttaggaaggagtgtggaagcatcccaagagcaaggtgtggctgcaaacatggcaacctccctacagtag

SEQ ID NO: 20818 - DNA, 507 bp, Glycine max
  Peptide Sequence Number=SeqID_137596
atggagatagaatggaagaatgtaggaacaataacggaggggagggacatcgcggtgccaccgcgagtggaagtaagcatcgccattaactccgcgaggatcttctcttccgcgacaaggtggttcatgctgagccagaagaagaagcttagtgccaccaacgacttatccctgttggcaaggaggatgtttagtgcggcgatgctcagtgcttttttggcaccgtcacacttctttatgacggagaggatggtggtgttggacggggagtacggtgcgagggagcggattgagatgacgccatattgggagttgcgagtgaggttggactggggagaattggtggtagcgaaggacatcggcgagggtgaccgaggagagttggtggcgggagaggtggtcatcgacagcgaggtaggtgttggggatagtgagaatggagagggaagtacgatccgagagatctgcggtgaggggcatggtggaggcgaggaaggaggtgaatag

SEQ ID NO: 20819 - DNA, 603 bp, Glycine max
  Peptide Sequence Number=SeqID_137597
atgaaagaagcacaggcaacaaaagtcgtagagcatggagaggtagcactaattactatagaaagtatccagtctgccaatagaaagattaccattgaagccaccaatgttgtagtttgggactctggcatctggaagccaaattggcctctatttgatctaaaatcaaggcaggctatgcatgtcaatggaaagctacaaaagctaaagcgcctcgttgaggttcctaaggatccaccattgtcccccctgagtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagcaaaataggggaggtggttgccgcccagctcgcccaggcgagcagggttgcttcctccagaagcaaccgccttctggaggaatcttctggagggcccaagtgggcctgggtgctatttgcacccccatttttactaagtacacccccctctgctgttttttggtga

SEQ ID NO: 20820 - DNA, 306 bp, Glycine max
  Peptide Sequence Number=SeqID_137598
atgagggttcactgttatcaagcaagtcggagacctagcatgaccacagattcacctccactccttatgttcccacgaacctgggtgttgcaacctacccttttgcgggcgagcgatgcgaggctcacgggtgcgtcttccaaaggaggaaaatgcacggagtcgccaccaacgtttacttgtggaaaatgtcgaaaaaaccgaaggaaaccggtcaagaagaatattccagattcgggagttgtatttatgtttgaagaaggtattagcatctctcacgtttgtcccaaaggacaacaaccttaa

SEQ ID NO: 20821 - DNA, 448 bp, Glycine max
  Peptide Sequence Number=SeqID_137599
atggttaactgtgctaataagcctatggagttgtttgaaaagatgtttggttttgggtatgaacctgatggcatcacatgctctgccatggtatatgcttatggactttcaaataatgttgacaaggttgtaagcctatatgattgtgcaatagtagagaaatggtgccttggtgtagcagcattgttagcattgattaagatgtatagcatggcaggaaactatgatagatgcttgaaaatctaccaagaaatgaaagttcttggtgtgaagcctaatgtggtgacatataactctctgttgggtgccatgttgaaagctaagaagcaccaacaggccaaggctatatataaagagatgagaagtaatggagtttcactagattttataacatatacatgtcttgtggaagtctataccataccacattatagtgaagatggtcttg

SEQ ID NO: 20822 - DNA, 1593 bp, Glycine max
  Peptide Sequence Number=SeqID_137600
atgaatggtcctagtggaaaaacagagaaccaagatacaggggagcagacacgttcaagagaaaactgcaagaaaggagcaacattcatttgggaattagcaaatcagttgggggcaattgtagtggaagatcaggggaggatggtggagaaatttatggcagtggaggagagagataggaaagaggctgagaaagagtgttggcggacccaccagcaaaggggttggggtgggtatgtgctcaaagaaaaaataaagagattgaaagcaaggttgaagatatggaatagagaccagttcggtgatacttttaagagatacaagaagattgagggagagctaaatcgactagaagtgagcataatacatagaaagctttctcctaaggaggtgctaatccggaaacagcttcaagaagatttgtgggcaactgcacagtctcacaaatctttactacgacaaaaggcgagagccagatggactattggtcagcagcacaatgacatgctaacaaggagatttcttgaggaggagataaaggatgcagtttggggatgtgggagtgagaaaatctcgggcccaaatggaattaatttcaaattcatcaagagattctggcacttagtaaaacctgatgttctacagttcttggatgaattatatgtcaatggaatttttccaaggggatgtaatgcatctttcgttgtcttaatccctaaggtggtggaagaggccaaaataagtcaaaagccgtgtctagttttcaaagtggattatgagaaggcatatgactcggtctcatgggatttcctggtctatatgctaagaagactgggcttctgtgccaaatggatccagtggatcgtgggatgtttaaaatccacatctatctcggtactggtaaatggtagcccctcgactgagttctcaccacagagaggccttcggcaaggggacccattagcacccttcctcttcaatattgtgggggaggcactgaatgaactggcatcaaaggagaatgttagggctattaaagcaattttgaggacattcaaacttgcatcaggcctcaagattaattttgcaaaaagttgttttggtgccattggtatgccagagagatggaagtctgaagcagccggttgtttgaattgtagtctgttgtccattccatttgtctacctaggaatacctattggggcaaatctgaggtggggtcagatgtgggatcctattataaaaaagtgcgagagagcattaactaagtggaaggcaaagacacttatacctaagaaggtggccgacaagttagtcagcttgcaacgtagatttctatggggaggagggccagataaaaataagattgcgtgggttaagtgggacatacatgaaggacagttgtgggcaagggtcttggagtctaaatatggtgggtggaggggactggatgaagcacctaggggtaacaaagagtcaatatggtggagggagctaaagatggcttttcaaaattcacaacagggcgaggagttcaaaaaagggatacagtggagggtggggagtggagataggattattctaggaggatga

SEQ ID NO: 20823 - DNA, 372 bp, Glycine max
  Peptide Sequence Number=SeqID_137601
atgcttcccaagctaggaccgggattccccaacattggacctaggccattcgatagcccagatgcatactcggcgaccacttctgcaacgaatagaacaaggggagcgtatcatggcactcttcattcattatttgttcagctctttactcatccagttcgagtagcaggaccatgtcatccctcagatatttggttgaaatatccattccataatcccaccttgtcgaaacttgctgggttcgacagcctcccgacccacgcgttgctaagccacttcagcatttcctcggtgggctcaagttatactgacgatagcccaccttcgccactatgtactctatttctcttccctgccaccacctccgcgtaa

SEQ ID NO: 20824 - DNA, 2451 bp, Glycine max
  Peptide Sequence Number=SeqID_137602
atgcagctctttgctctatgccctttaccctttggggccaacacaaataccaacacaaagtactccaaaactaccacaacaacaacctctttctaccaaagtaattccattcctacccgagtatatagccataggcacccttcagttgtactcttagaaaactgcacttctaagaaggagctttatcaaatccttccctttatcatcaaaaacggtttctacaatgagcacttgtttcagacgaaggttatcagcttgttctgtaaatttggcagcaatagtgaagcagctcgtgtctttgagcatgttgagctcaagctcgatgtgctttaccacattatgctaaaagggtatgcaaaaaactcgagtttaggtgatgccttgtgcttcttccttaggatgatgtgtgatgaggttagacttgttgtgggtgattatgcttgcctgttgcaattgtgtggagagaatttggacctcaaaaagggtagagagattcatggactgatcataactaatgggtttgagtccaatttgtttgtcatgactgctgttatgagtttatatgccaagtgtaggcagattgataatgcatataagatgttcgagagaatgcagcataaggatttggtttcttggacaacattggttgcaggatatgcacagaatggacatgcaaagagagcattgcagttggttttgcagatgcaggaagctggccaaaagcctgattctgtcacgttggtcagtattttaccggcggttgcagatatgaaggctttgagaattggaaggtctattcatggttatgctttcagatcaggatttgaatcactggttaatgttacaaatgcacttcttgatatgtacttcaaatgtgggtctgcaaggattgcaaggttggtttttaaggggatgaggagtaagactgttgtttcatggaataccatgattgatggttgtgcccaaaatggtgaatctgaagaagcctttgcaacttttctaaagatgttggatgaaggggaggtacctacacgtgttacaatgatgggagttttacttgcttgcgctaatttgggtgatcttgaaagagggtggtttgttcataaattattggacaagctgaaacttgattctaatgtgtcagtaatgaactctttaatatccatgtattctaaatgcaagagagttgatatagcagcctcgatatttaacaatttggagaaaacaaatgtcacttggaatgccatgatattaggctacgcacaaaatgggtgtgtgaaggaggctttaaatctattctgtatgatgcaatctcaaggcattaaacttgattgttttactttagttggtgtaattactgctcttgcagatttctcagtcaaccgccaggctaagtggattcatggacttgcagtaagagcttgtatggacaacaatgtctttgtttccactgctcttgtggacatgtatgcaaaatgtggagccatcaaaactgcaagaaagcttttcgacatgatgcaagagagacatgtgataacatggaatgcaatgatagatggatatgggacacatggcgtagggaaagaaactctagatctcttcaatgagatgcagaagggagctgttaagccaaatgatataacatttttgtctgtaatttcagcttgtagtcactcaggttttgtggaagaaggtctcttgctcttcaaaagcatgcaggaagattattacttggagcctactatggatcactatagtgccatggttgatctccttggtcgtgctggccagctagatgatgcttggaatttcatccaagagatgcccatcaaaccagggatttctgttctaggtgcaatgttgggtgcttgcaaaatccataaaaatgtagaattgggagagaaggctgcacaaaaactatttaagttagaccccgatgagggagggtatcatgtgttgcttgccaatatttatgcctctaattcaatgtgggataaagtagccaaggtgagaacagccatggaagataaggggctccacaaaactccaggctgcagttgggtggagttgagaaatgaaattcatacattctactcaggaagtactaatcatccagaatccaaaaaaatttatgcttttcttgagactcttggagatgagataaaagctgcaggttatgtacctgaccccgattcaattcatgatgtggaagaagacgtgaagaaacaattgctcagtagccatagtgaaaggcttgctattgcatttggacttttgaatacaagccctggcacaacattacacattagaaaaaatcttagagtttgtggtgattgccatgataccactaagtacatttcacttgtgacagggagagaaattatagttcgtgatttacgtaggtttcatcattttaagaatggaagctgttcttgtggggattactggtga

SEQ ID NO: 20825 - DNA, 102 bp, Glycine max
  Peptide Sequence Number=SeqID_137603
atgagcttgcggcaaacttcgaaggtcacggcggaggttgtggcagactacggaggtcacggcaagttaagagggcgtgaattggtcgtggagttggtgtaa

SEQ ID NO: 20826 - DNA, 615 bp, Glycine max
  Peptide Sequence Number=SeqID_137604
atggagcgctatgatctgcaaagacaaagaagggatatgaaaaagaaaggaaggaatgttgtgtggtcaattgcgatggacaagtgtctgattgaagccctggcagctcaggcaagaagtggaaacaaaattgacaaatgtttcaatgaaaatgcatacatggctgcctgtgttgcggtaaacacttgcttcaacttgaatttgaataatcagaaagttatcaaccggttgaaaacaattaagaagaggtataaagtaataaaagatatcttaagtcagaatggtttctggtggaacccaaatacagagatgattgagtgtgacagtgatgagatttggaagaattatgttgctgcacatcccgatgcgaaaggattccatggaaagcagatagagatatatgatgaacttaaattgtttgcgatgaagagtggaactcagctaatggacatgaagaattgtgacaatgaatcagcctcctttgtttctcccaattcagaagacatgagtggtacagatggaactgaatcatacactgcaactccagaactaggccagatgctagatggttttcaagagcctcctgtacctcagatgctcttcaggaagcattga

SEQ ID NO: 20827 - DNA, 1305 bp, Glycine max
  Peptide Sequence Number=SeqID_137605
atgtcgagactcaaggcgttcaatcactgggttctccgtctacttcggaaatcattgaaaaacattgttcttgacgatgaggatcttgagttaattcgtgagaacaagagcttcaatcaagaaacattgattgatggaaaattcaagaagcttagaaaggctggtgtagactctgagctgatggaatactcttccgatgacagagtatcactctttgatgatattgctgaagatcagactaacgatgatgtagaggatgacatggcagattttatagtggatgatgaagatgtcatctacgggatgggagattctctcaacaaaaaacttaaagccaggaaacattcgcctgcattttcgaaaggcaaacatagttttggcaaggaaggtcagctggaaaaccacattgggatagttcaaattcaggctactaagtctgatgatcctaacaagtataaatcattcatccctactgacatgcacatagctggagaggataactgtgtaaatgatacagacatacctgagaggatgcagatatttgattcaatcaccaatatgctcaagaaggctgaaaccgagagtgagattgatgatattgataggaagtttaatttgcattttccaccagctgaggagttttttgatagtgggctgtggtcacttgcaaacaaatttggcaatcctgagaaatttggttctttagttactcttgagaaagtgggaaaaagcagtgaagaagatccgcaggaatctccagaggagatagcatcaatgtacaagtgtgaaacctttcaaactacagaagctgctgcagtgatgttaagcagtgagattcctttcaggaaatatgtgagcaccatatttatggataaggcattagtttcaactagccctacaataaaaggaaatacaacagctgaagaagagaagcttcttcaagttaaaacagagttgcctggtcatatcataaatgaattgataatgacttgtaatgatacctatctaaaagatagtgaaggaatatctactaggctttggaatgaacagcataaattaatcatgccagatgccatttcaaatttcctttttccttatatggagaaggaagctcgggaattgttaaatgctaaggctaaaaactggttattaatgaagtatgcaatgcaagtgtggaacagagtctctgtggcaccatatttgaaaaatgcacagaagaaaagagtcatggcttgttgtgggggaaatggaaagccaggtaccacatttgtcgtgttggattctgaggaaaattggttgatgtga

SEQ ID NO: 20828 - DNA, 160 bp, Glycine max
  Peptide Sequence Number=SeqID_137606
atggaaggcgaccgtggaagttcaagagatctagctcaagagggaagacaaactagttttgctggctacgcttctggtggtattgctagtgttggtgctagtgctagtactgatgctggtgttgttgccgatgggattgctagtggtagtccttattatg

SEQ ID NO: 20829 - DNA, 171 bp, Glycine max
  Peptide Sequence Number=SeqID_137607
atgaagtacaaacgtggaccattggtcaaggttaaggctgaacatcatagacgcatcaatagtgaaggggatgttggaccaaggttggtaagaagcaatggaatgagaagagagtggagtttgaaggatttggctgggcaacaacaagacaagggagttagatgctattga

SEQ ID NO: 20830 - DNA, 291 bp, Glycine max
  Peptide Sequence Number=SeqID_137608
atgtcatttgatttcattacaaaaacacgaaccccttttgaagagataaagtctgctgcctcatatgctcttggtaacattgttgttggtaagaacaaccagcccatctgcatttactcgagctactgttgtcattgctgtgaagttgttattatgagtatgcaacatgttaggcgagctgctgttttggctataagcacattagcacacaataagccgaatctcattaaggggcttcttcctgatctgttgcctcttctatatgatcaaactattgttaaggtaacctga

SEQ ID NO: 20831 - DNA, 639 bp, Glycine max
  Peptide Sequence Number=SeqID_137609
atgtatgctactgttggattttgtatgccggcatttgctgtcattgctgcttctctacttcgggtggatctatcatgtgttctagagcatgtggctaatcatgctctaaggcaggctaccttgggaaccttaaattcacttatagttgcttatggtgataagattgttttgtttgcttatgaagttattatcgtagaactgtcgagactaattagtgattctaacttgcatatgatagctcttgccctggaactctgttgcacattaatgggtgacaagaggtcaaatcaaagtattggtttggccgttagaaacaaagttcttccccaagctttaacattaattaaaagctcattgttgcaggggcaagcactttcggctttgcaaaacgtttttgctgctttagtctattctgcaaatactagtattgattatgtgttggagtcattatttgcctctgctaagccttctccacagtctggtggcattgctaaacaagctttgcattcgatagctcagtgtgttactattctatgccttgttgctggtgatcagaagtgttcatctacagtgaaaatgctcactgacattctcaaggatgacaacagttctaactccgtaagcttttctcttcagtga

SEQ ID NO: 20832 - DNA, 105 bp, Glycine max
  Peptide Sequence Number=SeqID_137610
atgaggcctatttcagatgcaaccaacattgaggcaaatggatggaaatctaaagatcattgtaacatgatggtgaagagaatatatgttagattggccgtataa

SEQ ID NO: 20833 - DNA, 237 bp, Glycine max
  Peptide Sequence Number=SeqID_137611
atgatgaagcacgatgcaaagcaaatatcaaatgtactaagatgcatcaatcaagataacaaccaatataaatgtcactcaaaggagttgggcatgttaaagccaaaacttcttcaagcttttcttgagcttcaagctttagccttaagttgttccatgttgctcatgttgctccccttatctctaagaggaagctatttcttgacgaatggtaccatattgcatttgaaagtttaa

SEQ ID NO: 20834 - DNA, 432 bp, Glycine max
  Peptide Sequence Number=SeqID_137612
atggttagcacccagtctggccatagactcgagacccctctcgaagactctcatcctcatccggcagctatggcagacacaaatactctacaacaactccaaaaccgcattgtggagatggagcgatgccatgaggaggagttgagaaagctaaaggctgcccatgatcagctggaggcttgtgtcagacgtcctcaggacgacgggcactctgcctacacattgcctgagcgcacccaaggtgatgcaatcctacccccaagggtattggatagaagactccaagaggattgggctagagtggctaaagaaggccctagggttctcatgaatcttagggtgagcttagctatcagagggcttctcaaggaagcttctcaaggaagtttctcaaggaaacttctcaatgacatgagcttagctattagaggg

SEQ ID NO: 20835 - DNA, 651 bp, Glycine max
  Peptide Sequence Number=SeqID_137613
atggccaaaatacaaggccaaaaagaaggaaaacctattctaatatttacaaagaagagtggacctaaccttggcccatgggctcataaatccaccatgaggattgtatctcaaggggaatcacacccccgacgcacagtcaacaccacaaatgacttaaatctttcccacatgcaccgtccagtaaggcagactacccgtcagcatccttttgttgaccgcattatggaggcagacatacccttcgggtggaaatcactcaaccttgagcggtccatagacaacttcgacacccttgttcgacaattcagtgtgcagtataccaccaacagaatcgtccagatccgaaatcttaacctcaaggtagtattgcattccatactccttgccctatgccccgacaagttcatggatagtctatgcagaaaacctcctagtggcatgggcgagttgcacgaacgagtcaacgactacattcagatggaggaaattccatacaagcgccagcctctccccaaagggcccaagtacgagcgttacacacccctaacgcccaatcgcactacgattctagaggaagctttcaactttgaggccacacaaccaccaagcaagagcaagtcacagaggacaccaagaggagctgcatag

SEQ ID NO: 20836 - DNA, 309 bp, Glycine max
  misc_feature (233)..(233): n is a, c, g, or t
  Peptide Sequence Number=SeqID_137614
atgtcaatccttaccctcagaagcaaaaaaaaaggaaagaaggaagatttccaatcaaagagaaagcaaaaaaaaaggaaagaaggaaaatttccaatcaaagagaaagcaaaaaaagaaaagaaggaaaattctcaatcaaagagtgggagaaagcgaaaagaaaggaaagaaaattccaagtcaaagaaaaaagaatgggagaaagtaaaaaagaagcaagctcctggtcnaagaaaccagaagaaatgtgcagagaggtctttggaccggacaatatctgaacaatacagaattgtcaccaaatga

SEQ ID NO: 20837 - DNA, 259 bp, Glycine max
  Peptide Sequence Number=SeqID_137615
atgtcacgaaaccttacggattatgcaatcgtcccctctttggcttctggaatgttacggaactttacggattgcgtattaacacttcctttcaactcccgacatgtcgcggaacttcacggattgcctaatgaggggtgtcaagtacctcgaagtggtcaagtgaaggtcgcatcccaccaaacagatggtccccggacgaaattagggtatgacaacactgatgtggcaggacctcaaagaacaccatcactacaag

SEQ ID NO: 20838 - DNA, 225 bp, Glycine max
  Peptide Sequence Number=SeqID_137616
atggaagaaagaaaatcaaaagtgaacaagatgaagatgaaagcaaacaaaacaagaaatgagttgaaagtgtcggattcgaacacataccggttgaataacgaagaacaaacgaagaacggacgaagaacggttttcggaaattttacggaagccacggaagccccgaaaaccatttttcaacaaaacgtggaggagcttgccgcccagtttcttcctccttaa

SEQ ID NO: 20839 - DNA, 360 bp, Glycine max
  Peptide Sequence Number=SeqID_137617
atgaaacttctctccttttttttggaagcgcattctgttcttccttccgagggtaagggtaaaagttcctatcctgggtcaaggtttatcgccaaaaggttgatgttttggctcaaaaggcttgcagaaggcaagacatggcgtatgtcagggtatttacttagcaatcagttcagggataagggaatgccccacattatttccatgacacctccattggagcttgtaggtctaggatcttcttcatcaatggattcctttgcttcttggaagatgaatggcagtggaatagagaaggaagagagagacgagatgccacttcaaggagaagatgagtttagaagaagctcaccaccatag

SEQ ID NO: 20840 - DNA, 336 bp, Glycine max
  Peptide Sequence Number=SeqID_137618
atgcgagcggggaattccgatgtgtatggattcctcgagccacagtccattcagagatctaggcaactgcaatttgaatcagaaagttatatgaagagttggatgcagagtttaaaacgtgatgtctaccttggagcctacctaaatggtgctttgaaaggacttgatgatactccacaacctaaatccaaggctggtgctaggtggattgttgttaagacaaaaattaaaggaatcactgagttcggttattacgtcatgcactggatgtccatgataatcttaggaactttcaggaataattgggaaacgtattttaatgatgttagaccatga

SEQ ID NO: 20841 - DNA, 654 bp, Glycine max
  Peptide Sequence Number=SeqID_137619
atgaccatgattacgccaagctcgaaattaaccctcactaaagggaacaaaagctggggcgttgttcgagatatcccggttgctgttgctccgttgcatcccgtgggtgcctctgttacatctgcatctcccggaggcttgctcgggcgcctttcaaccgagaaactgatttgtatcggtgcgtctaccggaggtactgaggcaatcaaagaagtcttggttcagatgccagccgactcgcccgccattgttatcacccagcatatgcctccagggttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20842 - DNA, 159 bp, Glycine max
  Peptide Sequence Number=SeqID_137620
atgggtaggctccaagatagacatcgcgttttgaactctgcatccaagtctttatgtaactttcagactcaaactgcgattgcccagacctctaaatggactgtggctcgaggtatccatagatatcagtattctctgctcgcatacttgtatcagtga

SEQ ID NO: 20843 - DNA, 763 bp, Glycine max
  Peptide Sequence Number=SeqID_137621
atacacagataatattctggggagaaacattttaccagagaggaaagtagagatatatcattatgagctagatgagtttaaggctgaattggagaggcaaaattcccataaacgcctcaccaatttagtcgatgggagcatagacttagctttggtgaaagaattctatgcaaatttatacagttctgaggatcatccaccaaagcaatccagagtcagaggtcatttggtgaagattgatgctgacagtctcaacacattcttggagacacctgtggtattagctgagggggagaccttacccgcttactccagatattgtagtttgcctatagactacagagagatagaggctgccttatgcatacctgcccgagggttcatcttgaactcagagggccatcctaggaagattctcaggaaggatctgactacactagctcaggtgtggagtgccctctcatactccaacttggcccccacatcacacacttttgacttgacattggatagagctagactgatatttggcctagtctctcacttgcatatgaacataagagcactgatctatggccatatgacctctatagcccagtctaacacttctagacttgggttccatgctttaatcaatgcattatgtagagccaggggagttgtctctgatagcctcacttttgagcgcctgagcctgatcattaacttggcctacattaggaagaactgttggaaccctgaggatctaacagtttctatttga

SEQ ID NO: 20844 - DNA, 770 bp, Glycine max
  Peptide Sequence Number=SeqID_137622
tggccgagcagcagatcgttgcgcgccaggttgacccagtcgagcgccagcagcagcgagataaagctggcgttgaggaaaaacagcagaaaggcttcgaatttgggcaggcgcaccgcgcaccagaacagaatcaccacgataaaggtaaacggccacggcaggaagcgcagcgccagatagctggccagcagcgtgaccatcagcgccacagcagcagcaccggaccgaaggccagcacgccaatcacttcggagatcacccatgtggagaaaaacggcaacgaggcgtggccgtcaacgtgcagcatccatagcgccacgacgccgcccagcagcggcgcgattaggcccgcagccagcgcaaagcgtatccagtcggccagtgagttgagcggggctttgcggtcgagcagcgcgcgcagcatcagcccgccgaggatggcctgcaccatattaaggatggcgaatttgacattgctcagggccgggccgatcaccagcagattggccagcgccgtgccgagcacgcagctggccagcagcagcggtacctgtcgcgagggggcgcggaacaccacgacggtcattaacgcggtggagtaccagagcggggaaatgcggccgctgacaacaatcagttccagacagaacagcgtaagtaaaaatgccagcgcgcaaagcagcagggcgctgagccactttttttgcggattatcctgcgaggttgttatctcaagagtcatgcacgaatccagcagcgcgcattga

SEQ ID NO: 20845 - DNA, 150 bp, Glycine max
  Peptide Sequence Number=SeqID_137623
cctagtcctaatcaagcgtcatcctcaaatccctcttgttggcgctcgcttagcaaggtagtgctcgctcagcgcctctgtacagctcatccttcttccaaaattgtccatccgcttagccaaaaaatgagtggcttagcgagttcatga

SEQ ID NO: 20846 - DNA, 1087 bp, Glycine max
  Peptide Sequence Number=SeqID_137624
ggagaggctattggggaaatcgtggcttcgcgtaatcctttgtttaacgttggcgaggggcgtattcaccttctccggttggcaaaagtattatatcggtgatgctcaaaacttcactgttcatcgtttgccggagacaacattaccaccttctatttttctcggtgcggtcgggacgccgggccgatcggcctatttcggtttaaacaaaatcgcgaagccaaaaccgggtgaaacattggtcgtttctgccgcctcgggctcggttggctccgtcgttgggcaattgggtaaactggcgggatgccgcgttgtgggattggccggcagcgaggataaatgccggtatgttgtggaggagctgggttttgacagttgccttaactacaagactgccgaccttaaccgggatttgcgcgccgcgtgcccccagggtatcgatatctattttgagaacgtgggcggccgcgtatcactgtttgtcgccaagttgctgaatgagggggcaagggtgcctatctgcggtaatgcggccaattacaataaaggcactgatgttgatgcatccggcccggcggactttttctctgccctgccggatgcgcctttaaatcgtttctttttggtaaccgaatggttcaaagactacgccgaatcagatgcattcttgttaaatgcggcagaaaacgggtttctttattggttgctttattggcgctactttcaaaccaccgacaatgcttacgtgcaagcagacattacaaacgtcagcgcccgcatcagcgcggtggtggttaactctatgattcgggacaatcatcgggtgaataagggcgacttgttggctcagttggacgacagggagtttgttgtcgcgttgcagaaagcagaggcgactctggcgcaaagtcgggcggcgttaacgaatgcccaggcaagttatcaaatgcaaaaaagtgctattgacgagtttcgcagcgatgtgaattctgctgcagccactctgcagtatgcgcatcagcagtatctccgttttcaaattttgcagaaaaagaattatgtttccaagggaggtgggatcctctag

SEQ ID NO: 20847 - DNA, 126 bp, Glycine max
  Peptide Sequence Number=SeqID_137625
ggaacctattgggtgagaacttctaatctgcccctaggtttgcttgagggaacctattggatgagaacttctaatctgcctctaggtttgcttaaggtttatgcatggtgcccctcattgccctag

SEQ ID NO: 20848 - DNA, 273 bp, Glycine max
  Peptide Sequence Number=SeqID_137626
atggtgtatgatcatacatcaattatgtcaaatccacctatgtttcctattcatacaacagttatgccacaaccacctacaccagcagctgttgatgcaagcatgcctcgacatgtagtggtcgcttgccaaaagatagcaaaaagcttgcaacacatgataaatatgaggatggtcactactagaattgatgcatacactatgactgagcactgcttaagattagccatgtgtgtcattgagaaaggaaaagtttatcttcgctcaagatga

SEQ ID NO: 20849 - DNA, 225 bp, Glycine max
  Peptide Sequence Number=SeqID_137627
atggcttccaaaacactacataggtctccaaggctattctgcaatagtctttttaaggcccaatgtacagatcattccttgttgtcgcaacctactctttggtgggagggcgacgcgagggctcacgggtgcgtttccaagaaaggaaaatgcgcagagtcgccaccatcgattattcgaggaaaacgtcggaaaaaccggaaagacgtggtctacgaactttaa

SEQ ID NO: 20850 - DNA, 742 bp, Glycine max
  Peptide Sequence Number=SeqID_137628
cagctgcacttcgccgtcctggatcagcacgctccagcgcatggcgcgctggatctgctggccccacagttcgacgaaggcaccatcgaggtcgaccaccgaaaggttgtcgaagcgcgccaggcccttgctctgcttgctccaccagatgtccgaagcgttgccgccgtagttcaccacctgcacctggcggctgcggttgctggccttgcggatgcgcgattcgtctggatggcccaggtcgatccattgcaggatgtcgccggtgtagtcgtgctcccacaggtccggctcgtcatcggtactcaggccgcggccgaattccaggcggtcgccggcgttcagcgcgaaggcgagcaggcgcaccatcaggcgatcgtcggtctcggacgggtgctgggccagggtcaggttgtgggtcacgtagtagccgcgatccatgtcgctgatctgcagttcggccttgcggatggtggcggtgagagccatggggggggtgtccgtggccgggctgtctgtggcgcgtcaacgtggcaccctttcactctttcctgccgcaggagtgccaccgatgaccctgcccagccgcctgcagctgccgcccggccactggcgcagcctgctcgatggcctgtgtgcacgtttccctcgcatcgaccgtgcgcagtggcaggaccgcttcgcccgaggccgtgtgcaggatccgcagggcagggcactggcgccggacatgccctggcag

SEQ ID NO: 20851 - DNA, 637 bp, Glycine max
  Peptide Sequence Number=SeqID_137629
atgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccggaaggaaagagcatgccatctactacttgagcaagaagtttacagattgtgagtccaggtactccctacttgagaaaacttgttgtgcactagcctgggctgccaaacgtcttcgtcactacatgattaaccacaccacctggctaatatccaagatggacccgatcaagtatatctttgagaaacccgctctgacaggaagaattgctcgttggcagatgttgttatccgagtatgatatcgaataccgcacccagaaagcaattaagggaagtgtacttgctgatcatttggctcaccaaccaattgaggactatcaacccatcaagtttgactttcctgatgaagagattatgcacttgaagatgaaggattgtgatgaaccattgcttggagaaggtccagatcccgagtctagatggg

SEQ ID NO: 20852 - DNA, 282 bp, Glycine max
  Peptide Sequence Number=SeqID_137630
atggtgacaagaaggcctaatgccgcgggggctcctcaacaccgcctgttgcaacctctacacttctccgtggggagattgcctctgccagtggaaggaaagaagaaatgggacctcatcgaggagaggctaagggccatcgtagggtttggtgattacccgttcgctgacatggtagagttgtgtttggtacgtgatgttgtcattccctcaaagttcaaggtacctgatttcaataagtacaaggggactacttgccccaagaatcacttgaaaatctag

SEQ ID NO: 20853 - DNA, 1533 bp, Glycine max
  Peptide Sequence Number=SeqID_137631
cgtgaagtgaagcgtgttgctgatctcacagatgatgagactatagatttatggcgcatagcaaagaaacttggtaggcagctagagagctaccataaggcatcatcacttagctttggtatccaagatggacctcaagcagggcaaacagtgcctcatgttcatatccatatccttccctggaaaagtggtgattatgagaacaatgatgacatttatgatgacatgaatgaaaaagagaaagagttgaatcgagcgcttaagtggcttcaaactttgggaccttacgcttctcttcctcctctcgccaccatgtccgtggagaccatgtgctccgttctcaagaaatactttgggttttcggattttcggccttatcagagagaagttattgagaaaattattgagaaaagggattgtttggtagtcatggctactggtagtggcaagtccttgtgttatcaggtacctcctttggttgctaaaaagactgggatagttgtgagccctctgatatctttgatgcaagaccaggtgatggctttgaaacaacggggcatcaaagctgaatatcttggaagtgctcagaaggatttcactgtgcactctaaagctgagcacggtcaatttgacattctgttcatgactcctgagaaggcatgcacagttcctagcagtttctggtccaacttactaaaggctggaattagtctttttgctgttgatgaagcccattgcatatcggaatggggacatgattttagggttgaatacaagcatttagacaagctacgtgaggttttgctagatgttccttttgttggtctaactgcaactgctactgaaaaggttcgatatgacatcatcagttccctgaagctgaataatccttatgttacaattggttcatttgatcgcacaaatcttttctatggtgtcaaactattgaaccgaggacaatctttcattgatgagcttgtgcgagaaatttcaaaagaagtcactaatggtggttcaactataatttattgcacaacaatcaaagatgtagagcagatattcaagtcatttgcagaagcgggcattgaggcagggatgtaccatggccaaatgaatggaaaagctcgagaggagtctcatagattatttgttagagatgaactgcaagtcatggtggccaccatcgcctttggcatgggcatagataaacctaacattagacaagtgattcactatggttgccctaagagtctagagtcctactaccaggaaagtggacgatgtggtagagatgaaaaagtttggctgattgaagttgctgacttcttgcatattttctggagacaagttatccctgttctcttagtaacatgtgagtctccaatgtaccaggaaaaacaaagaaaagctattatggagtcattgcttgctgctgaacgctattgtgtgctgacaacttgcagaagaaagttcttgcttgaatactttggggaaaaattcccagctgatagatgcggtttgcctttcacttag

SEQ ID NO: 20854 - DNA, 1092 bp, Glycine max
  Peptide Sequence Number=SeqID_137632
atggagaatgcgttggaaaatgggaatttaagttcaaaactttgctcagaagacaaggagaagatcagttctgcaattacaaaggccacaaagttgcttgaaggtgaaaatcaaaatggtgaaatagatgtgtttgagaatctctttgaacgtgtcattggaaaggaagaaaagaccacgatgctgggtgtgaccactcttactctgggttcgtccaccacattggtggctcagaaccatgctcaacaacatgccaccactcttgcctcagccaatggaaacagaagggacagtgtttccaacaggactcaccccttgcctatgagtttggtatcttccaccgaccaaagtttcagctttctctcttccttcaaggaaccaacacatgcacgccccttcaccacagctgttgcatctgttgattctgacaagctcaattcatctgatcctcccaccaagaatgaagcctccaagtattattttcttgttgcaaatgcaaagtttatgttggatgaggaggagcatttccaagagcaattgtttgagcggcttcgtctctttggagagcgtaatcaagaacaggatttctggcttgtcattgagcctaagttcttggataagttccctaacattaccaagagattaaagagacctgctgttgctcttgtgtcaaccaatggtccctggatcacattcatgaagttgagactggaccgagttttatctgacagttttgaagctgagagcctagaagaagcattagctttcaatcctactgatctgaagtttgagaagcctgaaaaatgggtggcaccctatcctaaatatgaatttggatggtggaaacccttcttgccccctgttcagacagagatacgtgccataatccatattctgcattcttgcactctttgtgatgacatgggtgtgattgtcatgaggtctgggaaactgggggcatatgtggcatgcaggcttctttttgaggttggacgtcctcatcttaaatgtttgagtctgagaaaatatagagggcagtgttgcaattgtgatgggaggactgatgaaaacttctatagcattcgcttttag

SEQ ID NO: 20855 - DNA, 1230 bp, Glycine max
  Peptide Sequence Number=SeqID_137633
atgccacaaatactgtgtgtgagtcaacctgacatagtgagagatatcaccacatgcacatccttggacttggggaagccttcatatcaacagaaacaactagggcctttgctgggtcaaggtgttttaacttcaaatggaactacatgggtgcatcaaagaaagatcctagctccagaactatacatggaaaaggttaagggaatgatgaatataattagtgagtctgctatatctctgctaaacttgtggaaaagtagaacagaagcagaaggtggagttgctgacataaaaattgatgagtacatgagaaatttctctggggatgttatttcaagagcatgttttggaagcaattattccaagggggaagaaattttcttgaaacttggagctctccaagagatcatgtcctggaaaaatgtttctattgggatccctggcatgagataccttccaacaaagaccaatagagaagcatggaaattagaaaaggaggtgaaaaaattgatactacagggggtgaaggaaagaaaagaaactagttttgagaagcacttgctgcaaatggttcttgaaggtgctaggaatagtaatacaagtcaagaggccattgaccgatttattgttgacaactgcaagaatatatacttggcaggctatgagacaactgcagttgcagctacatggtgcctgatgttgctggcctcaaatcaaaattggcatgaccgtgttcggactgaggtgctagaaatttgcaggggtagtatcccagattttaatatgctttgtaagatgaagcagctaacaatggttattcatgaatcattgcgcctttatccccctgtagctgtggtgtcaaggcaagccttcaaggacatgaaatttggtaacattgatgtccccaagggttttaacctttggataatggtagtaactttgcatacagatccagatatctggggagatgatgccaacaaattcaacccagaaagatttgccaatggaaccataggtgcttgtaagttgccacacatgtacatgccctttggggttggtccacgagtgtgtcttggacagaatttggctatggttgaacttaagatgctggtagctctcatcttgtccaaattcactttctccctctctccacgatacgttcattcgcctactcttaggttgctcatagagcctgagcatggagtccatctcttggtgaaaaaactatga

SEQ ID NO: 20856 - DNA, 240 bp, Glycine max
  Peptide Sequence Number=SeqID_137634
atgtcatccgactcgtcatctctggatgacaaaggtgcagatgaggatgtgcggataaccataaggtatctccgcatgtcatcggactcgccgtctctggatgacaaaggtgtagatgatgacggatggaaattctcatcctgggtcaaggtttatggtggtttgaggtcttggctcaaaaggctcgcagaacggccgaacatgatgtatgtcaaggtgttggtttggccagcggtttag

SEQ ID NO: 20857 - DNA, 1077 bp, Glycine max
  Peptide Sequence Number=SeqID_137635
atggtgttggctgggctggtgaggggtcgcacactcgcaaatctgaagttgggaatggtgcacgatgctggtggtggtggtgacgtgttgaggccaataccgcatggtgcgatgctgatgggaatcgaccttggcacgacttactcatgtgttgcagtatggcaggagcatcactgtcgagtggagatcatccacaatgatcagggtaacaatacaacttcttttgttgctttcacggacgacgaaaggttgctaaaaatcaggctgctaccaatccagagaacaatgtctttggttgttgctggtactcatgacaaacctatgattatccttaactacaaggatgaggagaagcacttttgtgccgaggaaatatcgtccatagttcttgcaaagatgtgggagattgcagaagcgtttttggagaaacgtgtaaagaatgcagtgattgctggtctcaatgttatgcggataatcaatgaacccactcctgcagccattgcatatggcctcaacaggaggactaataattgtgttggagagcgaaaaattttcatctttgaccttggtggtggtacttttgatgtgtctctccttactcataagggtaagatcttccaagttaaggtaacaactggaaatggtcaccttgggggagaggaaatcgataacagaatggtggactactttgtaaaggagatcaaaaggaaaaaaaaagtagacattagtgggaacccaaaagcgctaaggaggttaaaaactgcgtgtgagaggtcaaaaagaatactctcatgtgctgtagctactcacattgagacatatgctttatctgatggcattgacttctgttcttcaaccactcgtgcaaggtttgaggaaatcaatatggatctctttaaggagtgtatggagacagtagataagtgtcttactgatgctgaaatggacaagagcagtgtacatgatgttatccttgttggtgggagcatcaacactgatgaagctgttgcttatggtgaagttgtgcaggctgctttgttgagcgaaggcattaagaatgttctagacttgtgctga

SEQ ID NO: 20858 - DNA, 999 bp, Glycine max
  Peptide Sequence Number=SeqID_137636
atgagatttctagatgaaatagaatggatgaacagaaggagttcaagaattattgctttagaagagaaaaggcataaggaaatagagaggaaactagcattggcattggaaaggaagaacaacttagtcaatcattacaaagaaaaaggaaaggcaacaatgaaggtaccagatgacttgagtgattttagtaaggatgtagaaggtccaaccaagaaaggacacaagagtaaagaactttatcaattgatctcttcaatcaaggactcatctttgaatgacatgccattaaggagcatccttcaaataatcacagatttcctacagagggatgacccggatgagctctttgctcaaccaattaatcttgatgtggtggagaaataccatgaaattataaagcaaccaatggatttcggtaccataagggccaaaattcacgagggcttatacacaaacctcgaacagttcaagcgtgatgtctttctaatgttctccaatgcaatgaatgtcaatccagcaacctcaaaatatcaccaagtggctgaagacattagcagggatgctaagtggatttttgaagcttttcctaacccttatcattttaattcaaaacttttcctcgacaagagaagcccaaccagaaagccacaaaatgagcaactaggaacctcacagaaggtttctccaaaagagattggaagaaataatgctactcatgttatggtacctaaaacagaaaagaggcatatgtattggcctccaagcaagccgttgactacagaagtcccgtgttctaacaatcctaatattctattgaacacaaattcaattaagtacaaagagagtctattgcggtttgtagaagatttggggccaacggctaaaagggttgcggctaaaaaactagaagcactaagggatcaacaactatgcaatgttgactctccaactccacaaaccagtctgcaactctcaatgcccagacacttgctttag

SEQ ID NO: 20859 - DNA, 207 bp, Glycine max
  Peptide Sequence Number=SeqID_137637
atggcacaattgttcacagtagaggtttgtggtcttgccatatggcttggtggtgctttaattgagggagaaaagttaaatcccaaagaaagagaaaagttagctactcatggccacaaggaagaagcttttgatggaggaacaatggagggtgaattcaaatacaaccaaagttctcaccttatctctagtttctttctctcttaa

SEQ ID NO: 20860 - DNA, 1227 bp, Glycine max
  Peptide Sequence Number=SeqID_137638
atggagaattatcacgaaattgtcaagcaaccaatggattttggtaccatgagagccaaactttacgagggcatgtactcaaacctcaatcagttcaagcgtgatatctttctgatatgcagcaatggaatgaacgctagtcctaagacatcaaaatatcatgaagtggttggagacattaataggtatgcaaagtggatatttgaggctctgaattcggatcttggacattttgattcggaactttccctcaaccagagaggtccaagtcgaaagcaacaaaaggagcaattgagaatcccacggagggttactacaaaacgtgctgggagaaacaatgctactcattctacggtacttgaaacagaaaagagggataagtactggcctccaagtaagccactggttgcagaagtcctaaatgctaagaagcctatcattcaattgaacgaaaatgcaagtaagtacaaagagagcctgctgcggtttgtgaaggatttgggaccaacagctcaaagggttgcagccaaaaagctagaagttatttccccagttgagaatgtatcttattttcatgaatctgcagttcaagagcataccaatcgactccacttaggagctaacagaacaagcaacacaagacagtggaatacctctgctggtacgccaactatgttagccactggaagctccagcaatgtgtttgctcacgtccatccaacaagcatgttctcaggacgacctcaaccaaggttaacaggcaatagaaatagcctttcactgttttcgtctctcataccaaatccatgtcttgtgtctcattcaaggccagaaaactcaatgtcttgcatgccaagcaacaacctcgccctgctaccccttgtgcatcagccaaggtcagaaggcactagtaacctctcagatctgcctcttgtatctcagccaacgccaagagaatcaatgtatgccatgcctagcaataaccttacaaagctatctctttttccacaccgagaagattgtgtgtccagaatgaatcctcatggaccagttcctcaacaggaaccaaattcatcatttctacaaattctcttaggaggtgaaacaaataattatggagaaggaggaggtactcttataggccagccagaagaggttcctccacaacttcctctgaacaatgataatgatgatcatgaggaacccaacttagaacttcacctctaa

SEQ ID NO: 20861 - DNA, 279 bp, Glycine max
  Peptide Sequence Number=SeqID_137639
atgtctccttctccggtatcttccatgatgtctccaacaacgacgcctctaatgacctacatatccatctacatcatgactctgttgctatcacagacacctccaacaactatcatttctgccacttttgaaaccttcatcgaaaacttaagcacaacccaaaagcgtagagacatacaccttgagttacaagttttgaaggttgtgggcaaggaggagccgccaaggattttgtatttcaattcgaggttgagaggggattggagtggaaggtcgtga

SEQ ID NO: 20862 - DNA, 696 bp, Glycine max
  Peptide Sequence Number=SeqID_137640
atgatatttcacttgcatggttgcacccttcctcatgacaagctcgaagtcttccatttgataaaaccacatgtttttcatttcctttgtgtattcactttttctatcacttcaaagttaatacaggaatctggaagggacactcacaatgcaagtgctttggaaacaaatggctcatatttgaatggtatgccattgaagaaaattcttaacaatatcattgatttcctacagaggaaagatacatatgagttatttgctgaaccagccaatcttgatgtggtggataattatcatgacatcgtaaagcaaccaatggattttggtaccatgagggccaaattacatgagggcatgtatacaaacatcgatcacttcaagcgtgatgtcttcctaatatgctccaacgcaataaatgtcaatcccccaacctcaaaatatcaccaagtggctgaaggtattagtaaatatgccaagcagatttttgaggctttaagagaagagcctcaacattctgaattgaaagaattttcccaaaacaagaggcgtccaagtaaaaagtcagaagatgggcaacgaagaacctcaccgagggtttctcctaaacctgctggtatggaaacctgttcctcactttataacctttttgtagtcttaaccatcttaaccattatgttatatgtgccttcatcttag

SEQ ID NO: 20863 - DNA, 258 bp, Glycine max
  Peptide Sequence Number=SeqID_137641
atgaagcttacttttcacgcaaccttcgcactaagcgtactgaccatgcttaacgagtatggcggtattcgtgctcagtgcgtgtctcacgctaagtgcgcctttactttccaaaattatattcttggtgctaatcatgcgtttcccgttgagcctgtgcatcgcgctgaacgcctgagacgtgctaagcgagtagcttcacatcttcaatttgcttcttgggatttactttattttcctgctcaaattattcattaa

SEQ ID NO: 20864 - DNA, 800 bp, Glycine max
  Peptide Sequence Number=SeqID_137642
atgctagaaagcattgacttgtccagcaacaatttctcagaggaaattcctgaagctgttagctcactgctgagtctgagggtcctcaaacttgaccacaacaggtttgcacacagcataccttctgggattctcaagtgccagtctctagtttcaattgatgtttcttcaaatcagctgaatggaacacttccagaaggttttggcgctgcttttcctaaacttagggtcttgaacctttctgggaataatatgtatggtcatgtttcagatatttctgggttaaagtccattgtgaatctcaacatatcagggaattcgtttcagggttctattgtggatgtgtttcagggaagattggaggttctggaccttagcagaaaccaatttcaaggtcacattccacagaataatcttagtggggatttttttcaaaatttgaatgagtccctgaatttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 20865 - DNA, 312 bp, Glycine max
  Peptide Sequence Number=SeqID_137643
atggtgcaaaaaggattagttaggcatagtgtgcatcctgatcattctgagtattctgagcattctgagtatttagagcattctgtgcattctgttgttggtgattttgaacattctgattttgagcattcgtctgctaattatcatattgagaacatggctcaacctccacctcgtgagaggacttttagggagatggttgcacttgacttcacttatgaaagcttgtgcattcaatatcctgatgaggatgttccatatgttctcaagactagactaatacatttgatgcccaagtttcatgtgttgcag

SEQ ID NO: 20866 - DNA, 501 bp, Glycine max
  Peptide Sequence Number=SeqID_137644
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcatcgatgccgacgggcagcgcacctccatgctgtatgaccgctacggcaacctcgtcagcgctactgatcgtgcgggcaaggttatccgtcacacctatgacgggcggggccattgcgcccgcaccacattgcccaccggtggggttatcgattacggctgggacgaggctgaccggctcacgacgatctcaagtggtggcacgctccgggtgcgcctggattaccagggcaccgaacgcacacccgtgcgcctcgccgatgcccacgccaccaccctgacgatgtcgtggaatcggggtctactgcgccaactggtcgatgctaccggcgcgagcatcagtgtcgactacgacgagtatggccag

SEQ ID NO: 20867 - DNA, 763 bp, Glycine max
  Peptide Sequence Number=SeqID_137645
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcgccagcgagatcgacgacgggatcgcaccgatcagcatgttgtagccgtcgcgcgccagcttctcggccacgcgccggccggcgtcgggcgtgccctcgtcgtcggcctcctgcacctcgaccttgtggccgtcgaccccgcccttggcgttggcctcgtccaccgcgaagcgcaccgcccgcatggcctcctcgccctgctgggcgaagacgccggacttcgagctcaccaggccgacccgcaacgggtccttggtctgcgccggggcggcgaagggcagcgcggcgcacagcgccagcacggcggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20868 - DNA, 381 bp, Glycine max
  Peptide Sequence Number=SeqID_137646
atggaaggtagcctaagcactagaggcagagggaggcagaaaaactataggcaaaacaatttaggaagatttaaagtaaagctggttgagaatgatagattgagaaatgggaatagagaagcacttactgcattaaggaagagggctcggacaaccaagagtagtgttccatctccttttgaatcaataatgaaaggagtagcagggaccagctcgagacctttggtgcaagaggtttgcaccacctgtggcaaacatgactcttctgagcagacatggatgatgtttccaggaactgatctgtttgccagaattccatttcatgcggctcatactatattggaaacaggtgctttcattgctgcccgtcctaacctctaa

SEQ ID NO: 20869 - DNA, 1599 bp, Glycine max
  Peptide Sequence Number=SeqID_137647
atggctaccccaagtaaatcaacaccaataatagcgtcagacactttggaacaaaaagggaagactatgactgaatcaaacgcaaacattcttcaatgtcctttaaaccagcaactctatagctccttagatggcccagtagcaatcctttgggatattgaaaattgtccagttccatgtgatgtgcgccctgaggatgtagcaggtaatataagaatggctttacgggtgcacccagtaattaaaggagctgttatgatgttttctgcttatggggatttcaatgctttccctaggcgacttagagagggctgtcagagaactggcgttaaacttattgatgttcccaatgggagaaaagatgctgctgataaagctatcttggtcgacatgttcttatttgctcttgacaaccctccaccatcctctatcatgcttatatctggggatgttgattttgcaccagcacttcacattcttggtcagcggggatatactgtaattcttgtcatccctgctaacgtgggtgtttcttctgccctatgcaatgctggtaaatttgtttgggactggcctagtgtggttcgtggagaaggctttgtgcccccttcgaaggctttagtgccaccacgtggaggtccagttgaacttgctggacactttatgggatgccatatcaatgacaactctgatggacaaaatgaagaagaagcaatagtttatagaggtatgtcacagagctattataactcaagggaattctcaatggtgtcacaatctctgtctgaatacaacaatggcacattgaacacgacttgcttgcctacaactatgagaacacatagccttccatctgtattgaatgatgttccaggagggtctatgatgccttcgagtgaccttaatgaatgtcagttatgggtacagcctggggatttaaatggtctcaaggggcagctggtaaggttgctcgaactttttggaggatgcctacctctggcccgagttccagcagagtaccagaaactttatgggagacctctttatgtatctgaatatggagcaataaagttggtcaatcttttcaagaagatgggcgatgccctggctgtggaagggaaagggaatcggaaatttgtgtatctcagaaactggaaggcaggcccaagtgctcctcctctctctctggcaaagaaagacaagaaaggaaaggaagcccaggaagagaatgtgaatattgtcactggtggatgctcttcagatgagttctcagatgaagaaagagtagtcatcgaagagcatgatgaaagaagttgcatagggaaggggaatcagggtagagctgccaaatgtgaaattgatgaccgttttattgagcaatttaagtatgagctgcaagagattctggtaagctattcttgtcgcatattcctaggttgttttgaggctatataccagcagcgttacaagaaacaactggaatatcagagatttggtgtggacaagttggaagatttgtttgagaaagtgagtgatgtggtggtactgcatgaggaaccagtaagcaagaagaagttcctggctgctgtaggtggttag

SEQ ID NO: 20870 - DNA, 1227 bp, Glycine max
  Peptide Sequence Number=SeqID_137648
atggaatctcgcaaattagccgccatactctcctcccttgtctcccaactcctcctcttactcctccacaacattttccctttccctccacacaactccatcctccccctcctcctcttctcccaccaactcgccgccaccctctcccccgaaccccacaaattcctccaacgcaaacgcaaacgcaaacgccaacgccatttccaactccccaatcccctcacccgcacccctgactccttccgcaacaccttcctcatgtcctcctcctccttccagtggctctccggcctcctcgatcccctcctcgagtgccgcgaccccgccgccctcttccactccctcaacctctcctccggcgcccgcctcgccatcggcctctcccgcctcgccgaaggctccgactacccccaaatctcctcccgcttctccgtctccgtccccgtcgctaaattctgcgtcaaacaactctgccgcgtcctctgcaccaacttccgcttctgggtctcttttccctctccctcggacctcccatccgtctcgcagtccttccaaaccctctccggcctccccaattgctgtggctccattctttgctctcgcttcaatatcttagtcaacgccaacatccctaacaacaaagtctcgatttctcaagtagccgcgcaaatagtcgtggattcctcctcgcggatcctcaccatcgtcgctggcttccttggacacaaatctgattcccaaattctacatgcctcctctctctacaacgacatccagcaaggaaccctcctgaacgccccaaacgcaccgtttaatcagtatctaatcggcgattcacagtatcctctgcttccctggcttatggttccttacacaaaccctgctcctggctctgctgaagagaatttcaactctgctcatcaaattatgcggcttgccgcgcttagggcatcggccagtctgaggaattggggggtgctgaggaaacccgtgactgaggagcttaagatggctgtggcttacattggcgcctgctccattcttcataatagtttgctgatgagggaggatttttcggctctggcttccgagtttgaggattgtaatcaaggtttttgtaatgctgctgcatttgagggtgaggctgtgtcttccgtggctttggctttgcgtgacaatttggctaacatggccaaggagttttgtcgcgattcgaagaattcttga

SEQ ID NO: 20871 - DNA, 1953 bp, Glycine max
  Peptide Sequence Number=SeqID_137649
atggaagtgttcagaattgtggtgaaagtgaagcaaactgttggcagtacagattgccctttgaattttactggttcaaacttcacactggcttcctccctatgctctaaccatggtgacaggggaaaatgttgtcgctacattaacactaacgttgcaatttctgttgctcgttttgctaatgcaacaggcaacctaggggtccctcaaaatgcatctgacatctgcctccaaaccatatttcaaaccttggaacttaatggagttgcacaaaatgcaacagctttttgtggttttgggacaaaaattcccgttaattatgaatgcaaggggagaactagtgttgtccaaatgctgcaatcccccagatttacggaggtcacaaaaaattgcaaagcgccactaggagaggaaagtaaatgtaagaagtgcttaaatgccggctttggttatctgcatcatatcggaattgaagataatataacactaagtacatgtcgtgatgccacttttgctgcactagcaagccaagttgatgagacatctattattgacattgcaatttgcttcttcggggttcaaggacttctcatacctcctgtttcagagtcatccccacccttgcctgctcctaaggcttctccaagccccccacgggttgctgatggtccaagtcatccattgttaagtgcgcctttaaagggaaaccaccattcatatcatttgacattagttccagtcttgatagttctaattcgccagaaaagcagagagctagacgagcctgataattttggtaaatcctgttcgaaaaccttacctccttgtgcaacatggaaatttcaggaaggttcttcgtctatgtttcgaaaattcagctacagggagataaaaaaggcaacaaacgattttagcactgtcattggccaagggggatttggaactgtgtataaagctcaattttctgatggactgatcgtagcagtaaaaaggatgaacagaatatctgagcagggggaggatgagttctgcagagaaattgaacttcttgctcggctgcaccatcggcatcttgttgctttaagaggcttttgcattaaaaaatgtgagaggtttctgatgtatgaatacatgggaaatggaagcttgaaagatcatcttcattcccctggtaaaacacctttaagttggcgaactagaatccaaattgccattgatgtcgccaatgcactggagtacctccatttctattgcgatcctcctctgtgtcacagagatattaaatccagcaacactttactggatgagaacttcgttgctaagatagctgattttggccttgcacaagcttcaaaagatggctcagtatgctttgaacctgtaaacaccgaaatccggggaactccaggttatatggatcctgaatatattgttactcaagagctcacggagaaaagcgatatatacagttttggggtgttactacttgaaattgtgacaggaagacgagccattcaagataataagaatttggtagaatgggctcaaccatacatggaatcagacacaagattattggagctagtagatcccaatgtgagggagtcttttgacttggatcagctccaaacagtaatctctatagtagtatggtgcacacagagagaaggaagggcaaggccttcgataaaacaggtacttaggcttctgtatgagacatcagaaccaatgcacagtgagtttctacaagcagttgaagatgaagaaggtcagggaagtcagcatagaggcagaagaagcaaggggaaaatgctcagaaatgaggcattgtttcacagcggagatggaagatatcttgcttcatcttcaagtacgtctcggtcgtattgcagtagaacctttttacttgagagtggctctccacagtctccgccaaatatgttctctctctga

SEQ ID NO: 20872 - DNA, 180 bp, Glycine max
  Peptide Sequence Number=SeqID_137650
atgcccttgcgggataggattgcatcactggtggtcgtgggtggtggagaagaagatcgcgctaagcgggagtccaatttttacgctgagtgcaactccccttgcgctaagcctgacaattctcgcttagcccaattccctcttgggttggaattgcacttagcgcgcttctcacgctaa

SEQ ID NO: 20873 - DNA, 274 bp, Glycine max
  Peptide Sequence Number=SeqID_137651
atggctactccacctacctcgcctcctcctcttcctccttctcctcttgcagtagcatcacaatctctgtctaccttgaagcagacacgcaaagccacacgactacaatccttggccactagaccacctggggcagagagatcggtggtccacgtcgatcctgcgatcgggaaggccgaaggtccccacaagaagaaatcaagtcgacatgacatacgagacttggaaggaagtccctgctactcagaaggatttgatataggaggatattcag

SEQ ID NO: 20874 - DNA, 150 bp, Glycine max
  Peptide Sequence Number=SeqID_137652
atgacacaggaaaacattgatatagaatactcattaaatgacccaacaatagatgatcttgatgattatgatgaacagacctttctatctgcctcatctgcatacccaaatacaggtggtacttacattgatatcggagatcctgtatag

SEQ ID NO: 20875 - DNA, 306 bp, Glycine max
  Peptide Sequence Number=SeqID_137653
atggctggccatatgggtagaggtgtcatagaggagcaggtatggaggaagggaccttggactgctgaagaggacaggttgcttgttgagtatgtcaggttgcatggtgaaggtagatggaactctgttgctaggcttgcaatacttcgacatccttaccttgacagtagcaagatcgcgacaccactccaaagagcacgacttcggctatggcggtggtgggaacaacaggtagctagggtgggcacgacggaggtcagggaacggcgatgtgagggtgggcacaaaagagatcgagtgggatga

SEQ ID NO: 20876 - DNA, 1230 bp, Glycine max
  Peptide Sequence Number=SeqID_137654
atgaagccaagcagtcgggctccagtgccggcggaaaatcaagcaggcacagcgaaccgtggcgtagttcttctgttggctgcgctcgcggcgataggcgctttgtcaaccaacatcatcctgccgtcgtttccggcgatgtctaaaaccctgggtgcgtcagatgcccagctcggcctgacactcagtgtcttcttcgtagttttcgcggcggggcaactcttcgtgggacctctgtctgatcgcttcgggcgtcgcaaactggtcatagggggcttgctggtcttcgcggctggcggggtggtgtgtgcccaggcggcggctccagccgaactgattgtcggccgagcaatacaggctgcaggcgtatgcgccgcgtccgtacttgcacgcgcgatcgcaagagatatgtatgaaggcgaaactctggcacgcgttcttgcgatggtgatcgtggctatggccgcggcgccggggttctctccgctgctgggcggcatgactgagaaaatgattggctggcgcatgaccttcctgacggtcagtgccttcgggcttgcactttcaatgtggtacgccttccgacttccagaaacacacgtcgcgtcgcggcggatgccgcttgccgttggccccatactcaggatctatgccagccttctgatcgatccacgcttcctccgtccagtcatcgctgtcatgtgtctcacaggcgggctttatggattcttcgctgctgctccatcagtgctgatgggcgccatcaagttgagcgcgctggagatggggctcttttttgcagccacggtgcccgtggtttttgctgcaggcctcgctgtaccaagactttcacatcgctggggtgcagctcgagtcatccaagccggaatcgtcttggccttggttggaggcgtgatgatctacctggcctcggttcgatacccatccagcctcacagcgttcacgttcgcgctctgtgtcttcctcatgggaatgggcgttgccaatcctctcagtacagcacaggcgctttctccatttggagctcaagcaggtgcagcctccgccatgttgggcttcatacagatgtccggcgcagcacttggcgccatgctggtcagcacgatggcagggatctcccacatggcggcggtaggactgcttatctcagtcttcgcactccttgctttcatcactttctggaaccagcccaggacggctggtttttga

SEQ ID NO: 20877 - DNA, 579 bp, Glycine max
  Peptide Sequence Number=SeqID_137655
atgaattgccttttcgttcatgtgtcctccactttcgagtttggagctatgtttcatgattgcctaagtgcggaccctcaaggcaatcctccattctcccctttttttcggagctccatgaattgcgttttcgttcatgtgtcctccactttcgagtttggagctgtgtttcatgattgcttaagtgcggaccctcaaggcaatcctccattctcccccttttttcggagctccatgaattgcgttttcgttcatgtgtcctccactttcgagtttggagctgtgtttcatgattgcctaagtgcggaccctcaaggcaatcctccattctcccccttttttcggagctccatgaattgcattttcgttcatgtgtcctccactttcgagtttggagctgtgtttcatgattgcttaagtgcggaccctcaaggcaatcctccattctcccccttttttcggagctccatgaattgcgttttcgttcatgtgccctccactttcgagtttggagctgtgtttcatgattgcctaagtgcggaccctcacggcaatcctcaattctcaccctttttatga

SEQ ID NO: 20878 - DNA, 1233 bp, Glycine max
  Peptide Sequence Number=SeqID_137656
atgtttagttttcagaaaatttatcttctattgacagtgttatttctgctagggaagcctgtcataagcaaggatcggtgcagggagaagtgtggacgcgttcatattgaatttccattttacctcagaaataacaatttgagtcacaccactggccatcatcctgggttcgatctgttttgtaacgataaagatgagactgtgctggagctccctgctgttccaattaaattatttgtaaaaaaaatagattacaagtctcagcaaatccaaatttatgaccctgaaaattgccttcccaaggtgttcttaaaactcggtaattactctatttatccattcaaattccaatcagatttttcggacaagcatgatgtttccttcttcttttgcaattcaatttcgtgcccgatttggcgactatcttaccttccatggattgatcctgaattgatatcttgcaccaaggtggaagatgttttgtccgtggagtggttggatggtgaggagatcataaactctatcttgaaatggtcaaaacccaactgtaatcagtgtgaagcacaaggccagaaatgtaaatggaagaatggtacccaagatgaaactgaatgtttcatttgcccaacaaacgcctttccaacatcaactattgtactcattgctgcagttggtttgatgctttttctgctactggttaaagctttgttctacatgtatggatattataagataaaagaagaagaccaggctcggatagagaaattcttggaggattatgcggcaatgaaacctactagattcacttatgctgacattaagagaatcacaaatgggtttagtgaaagtttaggggaaggggcacatggaaaagtgttcaaaggaatgctctcccaacaaattcttgttgctgtgaagattctcaatgacacagttggagatgggaaggacttcataaatgaagtgggaatcataggaaaaattcatcacattaacgttgttcgcttgcttggattctgcgcagatggattccaccgagctcttgtctatgatttcttcccgaatggttctcttgaaaagttcttagcaccaccggacaacaacgatgttttcctcggttgggagaaattgcaacaaattgctcttggtgttgccacagggattgagtatctccatcttggttgtgatcacagaatacttcacttcgacatcaatcctcacaatgtttactag

SEQ ID NO: 20879 - DNA, 453 bp, Glycine max
  Peptide Sequence Number=SeqID_137657
atggtggagttttttgtgctctctagagctcctccttcgattgttgtgctaggtttcttgagccttgagaagttcttcgacaggctttcagcctttgtcaacagtgtcatcacgtggatccacatcaaatacatcatcttgcctcatagacgatcagggtttagatctgccttgatagtcatggtttctcctgtcaaggttgagaaattcatcttgagatgtggtgtggagacaatggctctcaatttgttcaacatttccctgcccatcaaagcaaattatgagcctctagaatgtcttctagcaaagtatgtctgtggagctaccttggtgatgcaatcctaccccccaagggcattggatagaagactccaagaagattgggatggagatgcaagaaaaggccctagggttctcatgagccttagggtagatttcggactcatgggctaa

SEQ ID NO: 20880 - DNA, 279 bp, Glycine max
  Peptide Sequence Number=SeqID_137658
atggtgggtgccaaatgtacttaccaaaatttggagctaagcaacgttagaatcaacgtggccaagatgggctccatgatctcacacgtcgaactgaaggtaccctttgttatgagaacacgaggggggacctacaaaacaaaggactctgatgctcaagtaagtatgtacaacggtgtaacaacccttggagataattcctatcttgtagagataacttgtccgtctagttgctcggctactaacggcgatgcgttcatgctcttgcgacaggactga

SEQ ID NO: 20881 - DNA, 672 bp, Glycine max
  Peptide Sequence Number=SeqID_137659
atgaagcaggttgtcgggttgatgtctagttcaggtcgcccctttcttgctagttctcagggtccaccttcggcttccttggctgttcaggctactatttctactcctgctcctccgactcttccttctatgcctgctcaggaggtttttgtctaccctcctaccgtggctactgtgtcggtccctttggctgctcttagtttgatgattgcgagtgctctcaacattttgcctccttcttcttcagcttcaccagttccaactttaactattttgacgtcgacattgccttcctcctcttcttgccccaatgtctccctacatcatgtttatacttctcacgatacagttggcaatgttctcacgaagctgttgtgtacaagactggatggtgatgaagtgtttgggcattgtaaggacttgatgaaaaagaagaacgacttggctggaaaggttaagagtgatgttgtagagaaggaagagcttgccaaggtggttgtcaatagtcaaagtccaagctggaagagtcttaactcaaggcatctaaggagagggaggccatcaaggagccggaggaagagctattggcattcaagaaggaagtcgtggagtagtatgataagagcttttacaaggctattgggcaggacaagttcttcacaaaggtcttga

SEQ ID NO: 20882 - DNA, 1704 bp, Glycine max
  Peptide Sequence Number=SeqID_137660
atgggtgtgaaaaattatatgctgacgttaggtagttattccatattgttctattcacataaaagaatcgaaatcaagaagcatatcgaagtcgcgccaagaaagatagttctgaattccaatccaacactctcgaaattgcacatattttgcgagggaagtcccactattcagtgggcacataccctcagtacccaaacacttcattgcttgcgccaagatgttatgtattaccattttaatgagaggtatgcgatgaaggctcctctgattgttgatgacatctatgaaattatcatcaagaatgttgctcgattggacagtgagataatctatgatagagactttgactatgattactttggtttcaaaacccttgagaggtcatacatcctgaaggttcaaggaaaggttgtggaaaggcctcagcacatgttgatgagggttgttgttggaattcataaggatgacattgattctgctgtcagaacttaccacatgatgtctcagagatggtttactcatgcatctccaacacttttcaatacagaacacctaggcctcaggagtgtgttgtcattagcaaatcagcaggaggaattggtgttagtattcacaacattcatgccacaggcagttacatttgtgccacacctgggacatcaaatggtattgttccaatgctgcgtgtgttcaatgatactgctcgctatgttgatcaggggggaggtaagaggaaagggtggggtgaagaatttgagaaactctacactcagtatgaaagagaaaaacggctgtgtgcaacttggcatcaattgctctgccgcaatatgtaagagagaaggtaggacatccctggcatacttcataggtgtgatcatggaatttcatccaactaagcttgttgggagcagaggctcaaaaaatcgatattttgactttgataaactggaagaggttactgcaatggtgacaacaaacctcaataaaataattgatgttaattactacccagttgatactgcatttgtggaactgctttttgatctacaatttaagctagatgctcagcagttgaacaaggatatatttcagactatatactatcatgcactaaaaacttcatctgaattggctgcaaaagaaggtccctatgaaacatttagtggtagtcctataagcaagccttacccttgcatatgcaaagaggccgtttccggattcgaacccatgaccaacaagtcatcaagacacaactttaccgctgcaccagggctcgcccatgttacacgtgcacatggaattcttcagccagacatgatgggtgtgatggcctcgagtcgttgggataggggtgcactttggaagatgatatcaaagacgggtgtgagaaactcacttcttgttgcccctatgccaactgcatcaactagccagattcttggcaataatgagtgttttgagccatatacttctaatatctacagtcgtagagttttaaggctcattgcctttgaaattgtcaggactgtttgggagattaagcaaaagacattggttgatatggctgttgatagaggatgctacatagaccagagtcagagcttgaatattcacatggatcaacccaactttggaaagttgacttctttgcatttctatgcatggtcaaaggcatcaacctttttccttgggtctagttaa

SEQ ID NO: 20883 - DNA, 768 bp, Glycine max
  Peptide Sequence Number=SeqID_137661
atgtttggtatatcattgagttttatgtttgactgtcaccggcttaactcaaccttcctcatttacctgggcttgggaccggctatgataccacaggcagagttattatattattcccataacaacgattatcttgaaatttgccgttgctacaaggcaatatatgagattccatctgtcaaagaagaccctgccaagtggattccaatcctaaggaaaatatgttggtacttggttctagcgccctatgatccaatgcaatcaagctttctcaattccaccttggcggataagaatctatctgagattccaaacttcaagctactcttgaaacagctggttaccatggaggttatccaatggacaactctatgggatacatataagagtgattttgagaatgagaaggcctctgggaaatctttgggagaaaaagcagcagaagatctaaggcaaagaataattgaacataatattcttgttgtatcaaaatactatgcaagaattacattgaagagacttgcagagcttttgtgcctcagtgtacaggatgctgagaagcatctctcagatatggttgtgtctaaggcgctggtggcaaagattgatagaccattgggaatagtctgtttccaaacagcaaaggatagcaatgacattcttaactcatgggcagcaaacttggagaaattacttgatcttgtggagaaaagttgtcatcagatacacaaggaaaccatggtccacaaagctgctttgaaggtttaa

SEQ ID NO: 20884 - DNA, 1155 bp, Glycine max
  Peptide Sequence Number=SeqID_137662
atgaaggaaaatataggaattgagatctcgattaactttgaacattttgattgtttgcctctttcacctgtgcttagtgatacttccacaataagagttggttgtaccctggtggattgcctgaagcagttcattgttgctgaacatgttgaaaattatcactgcagccaatgttggcataatgccgcaatcaagtatctttctataatggaaggaaatgaggtagaactagaaaagctaaggagatgctctgacccagaaatctgcgattgccgaaaaatgtataatcttgataaactaccctggtcaaacaggttttcacacactttgaagcagctaagtatggctaggtgtccaaggattttatgcatccagttgaaaagagtttatatgaatgtctttggagagctagtcaaactgcagggccatatttcttttccattgattttggatgtgttgtcattcatgacaactagactgggagtgaagaaacacgacatagatgtacaaagtgtgccattaaatttgaagtataacaaaagaattttttttccaaatcattctgacctgcaatctgagataagtacattgaaatttagtggccttcatggagcaaaaaaagagcagatcaagtcagatggtgttattgatgatggacttgtctcctctacaaatggacaggcacttcataatgacactgtatttccctgctctggctcttcagaaagcattcactcagatacacatatgcaatcgattgaccaggtagatgtttcttgtaatttagtacctcaagaaacatgttcgtatcaacttgtttctgttgtggaacactttggaaaagctggaagtgggcattacactgtttacagatctattctcaagtgcatgctgtttcagtggaagatgttctttccagtgaggccagcttgcttttctatgagagaattccaaggaactgaaaaaattcctttattttgttttgggaagttctgggttcacacaagatgcattggcatcaatgttctgaatcacaggagtctatggtgtggcgttttaactcaccacgagtggtataaggacatgctaaggttgttccagattgctaaacaagcttttgcggaggctaattataatgaaggaataattaactag

SEQ ID NO: 20885 - DNA, 1458 bp, Glycine max
  Peptide Sequence Number=SeqID_137663
atgtgccgtgatttttcgcctattatagttgagttgaagaagcaaagttcatgctcggttcaattgaccaataataccaaccactatgtagcgttcaagatcaagacgacgtcccctaagaaatattcagtgcgtccaaatgttggagttctcgcgccgaaagctacttgtgaattcatagttacaatgcaaccccaaagggaagcacctgaagatatggtgtgcaaggacaagttcttaatccagagtacaaaggttcctgccgaaacaatcagtgaagatgttacttcccgcttgtttgttaaagatggaagtaaatatatagaagaaaataagctgaaggtgaccctaatctgcccacccaattcaccagatctctctcctattaatggagatttcaagaatgggcttgaccatgaaaaagttcagatatatagtaaagatgaaatccaatccccagagaccatggtcagaggacgcttcactaatgttcttaaaaatccagacatggttcatgaggtattagaactagaagaggatatggagttgaggccagagtattatgtgggacacaccatgaaacatgtaggggagccaaaagaagaagcaaggttgaaagtgtcaaaaaataaggagttgaatatggtcaaggatttagaagaattgaagccacaaaaaaagttagaggttgaagtgccaaaagatctggatttgaacaaaataaagaatgcagaggagttgaaaccagagaaagcagcagagttgaaagtgtcaaaacttctggttttgaacaaagtaaagaatgtagaggagctgaaaccagagaaggcagcagagttgaatgtgtcaaaagttctggatttgaacctcgtaaataatgtaaaggaactgaagccagaaacagaaacagagttaaaaatgtcaaaagatctggagttgaaaacagtaaagaatgctgaggaattgaagccagaaaaagaaacagagttaaaaatctcaaaagatatggagttggaaacatttaaaaatgttgaggaactgaagccagaaaatgaaatagagttaaaaataacaaaagatagggagtttagaacagtaaagaatgttgaggaactgaagccaggaaaagaagctgagttgagagtttcagagagtatagagcagctgaaattattgaaagctatcgaagagatgaaattaaagctagatggacttgagtcaaaactaaatgagggtgcaatatgtggcatgattaagttccacaatgtgtctggagtaacaatatcaaagttaacagaggagaggaggctcagcaaccaagagacaaaaatcttgcaagaaaaattagcagatcttattaataaaggtccaagaaaagttcaagtcggcttcccacttctatatgtctgtatggtggcacttatctgtgtcttcttgggataccgtttacactcttga

SEQ ID NO: 20886 - DNA, 360 bp, Glycine max
  Peptide Sequence Number=SeqID_137664
atgaatagagaatcaaatcaatccctcaatgttcatagcccctactccctgcatcctagtgaaaatccagctactgcattggtttcacccgtcttggatccaactaattacaattcattgaggagatccatgttcacagctctaagtgcgaagaataaagtggaattcgttgatggatctcttccacaacctgcatcgaatcatattctgttctcaacatggaagagtcacgctattcccaagtttgcactcattgtggcatcaatggacacacggtggatgaatgtttcaagaaacatggatatcctcctggccatagactctataaacctcaaggagcctcaatcaacaacacaatga

SEQ ID NO: 20887 - DNA, 276 bp, Glycine max
  Peptide Sequence Number=SeqID_137665
atgacagacagtatttcctcaatcaaatttctgttagatattgattatttgacacgaatcactgaggccgtattatggatctggtacttaagagcacaaatactgaaagaaaaaagcaatatggatagcactagtgatgctaggacatattatcaaagtgaaacgcatgatgatcacgtatttaagccaaaagaagataaagataatgcaaacgaagtgttctcaatggattacactccagccagaaggaagccaccgatccacaatttgaattga

SEQ ID NO: 20888 - DNA, 1506 bp, Glycine max
  Peptide Sequence Number=SeqID_137666
atgaccaaaactgtgccctcttatgttagggtaaaggataaagggatgatctacacagcaattgacacgttctacctcacagatgagcagctagcaaactcaccttctagaaaagatggcatagatgaagccactgagaccacccttagaatctatggttgtgatctcatccaagaaagtggcattttgctcagattgccacaagcagtcatggctactgggcaggttctatttcatcgtttctattgtaagaagtcatttgcacggttcaatgtcaagaaagttgctgccagctgtgtatggttggcttcaaaactggaggaaaaccctagaaaagccagacaagtaattattgtttttcacaggatggaatgcaggagggagagttttcccatggagcatttagacttgtattccaagaaatatgttgatttgaaaatggagttgagcagaacagaaagacatattttgaaagaaatgggattcatttgtcatgttgaacatcctcataagttcatatcaaattaccttgctaccctcgaaacacctccagaattgagacaggaagcttggaatctggctaatgatagtttgagaactacattgtgtgttcgatttaagagtgaggttgtggcttgtggagttgtatatgctgctgctcgcaggttccaagtaccccttcctgagaatccaccgtggtggaaggcatttgatggggagaagtctgggattgatgaagtaggcagggttctggctcacctttatagccttccaaaggcacaatatataccagtctgcaaggatggagactttacattttccaacaaatcatcagaaacaaagtctcaatcaacaccaaagtggtggtgcaaatcagcatcggttggatgttataagataaatgttggcatttgtaaacctgtattattggcaatcaactataaggatgttccacaaaatagttccccagctgatactgacaactcagtgccaaagggagctcaaggagaagctaatactgaatccaatggtggcaagggtgcaatggtaaatgtagccattgataagctgaaagattctaaaaggtctgatgatgaatccaaaggcatgagtacagaaggagaggcaagagacgaacccatactgaagtccaaggctgaccatattggggagacacgcaggaaccgggatcgggacagggatagagaacgagataggggtagggaaagagacagagatagggacagggacagaacaaaatccagagatagagatcgaggaagggattctgacaaagaacgtgaacgagaggaagctgagagggacaaactcaaggatcgtggtcaccgttctagggagagagcaaaggattcaggtgtctatagatttcttgacattcagagaagtcaaaacgccattcgtcgcatgatcgggtttcttactcgtcaagggagaaagatcggcatagacatcattgacattagtttagaggatatttcaagatga

SEQ ID NO: 20889 - DNA, 1359 bp, Glycine max
  Peptide Sequence Number=SeqID_137667
tgttttagaccgatatgggaaggaggagagtatgatggtgatgaaagccagcgacaagatgctctacgtctagccattgaattgggatcagagtttgttgatgttgagctaaaggtggctgatgagttttacaaatccattggagggaagaaggctgagagtgtgaagatcattgtgtcttcacacaacttggaaagtactccatccgtggaggaaataggcaaccttgctgcaagaattcaggctaccggggcagatgtggtcaagattgctacaaccgccttagacatcacagattgtgcacgtcttttccaagtcctagtgcactctcaggtcccaatgattggaattgcaatgggtgagaagggatttatatcacgggtactctgcgcaaaatttggaggatttctcacgtttggttcaattgaggccggagctatatcagctccaggtcaaacaactatcaaagaattgttggatttgtacaattttaggcagattggggttggcaccaaagtgcatggtgttataggaaatcctattggtcatagcaaaagtcctcatctttataatccagctttcaagtcagtgggatttgatggaatttacttgcctttgttgatcgataatgtctcagattttctcaacacttactcgtctcctgatttcgttggatacagctacacgattcctcacaagcagaatggacttagatgttgcgatgaggtcgatcctattgccaaggcaataggagctattagttgcatgattaagagaccaaatgatggaaggctaataggctataattttgattatcttggtgccattgcagctattgaggaacgactacatctacaagattcaaacggaagatccatatctggttgttcacctttgtatggcaaactgtttgtggttatgggagctggaggggctggaaaggcactagcttatggtggaaaagaaaagggtgcaagagtagttgttgccaatcgtacatatgccaaagccaaagaacttgccactaaagtgggaggagaggccattactctatctgaattagagagcttccacccggaacaagggatgattcttgcaaatactacatctgttggaatgaaaccaaaaattgacctgacacccataccaaaggaagccctgaaacactactccttggtatttgatgccatctacacacccaaattgacaagactccttcgagaagcacaagaaactggagctgccatcgtctatggtacagaaatgttcatcaaccaagcattcatgcagtttgaaatgttcacaaagttgccagcaccaaagcaacacatgagggatgtgctggcaagaaatacgtga

SEQ ID NO: 20890 - DNA, 2130 bp, Glycine max
  Peptide Sequence Number=SeqID_137668
atggaatgcaacaaggacgaggctttgagggctaggcaaattgctgaagccagaatgcaaagaggtgaatttgcggaggcactcaggtttgctaccaaggccaaaagactgtatgccgacgttgaaaacattgcccagattattacggtttgtgaggttcacatcgctgctcagaaaaaactctctggctgtgacatggactggtatgcaattcttcagattgaaaggctggctgatgaagcaaccgtaaagaaacagtacaggaggcttgcactgctacttcatcctgataagaacaagtttgctggtgcagaagctgctttcaagttgattgggcaagccaatgggctcttgtgtgaccaagcaaaacgttctttgtttgacaagaagtttggagcctccgtgaaaggtgctgcgcctaagcctaagacctcgcacaattattcaaatgggaatgtgtttgccgctaaacataatgcaaatgcaacaaagactcagaagagttctgattcgcaccatttctcacatgggaatgtgtttgctgcaaaatgtggcgcaaacgcaacaaattatcagaattcttatccgaactccactggtttcagcaaccaaggtgcacagatgacattctggacatcttgccaacattgtgatgctaagtaccagtacccgatccgatttgtaaatgcaaacttactgtgtcaacagtgtaagaagccatttaaagctcttgctaatggttttggaatcatgggtgcggcaacagtgcttacttcagtaaatattccgaaggaggctccaatgcatggtcccccaaaaccagcctcagaaaatactggtcgaaaaccccttggtagagaacaagctggtacgtttgtgcggtcaaatcctacatctatgaaaaaatgtgctgctggagtcggtagacgttgtggaggtgaaaagagtaaagatggcaacattcctgcatccagtgatatggagccacagacctctcaaaattttggaagtaaaagagtaaggcagtcagcaccagattcaggagaaagtttcaaagccagaaatggtgatgataccaaagctgccaatattcgagaaaatgctgttgattcttcaaatacaaggagatcttccaggaaaaagcagcatgtttcatatattgaaacctctgaagatgacgattttgagattccttccaaaaagccacgacaaagtggaccacttaatgctgatgaagctgaggaacaaaacgtgcctgcaagtggtgagtcgtctgataataatattccagctactcccggtgcgactgatcagaacaaagagaaggtatccgagtcagatattggtcttggaacgtcaaaggaggataagcgctccccaaaaaattcaaaggttccttctcgtccacggatatttcattgtcctgtttctgatacagatttcaatgattttgagaaggataaggaggaggattgttttgctgttaatcagttgtgggcagtttatgatagcactgatgcgatgccaagattttatggtcttgtcaagaaagtggcctcccctttccagttgaagattacttggttggaacctgacccagatgacaaaggtgaaattgattggaatgatgcagaattgcctattgcttgcggtaagtttagacttggtggttctcagcaaactacagatcgcaccatgttctctcatcaggtgcggtgcataaaagaaaccggcagaggttcttatctggtatgtcctaataagggagaaacatgggcaattttcagagattgggatatcaactggagttcgaatccaaaaaatcatctgaagtatgacttcgaatatgtggaaatcctatcagatttttctgagaatgttggcatcgcagttgcttatatgggcaaagtgaaaggatttgttagcctttttcagagaacggagaagaatggagtaaacatattttatatcgaacctaatgaactatacaggttctcacatcgaattccttcttataagatgaccggttatgaaagggagggtgttccaagaggatcatttgaatttgatccagcggccctgccgactcatctctttgaagttggtgattctggtaatgtaaagatgtga

SEQ ID NO: 20891 - DNA, 585 bp, Glycine max
  Peptide Sequence Number=SeqID_137669
atggatggtatagttcagctggagaggcaacttgttgattatactgcttctctatttcatgagggctttctagatgaccaatttaaccagcttcagcaacttcaagatgaaagtaacccagattttgtggttgaagtggtgactctcttttttgaagacgcggataggcttcttaatgagctcacaaaagcactaggccagccaagcattgattttaaaaggttggatgctcatgttcaccagttgaagggtagcagctccagcatagtgacatggacctcactcacctttgttagagcctattctggaggatacattcccatttgtcttacctcactatttggtctttctacaactatcaaaagtttgataaatgaagttattgggaaatgcagcattggagctcagagaattcacagggtctgcatttccttccgaaacacttgcgaggagcaaaacgttgaaggctgccttaaaaacttgcaacaagtgaaacacgagtattccttggtgaaaagcaagcttgaaactctcttcaggatggagcaacagattttggccgcaggtggatcggtttctaggtag

SEQ ID NO: 20892 - DNA, 1695 bp, Glycine max
  Peptide Sequence Number=SeqID_137670
atggccaaaaagaaagtgtccgaatctctggaccccatggctgccccaaccgatgactcctcctcagctctgcagattcagaacctcaaaaacctcaacgccctccttctcaaggagaccacccaacgccgccaccagattcactctctccagtccgccctccaccgctccgccgtcacattcgacaccaacctcgccttccacctccaaaacgccgtcgtttccgtcttcttcaagaaccagctccaggaaatgaacctccgcttcgacaccctgctcggagatagggacttcgaggtttccgctctcaagcaccagctcagcgacctcgtcgcgcgtctcgagaacgaaacgactgctctcgccgaggatcgtgacgggctcgttcgcgagacgaagcggctggaggcgagcgtcgaccgagagaggaagcttcgggaggaagcggagaaggttaggtcggaaggcgaagagtttttgtctcggaaacagagagacattgcggaactggaaactgagcgagatttggcggttaagagttctcaggagtcgcgtactgcgattggaacgttgaaggaggcgtttgaagcggtgactagggagaagagtgagattcaaagccgaaacagtgctctagagacgaaaatcggttatctggaaactgagttgaagcaactcaacgattatacgcggaaggaagaggagattacgcgtgcgaagattctcgaactggaagggaaccttggcattgccatgcagaaggaagaggagatgaaaatggagataagtgctcttctgaaggagaagaaggaggtggaaatgaatgttgaaatgttaacagaggaaaaagatggtgttcgtgaggctctgagtgtggttcagaaggagttggaggataagcagcgcgagcttgatgaagctgttaaggggaggaatgagattgaggaggtcaaggtcaatctcgagaataaaattgttgagttgcgagggaaagtgaacgagttgaaagagtctggtaaaaagtttgaagaggaaaacaaacagtcgctttcgcaggttaagcgttatgaaaatgctgttgatgaagctgtgcttgagaaggatagcatcaagaaggcatttgacgaggagaagaagaaagtggtgaagttagagctgcttattgcaaaaacgaaggaagtggctgcgaaaagtgatgctgagttgggacaagtgagaagtgaaagaaacaagctagttgagaaggaaaaggaactggaaggcaatgtgagtgttttgagggaagaaaatgaagcattgcagggtatgctcgcgaaggcgcgaaaggagtccaaggatttgaatgccaaggttgaagtttggtgcagcaattcaaacaaagcactgtcattgttgaagactactgctgctgcacttgtgtgtcaacacaaggaaaggggtggtgatgaagtggtggcggcggcggccgatgagaatcctgtggaagaaattcagccgtatgctcaagaactggatgcaataaagaaggctttcaaaactaaggatgagatggtagatgacatgaagcaacaacttgtttcactcaacaagtctgtggctgaggcacacaagagtaagagcttgtggactgtgatatcctctgcaactacaatttttgctgctgtcttagctgcttatgttgctagaggacgctga

SEQ ID NO: 20893 - DNA, 120 bp, Glycine max
  Peptide Sequence Number=SeqID_137671
atggcaaagcaatatcacgcgaaagccgctgcggaagcacgtgacggcccagagggtccaaaaccaaaactagggttcatgccgggccacagcaagaaaattgtgaggaaatgtagataa

SEQ ID NO: 20894 - DNA, 1707 bp, Glycine max
  Peptide Sequence Number=SeqID_137672
atggaccccatcgtcctctccgacgaagaagacccctcaacgccgttcccgctccgtcccaagaaacgccgaaccgaaccggacccaaacccaaacccaaaccgcaccgtcttcgtcatcgacgatgacccaacccctcacaaatccgccacaccttctatcgttcccgagactccaatgtccgcgcttttcgattccgagattgcaatcgttaaatgcacaatgctttccgatcccgccgttatggtttcccctaaaaaattctccgccccttcagggattagtcaaatgatatgtttggaatcggataacgagtcggaaaattgtggaataagcacacggaacgaaaatgaagcaagagattctagatggatttcgaattcaggggggtctggaaggtctcctggtatatgcttggaatcagataacgagttagaaaattgtggaatggacaaaccggttgagaatgaaccaagagatgcaagatggacttcaaatttgatggggtctggaagttctcctcgtatttgtttggaatcagataacgagttagaaaattgtggaatgggtgagcgggatgagaatgcaccaagagattcaagatggacttcaaactcaatggggtttggaagttctactgagaggcatatttcagggggaaatgctactcaaactgaaatgcctggggatgacctttcaaatccaacctcttcacaagggaagtttgcaatgaaatctattgtggcagaaattgatgcaaaggcggttgaatcaggttcaattggagggcatctgcttactaggtttgctgaaaaagggcttacataccatattacatcaaatctagtcgcagggtcaattttgtggtctatgaaagttccagaacatatttcacagctttctactgaaagaattgagattccatatgtcttgctcatttatgaggctggcaaattttgtaaccttgtcatgaatgattctctttttgatcaactctctagcattcaaagtctttatccagcatatacagtttgttacctcaccaataggttattggcttatattaataaaaaggaacaggaaaaatataagaaccccgagaacagtagttgttggagacgtccacctgtagaggaggttctggcaaaactaacaactaatttcaacaaagtacactccaggcagtgtttagacgaggctgagctggctgaacatgttgtcagtttgacatgtagcctagcatcttgtcagtttagaaagaagttatcccgattatctgtaaatgcagatggagcccttattccaaaggactatgttggccggaatttgatgaagaaatctttgtggttaaaagctttggttgctatgcccaaggtacaaccacgatttgctattgctattgggaagaaatacccaaccatgaagtccctgttaagtgtttatatggatccaagtaaatcgaaaggatggccagaagtttgtattatctttcttaatgatggaaggagcatgagaaggaatttttacttgatgacagaagttttgcttggtggtgacagaaggctaggtgaggtttgttcaaagagagtatatagaattacaatggtgcaaagcggatgcattagaaaagatgatgtcgagaatggtgctgatttctgtgaacgtcaatcacaaagaactctgtccttgtatgtaaactgtgtttaa

SEQ ID NO: 20895 - DNA, 1377 bp, Glycine max
  Peptide Sequence Number=SeqID_137673
atgcattgcagtgaccagaagaaaagccaagctaataaaccgaagaagcttacaattgcagaagctttagatcttcaatctgatttgctgcaccccgataccaatgccaatacgaggcccaaaagagctaccaagagacaagcctctctattttcttgttcatcttctgcccatgacttgaggcatttggaattggagaaagagaaagaaaatatagcatcaccaagaggagtcttggaagcctgcatgaaagactttgactctcacgaccaatcacatgaatcgaaagccacttgttcaaccacgagggcacgctctcactggtccaaattcttcaaaatttggaggaaaaaatcttttaagcgcctaggctccctccctcctcttattagtgtgccaaagataccgaagtggaaaagcaaaagcagcagagaaaaccaagttctaaaaaatataattggaagaggtggctttgctgaggtttacaaagggtgtctccaagatggacaattaatagctgtgaagaaattgagtaaagggaccacagatgaaaaaaccgcaggctttctatgtgagctaggtgtaattgctcatgttgaccatcctaatactgcaaagctagttggatgttgtgtagaaggggaaatgcaacttgtctttgaactctctacactcggaagtttaggatctcttcttcatggttcagataaaaagaaattagattggagtaaaaggtataaaattgctctgggaatagctgatggtctcctctatctgcatgagtgttgtcacaggcgaatcattcatagagatatcaaggcagagaatattctgctcacggagaattttgagccacagatatgtgattttggacttgcaaagtggttaccagaacaatggactcaccatagtgtatcaaaatttgaaggcacatttggctattttgctcctgaatatttcatgcatggaatagtagatgagaaaactgatgttttttcatttggggtcctacttttggagatcataactgggcgtccagcggtggatcatatgcagcagagtgttgtgatatgggcaaaaccattgcttgacgctaatcatatcaaggaccttgttgatccttctcttggcgacgattataaacgagaacagatgggttgtgttgttttaactgcatcaatgtgcattgagcactctcctatcttacgcccccgcatgagtcaggcaagtgaagaccatgttctgaaagctacaaaatcaagccgaaggaggcctctacaaagagcatactcagaagagctactagacgcgcaagaatacaactcaacaaaacatctaagagatctcaagcgatttgagcagattgcattgggttaa

SEQ ID NO: 20896 - DNA, 429 bp, Glycine max
  Peptide Sequence Number=SeqID_137674
atggttttctttctctatgtgcctattcttctttcactttctttctcgttccttctccatgtgtttaagaagcatattcacatttccttattggatcttgtcaccaccttcaactctaccaacataatgattgacaactacaagctttatcccaatcagattggttttattgaagatgttagtgaagggattgaagggtttatgacttgcaccaaaaatcttggtttccaaagcattgatattagtgataaaatcgatgataatgacaataataatgatgatgaggatgaagataattgttggaggaaaacaagggtgacagaaggtaaaggaaactttcctccaccactttcgtcgttgaatgggaatggacaacctagtttcattcttgtaccggtaaggaaaaatggaaggttacaactcagcaaa

SEQ ID NO: 20897 - DNA, 2970 bp, Glycine max
  Peptide Sequence Number=SeqID_137675
atggaaggggtggatgcaccaagcacaagcagagtcgctcgccctgtgtctaaactccaaacggaagcagagagagagagagaaggaaccgtctccgttaaggtcaaatttcctcaaccaccaactaaagcgcgccggagctctccgccgccgcgtacggcgaatcccgacgcctcttattcttatgctatattcgatcgcccgcgttccgcgactctcgtcgacggaattcccggagcaagagcagcaatggattcgttccttcttccttcaagttcatatcgtcttgcattaagaccgcctcttccggcgtccgctccgccggagcctccgtcgccgcctccatctccggtgacggacacgaccgcagagaccaggctagaactcagtccgtcttctttcaagcatgttctcttactcagctattccaatggatttcaagttcttgatgtggaagatgcctccaatgtaagggagcttgtctcaaaacgtgatgatccagtttcatttttacagatgcagcctatccctgcaatatcagaaggctgtgaaggatttagagcatcacatcctttactcttggttgttgcatgtgataaatcaaagatccctggtaaaatgctaaatgtcagagatggccataatgaagctcaagcagaaaatattgtcagctcagctacagcagttcggttttactcactaaggtcccatacttatgttcatgctctgagatttcgttcaacagtctacatggttagatgcagtcctcgaatagtggctgtgggtctagctactcaaatatattgttttgatgctcttactcttgagaataagttcagtgttctcacttaccctgtgcctcagttgggaggacaaggaatgattggggttaatattggctatggtccgatggctgtagggccccggtggttagcttatgcctcaaacagcccattgttgtcaaacacaggtcgcttgagtcctcagagtcttactcctcctgctgtcagcccatcaacatcacccagcagtggaaacctggtagcccgatatgccatggaatctagcaagcatttggctgcagggcttatcaatctcagtgatatgggatacaaaacattgtctaaatactatcaagatctaacacctgatggatccagttctcctgtatcttcaaactcgagttggaaagttactcgatttgcattaaattctacagaaacagatccagctgggatggttgttgtcaaggattttgtttctagagctgttgtggcacaatttagggctcatactagtccaatatctgccttatgttttgacccaagttcccaaagcagtgattggaactattcacatgtgcacctttacaagctccaccgtggcatgacatctgctgtaatacaagatatttgttttagccattacagtcagtgggttgccatcatttcctccaagggaacttgccatatttttgttcttgccccatttggtggtgagacagttcttaagatgcacgatcaagacactgatgggcctgctcttttgccaatttttcctctaccatggtggttcactccacatttcccagtaaaccagcagcagttgtgcctgacacccccacctcctgttgttctttctgtggttagccgaataaaaaatagtaatgctggatggctcaatacggttagtaatgctgcgtcttctgcagcagggaaagtctcaattccatctggtgctgtttctgctgtctttcacagttccattcctcatgattcacacaattcatacttaaaaaatcatgccatggagcacttattagtttataccccttctggtcatttaatccaatataaactactaccaccattggcggcagagtcaagtgaaactgtttcaagaacagccctagttccttcagcacagatacaagaagaagatttgcgtgtgaaggttgaacctgttcaatggtgggatgtctgtaggagatatgattggccagaaaaagaagtgtgcatattggggaatactgttggtggactggaagctgcagaaatgatcttggatagttcagattatgaagataataatagcgtcaggaacaataattctataaaacttaataagcaatgtcacttctcaaatacagaggtacatataagctctgggcggataccaatttggcaagaatctgaggtgtctttctttgtgattagtcctttggaagctggagagctgaatttatgtgaacttaatacaagtggagaaattgaaatagagaatattcctgttaatgagattgaaataaaacagaaggatctgttgcccatcttcgaccatttccatagaattcaatctacttggggtgacagaggtattgttatgggaagatactctagctcttcatctgattcacatggaactgaagagaagttgtcagaagatgctgcaattttccattcaaagttgatggtacctggcttagctgaaaagacatttgttgcctcaaaagtcaaaactgttgacacaaatgatgtttcagcaggtgcctcaaattttgcagatggtgcaaatgcaaaggtaaaatcatcaaaacatgaaaaagccggtgacagtttcaattcaagcttaagtggctgtgatttgaatatgaatgtaacttgtgaggagtcaatacgtgactcaccagactttgagcaatattttcaagaaggttattgtaaagcatcagttgactgtcatgaatcaacagaggttattactgatgtggattgtagcagtccctgtggcagggggaaatctgacgaagatggtgataatgatgacatgcttggtgatgtatttgacttctctgaggaagggaacaatggtgacgatgaaagtgatggagatgaaaataataccaacaatgatggtgacgatcttgggatcaataatgacgatgatgatactacaacaaggggaacctaa

SEQ ID NO: 20898 - DNA, 618 bp, Glycine max
  Peptide Sequence Number=SeqID_137676
atgcagtcctctgaagatgggcgcgtgcagccttctgaagggggggcgtgtagccctctaaaggcgaggacgtgtagtcctctgaaggcgagggcgtgtagccctctgaaggcgaggacgtctagtcctctgaaggtgataacatgtagccccctgaaggtgaggacgtgtagccctctgaaggtaaggacatctagtcctctaaaggtgagggcgtgcagccctctgaaggtgagggcgtgcagccctctgaaggcgaggacatgtagccctctgaaggagaggacgtgcagtcctctaaaagtgaggatgagcagccctttgaacacgaggatgtgttgccctctaaaggcgaggatgtttagtcctcaaagggcgagggcatgcagccctctaaaggcgaggacttgtagtcctctaaaggtgagggcatgcagccatctgaagatgaggacgtgcagtcctctaaaggcgaggacgtgtagtcctctgaaggcgaggacgtgcagtcctcttaaggcgaggacgtgtagtcctcggaaagtaaggacgtgctgtcctatgaaggcgaggatatgcagtcctctgaaggtgagggcacgtagtcctctaaggtga

SEQ ID NO: 20899 - DNA, 813 bp, Glycine max
  Peptide Sequence Number=SeqID_137677
atgacaacaggtagatcactagacaggaaagttgtgaaggcttctggaaagtgcaatccaaagacaggattcattggagtgagaaattcgcccaaaagaacaaataaattggatcaaaaagcaagaggatgcggtcaggagttgactgataaagagaatcagtattttccatttaaggaacatatgagaaagtgcccagaacttcccaacaagtgtacttttcttacagaaaagagagaggctattgaacttcatcctggacaaatgctcacttccgcaaaaatcaagttacaactttttccaattaatgaaggaactcggataggacttgaaaaggatgggcataatccttatttagaactcacacttagaggtcgaaagaaaatatgttcaatactaaaacaccttggaaagaagtggggaagttcaagtatagccaaaggggagcttatgctttttccatataatataatggaaaatctatctggctgcagaaggtggacaattaatgatagtgacacaacagcctctgctgtttatactgctgttggaagccctgcactcttccggttgaagtatggctggttctacatgcttgaacccgggtcttttggtataccttccacaccaactcccgataagcctgatgtagctggaagcggcaatgctaatttagaggagactttatgtggtgagcgggacaaggttaggataagcaaagaatacaaagcaactgaagtgggcaatgcagcaagtgaaactgtgtctcagaaagtagaaaacgcaactgttgatcctatggtaaacttatag

SEQ ID NO: 20900 - DNA, 234 bp, Glycine max
  Peptide Sequence Number=SeqID_137678
atggttgagcctgttgttaagattcggactttgcgtgcacgtctgattggagttgatcggaaagacctaaataaaacatttattcaacttacactagagattttggctaaacagaaatttgaagcatatgactcaaaaggttctgtggtagctggagataaaagcaaggagttttccaacagtttgtctccagggcacataagcaagagtattgaagaaaacagaagaggatga

SEQ ID NO: 20901 - DNA, 861 bp, Glycine max
  Peptide Sequence Number=SeqID_137679
atggtttctgtccttccgaagaggataatactgatgcggcatggggagtcacaggggaacctaaatacagcggcttacactaccacacccgatcacagcattcagttaacggcgcagggcatgacccaggcccgccacgccggcgagcagctccgccgcgtgatgggcggcgatgggtgttctcctgactggcgggtacaattctatgtgtctccctacggacgcacccgatcaacgctccgcgagctcggacggcatttttcgagaaagaggataatcggcgtgagggaagagtcgcgggttcgagaacaggacttcggaaactttcaggtggaagagaggatgaaggtgataaaggaaacacgtgaacgttttggaaggttcttctatcgctttcccgagggagagtccgccgctgacgttttcgatcgcgtttcaagtttctttgaatctctgtggagggacatagacatgaacaggcttcgtcatgatccttccaatgatctgaatttcgtaattgtttctcacggtctgacatcgcgtattttccttatgaagtggttcaagtggacggttgagcagtttgagcacctaaacaattttggcaactgcgagttccgcgttatgcagcttggaagtggtggagaatacagcttagctgttcatcacacagaggaagaaatgctagaatggggactctctcctgagatgatagctgaccagaaatggcgcgccaccgcgatcaggggtgactggaatgatcagtgcccctggtaccttgatgctttttttgatcatcttcctgatgatgatgctgtggaaaatgaagctgaaactaattctttaagtgtatgtgcatag

SEQ ID NO: 20902 - DNA, 330 bp, Glycine max
  Peptide Sequence Number=SeqID_137680
atggattctaagaatgttgttgcttttcaagttgtcacattttgtatatgcttggctgtggcaaattcagttgactttggttacccagcagttttcaactttggtgattcaaactcagacacagtggattcgatgaaatttccattcttaaatgcctacatggattcagtgggtttgccaaattttcagcatggatgcaactttgcagcagcaggttcaactatccttccagccactgccacatccatcagctcgtttggatttgaggttcaggtatttcagtttctgagattcagagctcagtctcttcaatttcttcaaggtatatga

SEQ ID NO: 20903 - DNA, 231 bp, Glycine max
  Peptide Sequence Number=SeqID_137681
atggatagcaaccaactcaatggaacactgctgagtgtgatcagaaagcttagacttgtcaccttaaccgcatcaaggaacaaccttgaaggtgcaataacagatgaatggtgccaacataatcttgttaagttagacctatctcacaataaattctctgttgcaaggccaactttccagtcaggtatgccaactagagcaaatcaatatcttggacctttcgcgaaataa

SEQ ID NO: 20904 - DNA, 279 bp, Glycine max
  Peptide Sequence Number=SeqID_137682
atgatcgatttccttcggtttttccaacgttttccacaaataaacgttggtggtgactctgcgcattttcctcctttggaggacgcacccggatcgtgcccgcaagtggacccgaagaagtccaatagggtcttggagttgccagctctaattacggacctctgtcaattctacggagtgcctgtcgcccccagcagagtcatcaggccccctactaatcgagctttcatcaagaagtactgcacccccaggcaggcgcagggcgaaacaccacagtag

SEQ ID NO: 20905 - DNA, 366 bp, Glycine max
  Peptide Sequence Number=SeqID_137683
atggagaattggcgaacaacactaggcaatcaattcgcagggctccagactcgttggtggaggatgcatgaacgacaatcaattcatggggctccgaataaaagtggagaatggaaaattgcgctaggcaatcacatcgcgtggctccagactcattggtggaggatgcatgaacgacaatcaattcatggggctccgaataaaagtggagaatggagaattgcgctaggcaatcacttagcgtggctccagactcattggtggaggatgcatgaacgacaatcaattcatggggctccgaataaaagtggagaatggagaattgcgctaggcaatcacttcgcgtggctccagactcattggtga

SEQ ID NO: 20906 - DNA, 330 bp, Glycine max
  Peptide Sequence Number=SeqID_137684
atggacccttctcatgaagtagaacctccaaaggttgagaatttgaagaaggtggactacacccccatttgtatacatgtaactgcatattcacctggtttgcacatctccaaggccactaaaattaagatcgttgcatatagagtgtgccctcgtctacccatctggtatgcaactaagaagaaaggactcaaactctattactgtgttgaaatgcctactaagaaaattatggtagaagtggtgaacattcccaaaaattggagttctctcttcaatgggaaaaggttgattcaagatccagacatgtatgatgcaaagaaatcctag

SEQ ID NO: 20907 - DNA, 1096 bp, Glycine max
  Peptide Sequence Number=SeqID_137685
aaagaagcgatttggacggcgacgactcttgaggtgaagattgcgcaactgagacttgaggaggaagcgaggtttggtgttgttggtgatgctgatgagattggagaaaagaacggccatgaaagaaaatccacatggctaatagacgttatccgctttcagacacagccaaccaatccagaccacccgaaatccgaaccaaatcataggacaaggaatgatgtggaagagaagaagcacacttctgcacttgaagttgaatccttgctgatccccatcatgggaactatttttcctcctcactctctctctccactcctcaacatcaaaccttcaccctcaagaattctcttggctccctctccgcaacccaagtcaaattctctcttttgctcgaaacccattgtttctagtctcagaaagaaccaaactttatctcctaaaccttcatcaggcacaagctggttggctcatgctcaacaaggcctagcagctttggctatctccttggcactcaactttagcccagttttgttcaatggcaatgcactggcatctgagtttgatgtacttaacgagggtccacccaaagattcttatgtgtttgatgatgcaggagtgcttagtagggtaaccaggtccgatttgaagcagttgttgtctgatttggaatcaaggaagaacttccggatcaattttataactgttcgaaagctcacgagcaaagctgatgcatttgagtatgctgaccaagtcttggagcgttggtacccttctgtagaagaagggaacaagaagggtattgtggtgcttgtcacgagtcagaaagaaggagcagtcactggtggcccggcttttgttgaagctgtgggggaaaagatccttgatgctaccgtctcagagaaccttcctgtattggctacggatgagaagtacaatgaagctatttttagcactgctaaacggctagctgctgccattgatgggcttccagatcctggtgggccaacagttaaagacaacaaacgtgagtctaatttcaaaaccaaggaagagacagaagagaagcgtggacaattcactcttgtagttggag

SEQ ID NO: 20908 - DNA, 531 bp, Glycine max
  Peptide Sequence Number=SeqID_137686
atgaaggtagacattaggcatgctgttgtgaacgttgatttaagactaaaccaaaaactctgcctcagtggcagaaatggacaagcagaactgcagaaggtgtatgatgatagaaaagaaaaggaggcaatggagaataataagaggtgggtgccacctatagcgggtgtaaaggagatcgggccgtccattccctttgcacctgaactcgcgctcgatgaagggacacgtggcgggatcatagggcgggtacgattcgtccaccacccacgttcccgtgaacacatcgcactgcgcataatccaaagccgaagaagaaccctttcctctcactttcgacaacaacaacccatgaagaaggaagaagaacagctgcagacgacaagagacaacaccctcacccattttcttaatctctctctcttgggtacgaggagagacaaagaatatggtaatgcagaagaaaggggtatggagagggttcttttctctctgatgagttatgagtatttgtgttgttctatccactaa

SEQ ID NO: 20909 - DNA, 1062 bp, Glycine max
  Peptide Sequence Number=SeqID_137687
atgggccgtgcaagaataaccttgaaacctatttcaaatgagagatctcgtaagtcaactttcaagacgagaaaggaaggactaattacaaaaatttctcaactttccaccatgtgtggagttgaagcctgcttgattgtgtatgatgacatcaatggtgatgttggagctgtgacttggcctgaaaaccccacattggtacgtcccatcattgaaaactatgagcgtcaaagggctgaaaaacctcccaagacctttgttattcaagactttttcgagaataggaagaacatggttgaagctgagatttccaaattgcataaacaggccagagagatcaagtatccaacttggggtccaagtttgagtaatatggaaaaggagcaattgagtgcattcattgctaatgtgaatgctaagattgaagcttgtgaccagagaattcacatcaaatccatgcaaaatatggctaaggaaagtgcttcttcctcccattcaagccaactcaatttcatgcaaaacatttctcaaagccaaatgatccctactcatgtagagccactacttaatgataataataatgggagggtgttgaattcaacaaatcaggttggtggagcttctagtcatggagttagcatgttgagaaacattcaacaaggtgatgtttgcgttagttacatgccaagcatgtctcagagccaaatgatcgcacttgaaacttttaagtcactcaaaggaaaaaataagatggtagattttactaatcaagttgttgttcctctagattcaactaatcatcaacttggtgagtctttggattgggctaatcaccatggtagctttgactgggctaatggacccattggaactgaggattggtcgaatccactaaatggtgatcttgtgggtagtcaacctgatgaatcagtcttgcagaatattcccattctatctgagaatgatcatcaaggagtagttttacctaccttgccactatcattggatggatttcaaacagattgccgtaatatgttttttcgaatgagtaactccaagtaa

SEQ ID NO: 20910 - DNA, 195 bp, Glycine max
  Peptide Sequence Number=SeqID_137688
atgactactttggaattacatgctcgatcgtgtacacaaacataccaagagaggaagaggaagggaaggaaattagtaggaaaagaagatggcgcagaagacgaaggtggtggtggagcagtggtggcggatggtggaagggcggtggaagaggctgagacagttatggctaacctctgcccgtcgttgcagtga

SEQ ID NO: 20911 - DNA, 1203 bp, Glycine max
  Peptide Sequence Number=SeqID_137689
atgttctattcctcaacttccttctttctttgccttctattcttctccgtaacattttctcatgtttttggggataaagtatttacgggaacatatggagtaaactacggtagggtagcagacaatctaccttctcctgagagtgtggttacccttctgaaagctgcaaagattaggaacgtgagaatatatgatgctgatcgtcaagtcctgagtgccttcaaagggtcaggaattgcaattagtgtttgtgtaccaaatgagcttctgaaggagataagtgtgggtgaggatcgtgccatgaattggatcaaacaaaatgttgaaccatatcttccaggaaccaaaatccgtggcatttccattgggaatgagatattgggaggaggagatatggagctttgggaagttttggtgcctgcagctaaaaatgtgtatgctgcccttcaaaggcttaacttggcacatcaaattcaggtgtcaactccacattcagaggctgtgtttgcaaactcataccctccatctgcatgcacttttagggaggacatactccctttcatgaagcctctattgcaattcttctcacaaattggcactcctttctatataaatgcataccctttcttggcctataagaatgacccccaacacattgacataaactatgctctcttcaagaaaaaccctgggatttatgatgccaagactaagctacactatgataacatgtttttggcccaagttgatgcagcttatgcagccttggagaaacttgggtttgacaagatggaggtcattgtttccgagactggttgggcctctaaaggggatgacaatgaagctggggcaacagtaaaaaatgcaaggacttacaataaaaacctgcgtaagttactgctcaagaaaaagggtaccccttataggcccaagatggttgtcagggcttatatctttgctttatttaatgagaatttgaagcctggccctacatctgagagaaactttggattgttcaagccagatggaagcatttcatatgatataggctttactggccttgtaccttcctcagcaacaacctcgtcttttctttccttcaagcacgtcaatgctgatgctgtagcatttgttcatttcagggtattggatctttatatgcaatggtttctacaagctgtgcggcttttcttcttcttgtag

SEQ ID NO: 20912 - DNA, 795 bp, Glycine max
  Peptide Sequence Number=SeqID_137690
atgttgaatgagttgttgcttcttcttgttacaagtcaagaggtcaagcatattattttcttcaggaattattgggacattgttgctactgatatttggagtctggtggctgaagcctttgggactggaactattaatccagatttggccaacactcttgtagtccctatccccaaaattgatagtcttacgaaggatttcaaacctataagtctctgtaatgtgacccttaagattatttctaaggtttttgttaatcatattagaccatacttggataatctaattggctccttgcagagtagtttcattcctaaccaagggacaattgacatgctattattgcttaggagattgcgcatcacatgcacaagaggaaagacatacttcatgcagaatttgagatttaattggggggaatctacgtctcatagagtgaaatggcctaccttaactagatcaaggagagatggtggtctgggaattcaatctgctagggagatacaaatgttgcgttgctgggcaaacacatatggactcttttgcttgatgatcaaaagctttgggcagcgatgcaatttcataaatatcttacgaaccaagatgttctccggtctcaagcgcctacagggagttcttatttatggttctcaatttctaaagctattgaggatcttcgcgttggcaagggtgacatcttcttttggtatgatagatggttacctggtgactatctttgcggcatggtggattatgttagtatcatggacactcacatgctatggatctctttga

SEQ ID NO: 20913 - DNA, 309 bp, Glycine max
  Peptide Sequence Number=SeqID_137691
atgaacactggacattattgcttagatgaatctgatgacgattcccaagttagcaaccagggaaatgcaagtgggagacaacaacctatgcacacacaatgcaagttcggagtcaatggtaaaaacaactctctggcagatggaggtttggtggttttggtgatgcgattaggggaaaaagagaagaagccattgcagcggcacacagcggagatcgacgacaacaaaggaaacagagggcgagagaaagtagaggaaggaaagaaaagagagaaaaaggacgcccacaacggcatgacgatgagatag

SEQ ID NO: 20914 - DNA, 381 bp, Glycine max
  Peptide Sequence Number=SeqID_137692
aaatggctcttgtctcagtcaccaccgcaaattcttcgaagttcattctcttacgcactctctctcgttctcacgctttctccttcgctctccaccgtcaattccaactactctcgtcttcctccgctgtgctccgccgtcttccccggttcctcgccgcctcccccggttctccgctcccaccttccgaaaacgattccagcaggcaccttgaagatggatgatgttcagtcacgagcagatgttgctacatctttagccaaaattcaagatagaatacagatcttctttgctgttcttttctggatatctctattcttttgggcttctgcctgggatgggaggaatagaccaaacaagggatcaagatttagaagataa

SEQ ID NO: 20915 - DNA, 774 bp, Glycine max
  Peptide Sequence Number=SeqID_137693
atgttacttagaagctcctccgcaccaattctaacttcattgttattctattccaaggagttcccctccgaaccagaacacattcttcaccttcctaaaacagcatcagctttaagtctaagccaaagcttggtggatatagaccttaaaaactcatcaagtcccaggagaaaaaatcgtgtgccacttagtaatgttcctaataatcaacagagtataaagatcaatgaaagatatgaagggaaagatccacaacaaaaaactttcatgaaagcaaaaccttcaattctagaactgttttcaagcttcgatttagacaagggagtcctggatcatgaagagtgtggtgcggggaagaaagatagttggttacagacttcagtgatgggtgctggaatggggagtgatggtggttggatttgtggtggttgtaatggtagtggaagaggctcagatggtggacatggaagaaggtggggtttcgatgaaggaaatgatcacggtagagataggacggatgcttattaccagaacatgattgaagcaaaccccagtgatgctcttttgctaggaaattatgctaagtttttgaaagaggtttgtgaagattatcctaaagcaaaagagtatctcgaaagggcgattttggctaatcctgatgatggtcatattctgtccctctatgcggagttaatatggcaaacagagaaggatgctgatcaagctgaaggatattttgatcaggccattaaaagtgccccagatgataggtaa

SEQ ID NO: 20916 - DNA, 660 bp, Glycine max
  Peptide Sequence Number=SeqID_137694
atggttgtcccagcttggtactctcttcatataaactgtggtggaaagttaatttctaatggaaacatgaaatatgatgatgattcactagaagctggaccagcaagatttcgccgaaccggatcaaattgggtatttagcaacactggtcatttctttgatagcagtcgtttagactactatacctggtctaatacaactaagcttgctatggacaatggtgaactatatatggatgcacgtgtttctgccctttctctcacgtattatgcattttgcatgggaaatggaagctacacaagaaagttggtggtgaaggattttaatattgcaaaagaagccggaggagttggtaaggcaatcataaaaaagttcaatgttactgttaatatcagtaccttagagattcgcttgcaatgggccggtaaaggaacaaccggtatcccatttggatcagttcatggtcctcttatatcagctatatctgttgaccctgactttacacctcgagaagaaaatagagatggcacgcctgtgcagtttattgttgcaattgtagttactggagcacttgttatcatcataatatttggtatagcttggtggaaaggatgtctaggacggaaaggttcattagaaagaggtgaagggagggcatag

SEQ ID NO: 20917 - DNA, 513 bp, Glycine max
  Peptide Sequence Number=SeqID_137695
atggatacagattatctatcaaggagcacattcagacttcagacacatatattgattgactttattcaaaagcattttcatcaagatgtattcttgccttttcagtatctttgtaacattatgggtgcatctatggaagatctagctcgttgccctggcatagtaggagagcgcaaggtatattaccaatggtcaagcgcttgtttgacacttttcatgaacccttcaagcatgtggaatccagccggcaagccattccagagacttctgtccagaacaagccagctagtccgtccagtctcatcgatcaggaacaatgctgaatcttcctccttgattgaagacaagcatgaggatgcagaagatcttttgccaaatattctggtagagttggaaagaggaaaagcacttcacaggtggaggaaaaaggagaatcaattatttccaaagaatcagaagctgaaacataaaattaccatgaagtttttcactggttcaataatttacccataa

SEQ ID NO: 20918 - DNA, 1011 bp, Glycine max
  Peptide Sequence Number=SeqID_137696
atgaattactcaaaccgaaatggaggaatttgtatccttctctttctcttcctccttccttttgctgcggcacaacatggcaaccaaaacgaatcgtattacaacaagttcagcccttccatggcgatcataatcgtgatcctcatcgccgcgctgtttctaatgggcttcttctccatctacatccgccactgctccggctccccctccgccagcatccgcaacctccctgccgcctccgggaggtcgcggcgcggctcgcgcgggctcgaccaggcggtgatcgacacgttcccgacgctggagtactcgacggtgaatatccacaagctgggaaaggggacgctggagtgtgcggtgtgcttgaacgagtttgaggacaccgaaacgctgcgtttgatccccaagtgcgaccacgtgttccaccccgagtgcatcgacgagtggctagcttcccacaccacttgccccgtgtgccgcgccaacctcgtcccccagcccggcgactccgtccacggaatccccatcctcgacgctcctcaaggcatcgaggcccaacagcaacaagaccccaaggccgaacctcaagtgctgacactaaaccagacgctgaaccggaaccgcaccagaggctcccagtcgggccggccccggcggttcccgcgctcacactcgaccggccattctttggtccaacctggcgaggatactgaacggttcactctgaggcttccccagaaagttagaaagcagatactgcagaagccggaactgcatcgcgcgagaagcttggttatcttaccgagagaaggtagttcgcggcggggatatcgaaccggtgagggaagtagcagagggaggtcctcgaggcggttggaccggtgggttttcagcatggcgccggctttctttgtgagagcgtcgtcgattaggtcgcccagggtggccaataacggcgccgacggaacttccgctactgcgcctttgccgcctgctgtggagtctgtttga

SEQ ID NO: 20919 - DNA, 582 bp, Glycine max
  Peptide Sequence Number=SeqID_137697
atggttcaacatcatatggctttgaagaacttgcagaaaagggtgtgtgcttcctcttccttgattggcaatgtgcagaagcagaggtggaacaatgaattggtcaaaaggtttggtagtgcactgaagttgctgtcaccgaagggaaaaagtctaatagggtgtttcccaggaggaggggcagaagatgggtttggagaaacgatgatcgtcacttccctccatgctttgttactcattgctagagaattctttccttgggggcttgggagtgcactgatgcaggcaagtgagaacatcaacaggttgtttgagaacatgaatctgagaccttggtctctgagtggaggtatgaaagagaaggatgagcattacaaacagggagagcacaaggaagagaaagatgatgatgagcattggtcatcaacaagtagctatggatactataacacaagcctgcttttgcctgatgatgccaaggctgatgacattaaggcagagttgaaagatggtgtcctaactgtaaccattcctaggactgagaagcccaaaaaggatgtcaaacaagtcacagtagaatga

SEQ ID NO: 20920 - DNA, 807 bp, Glycine max
  Peptide Sequence Number=SeqID_137698
atggggaagttatcgatcaagttgcatgataagtgcaggaaccgcaaggaatcatcatggccattaacaaaattcaaatctatcatggtatatacaaagaaggaacatgttgccattaaatgggtgaagctacaagacaatgacgaaaggggaactctcacatcccttttggagacacaattttttagagaagtcacacatctacctcgtctccaccatcaaaatgttgtgaagtacgtagccgcatgcaaagacacacatttttattttattctcacggagtatcaacaaaagggttctttaagggtgtatttgaacaagttagagcacaagccaatttcttcgaagaaggtgatatcttttgctttggatattgcacatggaatggagtatgtacacgcacaaggtatcattcatagagaccttaaaccggagaatgttcttgttgatggggagttgcaccccaaaattgctgattttggcatttcttgtgaggcttcaaagtgtgactcattgaggggtacttaccgttggatggcaccagagatgataaaaggaaaacgctatgggagagaggttgatgtgtacagttttgggcttattttgtgggagcttgtgagtgggacagtgccatttgaggacatgggcccatgccaagttgctgttgcggtggcaaataggaattcaaggcccattataccttcggattacccacatattttagtttgtatagatggaaccatgaatgtagtgcaaaggcattgtagcgaggatcatagtcatctttttttgatggaaggatcatag

SEQ ID NO: 20921 - DNA, 861 bp, Glycine max
  Peptide Sequence Number=SeqID_137699
atgcagggcattttatcaaatggcacgataatagctgtcaagatgctttcatctaggtcaaagcaaggaaatcgtagtggagaatctcgattaaaattggattggccaacaagacacaagatctgccttggtattgctagaggtttggctttcttacatgaagaatcaagattaaaaattgttcacagggacattaaggccactaatgtgttactagacaaagacttaaatccaaaaatatctgattttggtctagccaagctcgatgaggaggacaatactcatataagcacaagaatagctgggacttatggatatatggctccagaatatgcaatgcatggttatttgacagacaaagcagatgtgtatagttttggagtggttgccttggaaattgtatctggaaagagcaataccatccaccgacccaagcaagaagcattgcatcttctagattgggcacatttattgaaagagaaaggtaacctaatggagctagttgatagaaggttaggttcaaatttcaatgaaaatgaggtaatgatgatgatcaaagtggctctcctatgcaccaatgccacttcaaaccttaggcccaccatgtcatcggtgcttagtatactagaaggaagaactatgattccagaatttatttcagatccatctgagataatggatgaaatgaagttagaggcaatgcgacaatattactttcaaatagaagaaaatgagagaaacgagacacaaacagaaagtcatagtttatcaattgatgggtcatggatggcttcatcttcatcagctgcagatctatatcctgtccacgttgattcttcctattgggagaaaagaaattag

SEQ ID NO: 20922 - DNA, 317 bp, Glycine max
  Peptide Sequence Number=SeqID_137700
atgtgggcccccactccgcccccaccgtgggatttggagaattattgtgaggagaccatagttgaagaaacaccgtcatcttcttcgtcctacatcgtttctgccccacaacagttctcggaagcccacggtagtggcggagttgttgaaggcagcggtgcagaagaggggacacttgggaagaagaattgggatttcagtgtggatccatgcagtgggcaaagtaattggacttcatttgttcaagtgaagggatttgaaaatgctgtcacctgcatttgccttgcaaatgccagtatctgccatgttgttagcat

SEQ ID NO: 20923 - DNA, 937 bp, Glycine max
  Peptide Sequence Number=SeqID_137701
caagaatggaacttgcgaagaagacagcagagagcttcatgacacaagcagcaggctcattacttcaacaacgttgaattctagcccagatgtgaaaagtgggtgtctcaatgggggaaatttgagcaggaccccagcacctaaatttagaggagtacaagtgttcacctatagggaattagaaattgccacggatggattcagcgaagcaaatgtgattggtagtaatggaattggagggcatggtttgatgtacagaggtgttctaagtgatggcactatggcagcaattaagttgcttcacactgagggtaagcaaggggagcgtgccttcagaatagcggtcgatctcctgagtcgcttgcactctcctcattcggtggagttacttggctattgtgctgaccaacaccacaggatagcccttgattgtgccagggcactggaattcttgcatgaacatgcagtctctcctgtgatccacagagacttcaagagtaacaacgttctactggatcaaaacttgcgtgccaaggtgtctgattttggattgcctaagatgggatcagacaagaggaacggtcaggtttccacccgtatgttggggaccactggatatttggcaccagagtacgccatgggtaagcttactacaaagtcagatgtttacagctatggtgtggttcttcttgaactgctcacgggacgtgtgccagttgatatcaagcgggccccaggagaacacgtccttgtctcttgggctctcccaaggttgacaaacagagaaaaggtgattgaaatggttgacccagctctacgtggacagtactcaaagaaggatttaattcagatagctgccattgcagcaatgtgcatacagccagaagctgattacaggccgctcatgacagatgttgtacaatcactgataccactt

SEQ ID NO: 20924 - DNA, 594 bp, Glycine max
  Peptide Sequence Number=SeqID_137702
atgcagcaagctccattcttaaactctctccatataaactgtggtggtgcaagagagacaagcagtgaaggtataatatatgatggcgattcagattcattaggaccatcaacatctaaagaggtgggagaaaactgggcaattagcaacactggtcacttcttgaatagcaatgcctcagaaacctatatccaacaaaatacaactaggctttctatgcccgataatgccttgtataagaccgcgcgtgtgtcccccatttctctcacttactatggattttgtctggaaaatggagactacactgtcacgctccattttgcagagatagctttcactgatgatgatacatataagagcctagggaggcgtatatttgatatttacattcagagaaaactggtatggaaggatttcaatattgcatatgaagcaggaggagttggaaaggaaattaaaataccatttcctgcttatgtgaataataactctttagagattcgcttttattgggctgggaaagggacagatggtatcccatataaatcaatatatggtcctcttatatcagctatatctgtcactcgtggttag

SEQ ID NO: 20925 - DNA, 471 bp, Glycine max
  Peptide Sequence Number=SeqID_137703
atggcggccagaagggttatggcgaaggttaacaaagcattagctctctctggctgctactatccagaagcagaagcaactctagcttgtaaagttgtaaagcagaatagaagaatatgttcagcatcagctgttaatatatgggctaaccggttgatattttccctgtatcggatcagaaagcccactaggtcgggtggtttcggccagacacacaacacactcatatttgtttttggatttgggttgggtgggggtcacaggggaggggtggcgacacggtttgggggtgatgcgagggagggtgccaacacttgtgttctatatctggactgggatggaggagatagttttggatctatggagaaggcaagggggtgtgaggatttggtgagtgggcaaaagagaaatttcccaaggttgatattgctaatagcaaggattggtattgggaatagtagttccctttga

SEQ ID NO: 20926 - DNA, 792 bp, Glycine max
  Peptide Sequence Number=SeqID_137704
atggataatcaagggcatggacatgggcagaatccatctatggggattgttggaaatggacctcaacttccttatggttctaatccataccaggcaagccatataacaggttcacctggaatggttgttgcatcacctggaaccattcaatccactggtcaaccagccgcaactcagctaggacaacatcaacttgcttatcagcaacaacagcagcagctgcagcagcggctccaagccttttgggcaaaccaatatcaagaaattaagaaggtgaccgatttcaagaaccacagcctccccttggcgaggatcaagaagattatgaaggctgatgaggatgtcagaatgatatcagccgaggcgccggtcatatttgcgagggcatgtgaaatgttcatactggagttaaccttgcggtcttggaatcacactgaagagaacaaaaggagaacacttcaaaagaatgatattgcagcagccatcacaagaactgatatctttgatttcttggttgacattgtgcctagggaggacttgaaagatgaagtgcttgcatcaatgccaagaggaactgtgcctgttactgggcctgctgaggcacttccatattgctatattccacctcaacatgcacagcaagttggagctgctggtgtcatgatgggtaataagcctgtgatggacccgtatgctcaacagtctcatccctacaacatggcaccacaaatgtggccacaactactaccaccaccaccaccagagcaacaacagtcatctccagatcagtag

SEQ ID NO: 20927 - DNA, 276 bp, Glycine max
  Peptide Sequence Number=SeqID_137705
atgaagaaggtcacttcctctcaatttctcctccttcaactccttgccttatggttcacatcacttgcttttggagccaataccactcagccagaagaagtgcaagctctgaaagatatgggcaagatccttggtaagaaggaatgggacactgatatagacccatgttcaagccaacatccctggttcacacctaaggtggacaccgtagagaacaatgtcacttgcaattgctctatccccggtgacaacttctgccatgttgtttcaatgtaa

SEQ ID NO: 20928 - DNA, 213 bp, Glycine max
  Peptide Sequence Number=SeqID_137706
atgattagaatcctgaaattggccaaatacaggctaaaggcacaagtggagaatgacaaagctcccgagtggagaaggatgaaggcccaagtggagaaggatgaaagcccagaggcagagacactatcaagactattaattattgctgaatcgcaccaaatctgtctcagaaaaaccaagatctcggattcattcaccgttggatcgtcatga

SEQ ID NO: 20929 - DNA, 1132 bp, Glycine max
  Peptide Sequence Number=SeqID_137707
atggtttctgaggctgacctagaaaacgacgatcgatgttttttactgtacttcatcatgggaacctacttgggccccgacatcaaaggcgaagccaccaaaaaatcaatcttgcaaagagttgcggaggggcttcctccttacacattggagcaactaactcattcttgcatcgaagtggtggaattggagcgtgtctactattacattctcaggaacactgataaatcactcatcctcaacttaacctctttgcgccgtttcttccatggccaagcacagggtggagatggaaatggaaacaacaattaccctcaatttcctgagttgttccctcctgggtttcatcctcagtaccgcttaaaaaacaagcacaaagttattgataatgttgtgtttattaataaccctgatagcttctatattaggtctgaggatgttgagaggttcaagaggctgagtggtgtgcaggagttgcatgtggacagagatgttgccaggttgcaattgggtacttgttttgataacaacaatcgtgttccgagtaacagtaccatttcagaggggaaggttgagcctgatggtaatgttgagtcctgtggtggtgctggttcttctgagcttcaggatcgtgtgaatgttgttgcatccacgagtgacggcaccacgtgtcgtggtggcggtactaatgtgatgtatgatttcatggatactgaagatgatgagagtgatcctgataaggttgggccggctatgttgttccttccttcgcggccttctaagaaggaatggtctgatattgtggctgctaccaagaatggttttgcattgaccggaactgtggctatgggggggattgggccaaccatggggcttgtggacattggagagtgtgaagatgcgtacctgtttcgcttgtctcttccaggagtgaagagggatgaaagggaattcagctgtgaggttggcactgatggtaaagtgttgatatctggagtaactacaaccggagagaatactgtatcccggtactctcaggtatttgaaatgcaaactcagaacctttgtccaccgggccgattctccatctcattccagctgcctggccctgttgatccacatcaattttcag

SEQ ID NO: 20930 - DNA, 492 bp, Glycine max
  Peptide Sequence Number=SeqID_137708
atggatgctgcatgtgtgaaattgctacaagcaatatcagacaaggtagagaacctgaattggaaagttacacaacattcttgcaacggggatagaggatttgataacaggaacatttcaagggataagtctcaaatcataaggaatgtcacgtgtgattgctctttcaacaataacactacttgccatgtgacatcaattgcgctcaagggtctcaatatatctggacctatacccgatgaatttggaaatttaactcgactagaaatacttgatctcacttggaataatttcaatggctcaattccaaaaagccttggacgcctctcatcagttgtcaatctgtcacttttgggaaatcgacttactggttcaattccctcagaaattggtgacatggctagtctgcaagaactgaatttggaagataatcaacttgagggacctcttccccagagccttggaaaaatgagcaacttgctgagattgtga

SEQ ID NO: 20931 - DNA, 1698 bp, Glycine max
  Peptide Sequence Number=SeqID_137709
atgaagaaggggtttcagtttgcagggtatgataaagccaccataggaactataactcttgactgtcaaagtccctatggagagaagcgtaaccgatgtgcccttctaccacctaatgttcctattcttgctcattccttagaacgtacacaacgaaactggattgctaggtcaaattcccctactgatataattatacaagttggtgattctagctttcacttgcacaagcttgcaattgcctcaagaagcgaatatttgaaccggcttgtatttcagaggggaagcaacagagaaaaagctggtgacagcctcatcatccaaatgaaaaatcttccaggtggtaaaaaaacttttgaattagtagtcaaattctgttatggaagaaaaattgatattaccgcagccaacattgttccattgtattgtgctgcacatttcttggaaatgagtgaagatgttgaagaaggaaatctcatatccaaaacagaatcatttctaacctttctaatactatcttcatggaaagacacatttcgaatacttaaaagcagtgaatccatttccccttgggccaaggacttacatatagtgaaacgctgctcagaagcaatagcctggaaactgtgcacaaatccaaatgcatctagtttcacttgtgaaagtgaaacacccttaagtaataatagtgttgataattggtggttcgaagatgtatcatgtctacgtatagatcattttattgaagtgattcaatcaattagaaaacgaggaaccaaacctgagcttgtaggttcttgcatagaacattggacaagaaaatggttttcccaagtcacatttggacttgataaggagactcctatacccataactctccagttgcatagaatttcaactgagtgcttgattagcatacttcctagtgaagaaaattcagttacttgcaattttttgcttcacctaataaaggcaggggtgatgctgaagataaattctgagttgttgtgtgtgctagaaagaagggttgctttaatgttggagaaatgtcgtgttcctgatctcttggttaaaaatcaaggagataaagattctttgtatgatgttagtgtggtacttagggtgttacggttttatgtctgtggcatgtcaagtaatcaatcagcaaaaccccacagtgttggaaggttagttgatgggtatctcacacaagttgcacgggatgagaatctcacaatggagagtttcaaatcacttgttgaagcattgcctcaaaaagccagacactgtgatgacaacctctatagagccattgacatgtaccttaaggcacatccaaatttggcagaagaagatagaacagatgcttgtagagtcctagaataccatagattgtcgcacgaagcacgtcagcatgtgatgcaaaacgataggttgccattgaaattaactacagagtttgtccttttagagcaagtgaacatggcaacctcaatgacaagtaatggatcaaactaccgaaggacaaatgctcagacaatcatcagagtgaacaaggatatggaaaaaagacaaataacaaatgcccaggagataagcatgatgaaaaaagacgttgaaatgataaagtcacaactattggaagtatatagctgcaaaatgaagctccaaaaccaactgaagagatgtattcgttga

SEQ ID NO: 20932 - DNA, 570 bp, Glycine max
  Peptide Sequence Number=SeqID_137710
atgactatgtttctattttctaatatattctcctttaatttgcatgcttgtgtggtttccctagacgaggaggatctacttcatgacatcaacgtatacagaaaagttttgaaccttcctgttctggatgaaagtggcaaagcttcttgcttagctgaagagatagcagaaaatctagagcacacgaaatgtgaagactttcgtgactactaccctctgcctagttacacctccaaaattcctaagttccaaaagagcataaacaaatgcaagatcaacatcaacaccacaaaagatggggtcatcatgcctctctgtgtgcccaagttggaccccgatgctttgttttccaattataccaaatctaatcgcttctcaaagtatctgaataattccaagtataagatagcagggcttggttctgaggacgattggatggttcttattatcagcaccaacacttcttctggagatttttcctctgcaacttctctgcttgctggggctttgaagggtcactacctcatgctgccattcttcttgagcacgcttattgttttcttcaactaa

SEQ ID NO: 20933 - DNA, 1407 bp, Glycine max
  Peptide Sequence Number=SeqID_137711
atggagacagcctcagactatggagcattcatggagaaattcactttaccaccaaattctgcaccctctcttcctcttaattcactcacctttgcagtcaaagagatttttgacgtggaaggatatgtgaccggtttcggtaatcctgactgggcaaggactcatacagtggctacctctactgctccaacagttttggctctcctcagagcaggtgccacttgtgttggtaaaactgtcatggatgaaatggcttacaggctaaatcttatagttggaagtaatataactttcgtaactttcagtcagtcagtagattatatggaaatgacaaggctcctcaatgattattttgtctctataaatataaatggagagaatatacattatggaacacctagaaatccttgtgcacctgaccgggttcctggaggatcttctagtggctctgctgttgcagttggtgctgagcttgtggacttctcattaggaaccgatactggaggaagtgtaagagtgcctgcatcatactgtgggatttttggttttcgcccttctcatggtgctatctcagaatcaggagttatccctatgtcgcaaagttttgacaccgtgggatggtttgccagggatccaatgattttgagcagagtaggaggtgtaattctacaattgccagatgtagcaccaccaattagacctacttgcattatcattgcagaggactgtttccagctttcgagcactccatttgatgtagttacaggaactgtcatccaagcggtagagaagttatatggaggggatgtattgaagcatgaaatccttggagactatgtgaagaccaatgttccaagtttgaaacatttcatgagtaaagagaatacagaccaaatatatagcattccatcactggctgcactttcaagtgccatgcggttgcttcaaaggtatgaattcaagaataatcatggtgaatggatcagtgcagttaaaccagatttaggtcctggaatatcagaacgtgtatcagatgccttaaggacaacaggggagaacattgatatctgttattctataaaaaaggaactacacgatgctcttgcggctcttcttggggattttggagctctcatgatccccacagttccagggcctcccccaaaactacaaacaaatacatctgacttggaaatttttcgtgcaagggcttttagcctgctgtccattgctggagtttctggattttgtcaggtaagcataccactagggatgtataataaccttcccctatcaatttctctggtggccagacatggtgcagatagatttttacttcaccttgttgagagtctttatgacagcattaaagatagaaagcagcatatcacagagcacaaactttaa

SEQ ID NO: 20934 - DNA, 753 bp, Glycine max
  Peptide Sequence Number=SeqID_137712
atgcttggtctcggtaggtcccgcagttcgtttccttcgcaggttttcgacaacttcagcacgcaccgtaaactcaccctctgtctctcctcgttcaaaggggttgtcctcttgggcaacgtggccacctacgagtccgaggttctcaaatctctcaccttcacaccccttatcaccagcttccccaggcaggaatacatcatcaatgttagctccgtcaaaatcaacggcaataggttgtctttggacacttcatcatcagagtcgtccaatgaacaagatggtagtgtaggggctttaactcttttaagcacaattctgccctacaccaccatgcagagttcgatctataactctttcaagacatcttttgaagacgccgctgtggctatgaacatgaccagagtggcctcggtggcacccttcgagctttgttttagttccaggggcgagcaagcggggcccagtgtgccggttattgagttggtgctgcagagtgagatggtgaagtggaccatacatggaaggaactccatggtgagagtgagcgatgaagtagtgtgcttggggttcttggatggaggtgtgaacccgagaaattccattgtgattggagggtatcaattggaggatgtcgtagtgcagtttgatttagccacttccatggtgggatttagttcctcccttgtcgccaaaaataccaagtgttccgattttaaatttgctagttccatcactgcagactcgatttga

SEQ ID NO: 20935 - DNA, 477 bp, Glycine max
  Peptide Sequence Number=SeqID_137713
atgccattccctgacggctttcttccccaaccacaaccgaagcaacgaaatccccgcgagacaaaacgacaaggccctcagaaacaggtcaaactctcgaatcctccacgaccacaagccacccgcaacgcagaccaacacgaatgcaaaccacgccgatttcttcttcgtcagcctcctgttggcggttattttccctctccggccaccgacgagaaggctcagagtctggcaatcgccgcgcgcgatttcgccggcgagggagttgaagggctccggcaggatcttgagattgaacgcgacggtggaagccagttgaagaattttccgattggatggttgggaccagccgccgcgcctcttagcgcagaggattgtgggagttggatgagattgcgaaaggcgaagagaaataggattgaggaagcgagaatagatgtggattacggagattgggaatggaagggggtgatctga

SEQ ID NO: 20936 - DNA, 147 bp, Glycine max
  Peptide Sequence Number=SeqID_137714
atgggaaaaaagtggagcatacacacaagtttagagtatggtggaaaagctttagccatgaaacagctcgaggctcttataagacagttaatagagaagtaccttcctctcctgaccccttacacaacagagcttctcgtgggatga

SEQ ID NO: 20937 - DNA, 210 bp, Glycine max
  Peptide Sequence Number=SeqID_137715
tgtatgtctgttgtgccattggagatattcagatgggtggttgctggtgtggctgggttcatgtcagcaacttttgtggcacttaacctccgggcacatattatgtcagcagttggctctagctgtagcactaaaggtctacctcttcacagtaacagtatgagaggaaagtggtattatcatcattcagcatcaatgaattgtagataa

SEQ ID NO: 20938 - DNA, 3540 bp, Glycine max
  Peptide Sequence Number=SeqID_137716
gctgaaacaccaaagcatgataatggtgctcttgatgttggtactgtgttggattcatccaatgggattttagacaaagctggcagatggcacgtggagtttgagttcagtccacattctgcatcgcaagatcatgttaacccacaaccaagtccagaaagtgaatcaaatgacattggaactgggtttgccatgttcagtcaaaattttggggagtttagttcagggtcagggccaaatcaaaatttggaagtactgaagaaggctgacatttatcccactaatatggaattactgaaatttgaaggtgcaactccccatggtactattgattcatctctcacatcagaatctaatcaacctgatggatggaactttggatttaatttcaattctagttctgtgggtgaagacaatcatagttcagattcatatttcaaaaccaaaaacaatcaggatgataacaacagaaacaatgcttccccaactaatataaatgttgattcacatgtcaatttctttgaatcagagagtgatgttacaaaacatgagaagcccctaacaagctcagagaatcgtagggaagccatgcctctgtcaatttttggtgatgagacaccagatactgataaacatcctgtgactcaagatttatctccctatacaccaacatccccaataaggaacagcttcaacagccctggttccaacttttctatcaatgacatatggaatttatataatcaagctgaaaaccaaagttctcctaatatgacaccaaaagcaagtgaaaatcagattcatgcctcccctgaagtattgggctccagtttggttaccagtaatgataatttagatgatgacttctgggactataaggatgctgcaactgaaacaagatttaccaatgaatctgcacagaaaacttcttcaccacaagtcaatgagaatgtgttgcagtcttccccaacatttttaaattctgatttgaccaacggtgatgatgattttgtggatgattcatgggtgtttaaggatgctatctctggaacaataagtcaagatcacacaccttctctcgatcacagagatttaccacagttatcaacaaaactagagcaggttgattatgcagagttttatagcaaagtgaaggatgaattgtgcaattatgttctgttccatcttcagaatctcaagaaaactcaaaatgttgctgctctttcgggtgaagatgccaaagcaaaagctcttctggaggaaattcaggggattctctccatgggggtaatgggagaatctggcggtaggtctttcaggatttggcacaaagaattctccaagatactgcatcaggataatatgagcatccccaatgaatatctctctgaggattattgcccaagaaatgtctgctttaatgaacttcttgaagttttgaaggaacctaagttccaaccttttgagtcagaataccaactagcatcaaggttgttgatggccgagaaggatattaaatgtgttatggaacttttgaaagatacagtatcaacattaagaattctcaagctgggatcaacagaagaacaatctaattatcttaccatatggtccaaaatagcctttgtttgttctcaagagctgaaacatggtgcttatgtttggaagcaagctgtactacagaatacccatgaccagatattatctagcccgaaaggtaagctacatgattatgtcatgcctaatgtatatgctgctgatgtggatgaacttaagcagtctgaaataacctcttccttttctggcataggtgttcagtttatccttgcactcggagaaatttatagagtggcagaaattattggaacttcagccaaacttcacaaaccttggatgttatcaggtgccacagatcacaaaagtttgtgtgcccttttgaacgaatgttatggcatatggttggcttcaggacttgaagaagctattttgagtatatcaaattggaataattttgagccagatggcatttcaagggaattagttgaatccatcaagtatattcacgagcttgatgaacatgcacttcagagctttgtcatctctggagaacaaactacttgccagttgtcagccttgccagctggtttcataccagtcgttgcacaagtgagggaggttgaaggcggcgtgagaagcatgttggacatcaacctattcagagaggagaagggccacaaccctgaattcatccgcgaatcccagcgccgtcgtttcgccagcgtcgaagtcgtcgacgaggtcatcaatctcgacaaagaatggcgaaagcgtcaattcgagttggagaatctccgcaaagaatttaacaagatcaacaaggaagtctccaaactcaagcgtgctggcgaggatgcaactaagttcatcagtgaatcagaggaaaccaagaaatcgataggggagaaagaggttgaagttcgggaaactctgaatctcttgaattccaagttggaaactattggaaacctcgtccacgattccgttccaattagccaggatgaggccaacaatgttgtcgttagatcgtggggagagaagagagtggagcctaagctgaagaatcatgtggatctagttgagcttctcgggatagcagatacaaagaaaggagctgatgtagctggaggtagaggtttctatctcaaaggagatggtgttcgtcttaatcaagctctaataaactttgggcttgattttttggaaaaaagggagtatactttattgcatactcctttcttcatgagaaaagatataatgtcaaagtgtgctcaactagcccaatttgatgaagaactttataaggtaactggtgaaggagatgacaaatatctgattgcaacagctgagcagccactctgtgcatatcatttagatgattggatccaccctacccagctaccattaagatatgctggatattcatcatgctttcgtaaagaagctggatctcatggtcgagacactctaggaatattccgagtccaccaatttgagaaagtggagcagttttgcctcactagcccaaatgacaatgattcatgggacatgcatgaggaaatgctgaagaactctgaagatttctacaaagcgttaaaccttccctatcaagttgtttccattgtatctggtgctttgaatgatgctgcagcaaagaagtatgatctagaagcatggtttccagcctctcaagcttacagagagctagtgtcctgttcaaactgtacagactatcaggccagaagattagaaattcgatatggtcagaaaaagagcaatgagcaaatgaagcaatatgttcacttgttgaactctactctaacggctactgagaggaccatttgctgcatactagagaacaaccagaaggaagatggggtagagataccagaagccctcaggccattcatgggtggaaagactttcctacctttcaagaaccaaccatctaatgaagccaaagggaagaaatcgaaggcctaa

SEQ ID NO: 20939 - DNA, 514 bp, Glycine max
  Peptide Sequence Number=SeqID_137717
atggcttattcctttgctatgatcatcagcttcctcctctgcctcatgagcacactctcccactctctctccccagtttggttcctaatcccagtcactaaagacgcttcaaccctccaatacataaccacactttcctatggcacccctttgctgcccaccaaactggtgcttgatttaggaggtccttttctctggcttcactgcgcatcacgtaacacgccttcatcgtcttccctaaccaccccccaccgttccctccaatgcttcacggccaaaacccacaaatccaccaactcctttctctccagccccgtggacgaagtccaccagtaccacccatgccaagttttccccgaaaatagcatcaccggaaccgtcgcctccgaaggagaactcgtcgaagacctcatggcccttcaatcaccccaagaagaagaaggaggacaacttgtggaacaccagagtctcttcacgtgttccccgaccacgctcttgaacggccttgccaggg

SEQ ID NO: 20940 - DNA, 255 bp, Glycine max
  Peptide Sequence Number=SeqID_137718
atggagaaactaattctaggacttgagccagtgatcactaggtcatcaggaagcaatcttactgtaaggttgctccaaggctcaccctttttctatactgttgtggcatatctgatgaagactcgaggaatgagtttttttgaagctctgaaacatgtgaagagtatacgaccagcagcaggtcccaatcagggtttcatttgtcagctggaggactttgaaaagtctcttcaaggtgccaataaattgcattag

SEQ ID NO: 20941 - DNA, 264 bp, Glycine max
  Peptide Sequence Number=SeqID_137719
atgaggacacgcaaaggagggagaggaaaggtggtggcacaacattgtgaaaagggtgcaagggtttgcatggtggaggacgaggtcacaatcgtcatgggtgaaggagctcttgtcgaaatggggtgtcagtcagtcgcgtggggtgcagcggcttctctaattgaaggaagggaggtgttagggttcagaaatttgggaaaggggggcgtgcaggaagcagaggccttccaaatgccctcatccaacttcggactcagttag

SEQ ID NO: 20942 - DNA, 420 bp, Glycine max
  Peptide Sequence Number=SeqID_137720
atggtgtcttctcccgctttcgtcgtcatcattgccctcaccgtgagtactcgtatctccttgcctacaacttctgcacgtagacaacgagcagctgcaactattgctgaggatgttgatcacggggatcatgctactgacaaggttcatgagcagcctcaagagccaattacgaatcatgtcggtgttgatacagagggttttccaggcagaccccatgatacatcaatgttgacgcattatgttgatcatgaacatactaagttaaaattgacttctcataggaggaaggtagagaaatttgaaaggtttgcacctgagattgaaggcataatggttgctagagggttaagttctctgattacatgttcagttgacactagtgacatgagacttttatatgcttttgcggaagggtga

SEQ ID NO: 20943 - DNA, 186 bp, Glycine max
  Peptide Sequence Number=SeqID_137721
aataacttaggtggtcgttgggttctcgtttactcagaagttgggaacagagactcggaatttagggtatgtgtcctcctacggcctcttgattggagtatggacctaattaagtttaactgccccggtgaggtgtgctctcagctgcacttggcaactggcactaaattccattccattttatag

SEQ ID NO: 20944 - DNA, 870 bp, Glycine max
  Peptide Sequence Number=SeqID_137722
atggcaatgcctgtgaatgatgatacaatgattgaggatgaaacagaagatcagagtgaaaaaatgtcgtcatctgaatcagaacaggaagaagatgtgagattagctgaaccatctaaaaatgcagtatataacagagatgctctattagataaacttggagacatcagttggccagcgaatgtggaatggatacacaaactctctattgatgttgatcaagagcaagaagtagatgtcaatgatgacttggcacgagaacttgcgttttacacacaggcattggagggaactaaggaagcatttgagaaacttcagtcaatgggtctccctttcctgagacctgcagactattatgcagaaatggtaaagacagatggccacatggaaaaggtgaaaggtcggctattatcagagaagcgaaagatggaagaggctgatgagagaagaaaggctagggaggccaagagattggccaaagagattcaggctcagaaattaaaagaaagggctaagcagaaaaaggaggacattgaatctgttaagaaatggaggaagcagaggcaacaaagtgggtatgctgacaatgggaaagatgcagatatgggttttgactttgaggatggaaaagtatttgagaggtcaaataagaaaaggccaggggtgtctccaggggatcgttcaggagggaaggcaaagcaagcctttggtaaaggaaagaaacagaagataagagatggtaagaattccaaatttggttttggaggcaagaagggaatgaaaaagcagaatactgctgacaccaccaatgattttggtaaatttaataagggtgctgttgctggaaataagagaaagaggctttattga

SEQ ID NO: 20945 - DNA, 222 bp, Glycine max
  Peptide Sequence Number=SeqID_137723
atgaaatcatataatggtggtgaccaagctttggtcaacgaggtgttcacgtggtggcaccgtttgccaacaaaactaaactacttgaagagttttgaaaagagggaagggaatgagaatttggaggtggttcctgaggacttgtttatgatatgccatgcccatagaggttcaatcctattgtggactactaagaagagcaagaagtgccaatttgtctga

SEQ ID NO: 20946 - DNA, 177 bp, Glycine max
  Peptide Sequence Number=SeqID_137724
atggcaatcagtgacagggagtataaagaaaaagaaaagattctaggtgttggattcttgttcttcttttcactatcaagaagaagaagagggccaaataatattggcatacaaggtaccgttaacgtagatgcaaaatcagaatctttgaagcttggagaaggctttcagacatga

SEQ ID NO: 20947 - DNA, 561 bp, Glycine max
  Peptide Sequence Number=SeqID_137725
atgtctttctcgtggacctctgctctcaatatcacttttctacttctcctcgttgctgctgctgttgttgcttgtttaactctcccagttgacaagattctgaaggacttgttggaatggattgatcgtaatttagggccatggggtccacttgctttgattgctgcttacattcctttgactgtcttgtctgttccagcctctgtacttactcttggtggtggttatctatttggccttccaattggcttcattgctgactctattggtgcaaccgttggtgctgtagctgcatttcttcttggtagaacaattgggaaatcacttgttgtttctaggttgaaggattatccacagtttagattagtaacaattgcaattcagagatctggctttaagatttcaatactccttcggcttgctccatttgtaccatttaacatgttaaattacctcctatctgtgactcctgttccattaggggagtacacactggcttcttggttaggaatgatggtatcttcttcatctctgatcaattatacggacggttactcttaa

SEQ ID NO: 20948 - DNA, 456 bp, Glycine max
  Peptide Sequence Number=SeqID_137726
atggggaaagtgcaaggttttagccttctatcttttggtggctgctttgatggttgtcgtgaccatactcaaggctctggttacggaacaaggatatggaacctcagtgatcgaccagtggagctgcaaataagggtgggatcaatactgaagaagattcacacgttgaagccggggtcttctaaaagattgaaatctaaaagcatatataaggcttatatgcctgggaggagtggcagtgtcggtggtagcttgaagagcttattgtattactatgatgaaacatatcacccttatatttggattcatgacacagggtgtcactccttaaggatggctaagcagcagtatattagccttgaggatctgagggattcttctgagatcaaagtcttctgggatcatcagagaggttctatatcagttcgtaagagaacaaggccagatttctgctga

SEQ ID NO: 20949 - DNA, 817 bp, Glycine max
  Peptide Sequence Number=SeqID_137727
atgacgattccagtgccagacaacaacaatgtgtcctcaacgatgagagctttgttcttcgcttctctattggaccatttgagtgatcacaccctagaaattgttaggatggtgatggtggtgactagggttggtgatggtggtgcacaatggcacaacgacttggaggggtatttttgtccgcttgagtcttttgggaggtgcaggatgagaatgggagatcaatccatgcaaatccaaatgctcgctgaaaaattccaccgatttgttcttgactgcgaactcaagcaaccgtcaatcgctcagtgctctgatattgtgtcaaagcaagtgaacgagaactctgactccatggatgaacatagtttgtccaatggaacccatgaagtttctccggataagggtcacacacttcccatattgaagaaaatacttgatctcggtgctaaaattcaggatttgaagaagcagcatataaccttgtgtgatgaagtgaaactcacttctgagtcttttcctggcaatgatattttgaagtctgtacagcttctgggtgctgaatacgaactcttaaaaagaaagtactcagaggagtcctctgaacggaggcggctttacaatgaagtaattgaactcaagggaaatatcagggttttctgcagatgcaggccattaaatgagaatgaaattgctaatgggtctgtatctgttgtcaattttgagtcgtcttcagataatgagctacaagtcatttgcgcagattcttctaaaaagcaatttaaatttgatcatgtgtttgggccagaagataaccaag

SEQ ID NO: 20950 - DNA, 2967 bp, Glycine max
  Peptide Sequence Number=SeqID_137728
atggccaagaccacgctggattcgggatggcttgcagctaggtccaccgaggttcatttcacaggcactcaactcaccaccacgcaccctccctctgcctccacccaaccatggatggaagctatcgtccctggaactgttctggctaccttggtgaagaacaaagcggtgcctgatccgtttcgtggactaggaaatgaggcgatcctggatattgctgactctggaagagactattacaccttctggttctttacaacctttcagtgtaagctgtcaggcaatcagcactgtgatctgaatttccgaggaatcaattaccgtgctgatgtctatttaaatgggcaccagatggtcctcccaaaaggaatgtttcggagacattctcttgatgtcaccaatattattcattctgatggtagtaacctgcttgctgttcttgttcaccctcccgatcatcctgggagcattcctcctcaggggggacaaggtggtgatcacgagattggaaaggatgtggccacacaatatgttcaaggttgggattggatggctcctataagagataggaatactggaatatgggatgaggtttccatttctattactgggccagtaaaaataatcgatccccacttggtgtcatcattttttgacaattataagagagtatatctacatgcctcaactgagttggaaaacaggagctcctcgactgctgagtgctcattgagtatccatgcgacaacagaacttgaggggagtattcacttagtagagcagcttcaaactcaaaatctttcaattcctgcaagatcacgggtgcaatatacatttcctgagttttatctcttctttccaagtgctaatgatctgcattggcagctctttttctacaagccaaatttatggtggccaaacggaatggggaagcaatctttgtacaatgttattattaacattgatatcaaaggatatggtgagtctgattcatggaaccatcactttggattccgcaaaattgaaagccatattgatggtgcaacaggtggaaggttgttcaaagtcaatggagaaccaatttttatacgagggggtaactggatactgtctgatgggctactgcgactttcaaagaagcgatacgaaacagatatcaagtttcatgcagatatgaattttaacatgattcgatgctggggtggtggactcactgaaaggccagagttttatcattattgtgattattatggtcttttggtatggcaagagttctggattactggggatgttgatggacgcggtatcccagtatcaaatccaaatggaccattggaccatgaccttttcttgttttgtgctagagacacggtcaagcttcttagaaatcatcctagtcttgccctctgggtgggtggaaatgaacaaactccaccagatgatataaatgttgccctgaaaaatgatctgaaacttcatccttattttgaacatggagaagaaaaagaaaaacctgtaggtgatttgtccccaaggttgggggatcctagccaatatcttgatggcacacgaatttacatacaaggatcattatgggatgggtttgcagatgggaagggggacttcactgatggaccttatgaaattcaaaatcccgaagatttctttacagatagtttttataattatggattcaatcccgaggttggttctgtgggaatgccagttgctgccaccataagagcaacaatgccttcagaaggatggcaaataccactgtttaacaaactttcccatggttatgtagaagaagttccaaaccccatatggaaataccataaatacattccatattcaaatccaaccaagaaggttcatgatcaaattcagctttatggtgatgtaaaagatcttgatgatttttgtttgaaggctcaactagttaactacatacaatatagagctcttctggagggatggacttcgcacatgtggaaaaaatatacaggagtattgatttggaagacacaaaatccttggactggtctgagaggtcaattttatgatcatcttcttgaccaaacagcaggtttctatggctgtcgatgcgcagcagagccaattcatgtacagcttaatctggctacatattttatagaggttgtcaatactacatcagaagaattgtctagtgtagctatggaagtttcagtgtgggacctcgaaggcacacgtccacactacaaagttcatgaaaatctcactgcactgccaaaaaaagtaacacctattgttgagatgaagtattcgaagtcaaaaaatcctaggccagtttactttcttcttctcaaactctacaacatgtcagataatacaattttatctagaaatttttattggttgcatcttgctggcggagattacatgctattagagccatataggaagaagaaagtacctctcaagataacatccgaggttttcattgaaggatccacttatatacttcgaatgcatgtgcaaaatacatctaaaaaaccagactctaaaagtttaacattggtacacggttcaacagctagactaagcaataactgctttgttacagactcaccagaaaccatagatagtgggactggaaaagagcatgaagttggttggtttaagaggatacacaaatgctttgctgggaaaagtgatggtttgaaggtttctgaaattaatggacaagatataggtgtcgctttctttcttcatttttcagttcatgcttcaaataaggaccacaaggaaggggaagacacgagaattctccctgttcattactcagataactatttttcagttgtgccaggagagaccatgactattaaaatatcttttgaggtccctcctggtgtctctcctcgagttactctgcatggctggaattaccagggacaaaccatccatgaagctctttactga

SEQ ID NO: 20951 - DNA, 300 bp, Glycine max
  Peptide Sequence Number=SeqID_137729
atgtcttgcaaaaaggataaaaacaactcaacaaaacaccttgtttacaaagaactacgtaagtctgatttccttatcgcaattaaggaatacgtaggagcaagggaaacaccctcgtcgaccgcaaaaagattaaaaaaacataaaaagcgactccgcccgtattcctttcttggaacatgcacccgcgagtcacgtgtcgccctcccgccgaagggaaaggttgtgaaagatgccatgaacaacatgatcaagctgcaacatgttgaaattaaagcatcctttgaaaccagtacgcat

SEQ ID NO: 20952 - DNA, 670 bp, Glycine max
  Peptide Sequence Number=SeqID_137730
gcggaatttgatatcccagaggcttctaacagcaggacgaaaaggaagttactatagaccatgggggagagatgaaggcagtttaaataagatctcacgaggaaatgggcccttgcagccgatcaggacgttgtcgaggacactgtctgatgtgcgcaagaaggcacaggtcatccagaagcagaatactacctcccacgttttgtctcgtgggggttatgattatttggagcagaagctcctggctgagaagacgaagaagaagctggaggaagctgcacagtcaggaagcgttgatggcgtcaacgaccctccatccccggattcgtttgaggagcaggccacacagggatcgttcgtcctccatggacgtcagcatgttctcgccgctgctattggacgtccagagcaccctagacgtcctccatggacgtcagcatgctatttaactttgtttcatgagcaggtagctgtgtctccggcaaaaccacctccgaagcccgatccggaggtcgatgatccgctttatttgatgatattgaccatcccagagcttttcttgaggctttatcaggttagatgggatgccaccgtgttcggggtctttaatcaagatttccccctctacataaagtacgaagacctctccgaaatcgcacacggtggttaa

SEQ ID NO: 20953 - DNA, 217 bp, Glycine max
  Peptide Sequence Number=SeqID_137731
atggcaataaaagaaaggtgcagtatgagtggtaaacgttatccagaagaattcaaaatagcagccgtccgtcaaatcactgaaggcggatatgctgtatctgaagtggcccgcaggttggatgtcacagtcgatagtctgtatgcctgggtcaggaagtacggcccaaatgcagcagagcataaagcaaaaacagctgagcaggcagagctgcaac

SEQ ID NO: 20954 - DNA, 437 bp, Glycine max
  Peptide Sequence Number=SeqID_137732
ggatccattgctgtactccagtacctgtggacagaccgaagccaatcctgcgtccacctcctgagaatttaccactcaaggaagtctttggttccttcagaaagatgtcaatcttcttgaggaaagacccccatttcatagcgcctggggaacgcaagtttgatcgaggattggagaggagaggtggaatggaagaaaaggctcgggatggatttaggagtctttgtgcgagccgtatgcgtgtggtggttgggcctacccaccctatttgttccatgatctatgggtctactggagctacccacttcgatcaattagccaagattttgaccggatacgaaatcactggtgctcgatctagtggtatttttatggggattctatctatcgctgtaggatccctattcaagatcactgcagttccttttcgggcggct

SEQ ID NO: 20955 - DNA, 404 bp, Glycine max
  Peptide Sequence Number=SeqID_137733
atggcacgcagagacaaattatggtcattctgcgcccttttgtcatccagaggcggcgagcccgatgagatgcggagacaaattatggtcattccgcacaccttttcgccatttggagacaatcgtgtccgatggcatgcagagacaaattatggtcattttgcgcccttttgtcatccagaggcagcgagcccgatgacatgcgaagacaaattatggtcattccgcacactttttcgccattcggagacaatcgtgtccgatggcgcgaagagacatattatggtcattctacgctttttgtcatctagaggtggcgagcccgatgacatgcgtggatactattatggtcatctgcgcctttcgtcaatcgagaggaacgaattcggcaatatcaggatgat

SEQ ID NO: 20956 - DNA, 1261 bp, Glycine max
  Peptide Sequence Number=SeqID_137734
atggcaccaacaaggaaatctagaagtgtgaataaacggatgtcaagttcaaatgacaattcccctgagaaagatggaattaattcaaataaaaacaagctgcggaaaacaagactacaagattcagattatgctttgtgcgagaagaaaaagttgaccgataaattgggatctcagtggagcaaggaggaactagagcgattttatgaagcatataggaagtatgggaaagattggaagaaggtggctgcttttatacgtaatagatctactgaaatggtagaagctctttacaatatgaatcgggcatacctctctctgccagaggggacagcttctgttgttggcctcatagcgatgatgacagatcactacaatgtgatggaagggagtgatagtgaaagggagagcaatgatgcaccaggatctcaaaaacctgtaaaacgaaagcatgaagaagttcagcttagtgtctctaaagatcagtctcattcaattgcttctagagatgattgcctctctatattgaagaagagacgctttgatggtatgcagctcaagccttatgctgttggtaaaaggactcctcgcgtcccggtttataagaaagacgatacagaaaattatgtttcaccttatagaagaagcctgaagtcgactattgatgctaatgatgatgaagttgctcatgttgtagctttggcattaactgaggctgcacacagaggaggctctccacaagtttctcaaacaccatctagaagagtagagcaaaaatcctctcccatccagagcttggaaagaaagcaccaaatgtcagagacagcttgtgccaagtttcatgatgtttctgtggatgaagaggttttagaaagtagtatagaaagcaggggagctgaaaatggagaatatgcaagagataatagttcattgatggatacagaaggcataagcactgttaaagtttttcagaagaggaaaattttttatagaaagagagagagagtggaaaatgtgggaaatcatcaacttgatgatggtggggaagcatgtagcggcactgaagaaggacttagttttagttcactgaaggaaaaggttgatattgatgttactaatgaaaaacttgaaaaattctctccaaaaagtcagaggaaaagaaacaagaaactcttctttggagatgaaacccctgccttgaatgcgttgcaaactttggctgatctgtctctaatgatgccaatatctacaatggaatctg

SEQ ID NO: 20957 - DNA, 711 bp, Glycine max
  Peptide Sequence Number=SeqID_137735
atgtcatatgttggagtggctgttgaggactcaacttccccgtatggccttcgactattgattgaggattacccttttgcggtcgatgggctagagatctggtttgctatcaagacatgggttaaggactactgctccttttactacaaggaggatgacactatcaagaaagatactgaacttcaatcttggtggaaggaaataagagaggtgggtcatggtgacaagaaagatgaaccttggtggccaaagatgcagacatgtgaagagctgattcagacttgcactattattatatggattgcctcagctctccatgctgcaatcaactttggacaatatccatatggaggcttcccaccaagtcgtccccagaaaaaggaactccagattacttcacagtttctggctgttcttggcatttcacttgtagaaatcttgtccaaacattctagtgatgaggtctaccttgggcagagagacactccagattggacatctgatgctgagccattgcaagcctttgagaagtttggcaaaaagcttgctgatattgaggaaaggatcttgagaatgaacagtgatgagaaattcagaaaccggtatggtccagttaagatgccatacaccttgctttatcctacaagtaaaggtggactaactggcatggggttcccaacagtatctcaatttaatttaaaggggctgtaa

SEQ ID NO: 20958 - DNA, 513 bp, Glycine max
  Peptide Sequence Number=SeqID_137736
atggactttctcatcagtttgcaattgcttgttgaattcacattgaaggatgctaaggagctggatcagctgattaattatttaattaacaaagaagactctgaaggtgtggcattacttgggcatagtactggctgtcaggatattgtgcattacatgcgcacaaattttgcttgctcccgagctgttcgtgctgccatctttcaggctccagtcagtgatcgggaatatcaagctacactccctcatacagcttctatgattgacttggctgctaagatgataagtgaaggccgaggtctagagttaatgccaagggaagcagatcctagtgccccaataactgcctatagggaaaattccattgaacagtgctctggattcaaaaggaaaatgcaattgagagctgagaataaagaaatcagaggagataaactccacgaccctgtggcaggaggcacccaaaactgccaaattgatttcctacctctcatttcctccctagtcccttga

SEQ ID NO: 20959 - DNA, 1704 bp, Glycine max
  Peptide Sequence Number=SeqID_137737
atgccagagaaggttgtgatttcgccccaacgggctctatggtccattctaatgcttcattggcgtgttgggttgctcactgctttggttttggttggaatggttgtggtttggagcattgatgggtgcacagtcaagaacatcattcaagcttggaggtatcaacaagattatcttgctgtaaggtctcatactcctaatttaactttaacttttgtctctccatacagtcctgtatatggcaaaaagtcccttctagttgaggggcatgcaagttgggtttcaaatgagttagaacccaacttgacttcaaatctcatagctagatggtcagctcgtggaggtgagccttgtaaagattccaaggctgtggagattgcaattccttggttggatggtggggaagtggttgatctatcagctggatatgtgcatgaatttggttttcaagcactggatgattcagagaagcctctttgtgtaggtggagactactttgaggctgatctttcaggggaatcatggaaatctaggcctttggtgaaagatttcagcaatggttcttactcaatttcactgcaggttcacccagattttgatggggtttacaatctcactataatcctgctctatagacactttgaaggtctgaagttcaccccgtggaagttttcttatgaccgaatgctgcgaaatgttgcaatcagattctacaagagcagtgttcagctaccagaactgcaggcttgcaaggcttctgattttgtcagggatgtgtggattggaaggtggacaaggcatggcaagaatgatgactgctcgatagaaaatgatggtaggtaccggtgcctagcgccggattttccttgccaagctccttggtgtgatggttccttgggaattctggagagtaatggttgggtgtattcaactcattgctcattcaagttgtattcagctgagtctgcttggaattgcttgaaaaacagatgggttttcttctggggtgattcaaaccatgttgacaccataagaaatttgctcaactttgttttagacttgcctgaaatatcttctgtccccagaagattcgacatgaacttttccaacccaagagacccttctcaaacagttaggattacaagcatcttcaatgggcattggaatgagacacaaaactatctggggttggattctctgaaagatgaagggtttcaagatttgctaaagaagtacttctcagaagacacaattccagacactgtggtcatgaactctggcttacatgatggtgtccactggcacaacataagagcattctctgttggagctgactatgcagcatccttttggggagatgttatgaagacagtgaagcaaagagggttggcatggccaagagtgttttaccggaatacaattgcaactggtggatatgcaaggtcactagcattcaatcctaacaagatggaggtgttcaatggtgtgttgttggagaaattgaagcaagcaggagttgtttctggtgtgattgataactttgatatgacatttccatggcattttgataaccggtgtaatgatggagttcactatggaagagctccagcaaaaatgaagtggagagatggccaaattggacatcaatatttcgtggaccttatgttagctcatgttcttctcaatgccctatgtgcaagatag

SEQ ID NO: 20960 - DNA, 2559 bp, Glycine max
  Peptide Sequence Number=SeqID_137738
caagctgccgaaggaacccaagaggtcccaggacttgttgaagctcgtgtttatggaacagaagatgtgtgggaaatgcttaagactggaaaccgagtcagatcagttggatccacctgtgctaatgaacttagcagccgttctcattgtgagcgtgtggggaaaactgaagctgaaggagaaaggctgaaggaatctcaattcataaataagtcactttcagcacttggaggagactgcaaaactttaatgtttgtgcaagtgagtccaagttcagcagacttgggagagacactttgctcactgaatttcgccacccgtgtccgtgggatcgagagtggcccagctcgcaagcaagtagaccacactgagctgtttaagtacaagcaaatggctgaaaagctcaaacaagatgagaaggaaacaaagaaattacaggatagcttgcaaatcatgcaactcaggcttgcagcaagagaacatcattgtagaagccttcaggaaaaggttcgggacctcgagaaccagattgcagaagaaaggaaaaccagactaaagcaagaaagtagatctcttgctgccgttacagttcaaccctcatcatcaacagctcataaaaccatgacagacaagaagcctccactgaatccttcaaaactgagattgccactgagaagaataaccaattccttgcctccacggtctcctcttagatcaaagagttacactgccttcatgagtggaaaggaaaactctgtcagaaggaactcaatggcgacaaatgctgttaggccagcttcaccatcaacaacagcacagttccttcaggcaaggaggcgggtgtccgttgctgtgagaccccctgcaccatcaacaacgcaggtctttcagccaagaaggagggtctccattgccacactaccttctcacacaatttctgacattactactccactccgtacctcagcattacgtgttaccggtggaagcagccaacaatcacggataagaagccaaaggaaagatcggtattcaagtttgttcgccccattgccagagttgagaacatcagttgagacaactccaatgactgtaaggaggagcagcaagtttatgatgagcagtccggtaagggcagattccagggagggatccgctaggcatccaactcttcttgcacttcaacgcaagcctgtagtctggagtcctcttagagtgaaagacatggatagacttagtcgaccgttggaaaaaacaaaccgttacacagagttcgtgtttgttcaacatcaacacttaggagctaaactctgcaacaaaaagcaaaaggttaagggaccagaccgtgtcttcgtcgtagagagagagagagttcatatccaatctttggttgggtgggatattctaaagatggttgcgagaaccccaccaaagcagaagaagctgttggctgctctcaaccctgttctgattaaagaaacactcaacaaggtggatcagtgcgtggctcggctgcaggaacttcagtacactgtgactggtggaaccaaggtggtgtcaggggtgactctcagccctcgcagcaccagaggctatctcagaaccagtctcaggtgcaagcaagaatcactcaggatcaagaatggtgcctcaaggagatctcctgtggggaagtttccagcaaacacaggtgaatggaagagaatgtcattgcctgcaatgcttgtaggcgaaactgttggagaaattttgcaggcaagtcagtttgccagagaaatagtctcagcagttggtaagaaaactgacccagaggatccaaaaactccaatgtctcaacgcagcaacaaaaaagtagaacttgaaaacacacaactcagggccagaaggaagaaagagaagcaaaccaaagcacagaacgatggttccccatcacttcaaagggctcgttccagaatcaacttcaaggtttctcctcctaaggttagagaatttgataaagaaaggaacaggtatatggcaaatagggtgtctccaagaaataggccatggactagaaaaacagtactattccccaaccctttgttcctctccactcattcctcttcacagcaacagttttgcaagacaaggtcacctatcataacaagaaatagaggaacaacatcacacaagtttttgatcaagtctccatcttcgccatcagggccacaacagtttagcaagaccaggtctcctgtcataacaagaaataggggtggaacaccacacaagtttttgatcaagtctccatcttcagcttccaaatttcaagtccagatcaaaaaaagtccaccaactgtgtctatttcaccaacaaaacctgcaaggttgagcagaagtcctcccaagagatccacttccactgcatccaaattccgtcgatctttctctccttcaagaatagcatccagattagtatcactctcaccattaaggaccaggaaaactgtacagaaaaatgatgggtttgtaagtggactcaaacagcgcccgctatcatcagtgcaataccctgcttga

SEQ ID NO: 20961 - DNA, 840 bp, Glycine max
  Peptide Sequence Number=SeqID_137739
atgaaagtttatcctctaaaagatctacttttctcccgtaacttaactccacttccaatgggttgttgttgcgacgaagacgacggtgacattttcaggcacctcatgaattccaatttcccctcttcttcctcctccacctcttcttcctgcactgtaatctcaccgatgaattctcatttctctgcgctatcctccaccgacatcctccgcctcatcttcgagaaccttccaatcatcgatctcgcacgtgcgagctgcgtgtgccgtctctggtgctccgtggcctcccagagggacatggtaactagagccttcgtggcaccttggaaactgaacgacgtcgtcggcaacccactctctggaagcttctggagagacaactccctcgccaaattcgccatctcccatcgcattacgcgcggcgacaccgtcgccagcctcgccgtcaagtactccgttcaggtaatggacataaagcgcctgaacaacatgatgagcgaccatggcatatactcaagggaaaggttattgatccctattagtaatcctgatattcttattaacagaagatgctttattgagcttgatgtctatgcaaaacgagaagtagcagtcttgtatcccaatgatgtaccagacaggaggactacctatgtttcaaacagaatttcctcagaagaaagcaacaaaaaagtgcttgaatccttgaagagaagcatgcatgttgataatgaaactgctcaatactactggtctgttgcaaatggtgatccgagagctgcttttgccgaattttctgcagaccttaagtgggactggcaagcagggcattcctag

SEQ ID NO: 20962 - DNA, 483 bp, Glycine max
  Peptide Sequence Number=SeqID_137740
atggcacatacccatttcctatttctatctgctttactattttcaagggcacaagtggtgggttggccaccagttaggtcatttagaaagaacatagttcaaaggaacagcaatgaagaagaggcagagaagagcacgaagaatgctttcgtgaaggtgagcatggatggtgcaccgtatctacgaaaggtggacataaagttgtacaagagctaccaggagctgtcagatgcgctggctaagatgttcagttccttcacgattgaaaagtgtgggtcccaagggatgaaggactttatgaatgagaccaatggctctgactatgtacccacatatgaagacaaggacggagactggatgctcgtcggtgatgtgccctgggagatgttcgttgaatcatgcaagcgtcttcgcataatgaaaggctccgaggcaatcggtcttgcgccaagagccgtggaaaagtgcaagaacagaagctga

SEQ ID NO: 20963 - DNA, 804 bp, Glycine max
  Peptide Sequence Number=SeqID_137741
atgaatataaaccaggcttttgttgaaggtcaaagcctgacttattctgaatttgttactaagtttgtgtataaccagaaacagagatgttggcaacttatgaaaaagggttatactattgtcagacttcaatgggttcccccaactacaggggaattattttatttgaggatgatgctgactatctctagaggaccaatctcatttgaagatatcagaacagttgatggtgttgaatatcctacatatagagaaacatgttttgctatgggttttttacaggatgatagagaattcattgctgcaatcaaggaagcaaaagactggagctcagcaccttatctaaggaatctttttgtattattacttttgacgggtaccatgaacaaacctgaacaagtgtgggaaaaaacttggcattggttaagtgatgatattgtatatagtcatcgcagatcaacaagcactctaggattacatattgatgactgtaatctaatgaatttggtattgcttgaagttgaacagttgttacaagccaatcaaagatcacttaaagactatccttccatgccatatcctgagaacgcaaatttactaacacatgcagacaatggcctcattttgtctgagctgaatttcaacaatgaagaacttagatcagaattccttaaccttttttctcaaatgacaaaccaacaagcaaaaatttataaccaaattattcaggctgtcaataaaaatgaaggtgggatgtttttcttgtgggatcctctagagtcgacctgcaggcatgcaagctga

SEQ ID NO: 20964 - DNA, 1020 bp, Glycine max
  Peptide Sequence Number=SeqID_137742
atggccttagatgacgataacaaaccagtggttaaaggaaaacacactgaccaggcttttaccctaccaaagcaattgaagacagttaaatcatcagagagttccttttgcagtgatcagaaagatttgacagtatcaactgcagaagttccacttttgaatgaagttagtttaccaactaaacgaagtagacgaaagatgattttacagagaacttccttgcctaaggaaaagtcttctgattacatattgaaaagtcaacctaataagtactctacccttaaggcaaaggtttctagttgcttggcatctaatatggttcgcagatggtttatttttgaatggttttacagtgcaattgattatccatggtttgccaaaagggaattcatggagtacttaaatcatgttggactagggaatatcccaaggttaactcgtgtcgagtggagtgtcataaaaagttcccttggcaaaccccgcaggttttctgaacactttctatgtgaagaaaggcataaacttgaacagtatcgggaatcagtgaggaaacattacactgaactgcggactggtattagggatggacttccaactgatttagccaaaccattatatgttggacaacgtgtaattgctcttcatccaaaaacaagagagattcatgatggtagtgtgcttaccgttgactatgacaagtgcaggattcagtttgaccgtcctgaattaggtgttgaatttgtaatgctccttctatgcagagtgtctagggtacggttggacctactgtgtgcctatagaaggcagccttgcatttgcaagagcatgatttctagacttgaatctatgacatacagcctacaggacattgattgcatgcctttgaatccatcagataatatgccagaagctctgaggaggcatattggttcccaaaaagcctctttcatgaataaagaaccacaaattaatggaaattcaaattttgggggctgcgaaatgcattcctttcccgtgaag

SEQ ID NO: 20965 - DNA, 849 bp, Glycine max
  Peptide Sequence Number=SeqID_137743
atgccttcagcatatgtatgtggtgagagaggaggactcattatagaggattcatgccaattgggcgtgtcactaaatggagtgcccggactagacattgacatggaaaagaaagcggtggaggataagttgtaccaacttcaacaagagggggctacagaggatgatattaaaatggcaatgaaggacttcggtatgaaaagagcaactatatatggatggccaaacacgtatgtctttacaaaggcaatgggagaaatgcttatagaaactctaaaggaaaacgtgtccgttgttattgtacgtcctacaatggttaccagtacttacagagaaccttttcctgggtgggtcgaaggagtaaggaccattgatagtttaattgttgcttatggcaaaggaaaattaacatgctttcttgcagacatcaaggcaacttttgacgtgataccggcagacatggtggtgaatgcaataataagtaccatggtggcgcatgcaaataagccatgtgataatatcatatatcatgtgggctcctctttagaaaatccagttagataccacaatctccaagactatggctttagatatttcaaggccaaaccatatgtaaacaaggaaggaaattatgtcatggttcgcaaagttacagtgttagacagcatggctagctttcagagatacatgttcattcgttacttccttccattaaagggactagagctagccaatgctgccttttgccaatattttcagaggacgtatcttgacattagaaggaagatctatacagtgatgcggttggttgacctttacaggccttatttgttcttcaatggcgtgtaa

SEQ ID NO: 20966 - DNA, 477 bp, Glycine max
  Peptide Sequence Number=SeqID_137744
atggaatttggaagcataatccacttccttgaggacaagaatgttttggtcattggtgccgctgtttttgtggagaagatactgagagtgcaaccaaatgtgaagaaactttatcttcttctgagagccacagatgctgaatctgcctctcaacgattgcataatgagattatccagaaggacttgtttagattgttgaaggaaaatcttggtgcaaagttcaatacctttgtttcagaaaagttgacacttgtgcctggggacatttctcaagaggacttcaacttgaaagaccccattctacgggaagaaatttgcagtcaaacccattgtattatcaattttgctgccaccactaactttgatgaaagatacgatgttgcattgggtataaatacattaggagttaagcatgttttgaacttcgccaaaagttgtattaagctgaaggtgcttgtccatgtatcaacaggttag

SEQ ID NO: 20967 - DNA, 528 bp, Glycine max
  Peptide Sequence Number=SeqID_137745
atggttagaactggaggtttgggtcggactttaggcatgattataggaatagctttaggtagagaacgagaagttggacctattgttgaggatgttaagcatgtggatcatgctactcaagaggtccatgaacaacctcaagaggcacctgctgatgatgtagttaatgatgttgagagttttccaagcgggtctcacgacacatcagttttgacagactatgttcatcatgtggctgtgacagtttggaatagagaggaatgtcttgagttgaagttgtcctcccatagaaggaagaggtggcataaggaaactagtagtttccatctaccggtaggagaggtgactatcaccctagatgatgtggcatcgttgctacatctacccattataggcgccttccatagctttgaagctcttcatgtggacgatgtcgtcttcctcttagttgaattgcttaaagtaagttttgaagaggtaagagatgagataatacaatgtcatggggcatatgttcgactatcctga

SEQ ID NO: 20968 - DNA, 927 bp, Glycine max
  Peptide Sequence Number=SeqID_137746
atggcggaggacgatatcccaagacaacattttgcaccaaccagggtcattacgaatagagtcatgcccttcgggctctctaatgcacccttgatgtttcagggccaattttatctccgcctctccaaatgcgtgttcgtccaatcacaactcaagtatcttggccatattgtgtctcaacgaggtgtcgagcctgacccttccaagattcaggctatggtggattggcctaccccttcttcctccaagtcccttcgcagatttcggatttctaagccttatcggattttaccgaaaatttatctaagtatatgcgaccattgctgcccttttgaccaaattcctccgcaaggacaacttcttctagagcgagatgcctcagacttggccatgagtgctgttttgatgcaaaatcaccatcctatcgttttcttcaacaagcctttttgtccacgattgcagcatgcctccacatacgtccacgaactctatgccattgtcgtcgccgtccgcaaatggtgcctgtacttgttggcaagtgtacctttcaaagccattggggccgactacaccatccaatacaagagaggaaccaacaatgttgtggctgaggccctttcccggatctccaatccgtcggaggccactttcttcacattgtcattgccaaactttgtggttttggaccaattagaaacgactctccatgcttgtcctgaatttggtgagttgatgacccaaattcaacaatacccaactactcattcagactacaccattcaccgtgacctcattttctacaaagggatcaccaagactttgcatcgtcttcaagcttatttcttttggaagacaatctgccaacatgttcagcaatatgttgcccactgcaccacttgccaacaaatgaaatatgagaccaagtga

SEQ ID NO: 20969 - DNA, 1023 bp, Glycine max
  Peptide Sequence Number=SeqID_137747
atgcacttctggcagcacttacagagagatggttattgggcctattctgttccaccacttgaagaggctgtttggaaacatgtatccactgtggcttattttgtatggatatgtgttcaccatgttttgctgctggcctggcttggattggccctgtttgcttttgcttctgcatgcattgttgagttcttgggtttgctggggattcatggatcaaacttgactgaagaacagcttgagacacatactatagcagcatggagagaggcaaaggtacaagaatgcagaactgatagtaatgggagaacatactctcaacatttggttcatgctgggccccttgagtgtctaaaagatgttgctttaaaaattttgcaaaacaaggtggcaacagttcctattatccattcttcttcagaagatgattcatttcctcagctgctacaccttgtttccctcacagaaatactaaaatgtatatgcaggcattttgagcactcttctgattccttgcccattcttcagctaccaattggttcaatacctgtaggtacatgggtgtcaaaagtcggggaatccaataaaaagccacttgctatgctaaggccaaatgcttctcttggtgatgctttgtctctgttgattcaagctgaagttagctcaataccgattgtggatactaatgattcattacttgatatatattcaagaagagatattattgcattggttaaagataaagtgtatgcaaggataagtctggctgggtttagtatccatcaggttcttcatttcagtagatgcaccaggctagcattgcttttgggacgagatgcaagatttccttacgggcttcgcaatggaccgagatgtcatatgtgtttgaggtccgattcattgcacaaagtgatggtgcgcttggcaaatcctggtgttagacggcttgtggttgtggaggcaggcagcaggcgtgtggaaggtatcatttctataggcgacgtgttcagactcttgttaagttag

SEQ ID NO: 20970 - DNA, 408 bp, Glycine max
  Peptide Sequence Number=SeqID_137748
atgtatttagtgagagaaccagatattctgcctcctatcttaagtgctgaaacacctggtcaatcccacatggaggttgacaatgacatctttgggcatgtggaagctaatccgaggatgtcagagtctgatctgcaggtctcaaaacaccgtttatctattttcttgtccacacatactgcttatgagttgcttccccagtcaggcaaggttgttgccttggatataactttaccagttaagcaagcattccatgctctttatcaagagggaatatctatggctcctgtatgggattctaacaagtgtcagtttgttggaatgcttagtgcgatggacttcattctaattctaaaagagctttcagtagaagtacggaaaaatgagaacttgccaaatggtaaataa

SEQ ID NO: 20971 - DNA, 672 bp, Glycine max
  Peptide Sequence Number=SeqID_137749
atggaggataatgggttggcccaaataggagaatgtcatggtgagagaggcatagtccgtcatgattgggccaaggcctttgagccactagatgtcgaggacgagaggcaaaatttctcagaggcgggcataccagaaatggtgttgagactcatatggggcgtggaagtatctttgatgatggcgacagagagattgtgtggatctaaccgtggggacaacaggtcaagggtagcaggatcgtcatcgtcgtccgctatgaggagcaacatacatgctttgcagtggtggccagtgcaatggcctggggaagggtcatgggtagcacaacttgaacctcgcgctagagctccgacgacaagccagagacaaagcaactcaaaaggaacggcggagcaaggccgacgatacgctaagcacgggatcgtccacgggtcatggtcgtcaaaacacggaacatcgagtttgatcaaaggtttatggctgatggggatgggcgaaggggcgggggagggagaggaggtgctgagagtgaataatcagtccaagatggagtccattttgagggaaagctcagtgtggttggtggtgaggcagaggacggcatcctcaagacggtcagtgactaactttctggtgttgtggtcagccatggcaggtcggaccagttga

SEQ ID NO: 20972 - DNA, 381 bp, Glycine max
  Peptide Sequence Number=SeqID_137750
atggaaaatcatctggagagatgtttatcccatgattcccaagtggtgccttcaggggccagcccgagccattgcacaagaaccagcttggttggtggagatgtagtagtgtcccatttccaatccagcagtgacagaggttcaagcaaaggacggttgtccaaagcatcggaagaaagtggtgcgggattgtcaatgagaggatggatcttggaagaagcgggaagctgcaaacgaaatgcttggagagtttatggtaggaaccagcgatggaatgttgccaataagggcgaaggcgaacatacacccaatctccaactgaaaaagtcacatccttgcacttggtgtctgcaaaatgcttcatggcagcttgagccttag

SEQ ID NO: 20973 - DNA, 183 bp, Glycine max
  Peptide Sequence Number=SeqID_137751
atgatgcttacagatgcaccacttttatttcctcctgggcagttggccttggctgctttaggcaactcaaatgcactccacagagtcattgactttgataggggcaagaagcgggagaagaaatcaaagcacaagtccaaaaagagctcaaatgaagctcaaaatatgccatctattgcctag

SEQ ID NO: 20974 - DNA, 411 bp, Glycine max
  Peptide Sequence Number=SeqID_137752
atggcgttcttagtctcctccaccttcacccttcctctgcgagtgcgcgcttcaccactcaacaaaaacaagctgtttaactctaattgctcatggttgcttattagttattacattaatataagctcactgccaggatcttggaatacttaccctaatgtgaaccacaaaggaaagtctgtggaagctcaaaagattcttggaacttgcagttcaaataaacgcatactatccatgaaaggaagctgtcatcgttgtttgatgtcttgcacaatatttctacatgaaacttactcatataatttggatgtagattattgcaccgaaatagttatatctggatattgggtgggacctgatgctgatgatgggtggggatttgtggaagctgttattaatcaaatgaattga

SEQ ID NO: 20975 - DNA, 198 bp, Glycine max
  Peptide Sequence Number=SeqID_137753
atgaagctttgtgtcacaaccagattcacatctctacttcaggctggtgtctctgctttggatcggagaggagaatcggctagtgagttgtcggagaggatgagagcaaaggtgaacaaatcatttcaaacttcttcaggcattaatcaaactactgttccgaaggacaatcatcaagagtttcccagacatccatga

SEQ ID NO: 20976 - DNA, 564 bp, Glycine max
  Peptide Sequence Number=SeqID_137754
cggccgggtgatcaggtcaaacacccacggcgcgatgaaatgggcaacgccagtggccgccagcacggcaccggcgaaccggatacgtcctgttgccgagggcagctcagcggcgggcgcgatcccaatctgggtagcactggacatagagatggttcctctcatcggtattgcgtctcgaactggccgcgagcgctggccggcacacaccatcaggcttgcctgtcccacccgccgcaccgagctacccgaggtctcaggcgccgcaacggaggcgtggcggtaccctcactacgtgcccgaacagttgtcgcgcttcgagcgtcgcaagcaggagactcggcgtgagatcttgggcgcggcgcttgcttgcttcgccgagcgcggttatcacgcgacgggcatcgccgacatagtgaggcgagtaggcatcgcgcaggggacgttctatctgtacttccaaagcaaacgtgagatcgtcgaacaaatactcgatgacttgatggaacgtctgtccgcagcactcctcgacctgccgccatcggcgcctaccagcctggctga

SEQ ID NO: 20977 - DNA, 978 bp, Glycine max
  Peptide Sequence Number=SeqID_137755
atgggttatcaagaagtggctgaaattgttgaggaagatgatgcacactttgagaagattgtaggtgctgcaacatcacaagaaacatggaagatcttggagaaatgtaatgaggttgcagagcaattgaagaaggtgaaattacaaacgatgaggcgtcaatatgaattgatgcaaatggagaacaatgagaagatagttgatttcttcaatagaatcatcactcacacaaatgctatgaagaactatggtgagaagatttcaaaccaaacaattgtagaaaagatcttgagaactcttaatcccaagttcgaccacattgtcgtagccattgaagaatccaagaaacttgaagaaataacagtagaagaacttcaagagtgtgtagccgcaccaagtagcacagatcacagggggaatcaatcacatagtgattatcaagcacatatggccaaagaagagaatgaagcagactctgaagaaaaacccttgatgctgatgatgtctcataataatgaaatctggtacataaattctggatgctcaaatcatatgactggacatagggattggcttgtcaattttgatgtaatgaagaagagtaaagtaaggtttgcagacaacaaagtcatacaggctgaaggagcagggaatgtagctgttagaagactagatggaagacaagctatgatcacagatgtactctatgttcttgggatgaagagtaacctgataagtatgggtcagctcctagagaagggattttcaatgaaaatgagtaatggatctctgaaagtctatgatacagcaaagaaaatgatcatgaaagccccattggctagaaatagaacatttaaggtaaatctgaatactattgaacctcaatgcctctctgccgttacaatgtctgatgactcatggttatggcatctaaggctaggccactcgaattttaaagatttaagcctattgagataa

SEQ ID NO: 20978 - DNA, 321 bp, Glycine max
  Peptide Sequence Number=SeqID_137756
atggatcaggatgtgcaagatagagcgttgccgattgcaaatgtgggtcgaatcatgaagcaaattcttccccccagtgcaaagatctctaaagaagggaaacaactaatgcaagagtgtgtgacagagttcataagtttcgtgactggtgaggcatctgacaagtgtcacaaggagaatcgcaagaccgttaatggggatgacatctgttgggctctaagttccttagggtttgacaactatgctgaggccattggaagtttatgtgtctttccgatgaagattgaacaagttgatgacaagaagaacgaacacttctaa

SEQ ID NO: 20979 - DNA, 1581 bp, Glycine max
  Peptide Sequence Number=SeqID_137757
atggagcatgaatctaataggcagctaattcctccaagttctcctgataaaagcaacatagttggagccccaaggtcaaatcctcgaattggttttgaataccaggtggaagttccttccatgataaaagaatcaaaacggcttaaacttctaatgaatactgttgattcagaacttgtacataatgaagtggaggataatgtagctaatttgaataactcatggagtgatgctgatgtaaaaagttttctccttggacacaaaaatttctctggtcggaagcaacatgaactattgtcttgcttgactcaccatgtcttagaacaatttaaagatgctttgcaacaggtttccaagtcatattcagaggggagaatttctctagaagaatatatcacttctttgaagtctactgtagcacttggtgttcttgtggaagctgtaggaagctgtttgggccgcttactggcaagaggttggcactcggagaaactaaagaatcaaggctctctgagctccaaaaattttgtggcctttcttttccctggtgttaaaaaattttcaagaagaaaacttgtgaaaggtgatcattgctttgattctgtcagtgatgtcttgagcaaagtggtagctgaaccaaatcttcttaagcttgaagttgtagaaactaaagttggtggcagcaatgaggaagatgcagaaacgggatccaacaaggatggtcaacctgataaccatcaccatcgttacctcaaacaccgagcttctactaacaatggagaccatatgaagagtgcaattttttatactgatttggtgcacagagggaagtcatctaatttaagggaattgaaatctttacctggcaattcggtaggtaaagttgaggtagatgctgatgatatagcatataataaagggaacaagcatattagtaaaacaaaacacaggaaaggtaagcttgatgacatttcaccaagtgggacagaaactgctaagatatacagcaaaaagaatagtagtaatgctgactgccagaaagctaaacacaatagagatgctactggccaaaaagaagtgaatgctaaccctgatgatgcaaacaagatgacagaaaaccagaatcatagagaatcaattcagtcaaagagcaagatcagtcatcagcaggatgtgactctaatttcttcttcagctgaagtaagtgtggaattgaaaaaagaaggaaaaaatttcaatagagtctgtcttgacaagggtatttcttgtgacaaagttgataaatatgaatcacaacattccatcaacttcaatgcacctcaggttccactgaagtttgaagatggtgaaatgatggcaaaggcagagaaggatgagcagggcctaaagccaaatgatacaattccaaggaggaagagcacaagaaatagaccattgacagttagagcgttggaatcttttgcaaatgaattcttgcatgcacaaaggaaacagaaaagaaaagacatcctgatacttaaagacccattcaacgcttgcagccgcaaggctcgcaccaaaggtctaaagaatgttgcatag

SEQ ID NO: 20980 - DNA, 348 bp, Glycine max
  Peptide Sequence Number=SeqID_137758
gatcgcgcccgcaagacacctagtggacccggagaagtccaacagggtcttggggtttccatctctgattacgggcctctgtcagttctacagagtgcctgtcgcccctatcaaggcaggcgcagggcgagacaccacagcagcctgggatggccggcagtgggcaatagacgcaccgccgccacctccaaagcccctcagctcatctacaaaagctggagcgttgcctacgactcatggtcgaccaacaggcgaccaactccaaagccaaatgtaagcaaaagtgctaggtccgtgactgacaagtcatcacgcgtccagctcaagacgttaaagaagcgctactag

SEQ ID NO: 20981 - DNA, 207 bp, Glycine max
  Peptide Sequence Number=SeqID_137759
atgcgtctaccggggaaggagagtctgctgatgaaatctcccataaccataaatgagattttggatgttagcattttgtttctaaatgaccatttagaggaaacactgggttcgacaaaaatagaagaaatccactcaaagtgtatcaatcttgcacagtgcggggcgagaaaaaaggttgctagcgcacgggattttggttggtaa

SEQ ID NO: 20982 - DNA, 600 bp, Glycine max
  Peptide Sequence Number=SeqID_137760
atgcatcatcaattttttaaactgtcatcactcaatcaaccatctttctccaaattcattgccttcaagcactgtttcatttgccaaacagttctggtggatctaatgctggcttgcatggtattcccagctctggggcatgtgagtgggcctcagttgtgggatccccatgattttgattttgggaagaattttggcatggatcctgcaggattggcttttacatcaagtttggcatttgactccaaccccattaggccactttccaattggatgcaaacacaacatcatcatcctttttcaccaatggtgagtgtctcctcagggacttcatcaacaactatgcctcattcctcagtagagcaaccttcaaaccaaaactatagtggaagttatgtttctaagaggcaggaggagaagatgataggtattaaaagaccaaaccctttctctttggctacttctcctgtgtcctcttccaattttaaacctctcacttttgctactactatgaaagcaagtgaaacaattccatgcgggagtggaagaggattcaacttggattttggcaattcaactttaaggttggttcaaatttga

SEQ ID NO: 20983 - DNA, 201 bp, Glycine max
  Peptide Sequence Number=SeqID_137761
atgaccctcatggaggtgactagtggtggtggaagatgctggtgggtgcttaaatggagaatgaaagaaaaactatggatgttatgtgttggaggagaaaagaaaaatgagtcatcaacttggcctaggacatatgtcctccttgacatgcaaggtgacaagtgttccctgtcatgcaaaatgacacttggccgaacttga

SEQ ID NO: 20984 - DNA, 163 bp, Glycine max
  Peptide Sequence Number=SeqID_137762
cctatccctcttaagattattgaggcgacaaggtctaacagacacctatgttagtcctttgaccgcacaaatcactcttaacgttgtcggagaagaagaagttgacgacgttcatgctaatcgtaatgatcatgatgaaggagaattgattaacatcgtctaa

SEQ ID NO: 20985 - DNA, 153 bp, Glycine max
  Peptide Sequence Number=SeqID_137763
atggacaacgacaaagtctttgatttaatgcttcgattgttgctattcaaaagctacaacaggatgcattttgcacgctatacggaactaaaaacaaacaccaactatgcaatgaacaatgagcattttactaataagcaacccctaaactag

SEQ ID NO: 20986 - DNA, 675 bp, Glycine max
  Peptide Sequence Number=SeqID_137764
atggagttgggaagcatactccattttcttcaggataagagcattttgatcactggagccaccggttttcttgccaaagttttgttggagaagatattgagggtccaaccaaatgttaagaagctttaccttcttttaagaactgaagatgccaaatctgctactcatcgcttgcacaatgagatcatagggaaggatttgtttagggtactaaaggagaaattgggtgcaaattttaattcctttgtctcgaaaaagttgactctggtacctggggacatttctcgtgaggacttgggattggaggattccattctaagggaagagatttatgatcaaacagatgtcattattaacttagctgcaacaactaactttgatgaaaggtatgatatatcgttgggcctaaatacctttggtgttaagtatgtcatcaacttcgccaaaaaatgtaccaaactcaaggttcttgtgcatgtatcaacagcctatgtatgtggtgagggaggccgagaagggctcatattagagaaaccatatcatttgggtgattcacttaatggagtgtctggattagacattaatgcagaagagaaagttgtgcgcgacaaattaaaaaaggaaattaaagaggttatgaaggaattgggcattagcaggtttgtgaaaatctaa

SEQ ID NO: 20987 - DNA, 531 bp, Glycine max
  Peptide Sequence Number=SeqID_137765
atgcgtagtgattgcttagtgcaattctccattctcaacccttttacggaacccatgaattgtgttttcgttcatgtgtccaccacccacgagtttggagccatgcgtagtgattgcttagtgcaattctccattctcaaccctttttcggaacccatgaattgcgtttttgttcatgtgtcctccacccacgagtttggagccatgcgtagtgattgcttagtgcaattctccattctcaaccctttttcggagcccatgaattgcgttttcgttcatgtgtcctccacccacgagtttggagccatgcgtagtgattgcttagttcaattctccattctcaaccctttttcagagcccatgaattgcattttctttcatgtgtcctccacccacgagtttggagccatgcgtagtgattgcttagtgcaattccccattctgaatcctttttcggagctccacgaattgcattttcgttcatgcatcctccacccaaagagtttagagctatgcttcatgattgactag

SEQ ID NO: 20988 - DNA, 741 bp, Glycine max
  Peptide Sequence Number=SeqID_137766
atgtcgcggaggtcaggagaccttggggacgtcaggtggggtgctattgcccaaaaccaagcttggctaatcccgacccaacccaggcatagtcagtcagtgagaacctgtgacgtacctaagcaggcgagctcctggcagtcaaccaataaaagaacaaagtccacgaagcaaggaagcttgtgtggcggctggccagctatgtatcttgggtggggtgataagacactggtaatcgattaccagttgggtgtaatcgattacacagtgttacctgctactggtaatcgattaccatttatgtgtaatcgattacacagtatcgtgatggcagcgcagttgatccatgatcgcgttgtgatggagtgcctagagggtgtttgggagaccctcgaaggcaatgagaggtgccgatttcgtggcacaattcgactcactgctacttcattagtacatccggaggaacccgcacgcacacttcagcaacccgtggagtggatactacctacacctactccatatcgactagttgagccggttcaagtgatagaggtgtcatcctctgaagaggatcttgaagaggacccagaggagttacctcctgaacctgctatggacacccttgacttacctgaggatgatgaagacccactccctgatgttgattctctagaggatatcatgtcagcatctgaggcagactctacagaggagagtggcccttggagggacaacgaatag

SEQ ID NO: 20989 - DNA, 537 bp, Glycine max
  Peptide Sequence Number=SeqID_137767
gcgtacatgaagggaatcacaggagcaccttacagggcacgttgtgatgctttgaccgtcacagatgtgtcctggttgccgtacacggagcatcggggggttagggcctttgaggagatttcatcattccagggtcagctgagatggggtcctatggtggtcacagctcgaccggagagagtggtacggcagtttggttacatccagagcatccctccgccgcctgtatctgtggattacatggagtggtttttccgcatatctcacccattcatgataccgacccaggcaggtgaccagccgagagatgcaccagctgcagaccctgaggactacatacagctgcccagcccccaggatgattacgacggatatgaggcgattgcacagaggttggagcgtgtgctcaaccttaggatggtcactgcagccacaaagttatatgagattatgcaggactgcctgacgatcgccagagggggagccagtgctgatggaagtgtcagggctcgtcaaagacgccgcacggagcattga

SEQ ID NO: 20990 - DNA, 312 bp, Glycine max
  Peptide Sequence Number=SeqID_137768
atgggagatcgcttggaggacatgattcgtgaccttggacaagagtcttttcagcaagcacacgcccctatgtatgaaggattacaaagtgattcaatgaaacctttctatacggggtgcaagaattccttaaccctattgtctgcggtgttaagtctggttaatgtgaaggccaggtatgggtggagtgacaaaagttttacctcactgcttgagatactgtgtccgatggatttcggaaacgagccaagaaatcttagacttgtagtagctagtgatggaatgaatccatatggcaccttaagcacttaa

SEQ ID NO: 20991 - DNA, 500 bp, Glycine max
  Peptide Sequence Number=SeqID_137769
ggagcattacaaggacaattcgttatctatattccacgaataattctaggtggagacaggagttaaatccttacaatcaatatgaaaaggaaagagcctttgatcttgaaagtgtgtttgcagaattcatggcatatcatgctagctctaaagctaatcatgattcaatacaaaatcaggagattcaatttggcaagagctattttttagaaaattatcaaggggaaccagagttacaactttgctatcaaaatgaagcagaaagaggttccaatttggatactttgttaattcaagtcaaggatacaattggatctattcaacgagcatttagaagtgcaaaaattcaggttggtaagttggtagaagaagtgactcaagttatgggcagaagagaagaagaatgtgtagaggttgaagctcaagagggaagccctgtaaatgagcatgatttagaagaagatgaggagaaagtgcaacaacgggagcagtgctcataa

SEQ ID NO: 20992 - DNA, 520 bp, Glycine max
  Peptide Sequence Number=SeqID_137770
atggcagaaatgagaaagttggatcatctagaggaaaggctcagggccattgaaggaggtgaagattatgcctttgctaacctaaaagagttgttcctagtactcaatatcatcacccctcccaagttcaagggcatacgcaaagatgaggaattgctaatacatttcttccaagaaagtcttactggggtagctgttacctggtacactaacttggaaccttcccgagtccatacttggaaggacctaatggttgccttcgttaggcagtatcagtactattctgatatggttccggataggatgcaactacagaacatgtgcaaaaagggagacgatgatcgtgatggcaaatttagtcatccttcttggacgaatgagaaaactggggcaaatgaagagggtcagaaagagggagaaacccatgctgtgactgctattcctatatggccaagtttcccaccaacccaacaatgtcattactcagtcaataacaaaccacctccttacccaccaccca

SEQ ID NO: 20993 - DNA, 429 bp, Glycine max
  Peptide Sequence Number=SeqID_137771
atggcctctaccacatgtttgtttcctcatctattattcaccatgttacaagattgttactgcttaactgttggaatagttgacgaaatcattattgatgctccatggagttatgacagttgtcctaactgtacaaccacatttgatccatcaaaaggtggctcagcttgccgttcttgccataccagtgtgatcgatacaattccacggattgagcataatggggacaaaggaaacttccttctctgggatgcaacatgtatcaagctgtttggtaagactgctggagaatgtcgagatgagttgatagcggctggggatgatattaaggtgtttccaatgtgtgttgatgaaatcctgtccaaaacttgggctgtcaaatttaagttccattcacaattacgccaatctttttttttctggatgtga

SEQ ID NO: 20994 - DNA, 345 bp, Glycine max
  Peptide Sequence Number=SeqID_137772
atggagcattttcttgagcaagtagcctggcctgaagctcaacttccattggtaagacctaacgaggctgctccgcctgagcccacacctgtgcaggtcgatccagagctagctgacccacaatctccagtggtaaatccactatcttctcctgagtgtgaggtagttcccccatctccacctctgattatcatcttcaatgcatcatcagacgaagcggtcgcccctcctgattcatcagcaggagaaatagctgaccttcctacttccccagttggaggaattttcgatctttctgattcgtcatctggagaagttgttgctctcactgattccccagtttag

SEQ ID NO: 20995 - DNA, 459 bp, Glycine max
  Peptide Sequence Number=SeqID_137773
atggaaacaactaaatcaactcaacgagcactccaaagtgtaaaaatccaggttggtgagctggcagaagcagtgactcaatttatgtccagacaagaaaaatactttgtagaaattgaagctcaagataaaatccctataaaagagcacgagtcaagagaaaaagatgaggagaaagatgaggaacaagcacaacaacaaagggagaagtactcaacaatagaaaaccaacaagaaaatattctccaaatcaataaccttcctcatcaaatgattgtcaagaaaggaaggcaaggagagcatgaggaaattgcaactgccattctttctttaatcactaacacctttcttgaaattattgggaatgtccttctagactatatgaagttcatggaatttctagctaaaaggcgaaacttcaaggaagatgtgttctatgtgactttcatgtcaccttga

SEQ ID NO: 20996 - DNA, 282 bp, Glycine max
  Peptide Sequence Number=SeqID_137774
atggtgtccatggacaacacaactttcttttccaggaaccttggacacaacggtcttctagtctttcagttgagcactcctccagaacattctgattatcacggattccacaggaagcaaagggcgctatatgttgagaccaagaccttccaacatgctgatgtcgaagtagtgttcgacatgaacattaggttctccatcagagtggatggtagtggtgtctgtggtgatggtggtggtggcaagggcaatgttttccctggagttagacatggtgagtag

SEQ ID NO: 20997 - DNA, 1809 bp, Glycine max
  Peptide Sequence Number=SeqID_137775
atgctagataaaatcctccaggctcctatggtattcttccaaactaatccagttggccgcataattaataggtttgcaaaagatacgggagatatagataccaatgtttttaatttggtgaacatgtttttggggcaagtctggcaactactttcgatatttgttcttataggcacagtgagcactatttccttgtgggctattatgccacttctgatcttcttttatgcagcttatctatattaccagagcacagctcgagaggtaaagcgcatggattccattacaagatctcctgtttatgcacattttggtgaatcactgaatggtttgtcaagcatttgtgcttataaagcatatgacagaatggcacacattaatggaaaattcatggataacaacatcagatttactcttgtgaatattagttcaaatctttggctcaccataaggctagaaacattaggaggcctcatgatttggttgatagcaacatctgctgtcttgcagaatgcaagagctgcaaaccaggcaatgtttgcatctacaatgggtttacttctcagttatactttgaacataacaaatctcttgagtggtgtactcagacaagcaagtagagctgaaaacagtttaaattctgttgagcgtgtcgacacatacataaatttagaaactgaggctcctggtgtaattgagacaaaccgtccaccaccaggatggccaacatcaggatcaattgagtttgaggatgttgttctgagataccggccggaacttcctccagtgctgcatggattgtcctttacagtacctccaactgagaagataggggtagttggaagaactggggcaggaaaatctagcatgcttaatgcattattccggattgtggaacttcagaaaggaaaaatcattattgatggttgtgatatttctacattcggactagaagatgttcgaaaagttcttactatcataccacaatctccagttcttttctctggaactgttcgtttcaatcttgatccatttaatgaacacaatgatgctgacctatggcaagctttagagagggcacatttgaaggatgtaataagaagaaatccatttggtctagatgctcaggtttcagagggaggagacaatttcagtgttggacagaggcaactgctaagtctagctagagcattgctacgaagatcaaaggttcttgtcctggatgaagctactgctgctgtagaagttagaactgatgcccttatacagaaaactatcagacaagaatttcagtcctgcacaatgctcatcattgcacacagactaaatacaatcattgactgcaatcggattctgctgctcaatgctggccgagtccttgaatatagttctccagaggaactcttacaaaatgaaggaacagctttctacaagatggttcaaagtactggacctgaaaatgctcagtatttatgtagcctagtatttggaaagacagagaataactcaaatgaatataacaaggagttggaaaaccatgtgagacaattagcttcttctcgctggactgctgctactcagtttgctatagttgctaccctttcttcattaagccatcaccttcaaaagccaagtagtgaagacaataaagatatccttgataaaacaaaggatgcaattataacacttcaagaagttctagtggggaagcatgatgaagacatagaagagacactgtataaataccatattcctacagatagatggtggtctaccctctgtaaagttattgaaggtaaacacacataa

SEQ ID NO: 20998 - DNA, 279 bp, Glycine max
  Peptide Sequence Number=SeqID_137776
atggaaagatacaaaaagtatgagataaaaaaagtcgtgtgggatgttcctactgtgagaacattaaagctcataaaatggaggtcgaatgacaatattgtggagctagatataaggagtggagctcgtgtgccagatcgttgtcgttcaatacctagtgcagcgaaacccaacaatgacaaaggaaggacaatcctagtagggagggttgttgaggagtcaatcctcagaagttggatgaccacaaattggtacttggaaaatgatcaaaaggtgtaa

SEQ ID NO: 20999 - DNA, 224 bp, Glycine max
  Peptide Sequence Number=SeqID_137777
gtgcaccaaggttcaggaattctgttgttcttaaatattcagatgaatcagacttgatcaatgctatgctagatatgattcccgatagtgagccatgttgcaagatcgagaattcaatacttgagtcgaccgatcctacaatgcttgaatctcaatctttgtctattaccgctgaacatgatcggtcaatgcttggctcaagtgagcctacaaagtttgaatct

SEQ ID NO: 21000 - DNA, 404 bp, Glycine max
  Peptide Sequence Number=SeqID_137778
atggaattgatgccactgaatggaacccgtcatgccaaatgcaagattttgttgcaaaaggaattgggtcttccagtgaggcctgattatccaatgaaaggtattgacctgattcggttggcaatgctagagctcatggaagatggtgttcagtttgttatgctaggtttaggaaactctatttatgaagattggatgagtgcaacaaaatcagcttataaagataaatttcggggttgggtgggattcaatgttccaatatctcataaaataactgcaagactaaatcaattgtatgcaatgagatatggaactatacctgtagttcatgaaactgaggggctaagagatactgttcataatttgaatccctatactgaagaaagtaaagctgaaagcactgg

SEQ ID NO: 21001 - DNA, 2223 bp, Glycine max
  Peptide Sequence Number=SeqID_137779
atggaggtcgacgaagcaccttgggttggtagtaaatttacatgggtaagaccaaatggtacaacgagaagtaagctggatagattcttaatatctctagaatggcgaactaagtggcctggaacagctcaatacacattggagaggaacttctctgaccattacccgatactgctcagatccaaatatgctgattggggtcctaaacctttccggatcctggattgttggctctctgataagtctttcaagaaaatcgtcattaaaacttggacatcaaatcagcaaagagggtggggaggttatgtcctgaaagaaaaaattaatgcactcaaagtcaagatcagggagtggaataaagaacactatggggacaccttcgagaaacagaaggcgaggtctagatggatcaaagaaggtgactgcaattctagatacttccacttgatgatcaatgccagacgtaggaataattgcttgaaaggattgatgattgatggatcttggtccgaagagccgacaatagtcaaagaggcagtcagggtgttctttgcacaaagattccaagaacttgatcaggatagacctacattggaggatgaggtaaaaagggcagtgtgggactgtaggagcgataaaagtccgggcccagatggactcaacttcaaattcatcaagcaattatggccatccattaaacccgatttccttcggtttctagatgaatttcacgttaatggattgttcccaaagtgctccaatgcctctttcatagctctcattcctaaggtaatagatccacaaatgttgaatgagtacaaatctatatcattgataggctgcatatacaagatagttgcaaagatcttggccaacagactgaagaaggcggttgaagaagcaaaaaggtaccaaaaaccgtgcattattttcaaggtggactatgagaaggcgtatgattctgtctcttggaagttcttgacctatatgatggaaaggatgggttttttccccaaatggattcagtggatggaggggtgtctaaaattagcatctatctcagtcctggtaaatggtagtccttcagctgaatttttacctcagaaagggttgaggcaaggagacccattatcacctcttctcttcaatattgtcgtagaggcacttaatggaattatgtcgcaagcaatggcgaagggattatttaggggatttttaattggtgacaacaaggtggaaattagtgtcattcagaatgcggatgacacaatcttctttggtgaggcaacaatggacaatgttattgctattaaggaaatgctaagaacttttgaacttgtatcgggcctcaaaataaattttgctaaaagcgggtttggtgcttttggggtgccggaacagtggatacttgatgcagccaattacctcaattgtagcttgatgtccttccctttcacatacctcggtgttcctattggagcaaatccgagaagatatcagacatgggaccctattattaccaaggttcctaaaaaggtggtggacaagctagtgagtctacagagaaatttcctttggggtggtgattctgagcaacacaaaatagcttgggtcaaatgggaaactgtatgcttgccaatagaagctgggggtttgggagtcaaagatatcaatgcttttaatatatcattgattggtaagtggcattggaatctattccagcatcagggggaattgtgggctagggttctcgaatcaaaatatggaggctggaggagtctcagtggagcatctacaattagtgctgaatccatttggtggagggatttaaagcggatgatggagagttggagaggagtcattactaggttgggaataggatttcaggtggaggagaccataatatacagcgcatgggggctttcaaagatacaggttgggaatgggatttcaggtggaggagaccattgttcgatagttgagcctagtggccaatactcggtcaaatatgcttatcaggcgcttacagagaatatagccgcggaggacctggatggagctctcaaggagttgtggaaacttaatctcccatctaaaatagatgatactcctggtatggtgggaattgctgtcttgggtaaatttggtgggtgtttttcctcagaatccaaggcaacactttctccaacatattcatggaacgacagaggacatgagggttaa

SEQ ID NO: 21002 - DNA, 768 bp, Glycine max
  Peptide Sequence Number=SeqID_137780
atggtgcccacattagctgcatttgtttgtgttgagaatcaggaatttaatgttcacataaagaaggaaaatggccaaatggtcatggttcctctctatcaaagtcaggagaatatagttggggaggttattattgaaccttcaaatgggaagaaggtcaaacataatggtgtaaaaattgagcttcttggtcgcataggactgttttctgtaaatgcaatagccattgtcactgatgggctgatgagttgtattttgatagaggcaactgctatgactttacttctcttgttttcaactccctgtaacttatgtgcaatacgtgaacttgatgttcctggcaatttacatgaaaggaaaacatctgatacagccgtggctgcaaggggctggcttcaagggccagtgcctccaagagagaaagaacaaggaagaagaacaaagaaaaggcaggaaagtgttattcttattgatttgctgcagacaagcgctatccagcaaatcccaactgccagctcagcaccttcatcctcagaaataatctttgagttcctgtttctgctatgctatcatcttcccgcggcccttggagaatcaccttgtcctcaaggtgatgatcttgtattagctgatcccaatcctcctaagacgtttcatccgaagacagtcctcgccattgaactaatacttcccatggagcatcctgggcaaaggatgaatgacggtagtccagaatggctaagggagacagtaaaggttgatcgttga

SEQ ID NO: 21003 - DNA, 1500 bp, Glycine max
  Peptide Sequence Number=SeqID_137781
atgggggtgcaaatagcaaccaggcccactggggccctccagaagattcctccagaagcaaggctgttgcttctggaggaagcaaccttgctcgcctgggcgagttggctgaggaaaattagttccctgaagaaaatccaagccgaggcgcttccgcaacgtttccgtaacgtttccgagagtaattacgcgaagattctcgaccgttcttcaagattcatcgttcgttcttcgttttcttcagtcttcaacgggcttattgattgtgacctaattttgaaagaaaaggtttacatgaggagaaacaaggaaattgaagatgcacaaactctccagcataaccatgagtctgaatcgagggagaatttaattagtggtacaggcatgacttgggcgagtttaggtagactcgcgagtctgttacgagtctgcgggtttacgaaaattatgaaacgtcgtcgttttgaagctgagctactcccttactcgcgacttcgtgctgtactgaagttgagctactcacctcaccttgtttcgttgttcgagttctgctttgaaagccctcactcgtatcgtcatcgctggcccttagtcgcggtccttgtcgtcgctggtcctctgtcctccatcgtcatcactgcctcgctggtcttcacttgcactctaagctttgcttcacgtcacgatgctaaggaagctctaaatgctccaaagtggaaggaagctatccttaagaagatgagagctcttgagaagaaccatacttggagtgttatgcctttgctaactggaaagaatatcggattcactcagacctatggtatagactactcaaagacctttgccctggttgcaaagttaaacacaattagaattcttctatcacttgctgcaaacttggattggcctttgcaccaattagatgttaaaaatgcattcctcaatggtgacttggaggaagagcctccaagggcatggtttgaaaaatttgcccagtcagtctatgttgataacatcatcctcattggagatgatgaactggaattggctaggctaaaaaagaacttggcagcaaaatttgagatcaaggacttgggatccttgaggtactttcttggcatggagatacccctatggatcccaatgggaaactttgggaaaaagttagtgttcttgttgatgttggaagataccaaagtgcaaaagttgaatttaaagcaatggcccaagggatttgtgaaggattgtggatttatagtcttagaagaactgaagatgacaatagaactcccattgaagttctactatgacaagaaggctacaataagcatagctcacaatcctgttcagcatgatagaacgaagcacattgagattgattgccactttataaaggagaaattggatactgaaattatttgcttgccatttgtgccttccaatcagcaaacaactggcatcttgaccaagagcctaacaagacccatttttgagcattga

SEQ ID NO: 21004 - DNA, 2772 bp, Glycine max
  Peptide Sequence Number=SeqID_137782
atggtccaggccaccggacttgcgcgcttacaagaagagaaattcctcgatcatcgtcaacccttgcgccctcgcccaccacctccgaacccctcgccttcaccccttcgagcgatccctacgatacccgtgccatcccttccgccactattaccacctcctccccgttcaaaccctctgaccttgaagtgcctgtcccccgaagaaatcatcttacaccgcaagaggggtctctgcttcaattgtgaagagaaattccacagaggacataagtgtgcctccagggtttttctcctcattactgatgagacagaaccggtttcccctcatatagctattcctgacccacctgaaaacccacctcccgacccgctcgatagccctaacttatacttagcccaaatatctttgaactccttggtaggccatatcgcaccggaaactctccgccttgtcgacagcctcgccggtcaacaacttgtccttctatttgatgggggaagtacccacaacttcattcaacaacaactagtcacccaattgggattgtcatgccgcgaaaccaatcccttatgggtcatggtaggcaatggccagtacctggagtgccattgtatctgtgaggacatcgccatcaatattcaggacctcaccttcaccattgatttatatgtttcgccgatttcgggcgcgaacgttgttctgggcgttcagtggctcaagtccttgggccttgtccttactgactacactgctcagaatatacaatttatttatgaaggtcgtctaggacctggactttacttccacatcacagtactcatagaggataatcctccttcacgcatggaggacttgcccctcgtactccgaacattgctcaccaaatttggtgccttatttcgaccccaccatgcgatgccaccggctagggacaccaaccaccacattcacctgcttcctcaatccactccagttaacatgagaccgtataggtaccctcacttccaaaagcgcgagattgaattgcagatcgactccatgctccaaaaggtcctgattcagccaagtaccagtccattttctttgctgtgcttctctaagcttgacctattgcaagggtatcatcaaattcgcatgcattcagaggacattcccaaaacagctttccgaactcaccatggacactatgagttcaaagtcataccttttgggttgtgtaatgccccgttgtcctttcgggccaccatgaatctgatattccggccttatctccgtcattttgttatcgtcttcttcgacgatatccttatttacagtggctcactgaacgatcatctatgccatttggaaatgacattccaggtggagtatttgggccacttggtatctccgagaggggtcgagcctgtcgcgtccaaggtggccgactgtctcgtagtggctggtgccccaatccacgaaagccttgaggagttttttggacctgcctttgagcaactcaaccaagcactatccactacccctattctcgccttgcccaattttcaattgccattcaccatcgagactgacgcttccggtattgggatgggagctgtgttgtcgcaacagggacactcgattgcgtatttcagtaaaccatttagcacgaagcttcttcgggcatcgatcctcaaagaattgctgactcaagtcatacaaaccccagaacaacacatgtatctggcgcgtttgatggggtatgactacaccattcagtatagatcaggggcccataatcaagctgctgatgccttgtcccggctaccggagcacacctattctctttcgatgatactctttgtcccttgcttgacttttctcgaagagctacgccagaaattgcgctaccatcctcaatataacaagcaacaccaagacatcgtgtgttctccggagacacatcccaacttcaccattgctaatgatctgattttgaagaagggacgcatttggttgccgcgggaccttccgataatatcttctctccttgaagaatatcatgccacgcccatagggggccacatgggggtcgcaaagatgattgctcgtctctcagagaatttccaatggccgggactcagggatgacatagcaaaatttgagggcctctctttggatttcatcactggtcttccgccttaccaagggaagatcgtcatcgtggaccgattctcgaagggcattcacttgggcattctacttctggcacatactgctcatatggtcgcttccttattcgttgacatcatcatcaagttacatggcattccccgaagtttagtctccaacaaggatcctttgttcatcagtcgtttctggcaagagcttttcaagttgagtggcacaagattgaggatgagttcggcttaccatcctcaaagcgatgcgtggggaaagcttctcccgtgggttgaatggtcccacaatacttcgtggaacatgggaatagggtccaccccatatgagattacctttgtccgcaagcccttcaatttcccagaatacctcttgggatccttgaacatagacgtcattgacaacatgttgaataacatggatgaagtgtttcacagcattcgaaaaaagttggtcaaggcccaggctatcatgaatcacaacgctgatgcagtttctgacaaattggccaaacacttctacggtcccttccagatacttgatcgggtcggcactgtggcttatcgtttgaagctaccagaaggagcttga

SEQ ID NO: 21005 - DNA, 333 bp, Glycine max
  Peptide Sequence Number=SeqID_137783
atgcagggacaggtggaggtggcggcaacggcggtggcatgggaggggatggcatcctccaaacggtcagaggaccccgaggccttatcagagtcaggcatgaccaaagttgatatagtcgtggctgcaggggggtggcttcgagggccagtgcctccaagagagaaaggacaaggaagaagaacagagaaaaagcaagaaagtgttattcttattgatttgctgggaaccaatcttaacggctacaacagaattataactgctagtcagttattcgagcagaagcttctaatggttgagaactcgaagttgcttgttccctgcatggcttaa

SEQ ID NO: 21006 - DNA, 600 bp, Glycine max
  Peptide Sequence Number=SeqID_137784
atggcaaagaaactagcaaagaacatgccgtttgaaataacaagtgatgaacctttgaagtgcatgtcattgtcatcatcaagcaacggctacgacgtgccatgggtagaaaagtatcgtcccagcaaggtcgccatcatcgtcagctacgaggacgccgtctccaggctccaagtcatcgctcgcgacaacaacatgcccaatctcattttatctggtcctcctggaaccgacaaacccactagcattctcgctctcacacacgagcttctcgaaggaccaaattgcaaggaagctttttcaattctggacgatttcctgttaatttatcctttcacttttggttatagaggaattgatgttgtgaggaacaagatcaagatgtttgctcagaagaaagtcacactgagcctggggaggcacaagatagtaatactggatgaagctgatagcaatttggggctacctccagaatggtatagagcactgggatgggtgttccctacgtgggcaaggacgcattctcttgacacgggagaagctgtcaactttctaaaaggtgttgttgttatagctgaccggattgttacagtaagcaag

SEQ ID NO: 21007 - DNA, 492 bp, Glycine max
  Peptide Sequence Number=SeqID_137785
atggcaacaccactagccgtagccaaagaagaagagtggtacatcgtaatcgtgaagaagaagtgcacaactactattcatatattggcttatggatcacctgctgacagtgtcgatgaatacgttcgaattggtgaaaccactgcagtggaatgcttggagcgatttgtattaggcatctgcaccatatttgggaatgaatacttgaggagaccaaataatgaagacatcaaacgcctactacaaatgggagcagcacatggatttccaggtatgttaggttccattggttgtatgcactgggaatggaaaaattgtccagttgcttggaaaggtcaattttgtcgagatgatcatcgcaacccaacaatcattcttgaagccgtggcatcacaagatttatggatttggcatgcattttttggaaccgccggttcaaataatgacattactgtgttaaatggatctaatgtgtttgatgaagttttgtga

SEQ ID NO: 21008 - DNA, 234 bp, Glycine max
  Peptide Sequence Number=SeqID_137786
atgcggcagtttggatacacccagaccattcctgctccgcctgtcgattcatgggtgtcgtatgatgatatacacaacaggtggatgcactacctggaccatatggttctagcaggtgaggtgtgcgctgtgccagccccgagtcgtccctcaggccccacagacaaatatccctcacgtgccggagctaggagcaccgtcaacatctgcgaggcccgctttggaggagcctag

SEQ ID NO: 21009 - DNA, 720 bp, Glycine max
  Peptide Sequence Number=SeqID_137787
atggacgaaggcgaggaagggtatggtgagagtggcgacgaaggtttcttgggcgaggaagaagatgacgattacgaggacctttacaataatgtcaatttcgatgaaggattcccaaatttcaagattttgggggttgcttttatcaaggaagtatttgcgtattcggaagataagatttctgattttgagatgaagctgatggacattgacagtgaacaccttgggattctagaggtgtatcatgccatgccattgttaaaatcccatcctttgagtttgctaggatttgcaaggatctcaatagtattggtgacactgggtgtaaagttttccaccaaaggagacattggaactaccaatatagtttgtaggcaaaatacttctgaggacaagcttgaagaagctactgtcattgagatgaatgagcaattgtccaacacaattaccattagtatgccaaatgagttgtcaattgtagttgagtacaagattgctaagataggctatgtgtggttctatttggctcccaagatagaagaggatgaagaagatacaaaacctaagtttaatctacctattagatgttgggttatgggaattgtagaaggtgagaatgaagaagggataggtgttggtgttggattaggggctctgcaacgtgaccatggtgaccacaaccatgaacgtggtggtgccgaacaacaagatcgtcgcgct

SEQ ID NO: 21010 - DNA, 315 bp, Glycine max
  Peptide Sequence Number=SeqID_137788
atggtgattaatattttaaactccggggtcaattcaagcgggggcggggcccgaaagcgatggcatcgtatagcaaaggcgacgctgcagggtaagcgttccgacagaaccagatggtccattggcccacgtgtcactcaccctgcgcgtgccattctgatggctgtggctgggaatttgggtgaaggaacaaattctttggatatgccaaccttattgctttcggggttaagtgagggattaagaggactagagtgtttccaactcgttcagagttgtaacccggacaatggaacaagaaacgacaggagatga

SEQ ID NO: 21011 - DNA, 3555 bp, Glycine max
  Peptide Sequence Number=SeqID_137789
atgaaagctctgtacagaagctctctcttgctcctcttcttcctctccgtctgttctgcatcttcttcttcggttcccactctgcaactcctaagcttcaaaaactctctcccgaacccaaccctgctcccgaactggctcccgaaccaaagcccatgctcattcaccggcatcacctgcaacgacacccagcacctcacttccatagacctctccggcgtccctctcaccacaaacctcaccgtcatcgccaccttcctcctcaccctcgacaacctccagtcactctccttaaaatccaccaacctctccggccccgccgccatgcctcctcctctctcccactccaagtgcgcctccacattaacctccctagatctatcacaaaacgccctctccggttccctcaacgacatgtcgtttctctcctcctgctccaacctccaatccctcaatctctccagcaaccttcttgaattcgactcctctcactggaagctccacctcctcgtcgccgacttttcctacaacaagatttccggccccggtatcctcccctggcttctcaaccctgaaatcgaacacctcgctctgaaaggcaacaaagtcaccggcgaaaccgacttctccggttccaattctctccagtttttagacctttcttccaacaacttttctgttacgcttcctactttcggcgagtgttcttcgcttgagtatttggacctctccgccaacaagtacttcggcgacattgctcgcactctctcgccttgcaagaacctcgtttacttaaacttctccagcaaccagttctccggtccggttccttcccttccctccggttcgctacagttcgtgtaccttgcttcaaaccacttccacggccagattcctctccccctcgccgacctctgctccactctcctccagctcgatctctcctccaacaacctctcaggcgctctccccgaagccttcggcgcttgcacttctcttcagtccttcgacatctccagcaacctcttcgccggtgcgctgcctatggacgttctcacgcaaatgaaaagcctcaaagagctcgcggtggcgttcaacgcgttccttggtccccttccggagtctctgacgaagctctccactttagagtcgctggatcttagctccaacaacttcagcggctcaatcccgacaacgctgtgcggtggtgacgctgggaataataatattctgaaggaactttacctgcagaacaaccggttcacgggttttattccacccacgctcagcaactgttcaaacctcgttgctttggacttgagtttcaacttcctcacgggaactattcctccaagcctagggtctctttccaagcttaaagacttgatcatctggctcaaccagctccatggagaaataccgcaggagctcatgtatctgaaaagcctcgagaatttgatcctggatttcaacgacttgactgggaacattccctctgggcttgttaactgcaccaagctgaactggatctccctctccaacaacaggctcagcggcgagattccgcggtggattgggaagctttctaatctcgccatacttaagctcagtaataactctttctccggccggattccgccggagctcggcgattgtactagtttaatatggttggatctgaatactaatatgctcaccgggcccattccgccggagctgttcaagcagtcggggaagatcgcggtgaatttcatcagtgggaagacgtatgtgtatataaagaacgatgggagcaaagagtgtcatggtgcggggaacttgctggagtttgccgggatcagtcagcagcagttgaacaggatttcgacgaggaacccgtgcaatttcactagggtttatggaggtaagttgcagccaacgtttaaccataatggttctatgatatttttggatatctcgcacaacatgttgtcagggagtattcccaaggagattggggccatgtactatttgtacattctcaatttgggtcataataatgtgtctgggagcattcctcaagagcttgggaagatgaagaatctcaacatccttgatctctcaagtaatagactggaggggcaaattcctcagagtctcacggggctttccttgctcactgagattgacctgtcgaataacttgcttacggggacgattcctgagtcgggtcaatttgatactttccctgcggcgagatttcagaacaactctggtctctgtggagttcctctcggcccatgtggttcggacccggcgaataacgggaatgcgcaacatatgaagtctcacaggaggcaggcttctctggtggggagtgtggccatgggtttgttgttttccctcttctgcgtctttggtttgatcattattgccattgagaccaggaagaggaggaagaagaaggaggctgctcttgaagcctatgctgatggtaatttgcattcgggtcctgccaacgtgagctggaagcacaccagtacccgggaagcgcttagcataaaccttgcaacgtttaagaggccgctcaggaggcttacttttgcggaccttcttgacgctaccaatggctttcacaatgatagtctcattggctctggtgggtttggggatgtttacaaggctcagttgaaggatggaagtgttgtggctatcaagaagctgattcatgtcagcggccaaggggacagggaattcactgctgaaatggagaccattgggaagatcaagcacaggaaccttgttcctctgttgggatactgcaaggttggggaagagaggctcttggtttatgagtacatgaaatatggaagcttagaggatgttcttcatgatccgaagaaagctgggatcaagttgaattggtcgattaggaggaaaattgctattggagctgctaggggattgtcttttcttcaccacaattgtagcccccacatcattcatagagacatgaagtcaagcaatgtgttacttgatgaaaacctggaagctagagtctctgattttggaatggctaggcatatgagtgctatggatacacatttgagtgtgagcacactggcaggcacaccagggtatgttcctccggagtactatgagagcttcagatgctctaccaaaggtgatgtctacagttatggtgtggttttgttggagctgctaactgggaaaaggccaacagattcggctgattttggtgataataatcttgttggatgggttaaacaacatgccaagctgaaaataagtgatatttttgacccagagctcatgaaggaagaccccaatttggagatggagcttttgcagcacctgaagattgcagtttcctgtttggatgatcggcattggagacgtccaacgatgattcaagtgttgacaatgttcaaggagattcaggcaggatctgggattgattctcagtcaaccatagccaatgaagatgacagtttcaatgcagttgaaatggtggagatgagcattaaagaaacccctgaattgagcaagcattag

SEQ ID NO: 21012 - DNA, 1755 bp, Glycine max
  Peptide Sequence Number=SeqID_137790
atgactgccggggcagtggcgacggcagccggagcggcggtgatgctgtacctcgtattccggcggaggaggaaggccgaaaaggagtggtcgaggtcgcggacgacgtggaggttgaagccagctcaggcgccggcgaatatgttagaatcgattgcgacgttatcggagacgttgaggttcacttactcggagactattgggaaatggccaatcgccgacttggccttcggcatcaattacttgatgcgcaaacagggtgatttggcagttgcgagtgtgtatggtggaagcagttgtgtggagctgaaaggccctggagttgtagatgagttacaagagcttttgaggttgttgactttgtgcatgcttttctccaagaaaccgtttcccgagtttttagattctgccggattctctctagaccatgttcttcttcacaaccccgaagctgggcttctgaagcccgctttcacaattatacatgatacgcagtcaaaatgtttccttctattgatccggggaacccatagcataaaagacacactgacagctgcaactggtactgtggttccctttcaccattccattttaaatgatggaggaataagcaacttggttttaggatatgcacactgtggtatggttgctgcagctcgttggattgcaaaactctgcactcctacactacttaaagcccttaataaatgtccagactcagaagtcaagattgttggacactcacttggtggtgctgcttgtatgacatgggagttaggtgaatcagggaagcacttcatcactaccattataaatggttacgacttggtacccacattatcagcttcctctgttgatgatctccgatctgaggttgctgcgtcatcttggatgagtgatttatgggatcaggccgagcatacaaaggttctgaaagccgtccacaactcagcaactgcacttggatctcacttacaattcatatctagtgcaaaagacaaggtagctggtgtaggtgctattctacggcctgtgaccagtggcacccaggttgtgatgaagcatgcacaaagtgttgtcgaagctgttgtcaaaactatggcttcacaccgtcagaatattggaccattgccaaaatctaaattaaataacttggccgaatcttctctggaacccaaaaatataagtaaatctcttttgactgaaagtgtgcctgtgctgaataaggatgaaccaaactactcaagtggaagatctggacttgatgccatagatgaagaggagcaactgattgatgctaacgagcacattacctcttctgttgtaaatgacatcactgaaggtgaattgtggtatgagctggagaaggaacttgaaaaacagaacaatatcctgaacattcgggcgcaggtagaagaggcagctgcagcaaaagagataactgaggaagagaatcagcttattgatgctgcacaaggcaccagcaattcaatcacggcatctgacaaagtagatagctatcgtttttatcccccaggtaaaatcatgcacattgtctccactccttcgtcagatgactttagttcaagctccattgaggaacatgtgttggcgcgacccgccgtctctaaacgatcattaacgaatcgcctttcaccccctgacaggacagtaaggttctctgctgctgagtttgttcttcatagcaccttccacagtgtccctctatcagtgggagtgtgggacgccctttga

SEQ ID NO: 21013 - DNA, 516 bp, Glycine max
  Peptide Sequence Number=SeqID_137791
atggtgaatacattgccctctctcgatctcacccaccactccgatttcgacgcattagcttcatctccatctgcggctacggttccctcctctccggttgtccctgaatcactagatgggaagccctttaccaatccagcagttctctgtgcttcttacactgatgaggaattctttaaatttagatgcaacagcatccaagcttatattctgttagaaaatatagtagattatgcaaaaacactgaactgccagggccgagaaaaatattttcaacaattcggggagtataagatccataagatttggcgggatggtgttttaccatgccctgtttatcttggtcactgtgtcctggctgcaaaaagcctcggtgatgaagtccacaataactttttggatcatactttccttgctgaccgtaaaacgaccatacatcagtactttgaaaaagtgagtacatgcatcttggaagaagagccacctgagtctttgaaaacccgttatggtggttga

SEQ ID NO: 21014 - DNA, 744 bp, Glycine max
  Peptide Sequence Number=SeqID_137792
atggcgtacctaaacgctcggcgcaccttagcatataggctggcaggagctctgtcttcgtcatccgcaagcgcgtctcgctgtcgcttcgcattggcgttgcaccacgccaaacaaaccgtacccattcctcacccggcgagttttgcggttcggactcaatcttcgggttcgggttactcgcccctgaacgacccctccccgaactggagcaaccgtcccccgaaggagaccattcttctcgatggctgcgactacgagcactggctcatcgtcatggagttccccgataaccctaaaccctccgaggaccacatggttaactcctatgtcaaaaccctagctcaagtcctcggaagtgaggaggaggctaaaaagaagatatactctgtttccacttctacgtacacaggtttcggcgccctcatttccgaagagctttcttataaagtcaaagagttacctggagttctttgggtgctaccagattcatatcttgatgttcccaacaaggattatggaggtgatttatttgttgatgggaaagtaattcctaggccacagtatagatattcggataggcaacccagtaggagtagacctcggccacggcatgacagacagcggcaaacaatgcaggttgaaaggagagatcaacagaactggaaccaaggtccggggggatctatgcagccatccactgcaatgaatagccaaaactttgtgtccggtggagagtactaa

SEQ ID NO: 21015 - DNA, 297 bp, Glycine max
  Peptide Sequence Number=SeqID_137793
atgggcaccgtgtacaatctacgtgaacaacaaaagttagagttactttcaattttaaccaacaaattgccacaacaggcattcctgcaaggagttggatgtcggatgttacgaggagttaaatgtggaaggcactgcagaattcttggtggcagagccatatggggtggtggagaccaaggggcagtggaggtgggtttcgacgttaagggagagaatatgaacttgaggttgacatcgacagatccaacccaacaatctaaggttgatggcaactacagagaggttggaagatag

SEQ ID NO: 21016 - DNA, 732 bp, Glycine max
  Peptide Sequence Number=SeqID_137794
atgagccaaaggacaacaacttcaagagctagagaggagcaatataagggaaagacttctcaaacttttcaagctactagtccaataagtgatccttattcaacaaaagcatgcatggaattcttggacaacatgcaagatgttcccactttagcttactttaagttgatggagaagtttacaagtagtatgtctttgaattcatcttatgatagttcaagtagcatagattctgaattggatgattatgacaatttaatggatttagtagtttttattgataaaactccatgtaggacatctatgttgaccgaaaaaaatgaaattggtaatttatgtgatggtaagaaagtcagcatagaggaagtggttgcaatgttcttgattataatatgtcataacttgcatcatcgggtagttgatgaacggtttcaacattcattgcacacggtgagcaagtggttccggattatcctaaaagcagtttgcaagttaggcactgacataatccatcaaagaaaccaaacaagtacacatcctcatattaggggcaatccaaaatactacccatacttcaaggattacattggtgccattgatggaacgcatgtatttgcttggacttttgcttctaaacaaactgcttttcgtggaagaaaagtgttggtgacacaaaatgtattagctgtgtgtgattttgatatgcttttcacatttgtttattctggttag

SEQ ID NO: 21017 - DNA, 240 bp, Glycine max
  Peptide Sequence Number=SeqID_137795
atgaaacctcaacctcaagcagatcttgctaacattggaattgggtcccctggccagcagaagaatgtttggaacctttcatcagagcctcaaattctgtgtcaatacaaattttatccaacctatttgaccgctaaggtcattcagatgaaagtagaggacgtgaaatgtaatgaagctgcttcaagattcattgctgaaaacagaccagagttaccacaaagaggcttggttgggtga

SEQ ID NO: 21018 - DNA, 1329 bp, Glycine max
  Peptide Sequence Number=SeqID_137796
atgaattccaacttcaatttcgatttcgatctcggcatcggatccaaccgtcccaaatctcttaacgaccagaaaaaccccaaaccaacttcctcctattcctctgcccaacccgcatggacccaccgacccgcccccactcagaccaccgccttgcccggtgggcccccctccatggtcggagacatcttcggcaagagttggggaacccctcaaccttcttccgcttccaaaaacatcgggatcgttaataagaaccctaaccttttcggagatttggtaagttctgctctgggcctgggttccaagaccaacgttcctctcaaaaatgctcccgcgcccaataaaacaacaaccttctcaatgggaaacatggctgattctttgcccaaaacaggctccacgccacagagcagtgctagttgggcatcatcctctgggggttttaatgtcaatgccaataaaaccactcccaatcttgggggtccttcattgcgaaacatgggctctggaatcggaaccaattctaatactaacaaggatcccttcagttctctgtctggtattggatccaagcaatcttctactcttaactcagctgctaaaggaccaaaggttgatttgggggacgatggttttggagattttcaaaatgcttccaaacccagctccgctgcgttcccatccactgcttctcctggaattgatatcaattttactagatctactgctgctgctgcttccaatcagggatcaggtggtggtggtgatccaatggacatgtttttcacgacgatttcttcctcggcctcaggtgaaggtgctgctgcggcctctgatggatttggaggacaggacaattggggtttggattcggagtttggtgggggaggccaagatgtgggtggcaccactactgagcttgaggggctgcctcctcctcctgctggggtctcaggctccactgccaaaggcaaggggatggacagttacaagcagggacagtttgccgatgctattaagtggctttcgtgggctgtcgtccttctagagaaagctggggatagtgccaccactggggaggttttgtcgtccagggcttcctgttacaaagaagttggggagtataaaaaggcagtggcagattgtacaaaggttcttgaaaatgatgaaaccaatgtatctgtcctggtacagcgtgctctgttgtatgagagtatggaaaagtacagacttggtgctgaagaccttaggaccgtgctgaagattgatcctggtaataggattgctagaggcaccgttcaccggttggctaagatggctgattag

SEQ ID NO: 21019 - DNA, 894 bp, Glycine max
  Peptide Sequence Number=SeqID_137797
atgatgacaactcccactagtgattgtgcgaagacaattgaagaagtaaaaggaaatgttgaagcatccaagaaaacttttgcgctttgttttttgtcgaagaaggagagaagtgtagagaagcgtgtgaaggaaaggaagaaaatcaaccagaaggtgatccccgtagtagtcagcccaacaggccgatgtcaaaaggcccagaagcccaacccgtccttgaaattcggtacaccgcaagtgcgtattccgaaaaaggacacgtggcaatttgctcagatccgtgttactctccccagacccaattgcgtcaaattcacgatgatcaccatcatgatggtcgccgacaccgtcgccgtaaccgccgccaaaggcctcggcgtccttcgggcctatcaatccacctgtaacttttccgtcgccgatcagatctccgccatgattcagacttacgacgccgtcgcgccgccgccggtcaagcctactacctacaggctaagacgccgaacgctcctccggagaaaacaacttaccaaacgcagattatcaggtgacgactccggggacgccgggaacgaggggttcctcttcggtgacggcggagacggtccttttggaggtggaggtgacttcggtggcggcggcgtcggtggtggtggttggaatttcaatagatttgggggtggaaacaattgggatgaaccgtcatcttcggttccggaccctgcgttcgatttcgtgtatcaggtgctgtcgtggattatgctctcgaattgcttgcatttttcgttcaagaggattgttcgaattgttgcagcggggtcgattgtggattccgatagggaaaaggtcccgccagattggttccaatttgctgatttggtacccttttaa

SEQ ID NO: 21020 - DNA, 162 bp, Glycine max
  Peptide Sequence Number=SeqID_137798
atgtgttgggtttttaaaactgttttatccctcacactgatctctttctcaagtctccacgacttctctctctctccacctgaccctctctctcgccgtcgttcttcattggtcgctggtcgttggtcgtcgccacccattgccgcctttgtcagtcagtga

SEQ ID NO: 21021 - DNA, 306 bp, Glycine max
  Peptide Sequence Number=SeqID_137799
atgactactgagctcccattgtctccttccttccagttcaaccatgaccctccttcttcgatgcataaccccaccttcaatttttctgaacaaatttttgatgcatgggaacaaaacacaaaacgccattttatttatctggtttgccgttatcatccgacgctgagtctcgcctccatggtagcagtgctcatgtttggccatgaaggaggaagcacgatggagggttttcaccttttcggaggcgaggacaacaacggctacagaggagttgaatgtggcgaaaagggaaaaggaggtcgatag

SEQ ID NO: 21022 - DNA, 1791 bp, Glycine max
  Peptide Sequence Number=SeqID_137800
atgtcacctgattcttaccgaaacagaaatatctgctatcaattaatgggttgcgtttgtggcaagttttctccccctcgagaagagaggccgagaccaccgcaagtgaagagagttgcaagcaaagagggttcgagaactacgcgttcctctaagcatgtgggagagggtgtgaagagggagactcagagacagagagtgagtgtgagtgttaataaggattcaactgctaatgatggtggtgttgtagaaggagaaaagggaaaaacggttgctaaaaagggcaagactactaaggatttggatgttaaggaggagaagatggccgaatatggatttgtggacgggtggccaaagtggttgctcgataatatccccgcaaatgttttggctaaaattgttccaaagagcgctgattcctttgaaaaacttgccaagataggacgtggaacatatagtaatgtgtacaaagcaagagaaaagggcacgggaaagattgttgctttgaagaaggtaaggtttgacacgtcggattctgagagtatcaagtttatggcaagagagatcatgatactgcagatgctggatcatcccaatgtgatcaaacttaaaggactggcaacatcaaggatgcagtatagtctttatctagtttttgacttcatgcagtctgatctcacccgcattatctcccgacccggggagaaactcaccgaagcacagatcaagtgttatatgcagcagctcctttctggcctgcagcactgtcatgagacgggaatcatgcaccgagatatcaaggcttctaacttattaatagacagaagaggagtgctgaaaattgcagattttggacttgcaacttccattgaagctgaaaggccactaacaaatagagtggtgacactttggtatagggctccagaacttcttttgggttcaaccgattatggattcagcattgatctctggagtgcagggtgcctgttggctgagatgcttgttggaagacctattatgcctggcaggacagaggttgaacagattcatatgatcttcaaactttgtggttctccttcagaggattattttaaaaaactgaagctaagaacaagttatcggcctccaaaccattacaaactaagtttcaaagaaaactttcagaattttccttcctcttcccagggtctcttggctacatttcttgatctcaatcctgcccatcgtggcagtgctgcctctgctctccaaagtgaattcttcaaatgtagtcctttagcatgtgacccttcagctttgccagatatccccaaagacgaggatgaacgcttgcaaactaagagaggcaaaaggcaaagggtttccaaaagggggcaatcatctcaaacaagtagaagtgatgctagtcagtcagaaaaggtccaaattactgctgaacaaccccgtgaagatacagaatcgtctaaagagaagaatatggaacaacacaagcagggtcaagaaactggtcatagtgctagcagcacatcatccggttcaagactctttatgaccgaagggagcacgaatgcatctatgtccccagtttttctctctagtggcagtgtcagaaaatcccccaaaatagagggccaccctaatgctcttaggaacatagagaactatagtgctctcttacaacagacttctgtacttgatatgatcaaccgcaatgaaggcaaggaatttcctcagcttctcaaatcattctccgcgttggattttcgacttgattctgacaagctatcataa

SEQ ID NO: 21023 - DNA, 267 bp, Glycine max
  Peptide Sequence Number=SeqID_137801
atgtcaggatttacacgcaattctcctcaaatttcagccagcccgcatcaattagaccttgcaccttacgcttcagagccctaccatgctcaatggaatgccccggggcttctccgtgacaagcacacgttgcgtttgagtcatattctcggagaaatggaggttgatgaaccttggatagggttatggctaccattgaattatcatgtagatatgggatcaagtggtgttcgtcatgggaagtgcggtagacagactttgtggtag

SEQ ID NO: 21024 - DNA, 1416 bp, Glycine max
  Peptide Sequence Number=SeqID_137802
atggcagttgctgtccatgaatgtcttgtgagaatgaatgttttgatttcccttcctaaaatacttgttcaggtggcattgctcttgctgctggcgttgagcaatgaagttcgagttaatggtgatagcgatggtagacaatgtgaggttaatccagcactaaagccaagaccacacactgtctccatcttggagtttggtgcggttggggatggtaaaacattgaacactattgcattccagaatgccattttctatctcaagtcatttgctgacaagggtggtgctcagttatatgtgccacccggaacatggttgactcaaagtttcaatcttactagccatctcacacttttcttggaaaaaggtgctgtaattcttggatctcaggatccatttcactgggaagttgttgatccattaccttcttatggcagaggagttgaagttcccgggggaagatatcagagtttagttaatggatacatgttacatgatgtggtgataacaggtaataatggaatcattgatggcatgggattgggttggtgggaattgtttagttcccattccctgaactacagccgtccacatctgattgaattagtggcatctaatcgcgtggtagtttcaaatcttacattcttgaacgctcctgcatatagtattcacccagtttattgcagcaatgtacatattcacaatgtttcaatttctgctcctcaagaatctccttataccattggcatagtaccagattcttctgatcatgtttgtatagaggattgtgtcattgcaacgggatatgatgcaatttcactcaaaagtggctgggacgaatatggcattgcctatggcaggccaactgagaatgtacacatcagaagggtacatctgcaggcttattctggctctactattgcatttggcagtgacatgtctggtggcatttcaaatattcttgtggagaatgttcatctttacaactcaaagagtggcattgagttcagaaccatgaggggcagaggtggttatatgaaggaaatcatcatatcagacatagaaatggagaatatatacaccgctatggccgccacaggttattgtgggtctcatcctgatgataaatttgaccctaatgctctaccacttttggaccacattattttgcaagatatgattggcacaaacatcactattgctggaagctttgctggtcttcaagaatctcccttcactaacatatgcctttccaacgtaactttgtctataaattctgtttcttccattccttgggaatgctcaaatgtctccggattttcagattctgttcttcccaaaccatgtcctgaccttgagaccctttcagattgtctctccctgctcagtatcaagggaaaaaccgctgtcatgtga

SEQ ID NO: 21025 - DNA, 318 bp, Glycine max
  Peptide Sequence Number=SeqID_137803
atggtgtttttcctaagctacacgaaagcaaaggctaaaaacgctcaagtgagaaatggtctcggacacggaaacgtcgcgcacacgccaaacaccttctcgaagatccgaacgggtcaggagcccttgcatcatcaacgagattttttagacgacagtgacaccactctaaacggtgcagttgaggcgatgtacagtgaaatggcttctcgtcacagggttaggagcccttgcatccaaattatcaagactacaaccatcccagctaagctttgcaagaaggagagcaccaagcaatttcacaattcaaaaatctag

SEQ ID NO: 21026 - DNA, 201 bp, Glycine max
  Peptide Sequence Number=SeqID_137804
atggcctatgaaaagaatcctcatcctttcccccgaagaaaaggacagcagaatctcctcaatggagaacaaataacgaatgctaaaacccgaattcccaaagaaagaaatggaaaggaagaaatgagaagaaaggaaaagatcggaggaaaacagaataattcccggttaataaaggaaagagaacagaaggtcttctga

SEQ ID NO: 21027 - DNA, 267 bp, Glycine max
  Peptide Sequence Number=SeqID_137805
tcgacactggcagatggtggtcatcctgcccaaggaacacctagttgtctggtcttgactccacagcctaaatcaaaggctgttgctaggtggattgtcatcaagtgtaatagacaaaaaggaagcattgagtacggctattatgtcattcactggatgtccaccatcacattaggaagtttcaggaataactgggaagcaaccattggagccagagagattaaaggcatttcggatccagtgggcacggtattatctccgagttag

SEQ ID NO: 21028 - DNA, 360 bp, Glycine max
  Peptide Sequence Number=SeqID_137806
atggggcccgaaatctaccctaaggctcataagaacccttgggccttcacttgcatctctggcccaatctacttggagttttctatccaatgcctttgcgggccaatagttttgtccatggaaggaccgcccccggcaactgaagaaaggaggaaactcgatctccttgaggagagattgagggccgtggaaggatttggtgactatccgttcgcggacatgacggatctctgcttggtacccgatgttgttatccctccgaaattcaaagtaccggacttcgacaagtataaagggacgacttgtcccaagaaccatctcaagatgtactgtcggtcaagtgtatggaccacgttgtag

SEQ ID NO: 21029 - DNA, 207 bp, Glycine max
  Peptide Sequence Number=SeqID_137807
atgtcatatgacgcaacgattgaggtgaggaaccatgtttccccagagccagaggtggaggacgccggagttgcttcgttggcgaatccaaaggcttgtgacaaattcggaatgcaaaatgattttaaaggttcaaaggtagcaagcaaatctgaaaatgtgagtaaatgtgaagattttatggcaagtgagattaaagtttcatag

SEQ ID NO: 21030 - DNA, 624 bp, Glycine max
  Peptide Sequence Number=SeqID_137808
atggtatggggcatacataggagcagagtgacaccagaggtagtgcttggctgcttgattataaatagagggcactcctctgctaaagaagcacacagcagcaagcatctccttctcaaactagtagaatccattttattattcataatgggtgttttcacatttgaggatgaaaccacctcccctgtggctcctgctaccctttacaaagctctagttacagatgccgacaacgtcatcccaaaggctgtcgaagccttcaggagtgttgaaaaccttgaggggaacggtggccctggaaccatcaagaagatcactttcgttgaggatggagaaagcaagtttgtgttgcacaaaatagaatcagttgatgaggcaaacttgggatacagctatagcgtagttggtggagttgggttgccagacacagtggagaagatcacattcgaatgcaaattggctgctggcgccaacggagggtctgctgggaagctaactgtcaaataccaaaccaaaggagatgctcagcccaacccagacgacctcaaaattggcaaagtcaagtctgatgctcttttcaaggccgttgaggcctaccttttggccaatcctcattacaactga

SEQ ID NO: 21031 - DNA, 849 bp, Glycine max
  Peptide Sequence Number=SeqID_137809
atgaacggattagcaaaaaccaatgagcaccaaagcacgtatttgtgttcgcctacccttacgagagatgccaagtttaaggtttgttccttccaactaagctccatgcctccatggctcgggattcacaggcacctcgtgtcacgcaaatacaggtccgagtggactgcaaagggtatacatgatcttcgtgttgacctacttcaacaaaagctcacaattattgggtgggcagatccagaacaagttgtcaaagcaattaagaagacaaaaaaaaatgccaccatttgctctagtattgaactaacgtctccatctaaaccaactgaaccagagccaaaagaaaatgcaccagtccctgatgcaacacaaccaccaccagcacgagttccaccacctcaagcaagcccaccatcaaaaccaccgcctcaacggccaccacctgaagcaacaccaccatcgcacatacctacacagcacaagacaagccggcagtggcagaacaacacaggaattgaagaattagaacaggttcatgtgaagcaatactatcatctgcctaacaacgttaacagattcagttctggccgcaaccatgttgaacactggcacagataccataatggccctgtatttctacaagagtcatcccgacccatgtatgtgacacacagctataacacacacgtgccttcgtcaatcgtcactgaatatgaatacgtcagatcaccatccagacaaacacattacaattgtatagaacactacagtggagattaccagaacgacaatgtaaacatcacatccatgttcagcgatgataatcccaatgcatgttgcattgtctag

SEQ ID NO: 21032 - DNA, 351 bp, Glycine max
  Peptide Sequence Number=SeqID_137810
atgaacaaccctacattgtcaaggctatttccgggtttgaatagggagagggagatgtctgctatggtctcagctttgacccacgtggtctccggagaggtgccaataaccggtgattcttcttcttcttcttctttggttcttcatcatcaacctcatgatgatactgttattgttacaccaaccatgccttcttcttcttcttcatctacttatgttgttggcacctcttctctcaagagaagtagggaaaatgatacatatacatcatccttattctcacatccaccttcatcatcccctgctatgccaacaaaatacaacagttcaaccttcaagattgcagtctaa

SEQ ID NO: 21033 - DNA, 336 bp, Glycine max
  Peptide Sequence Number=SeqID_137811
atggaagaaatggaaagagaacctctccattggcggtttggcaactctttcgtgctagtcggcaaaaagggtaggaaaaaggagatacatctttttaggaccgtagtcaacgctgcattcagtcaaacgatacgggcacacgcggttaaaaaggtgatggatataacaaactgccgttggcaatggcggtttgctggccatctcccacgtggcaaggaaaacgccagtggtgatggcgagttcttcacgtctgcaaatcgcctctccttctggcgagtccgtgcacagatgagcaaaccgccagtcaaactggcggttttgcttttgcagccctag

SEQ ID NO: 21034 - DNA, 1194 bp, Glycine max
  Peptide Sequence Number=SeqID_137812
atgtcggccagtggtggcgccgccatctccggcggaagccgcaaccgcaatcggcatctcggcgagaaccgcttctacagtccgccgccgctgaggaaacacaaagagaagcaggaacagcagcggtcgtcactgtcgagagcttcctcggagaataggcccggttcctcttccgattgttcaatttcttcgcgcgccacatcggacatgtccaatttggatcggttgttggagcacatcacgccccttgttcccgcccaatattttcccaagacgaactcgaggaggtggaaatcgagggaagcggaattgcatccttactttgtgcttggggacttgtgggagtcttttaaggaatggagtgcttatggggcaggtgttcctatagtgttgcatgggaatgaatccgtgactcaatattataacgtctccttgtctgccattcagctatatatcgatccgtcaaagccctccacacgactaaggaaacccagtcaagaaagtgactctgaatcagctagagagacaagcagtgatagcagcagtggctattgtcatgaaagaggagctaagagtgttcatggcagtaggaatcatcttaatgttttggatgctagcaatcattctttggaaagggtctcacaaggaaaacctttaatgggttcatcaagtgatgagactgagagctgcaaccctcctgggcagcttatttttgaatactttgagcatgagacaccttataatcgtgaaccattggcaaataaggcaagatgtatttctgatcttgaacggcaatttccagagttgaaaacatactggagctgtgatctttcccctgcaagttgggtttcatttgcttggtacccaatatacagaatacctactggtccaacattacaaagcttgagtgcctgcttcttgacctttcattccctgtcaacagctttgcagagttcaaatactgatgggctacataatcattattcaagaggtagggacatatccaagctatcactaccaatctttgggcttgcctctcacaaattcaaagtttctatctgggatcctgatggggtttctgaatgtcagaaagccaattctctgtcgcgggctgctgaaaactggcttaggctattgcgagtcaatcatcctgattacaattactttatgtctcattatgcatatgtgagatga

SEQ ID NO: 21035 - DNA, 213 bp, Glycine max
  Peptide Sequence Number=SeqID_137813
atggaaggggaaataagaaacacgctaacacatcctggtggagcacagacagttaaacctttggtaacgcattattcttcaagttggccacttgtagagcacatagtacgtacgtattacatggagttgctgagactcttttgcatgtgcaaaccctctagctcgtgtgatggtttacaaatagttttattgttcaactcaattcccacatag

SEQ ID NO: 21036 - DNA, 339 bp, Glycine max
  Peptide Sequence Number=SeqID_137814
atggctaagcatgatgttgagggtggttccttctcagcaaaggactaccatgatcctcctccagcacctttgattgatgctgaggaactcacacagtggtccttctacagggctttgattgctgaattcattgccacattacttttcctttacatcacagtgctcactgtgattggttacaagagccagagtgatgtcaaggccgggggtgatgtgtgtggtggagttggcattcttggcattgcttgggcctttggtggcatgatcttcatccttgtttactgcactgctggaatctccggattggcttggttccctttctatattctgatttcttag

SEQ ID NO: 21037 - DNA, 210 bp, Glycine max
  Peptide Sequence Number=SeqID_137815
atggagaaggaagggaaaataaatgttgggaaagagaaaagccaaaagttgtgtctcattcggagtggcacttgtgattatgaggtgggcggaaaaggacgtgtaggagacgcgcacggcccacacttccacctctattggccataccacgtgtcacctccattcatgatgtggaccctccctttcttctgcttaattggaggtgtataa

SEQ ID NO: 21038 - DNA, 366 bp, Glycine max
  Peptide Sequence Number=SeqID_137816
atgccggaaattgcagacaaatatggccaatgtggcaatgtggttgcaattgaccaaaattatgggggtcacataaacccagcagtgacatttgggctcttcttggctcgcaaggtatctttgattagagccataatgtacatggtggctcaatgcttgggagccatatgtggagttgggttggttaaggcattccaaaaggcatactacaacaggtatggtggtggagccaatgaactcagtgaagggtacagcacaggtgttggattgggtgctgagattattggaaccttcgttttggtctacactgtcttctctgcaactgaccccaagaggaatgctagagattctcatgtgccggtatga

SEQ ID NO: 21039 - DNA, 357 bp, Glycine max
  Peptide Sequence Number=SeqID_137817
atgcatctatggccgacaaagaatctccgagattccttcaaggattcatacctcaaaaggctcgaatggaactaccagagaatgaaagcggaaaagaaccaacaacaatcctcgacggaacagaaacttctggaaaacgaaaaccaggatcatggcaacaataacaacggtgacgcacccaacctcctcaattgcgaagctggctcggtctcttccctgttccaggaattgttgttggttctctcctgctgctactgctgcttttgctgtggtggtgttgacattgatggtttaacgttttctaggtctagtgtggtcgttcttctggatgaaatggaattggtgaattttgattag

SEQ ID NO: 21040 - DNA, 159 bp, Glycine max
  Peptide Sequence Number=SeqID_137818
atggcgatggaggatggcgattccataaatcttcaagctcttcttccaaggactaaatctctaagggagaatggttggtgtgtggtcttcgtcaaggggcatgttgttggggtctttgtgggttggacctgggttgggattttggttcagttcaactag

SEQ ID NO: 21041 - DNA, 1986 bp, Glycine max
  Peptide Sequence Number=SeqID_137819
atggatgggatttttgaatgtattgatggaagatttgaagtgtctttagcagattctaccatgatggggattgtgcaccatgccatgaacaaagctcaagagaagatgaagctgaaaacaggagtcatcgagcagttgaatgagatatcaaagttctatgagttagcagtgatgcaacttgaaggttgtctaagcattgttcatacagagactgaaagcagctttcttgagagcaaccatgaagaggaatctgaattagccatagtagagaaggacaaagagttggcagagagattagaaaatgagttgcaacttaggcatgctttagagctgaaagaaagacaattggtttctttgggtatcagccatgggattgaaacaagtagtctcaatgctgagaatgatcaaacaacaagaaaagagcacgacaatggcgatggcgatggcgatggcaatgtgtgcgagttgaggactagtgttgatcaatcaaagcttgaggcacaacatgatatgttaagtgaggtacaaaataatggtattggcaggataaaggttgaagagatgggttctgacatagacatactaaagcagactatggatcttgcttttgggaagatgcaatctgcccttttcttgtgtgagatgaggccaaaagagagggaatggaagttgacaattgaaaaggatgtaatgtctatatcaattggaagcttcatgagggatttccaagagaacattgaagtaaaagtgaagagggaggagaatcaggattctgactgttcatcactttcttccccagcaaaaccttcttcaccgacaaagccttcttctccagaaggaaatcatgaaatacctaacaggttctctctgaagatggagacagataagtcacctgaagaagaagaaaatgaagacgggagcagcatgtatgttgctaagttgataaagaatcatgaatctattattcgccgaaagagtgaagaactgaatttgagtaagcatgtaatatcacaagaaagaaaggcctcatacgtgaggagaagaaaggaactaaatcgcatgagagaaagaatccatgttgtcactgaaaaattgggcaattttatacgccggaatgctaaacttattgaatctcttttcaaccaaagatctattcatgatgcagaactgtttcctcggaggaagttatcagaagtagatgaaatccatactatcaaggatgttgaaagtcagagaagagctgaaaaacaggtaaaaggagtctgtgatgctaaaaatgaaaaacaggacgaattaatagggatgtctcaaatggaaaaggaatataacacaatgcaaaattcaatatcagaaaatgtgtgtggttctgttgatgatcaggtagaagtgctcgatagtaaatcctacaattttgacttggagaagaaaatacaggagtgtgtatataaatactacttaagggaagtaatcagtgagtggaatgagaacatagaaatgcaaacaattgaaaggaagagtagagatgacataaatttgattgtcttgtctgaggcagttatggatatcagtgcaaatcaagaattttccttaatcaagggacgaggcagtgaagctgaggaaagttgcttgcaatgcttgacatgtagtgaccaagaggatgtgtgtatggttgtattcaaagctatggttaaggaatggaaattggagctggataactattatatggaaaattacatcagagagaatataaaccaagttgtcatggtttggacgttgaatgatgcctttctcttgaccatagaagatagttgctctacctctaccatgatgttaaatcaagttcggaaagttcatggagaagagaacttgaaaattttgttgttagagtctctacttggttgttttgaagcagaggagagtctgatgccaagtgcaaagtgtgagatcaaggaacaatgcagggaacttgacttgggttcggaatga

SEQ ID NO: 21042 - DNA, 684 bp, Glycine max
  Peptide Sequence Number=SeqID_137820
atgagagttcccaattgttcatcattcttcactccacctctacgccatttcattaccttagtaaacacattgggtttcattctcttgatcctctttatatctgggatcattgagttcccatctttttctttattctcacaattctcaaccaaaccaatattcaaagatcaatcaaaggctttcaccgatgtggttggtgcattcaaaaggtgggactccgaagtgggatgtgtccgattcaagaatgagataaaccaacaaagaaataatggttcaaattatagtttttctacttctttgcaagatcaattggaatgtggggtgctgaaaatgaaacatgtgagcatcttggtgaaagggtggacatggattcctgacaatttaaatagcatgtacatttgcccatgtggattaagctgcttgtggacaaaatcactggttcttgctgacaaccctgatgccttcttgtttgaaacgactaaacctccagcacaaagaatcataggacagccacttcgtgtatacatggatcttgaatctaaaagaaagcgatcaggtcgtgaagaagtatttattagttatcatgctaaagatgatttgcagtcaacctatgccagtgccatactccataatggtcgaaattaccatatttcttcccataagaacaatgattgcttggtttga

SEQ ID NO: 21043 - DNA, 258 bp, Glycine max
  Peptide Sequence Number=SeqID_137821
atggtatcagagcagttaatcttgggacctgtgaccgctagccctcgctttgtggtgacaaatacccaccatttattgttcacgcaccaagctttcacattattcattctcagatggtatcagagccaccaagcccaacaaatactgggcgtgagggggtgtgttgaaaaacactcaagtcccacattagttggagatagagccaaattagaatatataaatgagaggttaggcatactaaaccttaagcaggaatga

SEQ ID NO: 21044 - DNA, 360 bp, Glycine max
  Peptide Sequence Number=SeqID_137822
atggatacggttggaggaagaaacaagatgaagcaagcagaagaagaaaaggtggtatcaatgccatggcaggagaagagagaacttgcgcagaaggaagaagaggtcttgagcaaggatatcgaagaccttaagacatggcttgatatgatggagaacatgcacgacgacgaccagcagctgaaggaatatctagaatatcaccctggagatttgaacttggcaaaggacaaaaagaacaagaataaggtcgaaaacaccagcaagtctgtaccaaaaatcaccaacaagtcgaagtcttcagcctcctccaaatccaatggtattctggcttcagttttgaggttccacaagaactag

SEQ ID NO: 21045 - DNA, 486 bp, Glycine max
  Peptide Sequence Number=SeqID_137823
atggagcggggagggaaggaaattaggcttctgggaatcgaatctcagatctcggagatcagaatggtggatccaactggaaaaggatcggaggttgaagttgaggactcaaactcaaaccctaacgctccttcctcagggaacagtccgagcagcaacaatgagcagaagaaaacctgcgccgattgcggcaccaccaagacccctctctggaggggtggtcctgcaggacctaagtctctgtgcaacgcgtgcgggatcagaagcaggaagaagaagagagcgatcctgggaatcaacaaggggagcaccgaggacggaaggaaaggaaagaggaccggcggaggcggcggaattggcggaattggcggtggcgcgttggggagggaagtgttgttgcaccgatcgcattggaagaagctaggagaggaagagaaagctgcggtgttgttgatgtcgctctcttatggatccgtttatgcctga

SEQ ID NO: 21046 - DNA, 183 bp, Glycine max
  Peptide Sequence Number=SeqID_137824
atggatagctgtaacgttagcggtgtcctggtgttggagacggtgcttcacagggggatagtgacaaataagcagttcaacttggagggtcaagcttttttgttacaatttttatatcctgagcctcctaatggagggagttgtggctctcaagtgtctttaatatcggtcctgaaaccatga

SEQ ID NO: 21047 - DNA, 327 bp, Glycine max
  Peptide Sequence Number=SeqID_137825
atgtctcctccacctctaggacctcacaatcactcacaaactcatctcaagctctcaggacggcttcctcttcaagctcggttctctgcagcgcgtgcttttctcgctcagcgggatggactgaagcggtgcgcttcgctggatgaccattcgcttagcgcaatgcacaactcatccttcttccatattcttcctcgcgctcagtcaaggagtgttgcgctcaacggatggctcgctaagccagaagattggcttagcgagagggtgaaaatcaacacttcacaaactggcctagttaacctaaaattgagagaaaatgattattaa

SEQ ID NO: 21048 - DNA, 429 bp, Glycine max
  Peptide Sequence Number=SeqID_137826
ggcacccttattgatgactggaagtttgattattctattcatgatgctcgccgtatggtctgtaatgaccaggctgatatgaccggcagattacttgcattacggaccaatgcacctctcccttatcctcacctcgtcaccctttttcttcatcatttcaaaattcctttggaagatgaaccatttgttcaagtaaaaaggtcttttgctattagtgctggtgcggttatctcatttggttatcgtaaggatgatgatggtcagtgggttcggaaacaagacttacctcagccaatccctgacgaatatactctttctcctccaccgcaaagggttgattcctcttcacttctgaacgatgttctctctgaacttcacagtcttcgagcttttgtgggtgaccgatttgatgctatggatactcgctag

SEQ ID NO: 21049 - DNA, 234 bp, Glycine max
  Peptide Sequence Number=SeqID_137827
atgtcgctgcatgttctttatctttacgtgttttctggatttcccccagggattccccgtctactgtatctctcgttacaatctttcaaagaaatgaacgggcaggatcatcttgagctaccttctggggtggggacaaaacatgaacagcagaaaccaatcaaggtacttaggaacggatgcaagtggggatggagtcacgatcgactgatcgttgccccttctctgcgctaa

SEQ ID NO: 21050 - DNA, 196 bp, Glycine max
  Peptide Sequence Number=SeqID_137828
gatattgcttcaacatgtggacacagctacgtcagaagacgatgaagactcagagtcagagatgcaaagtgcatctgttctgtttcatgcttgtgcagtcgcaaaacaactcattgctgtagaagatagacttccaacgtgggcgttcgttcaaaatttgtggattgagattgagttgtgctggtggtcaatgtag

SEQ ID NO: 21051 - DNA, 452 bp, Glycine max
  Peptide Sequence Number=SeqID_137829
gtgggaagagggtgtatagaagaagcagagtcaacttcaactcttcatcagtgggaagaggaactgcagggttactgctaataaagggcatgctgctacttttatatggtaccattggagctgtcacacttgctgaagaaaatggtgctggaggcattgctgaagcatgtggtgtggttgctgctgctactgaagtgatgaccttaattgctagtcttggggttggtgagaatagttgcttgtgtgagattgcagagatcaaaggctttctggttcttgaaaatgtagatgttgtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 21052 - DNA, 465 bp, Glycine max
  Peptide Sequence Number=SeqID_137830
atggctgccagtgaccacacaattttgcataatagagttcatattcctaccaagaagagtttattggagctttcatcacaagatgccttgttggccctaaataagttgttgtccaagaaacttgaagctttaaccgaaacactaagttgcacactttgtggtggagctcatgggccaggcttgtgtattcccactgaagaaacatctcatgaagttaattacatgggaaaccagcctagacaaaactttaatgtagttggattttctggatttcaacatggccaaccttaccagcagcataatcaatggagaactcaccctagtaatcagttcaataaagaccagggtgggccacctaataggccacaacaacaagggcctagcttatatgagagaacaaaaaagctggaagaaactcttgctcagtttatgcaggtgtcattgactaatcataagagcacatag

SEQ ID NO: 21053 - DNA, 2621 bp, Glycine max
  Peptide Sequence Number=SeqID_137831
atgagagttgagaaaggagcaaaaaatgaaggtggatatgttggtggtttcttccacttgtttgactggacctcaaaatctcgtaagaaattatttgcagccaagtcagatttgccagagtcctcaaaacagagaagaaaggttgatggcaacatggcaatggtgctgccctatctggtggacgaagatgatgaaattggagtagggaaaggtattagagaatgtagtgatcatagttgtgcttcatctgttatagatgatgaagtttgtggaacaaggagccctggtgtagttgccaggcttatgggattagattcattgccctcttccagttttctggatccatattttaccccatactttgacagccaatctcttcaagatgtgctgtactggagaacaaaatttaatcatctgcatgaccatcagatcctgtattctggaaagtcgattgaaaaagctgagggatcttctaggaacttcatggaggaaaagcctcaacagacccgtagcaggccgattgaaaagtttcaaacagaagtaatgcctcccaaatcagctaaatctattccttttgcacaccataaacttttgtccccaattaagagccctggctttgttccagcaaataatgctacttatataatggaggctgctgcaagaattattgaacctggcccccaagctactacaaaggctaaaacccctctggtagcatcatcaacagtatcactgagggttagagattttaaagaaaaagcggaggctttacaaaaaggacctctaattgggtcatcttcattaacttctagagttagagatctaaaagaaaaaagagaaacttctcatagaactatcaggctttcgaaaccttctcaaaggtcggctgagtcttatgatgcccagtatctaaagggacaatctttcaacagaagttggaatggatctgtggatacacaagtcagatcatcctctcaagcagaagaagattcttctttgaaaaataaagggaagtctatttcacttgcaatccaagcaaaagtgaatgttcaaagaagggaaggcttgagctttagtagtggaaaaagtttggtagagcagaaagaacaatatgacattaaaaccccccagcaatctctgaaggctaatgttcatagaagtttgcataagaaatcctctggtcaagatgcttctggtgtcctcaggcagaataatctgaaacagaattgttcaatggaaaaagacaaactaccatcaaagccactggtttccaattcaaacggtaggaaagttgtgactggggattcctcttgtggatgtcatagaagctctagtagtaaagccactgcaaaatctaaagttgggcccaaaaaatcatccatgaatgtgacagatagtgaaaaggaagtcttatttactcgtaccaacaatttcccaaggaagaagaggaccacagacagggactggaatgatagggttgttgataatttgtttattgacaaaactcagaagcctgttaagtctaatttagttagtaataaacaccatggtggggctgaagaagtaaaaaataaagacatggatgtagtttccttcacatttacgacgccattgacaagatgcaattctgattttgagacatctggacaaactggcctgaagactgatagcctttctttggatcagcatattagaagagtgttgcttgacactgacattgacactgatagtacaaggactctggtaggatacaatgctattggtggcgatgccttaggtatccttttggatcagaagctgagggaattaacatatggagttgagaattcttgtgatgactccttcaaagcaaggtcaccttccagtaattcttgtgatgactccttcaaagcaaggtcaccttccagtactgtaccaaaatcaaaagatcttgtctccacccttaattcagtcaacctatttctggaattgcaacagaagaccgaccaagacatgatctggacagacaaattattcagtagccgtgaatgtgacatttccttcacttgtcttccagaaatatcatccaagcatagactctggatggaggagtgtaagatcaatcctatggaagcagagttattcagtcccggacagccgagtccaatgtctgttcttgacccttctttctctactcaaagctgtgaatctccattcagcacaaatgctgctagttcagtagatcaaaacaggaagcaggttgtgggctcaggaagtggcttgaattcctctagaaagtaccatcatgcagaagctgatacagaattgtttgattcagcatcaagttcgaccgtgctaaagaaacaagcaagtccatgttctcaaatgaagtttggaggatcaagaacatgggagttagattatgtgaatgatatattgtgtaatgtggagttgatgtacatggacttttctcttggtagagctcgtgacattgtgaaccctcatctgttcaaccagttggaaagtcgaagaggaagaaggtttgagagtgatggtggtgagtgtaggatgagaaggaaagttatatttgattgtgtgagtgagagtttggacttaagatgcaggcgttatgttggtggagg

SEQ ID NO: 21054 - DNA, 432 bp, Glycine max
  Peptide Sequence Number=SeqID_137832
atgaagctatttggttttcccttgaagggttccataagcactagtgaggacataccatgtgtcgtcgacgatagtggtggcaagaaattcaagtgccgctactgtcgtcgccaatttgcgaattctcaagcactaggaggccaccaaaatgcgcataggaaagaacgtgctaagctagcccagttcaaatatcttctccgtcttcagcaacatgatcagtaccatcataggttcaaagaagcatcaaatggttcacccagcgttagtgttgttggtagtgcaattactagtgctgctgctggtgcagctttgtttgaatttcatagtgcagctgcaggatcatcacatcttgggacagtgccagcgagtggcaatgatgtagtggatctcaacctcagactagcttgctcctcagagaacttcaagaactga

SEQ ID NO: 21055 - DNA, 762 bp, Glycine max
  Peptide Sequence Number=SeqID_137833
atggcggtcacacatgctgaccttgaaccaaggcgaagaaaaacagattttagcagtaaaacaggtgcattctttgtagttctcacaatcctattaggcctattatgcttcattctgtgtctcatggcagaagccacgcgttctaaggtgatgtggatgagcacagctgaacatggaaagggaagtaaatctgaatgtgtctatagtggtagtggaaaaatgccattgctatgcgcttcttgtgctttcattggactagcaattgccatgctggtggagcacacttttttgttgatggcagttagtaattcatcacctgctttacttaccttggatcctgattctgcttctgccaaatcattaacatggcaatccgggtttttcttcgttacaacttggatttgctttgcagttggagagattctgctgttggcaggagtgagtgtagaatcaggccatttgaagaattggtcgaagcctaaacccagttgtcttagtatcagagaagggttgttctgtgctgcaggggtgtttgctttagcaacggtttttctagcttctgctttatacctaacggctctacgtgcactaagaatatcacaggagcaagaaaatgttcgaagggaggtacttatgacttcttctctccatgcatcgccaccaagaacacctcaaccacatatcagggagagccccactactagagagactcccttatccgtttttccaactcctttcaataaaagcctcacctttgtgtaa

SEQ ID NO: 21056 - DNA, 1649 bp, Glycine max
  Peptide Sequence Number=SeqID_137834
atgtcgctcaggccaaatgccagaaccgagattcgccgcaaccgttacaaggtcgccgtcgacgccgacgagggccgccggagaagagaggacaacatggtcgagatccgcaagagcaagcgcgaagagagtttgctcaagaagcgtcgtgaaggcctccaagctcagcaacagtttcccgctcctcttcagaactccaccgtcgacaagaagctggagagtcttcctgccatggttgctggagtttggtcggatgataatagtattcaacttgaagccactacgcaatttcgcaagctgctttcgattgaacggagccctccgattgaggaagttattcaagctggtgttgttccacgttttgttgagtttcttgttagagaggatttccctcaacttcaggctgcgtgggctctcacaaacattgcatctgggacttctgagaacactaaggtggtaattgatcatggggcagttcctatatttgtcaagctacttagttcacctagtgatgatgttcgggagcaggcagtgtgggctttgggaaatgttgctggtgactcccctaggtgtagagatctagtgctcagccaaggtgccctcgtcccactgttggcccagttgaatgagcatgcaaaactttcaatgctgagaaatgccacatggacattatctaacttttgcaggggtaagccacagcctccgtttgagcaggtgagaccggcacttccagcactcgagcgtttggttttttccaatgatgaagaagttttgacagatgcttgctgggcattatcatatctctctgatggcacaaatgacaaaatccaagcagttattgaggcaggtgtatgtgccagattggtgcagcttctcatacacccatctccctcagtgctgattcctgctcttcgtacagtgggaaatattgtgactggagatgatatgcagactcaggtgagtcatgttgggtgctcaatggttcctgaactgggacacatttctgcatctcacacggtgctcaatggttcagttctcgactgggtagcacatactgttattgaagctggtctggttgcaccccttgtcaatcttcttcaaaatgcggaatttgacattaaaaaggaagctgcttgggcaatctcaaatgctacatctggtggaattcatgagcagatcaagtacttggtgagtcagggttgcataaagcctctttgtgatcttcttgtttgcccagacccaagaattgttactgtctgtttagaaggcctagagaatattctgaaggttggagaagctgagaagagcctaggtaacactggagatgttaacgagtatgcacagatgatagatgatgctgagggattggagaagattgaaaacctacagagtcatgacaacaatgaaatatatgaaaaggctgttaaaattcttgaaacatattggttggaagaagaagatgagacactaccttcaggagatggtgctcaacctggtttcaatttcggaaacaatgagcttccagtcccatctgtagggtttatgccgggtgggcgttgggataaagtctggagggtcagttattgcaccttgtgtccttcgtggttcatgaggtgccggggagggtcagtctacgctaccaagtccaa

SEQ ID NO: 21057 - DNA, 144 bp, Glycine max
  Peptide Sequence Number=SeqID_137835
atgcccattacttatacccatatgcctggtcaattgaactgggacacgtcaagcaacatttctaataacttgtccaaatggagaaaggtgcgtggcaggtggaatagactatatagcatgaccttacttcaacatcaacagtaa

SEQ ID NO: 21058 - DNA, 408 bp, Glycine max
  Peptide Sequence Number=SeqID_137836
atgaagtactcattggatttaggagttcaaaggatttgtcaaacattgaacgaagaagaaatatttgaagttcaagacagcttatcactttttcctttaggttggatacatacacacccatctcagacttgtttcatgtcttctgtggatctacacactcattactcataccagatcatgttaccagaggcaattgctattgtcatggcccctacagatactacaagtccacatggcatatttcatctgtctgatccgggtggtgtgtctgtcattcgtaactgtcagcaacgtggatttcatccccatgaggagcctgaggatggaactccaatatatgagcactgttctcatgtctatatgaatgctaacttgaagttcgatgttgttgaccttcgagagcgatga

SEQ ID NO: 21059 - DNA, 1053 bp, Glycine max
  Peptide Sequence Number=SeqID_137837
atgggaagagctccttgctgtgagaaggtggggttgaagaagggaagatggacagctgaagaggataagatcttgactgattacatccaagaaaatggtgagggatcatggaggtccttgcccaagaatgcaggtttgttaagatgtgggaaaagttgtagactgaggtggatcaactacttgagatcagatgtgaagagaggtaacatcactcctcaagaagaagagatcattgtcaagttgcatgctgttctgggtaacaggtggtctgtaatagcaggacatttaccaggtcgcacggacaatgaaataaagaactattggaattcccatttgaggagaaaaatttactgcttcatgaagtccttaaatgagtccctccctcccattgacatggctgctgtaaacgtagctgctaactccaagagaagaaccggtggccgaggcacaaaaactcaacaaaccatacaagaggacaagaacgtggcttataacacaagccaagtgcctcaagttcaaccaacgctcaaaagaagtgcaacttcacaaagtttcattaatgatgaggagaacccaacagaatatagtttggatggttattgtgagaacacatatggcacaaccgcttcatgcctcagcagcatggatgaagttgaggccttgggaccttaccaatggttagatgatgaaatcatgaaacttactcacatgtttgaaaatggggtgctcgtaaaccaaggtggagttttaaccaataatgaagagtggcttagtagaaattatgactgtggactaatgggagcaaataatgaagaaagcaaaagtggtgtttggagctcatctaatgcagaaagtggagagtggaacactactagctgttcgtcagtgaattctgtctatgactatcatcatcatcagtggcctgatatgcaattagaaggtagtgttgatcaatcctataatccttgggatttttgtgaagaaaaccagaacgaggctaattgcttttggggtactactggccataatgaaggaaatggcttttaccagtga

SEQ ID NO: 21060 - DNA, 1320 bp, Glycine max
  Peptide Sequence Number=SeqID_137838
atgaccatcgacttggattcgatcgctcgccgagtcgaggttgataatcgcattcccatccgctattactatcggattgccgataacctcctcaagcaggcaactatctaccgggaggagcataatgtagttgacttgtacatcattctccttagatttttaagtttggtttctgaaactataccatatcatcgagattatcaagcttcactgcccaatgaaagagcagcatataagaagagatcgcgagctgtgttggatgagcttgaatctttgaagcccgaatttaaactccgggtggaaaaaatgaatgactcacatgtaaaagctctattgcctgaagaaaatggtttcaataaggctttgcagagttcagtgaattcatctttgcaatggccggctgtcaataaacagatgtctaagtggatttcatcttgcagatctgttagtctaccccctccaaataaggagactttgtccagacactcatttttaggaccaaatggccttcggggccaatggcttggacctagtgcggaaataaaggttcaatatccaagcagtggtgagctcacacaggccaaggattcaagcccgaatcaggctgggctatatgatcttgtggcaattaaagatggcgatcaaggaccagttacatccacaatggactcagttctctctttggatgatggaagatggttgcgtcctgctgtggagtcctgttctcctgttgtaactgaatcaagggaggaccccttacaattgctcaacatcaagcaacctttgccgcctcctattcttgctcaggtgtatccagaacgtgtccccattcctccttcaaaagttgcagatccaaggccaggaccagctaaatcgtctcatgattctagacttgatgcaactacatatcaacacctacatatacctgtcaaaatgatggaagagtttttaagattggcttcggaaaacacaaggaaaaacttggagacatgtggtgttcttgcagggtccctgttatttgtgcttgcaatttgggtggctctagaaaaaaagggtatttcatatcacaacacttataatcccaaagcaagaatcaacttcagactcgatttcttggtactgactactgagttgtacatgaggaatggtaggaagaaacccagtggattatcccacaaattacagaatgagatgggaaatattaaagctaatgacctgaagtatagcagactgcctacatgcaagtggaaaaggataagaagggtatatgtttggggtaaatgcaaagagaagggagagttgaaattaggcagaatttga

SEQ ID NO: 21061 - DNA, 2772 bp, Glycine max
  Peptide Sequence Number=SeqID_137839
atggcgaataacttagcggcgcaacaactggttgatttggatgtggggagcattatggaggaagcaagaaccagatggctccgtcccaatgagattcatgccatgctttgtaattacaagtattttaccattaatgtcaagccagtgaatttgccaaaaagtggtactattgtcttatttgatcgcaagatgcttaggaacttccgtaaagatgggcacaactggaaaaagaaaaaggatgggaaaaccgttaaagaagctcatgagcacctaaaagttggtaatgaagaaaggatccatgtatattatgcacatggccaggataacccaaattttgtccgaagatgttattggctgcttgataagagtatggaacacatagtccttgttcattaccgtgaaatacaggagatgcaaggttctcccgtcactcctgtaaattcacactccagttctgtctctgatcctcctgcaccatggattttatcagaagaaatagattcaggaaccacaactgcatatgctggtgatgttaagtgtttgtttggaaacaatgagaggcaggataatgagttgcaagaaaagaacacgtgctatgtgcatgtatatatctcatcctttctgatttggacaaaaacagacacgagtgccaatataaatgtcaaaagtcatgaactcagacttcatgagattaatacacttgattgggatgacctggtggatgcaaatgatcataacacaactactgtgcctaatggaggtactgttccatattttgatctacaagatcaaattttactgaatgacagtttcagcaatgtagccaacaatctatctgcagacattccttcttttggtagtctcactcagcctattgctgggagcaacagtgttccttacaatttttcaagtgttaatcttcagacgatggacgatcaagcaaatccacatgagcagaggaataatacagtttccttaagtggtgttgattccttggacactttggtcaatgatagattgcaaagtcagaacagctttggaatgtgggtaaaccccatcatgtctgattcaccatgttcagtagatgacccagctcttgaatccccagtttcatccgttcatgaaccatattcatctctgatagtggatagtcagcaatcttctctgccaggacaagtatttactatcactgatgtatcccctacatgcgtatcttccactgagaaatcaaaggtcctggtgactggattttttcataaggactatatgcacctttcaaagtccaatctattatgtgtctgtggtgatgttagtgttcctgcagaaattgttcaggttggggtctaccggtgctgggtatcaccacattctccaggattcgtgaatctctacatgagcattgatggccataagcctattagccaagttgttaattttgaatatcgtactcctgctttgcatgatcccgccgtttcaatggaagagagtgacaattgggatgagtttcaactacaaatgaggcttgcatatttgctctttaaacaattgaaccttgatgttatctccactaaagtatcacccaatagacttaaagaggctagacaattcgccctcaaaacatcatttatttccaatagttggcaatacttaatcaagtcaactgaagacaaccaaattccattttcacaagcaaaagatgctctattcggaattgcattgaaaagcagactaaaggaatggcttttggaaagaattgttttaggctgcaagactactgaatatgatgctcatggccaaagtgtaatccatttgtgtgcaattttgggatatacttgggctgtttccttgttttcatggtcaggcttgtcattggatttccgtgataggtctggatggacagctcttcattgggcagcatattgtggaagggagaaaatggttgcaactctgttgtctgctggggcgaagccaaatttggtcactgatcctactccccaaaatcctggtggatgcactgctgctgatcttgcttatatgaggggtcatgatggcttagcagcttatctttcagaaaaatctctggttcagcacttcaatgacatgagcttagctggaaatatcagcggctcacttgaaactagcacgactgatccggtaatttctgcaaaccttacggaggaccagcagaacctgaaggatacattggcagcttaccgaactgctgctgaggcagcttcccgcatacatgctgcatttagggaacactctctaaaactgagaactaaggcggttgcatcttcccatccagaggctcaagcacgcaaaatagttgcagcaatgaagattcagcatgcctttaggaaccacaagacaaagaaagtgatggcagctgctgctcgcatacagtgtacataccgtacatggaagattcgtaaagaatttctcaacatgcgttgtcaggctgttaaaattcaagctgcgttccggtgctttcaagtgcggaagcattattgcaaaattctttggtctgttggtgtcgttgagaaagcagtgctgcgttggcgtttgaagagaaggggtttccgtgggctccaggtcaaaactgtcgaagcgggaactggagatcaggatcagcaaagtgatgctatgttccgttcgaagaaagcacaagaagagtacaggaggatgaaattggcccttgatcaagcaaagcttgagcgagaattcgaacgacttcttagtactgaagttgacatgcaactgaagacatag

SEQ ID NO: 21062 - DNA, 768 bp, Glycine max
  Peptide Sequence Number=SeqID_137840
atgggtccctccgtgttcttagttagatgtcgtgtttgggacaagaaaaagagaaatgaggttagcagcaaccagcgcaatctgggacttttctttctttctccccacacccagattcaaaaactcagctctgctctttcgtttggatctcaaaacatgttcttcttcgattggttctatggcattctagcttccctcggtctctggcagaaagaagccaaaattctcttcctcggtctcgataatgcagggaagaccaccctccttcacatgctcaaagacgagagattagttcagcaccagccgacccaacaccccacttcggaggaattgagcattgggaagatcaagtttaaggcttttgatttggggggccatcaagttgcccgcagagtctggaaagactattacgcaaagatttgtgaattctctttcaaatctcgaatggtggatgcagtagtttacctggttgatgcctttgacaaagagaggtttgcagaatcaaagaaggagcttgatgccttactttcagatgaatcattggcaaatgttccatttcttgtgctaggcaacaagattgacattccatatgctgcatcagaagaagagctacgttatcatctaggcctgaccaatttcaccacagggaaggggaaggtcaacatcacggagtcgaaccttcggccactagaagtgttcatgtgcagcattgtccgcaagatgggatatggagatggcttccagtgggtctctcaatatattaagtag

SEQ ID NO: 21063 - DNA, 252 bp, Glycine max
  Peptide Sequence Number=SeqID_137841
atggaaccagtattgtggggtagtgttaacaaggacgagtgtatgcggagtaatggacgtggttcccaacaatttatcccaatccccacactaaaaatctctcagctttcaccacaaaaaaatacaacccagatgatactcacaaacccaaacagacaaataaatacaaaagacaacaaccataccttcaggtggctcgagctatgtggtggtgatttagggcaagtgacgccagaaagagaaagagtgtaa

SEQ ID NO: 21064 - DNA, 906 bp, Glycine max
  Peptide Sequence Number=SeqID_137842
atggaggaaaaggcaaaagctgagcagaagaagataggtatgaccgagacttggttgaagaagcaccgtcttctttacaatggagccactagacaccctcttattattagcattcgcgatggcaccatcaacactgcttccttcaaaacatggctcgcacaggattacttgttcgttcgggcgtttgtcccatttgtggctagtgtgctgataaaagcgtggaaggaatcagattgcagtggtgacatggaagtcatattggggggcatggcttctctggaggatgagatttcatggttcaagacagaagccaacaagtggggtatttcactttctgacgttgttcctcagcaggctaacaaaaactattgtgggttgctggaaagtttaatgagtccagacgcggaatatactgtggctattacagcattttgggctattgaaacggtgtatcaagagagctttgcccactgcattgaagaaggctccaaaaccccaccagaactgaaggagacttgtgtaagatggggcaatgaggcctttggtaagtattgccaatctctgcagaacattgccaatagatgcttgcaaaaggcttctgatgaagaactcaaaaaggctgaagttatgttgctaagtgtccttgagcatgaagttgaattctggaacatgagccgtggaaatggtcttgttggtgtgctaaatagcatggatgagggtgaaactcacaacaatgcaacttcacccaataacccccataatcctactcctatgcctggaaggaatcactcaattggaaaatacaacaacagtggcactcagaagatcaaaggtctgagtaaccaaacgggcttcaccgaaggcaatgctaacggagccatcaactttggcagtttacatgcctaa

SEQ ID NO: 21065 - DNA, 1218 bp, Glycine max
  Peptide Sequence Number=SeqID_137843
atggaaatccttggtgtgtctaggttgcttcttgctatgaagagaaaaaggagtacggtttcacatcaacctcgggctaatgctgatacactatttcagagttactttggtcagctgtcaccagtagaaccttttggaaaacaagctgagaatgagaatgtcaaggaaaaaatggatgcttctgctggattagaaactggaaacaaattgaagaagctaaagctcaagtttaggggtgttactcatactattcatgccaagtcaaagacagaaacaggcttcagcagtgattctttaataaaaaaaatttctccttgttctgattgttctaagccacatgatgatacagatggtaattatgtttgtccttttgataagagaaaaggccttggcaataaattgctaatgccctctgtaactgaatctggttttacagcagagaatcattcacatagaggaaagaccaccggagaaactatagatgtcaatcatgagcatgtctgtgagagcaagcacattaccaggagatgtgccttgagtgtggaatttagtgatgaagataataaagatgcagaacttcattttctcaaagaccctggaataccgggctcaattaaatatggtaaaatgaaattgaaatcagggaagaaatatgaggattcagactatgtggaagaagatccaacatcaagtgacgagtcaatatcggagtggaagaagccaaagagggaatctgttgatttacttgtacaaagagggaatcatacttgttcagttgactcattgaaagatgttttatctgggtcagctgcaagcattgccgacatctcagatgctttagttcccatgggaaaaggggaaaattgtcagaaatggagcaacaagtcaagaaagctgaggctgcagagacgtaaaattcaatcagagaaggcagctcgggaagctgaggcagccgccatcagaaagatacttggtcaagaatcgggtaggaagaagagagaggataagatgaagaagcacagggatgaatttgttaaggaaaaatctaacaaatccttcaatttaggatcaaatactgttagattgaccatgagaccccaaggaactgtagtaactttttctgaagatattggtctaccgactatcctcccgagagaaaaatgctctggtccaaactgcactgatgagtacaagtaccgggattccaagtcaaagtaa

SEQ ID NO: 21066 - DNA, 780 bp, Glycine max
  Peptide Sequence Number=SeqID_137844
atgtctagtaagaaggaagagaaatctcaggctgcggctgaaagaatcaaggctgcagccctgagtgctgcgaaaggccttagtcgtgcccaggctgaaagggctgcgactgcagctgcccgaaacgtcaatgcttatgggcagaaggaagaagggcccagcagatggcaggagaaaagggaagcaaagaggcagatgtatttgatgagtaccgaaaaagctgttaaattgggggaaagaaaagacctcaagcctgcaatgtcggcagccggtggattggctcagtgccaaaagtgtttccaaagtggccactggacatacgaatgcaagaatgaacgggtttacatttcaaggccatcccggacccagcaacttaaaaaccctaaattgagggtgaatgtgtctgtgacttatgatttggatgataatattcctgatgctaaggaggaaaaggcaaaaacaagttccaaaaaaaccaaaaggaagcatcggaaggactctgattctgctagtgatagtgaggattctgttttcgagactgatagtggcagtgggtcatcatctgttacgggatcagattattcttcagaaagtagttcaggttacagttcatcttctgattcagaggaggaacggagacggaggagaaagaagaagcagaagagagggagacgcaagaggtacacttcatcagaatcatctgattcagattctgcttcagactctgattccgatgataaaagcagccggagaaagaagaggaataatcgaagacgttga

SEQ ID NO: 21067 - DNA, 657 bp, Glycine max
  Peptide Sequence Number=SeqID_137845
atgaccaaaaagaaacaagctacgaaaaggaagaatcttgagctaaatttagatgatgcttcgtccgagaatgactggattgtggaaaatgatgatggaacaatgaaggtttggatatggacaacttggatggggatgctccaaattgaagataaggacttggttctagaccaaggtgcaaaggacatcaatgatgctgctaaatggagaatttggatgatgaagatggacaaaatgaagattgttgagttggctgcactcgtggacgttgtgacattcttgaaagggacattggtgaacctcatagcagatgtggaagtgggattccgaaggagggttgttagaggccatgaaacacagcgaaacagccaagcgagggtgttgagaggggtgtttggtttcaaactgagccaaacaggtctgaacaagggctggatagttcaccagaacgccacagaggcatgtgcagaggagttgcgagtctcatctctggctcagaggtcaccgatggacggcaactccagttggaataggtcgttggtgaaagggataggcggcgatggccaaacaatggacgcaagtattgtgggacgacaagcaaagatgttcaccgaggacagtaggtccccgatggagaacaacaaacctaagctttga

SEQ ID NO: 21068 - DNA, 336 bp, Glycine max
  Peptide Sequence Number=SeqID_137846
atggcgttttggtggccgttgctcgttttagcattcgcttacggtatttgtaggttccttctcatgctcattcctcctaaggttccttccatcgacgttgacacttccgatgtgttagacgatggaaaccaagcgcaggagaacagtttcatatatgtacctccgaggggaacatcgcagcaatcaggcaagatagttcagtgctacgagcctgcaactatgaaatatttgggatatgttcctgcattgacgcgtgatgaggaactacgaagcactgatactttaatttacttcaagtatctgtatccgatatgtatcttgtaccgatactcctag

SEQ ID NO: 21069 - DNA, 1029 bp, Glycine max
  Peptide Sequence Number=SeqID_137847
atgtgggcaaagtccagcttcaagcaaagacgcctatttttgcgtatacttttaaagtatataattaaacatcaagcgcttatatgcgaaatatcttcgcgtgatactggaaagacaatggtagatgcctctttaggagaaataatgacaacatgtgagaagatcaattggctactgtcagagggtgagcagtggttaaagcctgaataccggtcttctggaagatcaatgcttcataagagagctaaagtagaatttcatccccttggtgttattggagccattgtttcatggaattatcccttccacaatatttttaatcctatgctggctgcaattttttctggaaacggtattgtgattaagatatcagaacatgcaagttggtctggatgcttctacttccggatcatccaatcagcccttgctgccataggagctccagaggaccttgttgaggtgataacagggtttgctgaaacaggagaagcattagtatcttctgttgataaagtcatatttgttggatcgcctggtgttggtaagatgataatgaacaatgctgctaacactcttacaccagtgacactggagcttggtgggaaagatgcatttattgtttgtgaagacgtagatctggaccatgttgcacaaattgctgtcagggctgtacttcagtcaagtggacagaactgtgctggggcagagcgattttatgtccatagggaaatatattcttcttttgttagcttagttaccaaaattgtgaagtctgttacagctggcccaccacttgttggaaagtatgatatgggagctttatgcatgcatgagcattctgaaaagcttgaaggccttgtaaatgatgctttagacaaaggagctgaaattgttgcccgtgggagttttggacatattggtgaagacgcagttgatcaatatttcccccctactgtgattgtgaatgtgaaccacacaatgagattgatgcaagaagaggtagcaaaactcactatcttttctacttga

SEQ ID NO: 21070 - DNA, 1635 bp, Glycine max
  Peptide Sequence Number=SeqID_137848
atgggtcatggtgtttatcagtttgatggattcttttgttcttcagatacaatcatctcatggagagatccagaatatgctactgaactggcacttagctttcaagagcctagcggctgctcttacatatgtgtcagcagtgagccaagggagttgcctgctgttgagctatcaacacttcctttgattctaaagactgtggttgacagtggctttgcagatcagttgcggcttacagaactaatattaagtgatcaagcattttttcggaagctgatggaagtattcagaatgtgtgaagacttggaaaatattgatggccttcacatgattttcaaaatagtcaaagggattgttttgctaaatagttcagcgatttttgagagaatttttagtgatgactttatagtggacattattggtgccctcgaatatgatccagaggttccttttgttcaacatcatcgtaaattcttaaaggagcatgttgtttttaaggaggccatacctataaaagatcccgttgtgttgtcaaagatacatcagacatatagagttggttttttgaaggatgttgttctggcgagagtcttggatgagggtattggtgcaaatcttaactcgataatacattctaacaatgcctatgttgtctctttgttgaaggatgacagtacatttatccaggagttgtttgctaggctaaaatcgccaaccacctctcaagaatcaaagaagaacttgtgtttggataatggtgggacaaaagatgccactgctgtagaggacattcgaaggcgaaatgatgagcgtgctctggaaagagaagaagaacggtactttaatgaggacagtgatgaggaggatagtgcttctgcatctgttccacgcaatcagaaaggacaccagcaacctaatctatccaatggagttgctgcaagctattcacagttaaggtcactggttgactatgaggatgatgaggatgatgaagattataagccacccccaagggagcagccagaaacttctgaggaagatgatgggataatggagtctctcaggctgaagaggaaattaccttccaaagataaggagcctgaacttgagaagaaacagaagttatcaaagaattctaaatctaaagatagtgtttttgctgccttgtgttcaacattgagccaagctgtgctacctagtaagaaaacatcaatcgacattcatacatgtgctcgaacagatgggaggatgagctcaagcgaagataatcagggggatgtacaaaatatttctagaagcagcagttccaataatagcaacattgcagcagaagacaatcacgtagagaaagaaggtgaagcctctagaagcttttctgattgcttgcatgcaaaatcagataacatacaattgggtggagaagaacgtccattggttgccccaaaatcctcaccagagatggctttttgtaattgcccagcctttacgctaatgtcgttgtgttgtggttttgctacgactgttcatggtttagattggttgtgcggtttactcaagtatatcagttgtgcaaccaacctaggtcctggaaaatgggttgccgagtggaaccagatagcagctctgtactcgtga

SEQ ID NO: 21071 - DNA, 1134 bp, Glycine max
  Peptide Sequence Number=SeqID_137849
atggaccataaccctgcttcagctatcacacaagcaaacgaagatcttgtgtcatcaatcaaagagaagctcgaagccgtttcatctttgaaatccatctacagagtccccgagaatcttcgagaagcaaatgagaagatgtacatccctagcacagtgtcaattggtcctctccatcatggcaaggagggtctaaaatacatggaagatcgcaagtggcattacctcttcacacttctgagtcgacaaccaaaccagcttgaatcaagcttgcacgaatttgttaatgcactaagcgatttagagaagccagcacgaaatttctactcagaactcaatctcacatggagccaattcatggagatgatgctggttgatgggtgtttcatcattgagcttttcttgaaatattctctaaaggatataagaagccgtggggatcccacgttttccacgccagggttactcaatagggtgaggtgtgaccttatcttgttagaaaaccaaataccatttctcattcttcaaaggctatttcaaattgtgctcattccaatacaatatgagcttaccctgaccctctgtgagcttgccgttcgtttcttcagaaaaatgttgccaggggataaggacattgtcaacgagaagtttagccaagagggttatcatttgcttgacttaattcgccagtgttacctaccaacctatgcaagagtaatgtccaaaaaaagtgtatctcaaggtgatcttgagaatgagagtgcaacaaagctcaagaaagatgggattaagtccaagagttccaaagccaagagcttgctaaatattaaatttgcaaatggacaccaaaatgatagccaaccgtttacatcttatgtctttctaatgaaagccttggtctgcaatgaaaacgatgtgaagttgttccgcaaccgagggattgtgatcatggataattacacggagaaagaagtttgtgatctgtttaaaaggctgtgtggggaagtggaatatgtggaggacaagttctattttgcagggctaattgaacaaattttagagtataagagaactccgagatcgtggaggaagatattgaaatgcagttggcttaaaactcgaacttctacttga

SEQ ID NO: 21072 - DNA, 233 bp, Glycine max
  Peptide Sequence Number=SeqID_137850
caccactaggtcaagcttctgtctcagtcactgtttctccggcctcgcttcttctctcagattcagataccaattcggtttcttctgaaccaaacttgtgcgtgggtttgagaaattcggccgttaattttccatggccaacaatccatcacagcttctcccatcagggtgacaaggagcttgttggtactcttagaggctttgatgtttatgccagtggggtccttgaagat

SEQ ID NO: 21073 - DNA, 399 bp, Glycine max
  Peptide Sequence Number=SeqID_137851
atgactggcatcagtctctatggtgctgttacagatattatcaaagaagaaaataaccaacaaactgttttctctttaagaatcgcagatactagtggagaaatttggacaaagcttcattttgcgagattttgtctggaagtattatggtttgagaatgatattggggcttctttcatcaatctcagttgtttaccagcattgatcaactcatcttgccttcataagctatcgcgactcactgatattttttaccagactagctatgcgcaactcgatgttccttgttttgttgctctatgcacatgctcaaccataatgaatgaagcactagttggaataccagatgatccgagtctgatttatggctgggcttgtagttttaccggtcacagctag

SEQ ID NO: 21074 - DNA, 355 bp, Glycine max
  Peptide Sequence Number=SeqID_137852
gattgaaaagattgaatcttcggaaattcacaggaagtttgaaaccctacaaagaaaacagattactcttgttgatggtgatggagtcaaattaaagtttttcttgtggggtgagcagattctccttgccaatcttttcagagtgggaagcatgcttgcactggacaaaccatacgttaatatttcagtggactgtgatactgagacaagtgaagacttatgtcttgaatacggaagcgaaacacaactatatttggtgccttatattcaacatgaagaacagctctgccgattaggtgtgcgtaacattgactccaaaccgccgtcatggttcacggcccttgggttcttttaa

SEQ ID NO: 21075 - DNA, 198 bp, Glycine max
  Peptide Sequence Number=SeqID_137853
atggctcgtctaaatgctgtttttcaaaatgatgcagtgactcaagaaggagagatgagagaaatgcatgcgtgtttaaggagaaatgacttcttaagacgcccaggcactacccaggaggacaatgccaaaaaatgtcataatggcttcaatcctaaaccaaagattgcgcatcagcttccatctgagaacccgtga

SEQ ID NO: 21076 - DNA, 762 bp, Glycine max
  Peptide Sequence Number=SeqID_137854
atggagaatagaggttatgcctgcaatacaaaggtaggctccgccatggacgtagaccattgccaacaaaaggaggaggaagaagagcaagaagatcctttcctcaaattcgtggattacgcaagatctgagctattatcgctggaaggcgatcgaaacaaagacgacgacggttccgatggacttggatggagttggatcgtttctcgtattctcaagacttgcattgcttattcaagcggtgtcactcccgcgatcttgctctctgaactctctcaggcgtggagtgagcaacgctgggttggggctccgaagaagcctctcgaattaatcaatcacctcaagaagaatcatcggaggacaaagcttccaaacactgttaccattgattccatatacgcgaagaacttcctgtccttgaacagtgttctagaagctgttattattgatgcatttgtgctcccaggcacaaacatccacatgcttacattaggggattattggagttccaatatcatagatgtctatctacaccgcagattctatgacttgacaggactgcagaatggaattctgaagcgagggagagagattttcctcactggttgctacctccgaactgccactggaggttctggacatccacgtcttttgccaacagagtatcttgtgattctattggatgagaatcaggatgatgatgcaatgctactaggagctcagttttgttcagaccctttctcttcaatttctcttgatgcg

SEQ ID NO: 21077 - DNA, 1137 bp, Glycine max
  Peptide Sequence Number=SeqID_137855
atgcagggaatgcccgataacgtgttcgctctggtgatggtgtgcatcatcctgaacgccacagcaataccaatggtcctgacccacctctacgaccctatgaagaaatacgcagggaactacacaaagcgaaacatcttcgacctcaagacgaacggcgagcttcgagtcctcacatgcatccacagacccgacaacattcccccaacaataaacctcctcgaggccacattccctaccaaggaggaccctgtctgcgcctacgtgctccagctcatcgagctcatcggccgcgcctccccactcttcgtctgccaccagctccagaagaagaagagagccgactccaacagctccatggcggagaagctcgtcgacgcgttccagaacttcgagcaggagttcaagggcgcgttggtggtgaacacctttacgtcgatatcccctcaggagaatatgtatgatgacatctgtactttggccctggacaagtttgcctcgctcatcgtcttgccgtttcacaagaaatggtcttctgatgggaacttcatcgagatagaggacgagtcattgcgagagttaaactatcgtgtcatggagagagcaccgtgttcggttggaattttaatcgaaagagctcaaatgacccatattttctcacctgaaacgccttatactgtatgcatgcttttcattggaggaaaagatgatagagaagcgcttttctttgcaaaaagaatgaccaagaacccgcatgttagactcaccgtggttaggttttttgttgattcatgcaatgagatgaacacgagggattggcagggaatgcttgacactgagattctgaatgatataaaggtgaacaaaaaggtgggagaggcttatgtgaactacattgagaagactgtgaaggatgggcctgacacggctttggtgattaggtctttggtgactgagtatgatttgatcattgttggaagacaagcaggggttgaaacccctcaaacttcagggttgttgcagtggagtgagtatccagaacttggtgtgttgggggatttgttggcttcaactgatgcagctggcaaggcttctgtgtttgtgatgcagcaacagagaacagccaaggatgcttga

SEQ ID NO: 21078 - DNA, 252 bp, Glycine max
  Peptide Sequence Number=SeqID_137856
atgaaggattgggggaattttctccaccaaatccttgaggaggattctaaggattccgctcgattacaacgttcttcttggcgtggaggtttggcagcaatcaacggtggctcgtggtggccaccggtagtcatgggtggtggagaagcaggtcctaaggtgaggtattctctgggctctagccaacataggggtgtcttacaccttctaccatacatagcttcaaagggagccatgccaatggtagagtga

SEQ ID NO: 21079 - DNA, 331 bp, Glycine max
  Peptide Sequence Number=SeqID_137857
ggtaaaggacgccggaaaaaatggcggaagcttggtgacggtgagccttccggaagacccgttaggggttcttccggaacttccggaagaagatcttccggaagatttccggaagaagggttcttccatcttccggaaaactctcggaacacctcttccggaatgtttccggaagatgtacttgttccggaaacattccggaagagggttcttccggaagtcgtttcaatggttccggaagcactttccggaagagccttcttccggaattgttccggaagaagtacttcttccggaattgttccggaagaagtacttcttccggaagtag

SEQ ID NO: 21080 - DNA, 330 bp, Glycine max
  Peptide Sequence Number=SeqID_137858
atggctatgagatcgtgggtgagtcgaggatccgtgactcgtttgatggactcagcaaatcgaggggctttcagtcgcttcttcagcgacaagggtcgcgttctcagcgaggaggaacaggccaaagaaaacgtctacatccagaaatgggagagggagaggttggagaaacagaagcaacaggctgagaagaccaaggcagacaagggcaaagatgctgctgctgataagcttgtttcttccatttctgttttgtggggaggagggactacccagagtgtatacctttgttacgcaattatgctcattttccatataatgaacaattga

SEQ ID NO: 21081 - DNA, 1449 bp, Glycine max
  Peptide Sequence Number=SeqID_137859
atggccactggacaactcttctcccgtactacacaagctttgttttacaactacaagcaacttcctgtccagcggatgcttgactttgactttctttgtggtagagaaacaccgtcagttgctggaataattaatcctggttctgagggatttcaaaagctcttttttggtcaggtggaaattgccattccagttcatgctggtattgaagcagcttgtgcagcacaccccactgctgatgtgttcatcaattttgcgtcatttagaagtgcgtctgcatcatccatggctgctttgaagcagacaacaattagagttgttgctattattgctgaaggtgtaccggagtcagacactaagcaacttatagcgtatgctcgagcaaacagtaaggttgttattgggccagccactgttggaggaattcaagctggtgcttttaagataggtgacacagctgggacaattgataacataattcattgcaagctctacaggcctggatctgttggatttgtttctaaatctggtgggatgtccaatgaattatacaacactattgcccgtgtaactgatggaatttatgaaggcattgccattggtggagatgttttcccaggttccacactttctgaccatgttttgcggtttaacaacataccacaggtgaaaatgatggtagtacttggggaacttggtgggcgtgatgagtattctctagtggaagccctaaaacaagggaaagtgactaaaccagttgttgcctgggttagcggaacctgtgcacgactcttcaaatctgaagtacaatttggtcatgctggagctaaaagtggtggtgagatggagtctgctcaagcaaagaatcaggcactaaaagaagctggagctgttgttcccacttcatttgaagcttttgaagacgcaataaaggaaacatttgacaaattggttcaagaagggaacatcacaccttttaaagagtttactgcaccgccaatccctgaggaccttaacacagcaattaggagtggaaaagtacgtgctccaactcacattatttccaccatctctgatgacagaggtgaggagccatgctatgctggtgtaccaatgtctaccattattgaaaatggttatggtgtgggtgatatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgctatttcaaggatgcctatgacagggtgattttatcccacccacatctattcatttacttgcccctgatgcctcacacgatgacaagcctattttacctatctatcccccaaatgcctttgcaaagactcaacagataa

SEQ ID NO: 21082 - DNA, 1209 bp, Glycine max
  Peptide Sequence Number=SeqID_137860
atggttgacactttcagtatagagagcaggcttcttataagagagtttgatgaagatagagatgttaaggtggtggggaagcttgagaagaactgtgagattgggactaaaaagggggtctccattttcaccaacatgatgggtgaccctttatctaggattaggttctatccccttcatgttatgttggtggctgagctgcttgaaagcaaggagcttgtcggtgtggttcgagggtgcattaagagtatgcgaactccttctgaatcattgctgaagataggttgcatactaggccttagggtctctcctacacacaggagaaaggggataggactaaaacttgtcaactcagtcgaagaatggatgctgagaaatggggctgaatatgcattcctagcaacagaaaagaacaatgatgcctctataaacctatttaccaacaaatgcaaatacgtgagcctcagctcacttgtcatatttgtccatccaattattagtttccctgcaaagcacattcctaaggatataaaaattgagaaggtgaacatggagcaggcaatttccttatacagaagaacccttagggccaaagagttgtacccattagacatggattctattttgaaggagaagctcagcttgggaacctgggtgagttattacaaagatgaagggtgcaggctcaacttgcagaggaatatggtagagagtgtcgatgaagacataattaccaatgaaatcacaagctcatggatcatctttagcatatggaatacttgtgaggcttataggcttcaacttaaaaagtctcagccacttaggtttctccatacaacattaaatcatgcaagagacaaaatcttcccttgtctgagaatgtcggtgagtgaatcactctgcacaccctttgggtttctcttcctctatggactccatggagagggagagaaccttggggagttaatggaatccatatggaggttcacatcaaggttgggagaaagcttgaaggactgcagagtggttataactgagttagggtttggggatgcacttgtaaaccatgtccctctaacagcttctatgtcatgtatcgatgatatctggtacactaagagaatttcaagccacagtgatgaaaacgatgatgaactgctgatgaagagacaaatcgggaacgtgttcgttgaccctagagatttttag

SEQ ID NO: 21083 - DNA, 279 bp, Glycine max
  Peptide Sequence Number=SeqID_137861
atgtggaataacattctactagctttggtgattgcatcgagctttacggagtgcacacggggtgggcgagtggaagtgtgcgtcggggcaatggtggtgcaagggactcgtagagaacaggcagtggtgcagagggagttgcagaggtggctttgcgacgatggtagctggatcatggtagaaggggtcacatatggatttaatgttaagagtgggtgcgacgttgttggagcagtggttgtgttgcacgcagccaacattggggtcgtggggcagtaa

SEQ ID NO: 21084 - DNA, 201 bp, Glycine max
  Peptide Sequence Number=SeqID_137862
atgcactacagcgattcacatccaccccacgacgaccgcaatcactccatctgtgctctcctctcctgttattgcgatctcccctccgttgctgcaactgcgaagcccaaggcaaagcctgctaaggtagcgacaaagaagactactgtaaaggtggtgaagaagcccgatagtgtcttgagtaaacctaagagtgtgtaa

SEQ ID NO: 21085 - DNA, 729 bp, Glycine max
  Peptide Sequence Number=SeqID_137863
atgagtcagaggggtttaatatatagctttgttgccaaaggaactgttgttttagcagagcacacgcaatataccgggaatttcagtaccattgccgttcagtgcctgcagaagctgccatcaaatagcagcaaatacacgtattcctgtgatggtcacaccttcaatttcctcctagacaatggatttgttttccttgttgttgctgatgaatcgattggcaggagtgttccttttgtatttcttgaacgggtgaaggatgactttatgaagcgctatggtgctagcattaagaatgacggtgcccatccacttgccgatgatgaggacgatgacgatttgtttgaggacagatttagcattgcatataatcttgacagagaatttggaccagcactcaaggagcatatgcagtattgcatgaaccatccagaagaaatgagtaaactatcaaaattgaaggctcaaataactgaggtcaaggggataatgatggacaatattgagaaggttttggatcgtggagagaagattgaactgctggtggacaaaacagaaaacttacagttccagcttccagaggcagggcaggcagctgagaaggaagatgtggctgcagaatctccaaatgaagctgatggtgggaggaggaatccttatcttaattataattctgtgggttattgcttgtgggggtttcaaatgttgatggagacactggaagtttaa

SEQ ID NO: 21086 - DNA, 249 bp, Glycine max
  Peptide Sequence Number=SeqID_137864
atggtgtttaagattgtgcatgaaacaattcagagagcagacttgaatcacattgtggagcaaataaagtcaagtgataagaggtttatccgtttgtggaaggaacatcaagacaaagggatcttctatgtgctaaagatcttagcgagtgagcaggggagagggagggaaaagcccaagcagactagcctagcccaattatgccaacagcacaggaagcaacaggaagctggactgctaccgtcatag

SEQ ID NO: 21087 - DNA, 1996 bp, Glycine max
  Peptide Sequence Number=SeqID_137865
gaaccgtagtgcggaaaatctatatggttatacagcagaggaagctctaggacaggatgggattgagctacttgtagaccctagggatttggacttggccaataatacagtgaatcgtgttatgatgggagagagctggacagggcaatttccggtcaagaataaaacaggggagaagtttttagctgtagcgactaatacacctttttatgacgatgatggaagcttagttgggctaatttgtgtctctattgatttgcggccctttcttgaaatgaaagttccaatgcctactagtgtaaggaacatcgagtcagattcagattcaggtggaacccgacctagaagtagcattacaaataaacttggccttgacactcaacagccgcttcaagcttctatagcttcgaaaatttcaaatttggcatcaaaggtgggtaacaaagttaagtcaaggatctggatgggagaaaacaatttggatcgggaaagtgggagtggtgaaagtcatcattctgagcatagtttgttggaatctgtttttttggagcagagagaggatgctaattccagtggagctagcacccccagaggtgatgtgccaccatcccattttggtgcgttttctcatgtcgaagaaaaatcccagggaaaagctctgagagagtctggtgatgagagtgaaggaaaatctattcataaaatcatacctaaggctgaagcctggattcaaaggaaaacattatcatggccgtggagaacaaaagatcgagaaggatcagatgcaatgaatgttcgtgttgctgggtcctggagacagaatgatcaagaaaatgaatcagttaatcagaagattctttcttctggcttgaagcaagaaagccaggcaggtgaaagtaatcgccctactaacaatgaggcttcaggatcctggtcctcctttaatgttaacagcacaagtagtgccagcagctgtgggagtgctggcagtggtgctgtcaataataaagtggatgtggacactgattgcttggattatgaaattttgtgggaggacctgacaattggagaacaaattgggcaaggttcttgtggaactgtctatcatgctctgtggtatggatcagatgttgccgtcaaagttttctcgaagcaagaatattcagacgatgtgatactgtccttcagacaagaggtgtctgtcatgaaaagacttcgacacccaaatattcttctctacatgggggccgtgacttcacctcaacgtctatgcattgtgacagagtttctcccgcgctggactgatcattgctctgttcatttgtattttatgacttcagtggaagcttgtgccgcttgttacacagaaacacatctaaacttgactggagacggcgagttcatatggccttggatattaaatcatctcagtgttcgaagcatgttgtatgcttacaacttactttttctacaggcacgaggtgtaaattatcttcatcattgtaacccacctatcatccacagagatttgaagtcatcaaatcttctagttgataagaactggactgtgaaggttggtgattttggtctttcacgtcttaagcatgaaacatatctcacaactaagacaggaaggggcacgcctcaatggatggcaccggaagttcttcgtaatgaaccctctgatgagaaatctgacgtttacagctttggagtaatattatgggaaattgcaactgaaaagataccttgggataatctcaactcaatgcaggtgattggagctgtaggattcatgaatcaacggctagagattccaaaaaatgttgatccacggtgggcttctataattgagagctgctggcatagtgatccagcttgccggccaacgttccccgaactgcttgacaagcttaaagagctgcaaaaacagtatgccattcagttccaggctgcccgatccactgccaaggaaagcacccaaaaggagtcctag

SEQ ID NO: 21088 - DNA, 636 bp, Glycine max
  Peptide Sequence Number=SeqID_137866
atgacattgctacttagcaacattctgcccagcgaccgcaatgccaatctccccctgcaaaagtatcagttggtctatgtcgtcccgacatggggatcgcacccacagagacacccagtggacctgaagaagtccaacagggccctggggtttccagctctagttacgggcctctatcaatcctacaggttgcccgtacccccccggcaaggtcacgccatcatagggatcgcgcttgcaagacacccagtggacccgaagaagtccaacagggtcttggagttgtcaagctctaattacgggtctctgtcagttctagggagtgcctgtcgcctcccagcaaggttatcaggcccccctaccaatcgagctttcatcaagaagtactgcgcccccaggcaggcgcagggcgaaaacaccacagcagcattgggatggccggtagcgggcaatagacacaccgccaccacctctagagttcacctcagctcatccgcaaaaaggttagagcgttgcctacgacacatggccgaccagcaggcgaccaagtccaaagccaaaggtaagcaaagtactaggtccgtgacctacaagccatcatgcgtccagctcaagacgttaaagaagcgctactag

SEQ ID NO: 21089 - DNA, 324 bp, Glycine max
  Peptide Sequence Number=SeqID_137867
atgcccgcaactatctacctcacttgctgcgaaggctgggttctcgtcgaaaaaggaaggaaaaacaaaccaaaaccagatccattgttggtgaagcgcgctgatgctgtggttcctttatgcggtggaggctggctagtggttctcacgttcagcccagtacggcccgaaaagcaaccgagcacaaacaagcaaacaaacagtatcaaatgcacttcttccagcgttgcgcgtgggtgtaagaaatttccgttcgttagtaatacgatggcaaaagtgtgcgcgttctggaattgcattgatttttgggggcagaaagcgtga

SEQ ID NO: 21090 - DNA, 1089 bp, Glycine max
  Peptide Sequence Number=SeqID_137868
atgggcaactgtttggggaagtcggagaagaaattaacggcggagattgttccacgcgacggggccaaagtgtatcccaccgtccgtttacacggctcgcccaagagcattctcgccgcttatatccgtttcgcgcttctccacaagtccgtttcgttggacttggtcgaaacggaaacggagcgcgtgggagatggtggtggtggtgcggttacgctccaggtggggtcggaggttgtttcgggctcacgcgagacgctgctgcggttcatcgacgcgcgcttccctgggccctcgcttgggagcgggagggaggacgaaacgacgccgttgctggcgagcttgacgcgggcgcaccacacgagcatgctgtggcacgtggagaggatggttaagtgggcggaggatctcacgacacgtggcggaaagaagatcgtcgatccttccgtggggactcccaggatggagattagaaaattcgccaagagctactctgagctgcttgagctcatgatggaacacgctcagatggaagaaaccatcctcttccctctttttgataaggccgatcgaggacttgctaaagttgccaaagaggaacatgctagggacctacctctcatgaatggtatcaaagaagtcataaaatctgttggagttttggactctggcagccctgattaccatgaggctttgtgcagcctttctactcgcctcaagtcattgcaggggcaatgcaaacaacattttgcagaagaggaggtggaattacttccactaatgaaggcattggagttgagcaaagagcaagaagtgagtgcacttgagcagtgttttgaagtgatgcaaggaacacacaatcggttgttgaagttttttcttgaaggtctccctcctcatgatgctatgaagtacttggacttgatcagcaagtgtagggacaaagaaaaaatggaatctattctccaaaagatagttaaccaagttcttgtttgtccattagctgatagttcacgtggtatcccttccaaaattccctcccctcttgttaaggtatcagattgcaaagtccgcttccttactgcgtaa

SEQ ID NO: 21091 - DNA, 99 bp, Glycine max
  Peptide Sequence Number=SeqID_137869
atgacccttcttgaggctgctacaagagagtctctgcagtgtagtacgaaagattctttatatgaagccggcgccaccgtcgctgttgtccctgtctag

SEQ ID NO: 21092 - DNA, 434 bp, Glycine max
  misc_feature (384)..(384): n is a, c, g, or t
  Peptide Sequence Number=SeqID_137870
atggatcctaatatgaagcttcttctgggtcagcaggagccattgaaagaccctagaagatattgtcatctagtaggcaggcttaattacctcattgtcactagaccagatatcacatttgtagtcaatgtggttagccaattcatgaaggaaccatgtaatgacaaaattgtctgctattctgatgctgactgggcaggatcaccatcaaataggaggtccatttctggatattgtgttatcattggaggaaacttgatctcttggaggagcaagaagcagttaacagttgctagatccatcgggaaacctgtcgtgccagctgcattaatgaatcggccaacgcgcggggagaggcggtttgcgtattgggcgctcttccgnttcctcgctcacttgactcgctgcgctcggtcgttcggctgcggcgagcg

SEQ ID NO: 21093 - DNA, 406 bp, Glycine max
  Peptide Sequence Number=SeqID_137871
atggcaagagattctcttggttctcatgagttcctaagcgggcgatacatccttgtaactaatcgaacgcaaacatggatgggtcctgctcaaactatcactgataaagttaaactctttgtgacttatcaagtgtctgcttgggtccggattggctcaggatcatccgggcctcagaatgtgaatgttgcccttggtgttgacaaccagtgggtcaatggaggacaaactcaggtttcggatgacatgtggcatgaaattggagggtcctttagaattgaaaagcagccatcaaaggttatggtttatgtccaaggtcctgcttctggcggtttgcgtattgggcgctcttccgcttcctcgctcactgactcgcttgcgctcggtcgttcggctgcggcgagcg

SEQ ID NO: 21094 - DNA, 984 bp, Glycine max
  Peptide Sequence Number=SeqID_137872
atggtggtaaaacttttcatgcctataaaactgctaatgcaaactctttttttgccttcagttatcatgcccccttcagccctgcttcggcttgcacatttggacatagtgtatcctatgttatttgaactgagaaatccttctgctgaaagagttactcactgtggagtcctagaatttactgctgatgaggggatcatatatatgccagaatggatgatgaaaaatatgaaactacaagagcgaaacactgtgattctgaaaaacacccacgttccaagagcaacttatgcgaagctgcagcctcacaccaaggactttttggacatctccgatccaaaatccatcttagagatttcactgaggagctactcttgtttaacaaccggtgacactataatgattccttacaacaacaagaaatattacattgacatagtggaaactaaaccctctcatgcagtcagtataattgaaacagactgtgaagttgattttgctcaacctcttgattataaagaacctgagaaactgttgccatctgcttcatctgacaagggatgcactgaaggttattgtctgttggaaattggaatatgctttttaaattcattagaagattctgactatagtgtttcagttcatgatgattcagcaactaagactgcccggatcattccattcactggttttggaagacgtttggatggcgaaccttgtacaccatcagttgaagaaacttcttcaatgctaaagcagctagagattgaaaatgaaaccaagaattgcaattctaaaatatcaagtactgcttcacgtagagcttctggaaagcttgtgtttcggtcaaatgcaaatgcaaatgcatccaagattcagacacccccaaagggttccctgaaaggcacaactcaagagtcttctaaggaggaagaacctaagtttaaagctttcgcgggaaagaagtattccttaaataattga

SEQ ID NO: 21095 - DNA, 327 bp, Glycine max
  Peptide Sequence Number=SeqID_137873
gattggatttctctaccaggtgtattgtgtgttgttttcggaggtattcacgtttggcatatgcctgctcagaccaagatctttggagatgattctgtactccaatttggcagaggaactttaggacacctttggggaaatgccccaggtgctgtagctaatcgagtagctcttgaagcatatgtgcaggctcgaaatgaaggacatcttgcttgtgaaggtaatgaaattatcagtgagactagcaaatggagtcctaaattagctgctgcttgtgaagtatggaagaagatcaaatttgactttgaagcaatggatactttgtaa

SEQ ID NO: 21096 - DNA, 1062 bp, Glycine max
  Peptide Sequence Number=SeqID_137874
atgctgagggaatattctcccaaagacacgaaactgaagaaggtgtttgtcccaacccagctccgcgttaaccgtcctctctctctctctctctcggatcggagcgagactggcggctccggcgttgggggcgttagggttagggttagggtttccaagagatgtggtatgctccaggcattgatgaatctgttctcgctgtgttggaagccatttggccgcgatgctgctgatcgaatcgattccatcggagttaccggaagagaaggcaaagacggcttgctttggttccgcgacggcggaaaatatggctctggcgatttctccatggccgtcgttcaggccaaccaggttctcgaagaccagagccagatcgagtctggtcctctcggcaccttcgtcggcatctacgacggtcacggaggacccgacgcctcaagatacgtttgcgatcacttgtttcgccattttcaagcaatatcggctgagtcacgcggggttgtgacacctgagacaatcgaaagagcgtttcgccaaacagaagaggggtacacagccctcgtgtcaggctcatggaatgctcgacctcaaattgtaagtgctgggacctgttgtctagttggagtgatatttcagcagacactctttgtggcaaacgctggagattcccgtgttgtattgggcaagaaagttggtaacactggaggtatggctgcaattcagctgtctgcagaacacaatgcaaatcttgaggctgttagacaggaacttaaagaattacacccacatgatccccaaattgttgtcctcaaacacggagtgtggagagtaaaaggcattattcaggtttctagatctataggtgacgtatatttgaaacatgcacagtttaaccgggaaccacttaatgcaaaattcagacttcctgaaccaatgaacatgcccatcttgagtgctaatcccactattctttctcatcctctccaaccaaatgattccttccttatattcgcatctgatggtttatgggagcacttgagtaatgagaaagccgtggatatt

SEQ ID NO: 21097 - DNA, 1002 bp, Glycine max
  Peptide Sequence Number=SeqID_137875
atggcaaacaccaaagacattgaacggttcgacgtcgtttcggacgattccgaccactactttctatcagcagttggtccgaatccatattccttcaccaacgcaagaagcgacgtgcacaaaaggatcatgatggagtggaaaattcttgccaacaacaaccttcctgaatccatctacgttcgcgtttacgccaaccgcatcgatttgctcagggcagtgatcgtaggcgccgcaggcacaccctaccacgatggactcttctttttcgacatcgcgttcccacacgattacccgtttcaccctccagaggtccattatcgctcctacggcttctccctcaaccccaacctatacaacaacggacacgtgtgcctgagcctcatcaatacgtgggtagggaaaagtaccgagaagtgggacccatgtggctccaccgttcttcagctgctgttgtcgctccaagccctcgtcctaaacgacaagccgtttttcaacgacttttggtgcgagatgattgggcgtggccgcgggctcttcgagaagaagtcactggcttacaacgacaccgtcttcgctcttaactgcaaaaccatcttgggcttgcttcgacacccgccgcgaaactttcaaacattcgtcgtcgggcatttccgtaatcgagcacgtgcgattctgggcgcgtgcgacgactacgcgaatgggcgcgtgagagttgggcgatacagtgaagacggtgacggtgaggcttctgataggagagtcagggtttcggagaaattcagggagtcaatgcgagtgttgtatcctcagctcttggagatatttctacggtgcggtgctttttcgcagagtgatgcggaacgctacttgaagatggaaagaactaatgtgttgtccaaaaatatggggaatgttactaacagaacgtacagggttcttgtgaggaaggtgattgggaagataaggaagctttatgcttcaaagttgatatcatgttag

SEQ ID NO: 21098 - DNA, 1014 bp, Glycine max
  Peptide Sequence Number=SeqID_137876
atggaagtaaagacgaatgagtttgggcacttcgacgtcgtttcggatgactcagatcaccactttctgggttcaaataatggaaaatgcttctatgattcaaatagtaaagtctacagaaccattatgaaagagtggaaaatcctggagcaaagcttacccgaatcaatctacgtgcgtgtctacgagcgacgcattgatctaatgagggccgtgatcgtaggtaccgcgggcacaccttaccacgatggtctcttcttcttcgacatcatgttcccctctgattaccctaaacaccctccaatgctgcatttccattccttcgggtaccgaatcaacccaaatctctacatcaacggcaaagtgtgtttgagccttctgaacacgtggaacgggaaaggaacggagatgtgggacccatccaagtcgacgatgctccaagtgctggtctccatccaaggactcgttctcaacaagaacccttactttaacgagcctctgcgtctcttcgattctgagagcaagtcacgtgtctacaacgagaacgcgttcatcattacttgctacacctccttccttctgcttcagaggccgctccgaaacttcgaagcattcgtcagtgcccatttttgcgagcgggcgtttccgattctctctgcctgcagcgactacgtgaacgggcgcgtggaagttgggtactattctagtgacctgcgttcgtcttcgtcaacggtacgagtttcaagggaattcaaggagaagatgatacagttttaccctaagctttttcaagcgtttcgactgaaaggtgcttctgtggggggtttggtcgaacacttggagttggagattgagcaatccgaaaagaaaagtagcggcggcgggcaaaggcagcaattgaagaacaaaagcagaagaatcttcaagaaggtcatggaaaagatcaaacaaactttgggatggaagaaaaagagccagattgaagggagagatcgcagtcttcaaagttcttaa

SEQ ID NO: 21099 - DNA, 201 bp, Glycine max
  Peptide Sequence Number=SeqID_137877
atgtcgaagaagaagaggccatcgtggtacggtgtgcccgcggcacctacgatcgatcaatacgtcgctcctagacaccttctaaagattgcaaagacaagggaactgctcaagcgatgccggtgttcgcagtcgaaaggctctgaaggttttgaatcgtcgttgttcaccatctgccagatcctcgtcgccgttggttga

SEQ ID NO: 21100 - DNA, 519 bp, Glycine max
  Peptide Sequence Number=SeqID_137878
atgctccaagtgttggtctccattcaagcactggttctgaacgagaaaccgtattataacgagcctggtgttgcgtcctccgagtcggcatcacatgtctacaatgagaacgcgtttcttattacctgcaaaacctcctatcttctgcttcggatccctcccagcgagcgtttcggattctctcaggcctgcaacgagtacgcgaatgggtgcatgagtgttggctattactcttctgactttcctcgtccgtctaagtcggatacaagtttctcaggtgttcaagcgtttcgactcaatggagcttctttggaatgtttggacgaacacttggatctcgagatgaagcaatccaaaaacaaaaacagcggaatcttcaaggacaagaacgtcttgaagctctacaggaagcaaaacaaaaccagtgaaatcttcaagaatgagttggcagtgagaggtcttctggaaatcattatgccttcaaaccttcatagactaagcgtaggaatcatgaattga

SEQ ID NO: 21101 - DNA, 213 bp, Glycine max
  Peptide Sequence Number=SeqID_137879
atggctaggcagcgaggcgattacgcgagaggaagatcatttggtgatggtggaactttggtgttaccgtcgatggaggcttatgtgtcgtcggtgtactgtatgtgctgtatgtgtatcgtggggtgtggagtatgggtacaaggaaggggttttgttcactggtcagtaggagggataaatttggaaagaagtttaatattaaaatgctaa

SEQ ID NO: 21102 - DNA, 261 bp, Glycine max
  Peptide Sequence Number=SeqID_137880
atgcctctatctgattctgacatgagaggttttagattaccacttttgggtagtgccaagagacttatcaaggctgctctacacgaagcagcaagaaaacgagaaatgcgatattcagacctccgtaagattgacaagaaggttcgacgccattttcatgatgatatatccgttattgttttattcttaaatcacgaccttatttccagaggcacagtgctagacccggcactttcaattcgaagtgctctcgatcactga

SEQ ID NO: 21103 - DNA, 534 bp, Glycine max
  Peptide Sequence Number=SeqID_137881
atggattcttcaggtgattttgaaaatgaaatcataaatttgggtctcatggcgaatgactatgaaagcggagaaaagctaatgtcttttaactatgacttatctatttcttttgatgaacttcaagatgcattcaatgacttgcataaagaatctatcaaacttgccaaattagtttcatattctaagaaaaccatttcaagtttagaaaaggaaattttgaagttaaatgtagagttagaaaatcttaaatctgaagttaaaacattaaaattagtagataaagaccaattgtcgcaacctgcccttcggcgggagggcgacgcgagggctcacaggtgcgtctaccaagaaaggaaaatgtgcggagtcgccaccaacgtttattcgaggaaaacgtcggagaaaccggaaagacgtggtctacgaactttaagtgtgaaaggttcgggagttgtttttacgcacggggaagggtatttcccttgctcctacgcattcctcaattgtgataagaaaatcagacctacatag

SEQ ID NO: 21104 - DNA, 225 bp, Glycine max
  Peptide Sequence Number=SeqID_137882
atggttccgaagtttgtgaattccaaggcagaaagacagaagcatcatgatcaagacgaaagccaatcaaagtggttttcttgcatgaagcaggatgtgcatttaatgcaagcattaaatgatccaatgaccacaaccttcagacgcaagctcaaaggaaaattatatccgtttagagacaataaacacttgaaaatgaaaacctataaatatcatatgctttga

SEQ ID NO: 21105 - DNA, 213 bp, Glycine max
  Peptide Sequence Number=SeqID_137883
atgtggaggcatccatcaatggaagaggcgatggtgcgcggtgtcatggttgagccaacggaggaggtggaaggcaggcttgatgaggaggaagtcatcatcgtagtcctagatttggagggagagagaaagaagggaaggcaaaccactcgtcaccgaggttgtcatggaggtgagaggaggaggggctgggacaagaaggcttcggagtag

SEQ ID NO: 21106 - DNA, 195 bp, Glycine max
  Peptide Sequence Number=SeqID_137884
atggaaaggaaaagtcacaatttcacaacggtcccttcctccgcgccagtctccgcgccaggcttcgaaggtgactgtaaattgctagggaaccttctcaacgacattctccaaagggaggctggctccaccttcgttgacaagctcgaaaaaattcgagtcctttcacaggttctcatttttcttttcacttaa

SEQ ID NO: 21107 - DNA, 444 bp, Glycine max
  Peptide Sequence Number=SeqID_137885
atgaagaagtctgtagagttagtgtgggatgtaactaaatttggaattccaaatgcagctgcatcattgttcgttacctgtgctgatgtgaatgaaataatatcaggcgtacagtgtttgaacatagctatactacaattatggaccatgtatatggaccaattgagtcaaagtgacggtctaggatcggtgtatggattccttgagccgcaggctatactgaatgcaaacgatagacgtggacaatgtgaagaatacattgaaaaatggcttaaggaatcgaaccgagatgtctatctaggcgcttatttgaattatgcatttaagactttggaaaccaagagtgaggggaaatttggtcatagtacaccgcggtggattgaagtgaagagtcacgttcaaagcggagtgatagaggccgtacccgaattaaataaacattaa

SEQ ID NO: 21108 - DNA, 189 bp, Glycine max
  Peptide Sequence Number=SeqID_137886
atgactgatgcgctaagcgtgatagccacacgcttagcgaagaaggatttgcgcttagcgtggcaaggcatgcttagcgcaactactctactgaacagcacaggcttagcgagcaagctcgctaagcccaattccaacaatttgaaaaacaaagagataattgctgttagcgtgacagggcatgcttag

SEQ ID NO: 21109 - DNA, 384 bp, Glycine max
  Peptide Sequence Number=SeqID_137887
atggcttcccataagagaaaagccacagttttagtgtctcgggctggttatgatagatcaagatttggaagcattgatgtagcaattgtgaaggaattctatgcaaatctatatgtccctgacgacaagtttcccaagcaagttagggttcgagggcacctgataaaatttgatgttgattccctcaacacttttttggagactctagtggtcgtggaacaaggggagaacttgccttcttactccaggtttgctagactaaggcctgatcctcaagagcttgcaacccagctgtgtatccctaggaggggatttgttcttaatgttgagggtctgccatggaagctcttgaggaaagatcttaccgttctggtccaaacctag

SEQ ID NO: 21110 - DNA, 801 bp, Glycine max
  Peptide Sequence Number=SeqID_137888
atgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatatatatttttacaggtatggcgcccactaggcaccctttggacccagataagtccaacagggccctgggattccccgcactgatcacaggactctgccagtcgttcggagtccccgttgcacctaccaaggtgattcggccgcccatcacccgggtttttattgagaagtactgtacccagagacaggctcagggtgatgctccacaggccgcaggcgtgccaccgacacctcatcaggctggccaggctggggcatttgacatagagcagtatttacggcatttggttcgccagcaggcggacaaccaccgagcacatgtacggacccatgactgtctgtaccagatgagccttagcatgcagagccagggcttcgcttctttttcatgccctactccagaccagttcagggcagaggtagcatggccccggagattggccccgaggcccaagcaggagaggcacccccacaagctccccggcgatggagaagaagcccacgaggatgaggagatggccgatttgcccccccccccccccgagggagtggagatacgtgactgggaaaaaaaacagattcatgttttctttcatatttcttttgtcatttttattctatgttattgttttgacttgagagactaa

SEQ ID NO: 21111 - DNA, 672 bp, Glycine max
  Peptide Sequence Number=SeqID_137889
atgaacaccgcaaatgctattagacaagtgtgttgcctaattggcggtgtagggtttagtagccaccaccgttcaaatatggtgagctctgctagagtttgtgaaataagcgataaagggtcaactattgaggaagacgatctcctccacagaagtaccacgaaaactagggaaggttctgagattgtggaagaagtgcctaaggaaaaggagggggatgtgaatgaaacgatacatggaccagtgataccgctgtctgatgtggaactgttaaggcaatacgaatcatcccgtatgttcttggttgaaacggatgcttctaatgcagttgctactcgtattattccaaaaacaagtttcaattggtttacgaaagtcccatgtttcaaaaacacaaactactttgggaagccctgtgtaacattgttgaggaaggcttggatggtgattggagattttaatattgtcctcaatgctcatgacagaattggtgcgcatgactttcgtgatatgatgcagggacgaacatttacatggatgacaggaaatttgcttcagtgcctcgataaagccatttttaatattgagtggcaccttcagtttcctaatgtcttggtcctccatctcccttactttaagtctaaccatatagggctttgcctgttaagctga

SEQ ID NO: 21112 - DNA, 774 bp, Glycine max
  Peptide Sequence Number=SeqID_137890
atgattttttcaaggattgcacgctccgtttcgagttcgtctcgcgctagaaatttattacacggtgatgggagattgggaacccatgtcggatcgccacggacgaatgcgtgttctgaaggagcccaaggggtattagggtttgttaggggctacgtgtcttctgccagagctctcagtaatggcttcgtttccaatttgcctgattttaaatctgttgcagcaaaccctacgattcgccgattgttttgcagcaaagctccaaagaaggagaataactcgaatgcaaacacagaggatagtggaaattttcaggaagctttcatgaagcaagttaaatatctagtcaccccattattgttgatggggctatttcttacatccttttcgtttggtcctcctgaacagaaccagattagctttcaggagtttaaaaacaagcttttggaaccaggattagtagaccatattgttgtctcaaataaatcagttgccaaagtatatgtaaggaacactcccctcaaccaaacagataatgaagtagcccaagggacccaacctgcaattggatctggaggccagtataaatattatttcaatattggaagtgttgagtcttttgaggagaagctagaggaagcgcaagaagctctgggcatttgctctcatgattttgtgcctgtcacatattcttttgaactggggtaccgggaatggattgcgttggcttcaatactgttgtttttgggatttgtcacatatataagcttttaa

SEQ ID NO: 21113 - DNA, 627 bp, Glycine max
  Peptide Sequence Number=SeqID_137891
atggcctgcaccaagaaaactgggcaaatgacgcctgaggcagcaaaggaaattgatgacaagattgcctcacagggttcctttgtcgcccatggatgttatgatgtactgactgctgccattgggcgactagaacaccctggtcgtgtgcatgttgctagagccggtgtcacaattaagcaatactttgaaccggctccaaggacctcctacacgtcttcgtccatggctcccgaagacctaaagcagctgacgcaaaaaatcagggaccagctagaggagtcgatcacagaaaaaggacttgcattgcctcctaaacctgaggttagtcctttagctgctcgtgtcaacacaaaggagagttatgttgatccctcagggaaaaatccagacacgggtgactcagacaaaagtgggttgtacatcgaagaaaatcctcgccacctggttgccctaggaagactttatgaggggtccacaaccgttcacaacattcctttgctccatgatcaagtcaagggagttgtgggaccggcgaaacttgcagataggccggatcatgatgtcaatgatcccctatatttgatgacattgacaatcccacagctttttctgaagccgttgtag

SEQ ID NO: 21114 - DNA, 570 bp, Glycine max
  Peptide Sequence Number=SeqID_137892
atggcacagctggcaggtgcggatgagatagagtctctgagaaatgagttagcagagataggaaggaacataaggtcctcatttagaagtcatgcctctagtttccagagagtttcaagcatcaatcctgtgcaacaagaagttgttgatgtcagaaagcttggagctcaagaacggcacacgttcatagagaagcttattaaacacattgagaatgataaccttcgattgctgcagaaattcaggaaaagaattgacaaagttggtattaatttgcccacagtggaactgaggtaccaaaatctgtctgtggaagctgagtgtaaaatagtccaaggcaagcccatacctacactgtggaataccctaaaagaatggatctttgacaccactaaattgtcagttctgaaatctcaaaattccaagataagcatcatcaaaaatgacaatggaattattaagcctggaaggatgaccttattgcttggcccaccagcaagtggtcaaccctttttttttagaacacaaattaaatttataacatatagatacatgactaatgttttataa

SEQ ID NO: 21115 - DNA, 1676 bp, Glycine max
  Peptide Sequence Number=SeqID_137893
atggcgcctcgttcattcctactcgccctgctgagtctcctcttgactcagtccgagtcggcacctcaagccttcaagagagaacccggtcaccctcagtggcaccacggagccttccacgacgtaagagacagcgtccgatccgacgttcgccgcatgcttcattctcgcgctgaggtcccgtttcaagttccgcttgaagtgaacgtggttctgattggttttagtggagacggaggctacagatacaacatcgatgcgcatcgattggaacagtttctcaaaactagctttccagttcacagaccttcgtgtttggagactggggagctgcttgatattgagcatcacatggtctataatgcgtttcctgctggacagcccgaactgatagcacttgagaaagagctgaaaggggcaatggttcctgcaggaaaagcaagagagactgaatttggaagggaggtacctttgtttgaagttgaggcaacagctgtggagccaatatttcaaaggctgtactcctacatatttgacatggacagtgtgggatcttctgtcacggagatggatagaccagtgccaagtgcaatatttattgtaaactttgacaaggtgagagtagatcctagaaataaggaggtcaatcttgatagttcactgtacgagaaaattcccgacctaaccgaggaagatatgaaaagacaagaaggagattacatctatcgttatcgttacaatggtgggggtgcaactcaagtttggctaagctctggcagatttgtggtgattgacctttcagcagggccatgtacttatggtaagattgaagctgaagagggaagtgtctgttctagaaccctgccaagattacaaaatgtgattcgtcctagtagttcgagcacaacttctcatcaatcaagcaatgatatttttcttgggcagcttgcttctttggtatcaaccacagtggaacatgttattgcacctgatgtgaggtttgaaactgttgatcttacttcaagactgcttgtaccaataattgtgttgcaaaatcataatcgatacaacattatggaaaagggtcacaattacagtattaacatagaagaaatcgaggccgaggtgaaaagcatgcttcacgatgggcaagaattagtaattattgggggtgtacattcattacatcgccatgagaagctggcaattgctgtttcaaaagctatgcgtggacattccctgcaggaaaccaaaaatgatggccgtttccatgttcataccaagacatatctggatggtgctattttaaaagaagagatggaacgttctgctgatgtgcttgctgctggattgcttgaagtgtctgacccatctctttcaagtaaatatttcctccgccagaattggatggatgaacctgaagggtcaactgattctattcttaagcataagtctctctgggattcttataactcaaaatatagccagaaaaggagaaagaaagtaaagaaacaaggggatctacaaccaacatatggaactagagtaattcctgtctttgtgctatcactggctgatgttgatccaaaccttatgatggaggatgaaagtatggtatggacaagcaaagatgttgtaattgtgcttgagcatcaaaataaaaagattcctttaag

SEQ ID NO: 21116 - DNA, 676 bp, Glycine max
  Peptide Sequence Number=SeqID_137894
ttacgtttcggaaacacaaagaaggcatgctcttccatctcaggcacagcggcatatattggctggacttgcctcagttgttggtggtttaagtgcgccatatgagaaggcttctcatgtacatgagaggcccgttgtgaattggctttgggctgctggttgtcatccatttggaccattctctaatacatctcacatcagtcaaatgctcctagatgttgctttgaggaactcaatatatgcccgtgtggattctgtgcttcataaaattcgtgatacgtcagagactgtccaaacttttgtagcagagtatctgaaaactccccttggtgaaccagtaaagggaaagaaagaaaagtcaaacactgaactgtggttagagaagttctacaagaaaactactaatttgccagaacccttcccacatgaattagttgatcgcatagaaaaatatctggatggccttgaggagctgcttgttgatatgtcttcactgttatatgatcatcggttacaggatgcctacttgaacagttcagatattctgcagagcaccatgttcactgaacaatatgttgatcatgtcttgaccagcgagagggataatatgagatgttgcaaaattgagtacaaatacccggtactggcaggggcttcaggtttagtttacttttga

SEQ ID NO: 21117 - DNA, 639 bp, Glycine max
  Peptide Sequence Number=SeqID_137895
atgaaaaggaaacaaaaaggcaatgatgtcatcgcatacgtaacgaagcacacacacgcatttcttttcctctcaacacacatcgcaaacacgctgttcctacaatcattccaaatgtgcccttccggtcgcaccctcctcccttcctccgtctccgatttccgaccggcattcgacgtcctcgatgccgaccgcgacggcaaaatcagccgcgacgacctccgcgccttctacgccggagtcggcggcggaggagatgacgtgatcggggcaatgatgacagtggctgacaccaataaggacgggttcgtggagtacgaggagttcgagcgcgtggtctcggcggagagaaagcccgtggggtactgtggggccatggaggacgtgttcagggtcatggacaaggacggcgacggcaagctcagccaccatgatctgaagacttacatggcctgcgctggttttccggccaccgacaacgacatcaacgccatgatccgattcggcggcggcgaccaaaacggcggcgttacgttcgatgtgtatgatatggtgatcgacggaagcctcgtcgtcttgggaggcatgggtggtgttgaaaccagcagaagaggttggggagtcaggattgggatttga

SEQ ID NO: 21118 - DNA, 732 bp, Glycine max
  Peptide Sequence Number=SeqID_137896
atgaaagaatctcaaacgcctcacaagacccatgctcttgctcgctcatcggagaagagcaatcgcagatcgcaggattccccaaacttcaataaggcacaacgcacttcgcaaaatcttactcagttttttcggctttgctttctacacattcaatttttcatgtttattgttgctttcatcttttgccagattcaaaccaaatgtttgaatgctgcattgaaatccatttctgaagttcctatgaattcctccacaatatccgacactttatacgctaatcgcagtgaagacgctactatctcgttggtggaagaaggtttgaaggaaaccttgcttccgtctgataaaataccgtctgaaaaggtcatcgatgaagtaggaattgtttccattaaatgtttgtatgcctatgaattggaaagttccatgttcccttccacagagtcagagattgctgctattgatcttacaaatgcaaaacctaaggtcttcaactcacacaatgctgcacctcaatataagaatcttatggatgaaataaccaaatatatcatagaagatctttatacgaatactgtgccagaagacttcgatcggtcttatcaattgatgtctgcaaaaaaccgaacggtgttgctgttgttctgcacttggcttattggagtgttggctatatttttcttcacttctgatattcattgcccttaccgtggaccattgccgacttga

SEQ ID NO: 21119 - DNA, 1985 bp, Glycine max
  Peptide Sequence Number=SeqID_137897
atggcacctgaaaacccttcaacgccagatcccgaatcgccaacctctccttccgttggtttcaacaccgaccagcttcctcacacccacaccagccatgcctcccaagacgacgaggcttccgtcgatcccgatatcgtacgagacgacattgaagaacagcccgaggaagaagaagaagatggagaggatctttacaatgacaattttttggatgattataagagaatggatgaggctgaccagttcgaatcgttcgggctggacgactcgttggaagacgacagagattttgatcagatcatgcaagatcgaagggctgcggaggttgaactcgaggcgcgcgatggtcgcgcttccaatcgtaacaagcttccccagcttctccacgaccaggatacagatgatgacaatcacaggtcttctaaaagggctcgagctgattttagaccttctgtagcaagtgatgatgactttgatggtatgcaaagttcacctggaaggtcacaacggcactcaagagaggatattcttatgactgatcaaacggaggatgatcgagatgacgatgattttgatgatggatacgagatgtatcatgttcaaggtacacttagagagtgggttacaagagatgaagtgcgccgcttcatagccaggaaattcaaggacttcttacttacttatcttaatccaaaaaatgaacatcgggacaaggaatatgtctggctgataaatgagatggtgtcagctagtaagtgcagtttggagatagattacaaacaatttatctatgttcatcccaacattgccatttggctagctgatgcccctcaatctgtcttagaagtaatggaagatgttacgaaaaatgttgtctttgaattacatccaaattacaggaatatacaccaaaagatttatgtgcgcataaccaacttgccagtttatgatcagattcgaaatataaggcagatccacttgaatacaatgatccgaattgggggagtagtaaccagacgttctggagttttcccccagttgcagcaggtgaagtatgactgtaacaaatgcggggcaattttggggcctttttttcagaattcatattcagaggtgaaagtgggatcctgtcctgagtgtcaatcaaaaggaccgttcactgtcaatattgaacagacaatttataggaattttcagaagcttaccctccaagagagtccagggatagttcctgcaggtcgacttccaagatacaaggaagtgatactattaaatgatctgattgattgtgcacgccctggagaagaaattgaggtcacaggtgtttataccaataattttgacttatccttaaacacaaaaaatgggtttccagtgtttgccactgttgttgaggcaaattatgttacgaaaaagcaagaccttttttctgcctacaaacttacacaggaagacatagaagagattgaaaatttggctaaagaccctcgaattggagaaaggattgttaagtctattgctccatcaatctatggtcatgatgacataaaaactgcaatagctttagctatgtttggaggtcaagaaaaaaacgtggaaggaaagcaccgcctgcggggagacataaatgttcttcttctgggtgatccagggacagcgaagtctcagtttctcaagtatgttgagaaaactggacagagagctgtatacactactggtaaaggggcttctgccgtgggtcttacagctgccgttcataaggatccagtcacaagggagtggactcttgaagggggagcacttgttctagctgacaaaggaatttgtcttattgatgagtttgacaagatgaatgatcaggatagggtgagtatccatgaagccatggagcagcagagtataagcatatcaaaagctggaattgttacatctcttcaggcacgctgctctgttattgctgctgcaaatcctgttggaggaag

SEQ ID NO: 21120 - DNA, 264 bp, Glycine max
  Peptide Sequence Number=SeqID_137898
atgtttggccccagaaaagtaggtccaattttgatgtatacggacagtttttcactagcagcccagctagcaagcttttgttggtgtccatctctattgttgtcaagaaacttattcccaactggccaactccatatggtagatcctaatttggcttccgtgacagttgctattctcacaatccaagaagagcttggtgcccccttaataccaaacaagaaattaaaagatgccatattgaagtcaactctcagggttaggtga

SEQ ID NO: 21121 - DNA, 1440 bp, Glycine max
  Peptide Sequence Number=SeqID_137899
atggtgattggagattttaatattgtcctcaatgctcatgacagaattggtggctctgaaaacccttcttggcgaggtgcgcatgactttcgtgatatgatgcagaatgaaaatgtgtttggggacattgttaagtataagaagaaacttcttagagatcttgatgctatttctcataagattactcaccaaggtatgcactacctagaggaaagacaaaggtctatctggcatgactaccaagaagttcttagacacgaggagctcctttggttcctaaggtctagaactaaatggctttcctttggtgttcaaaatacacattactttcatggggtcactgctataaggagacataaaaacatttatgaagctattcaagatgctaaaaacaactgggtaacgaacggtgcagaccttgaaaggcctattatcctatgtaacgtatcttacaagatatttacaaaggttatgactgcgaggcttaggagagtgatggaggacctgattagctcttgtcagagtaccttcatcctacatggtagcactagagataacattatcattgtgcaggagtgggatttcattgttgaaactctaactggcattggtttccccaacaacttcattgatatggtgagattttgcatttcctcttccaagatgcaagtcatgtggaatagaaaagcattggagagctttaagccatctagggaaatcagacaggtgaatgacactcaactatctagagtaggtcctagactgtcttatcttgcttttgctgacaacctgctcttctttgcggaggcttccatagatcaggaaaacattattaaagatagcattgctactcagttgggttaccaaagaactgctgatcttggcaattacttgggaattcctatgcatcatcaaaggatttcctccaagagcttcagctttatcacgaagaaggtggaccagcgtctgggcaattggaaggctaagaacctctctcttgctgggagggtcaccctcacaaagtttgtgattcaagctttacctacttatgccatgcagtcctattatatctcagcttccgtttgtgacgaaattgataagagatgttgcatttttatttgggaagattcaaatgacagtaggaaagttcactggacgagttggaaagccttatgctcccctaagaaaagtggtggggtctccaaagttaactgtgatggtgttgtgtttatccatgaagcaattgcaacatggatggcttcttgctccatccttgaagcaaaactttggtcgatattttatggaatgagacttgctgaagattgtggggttcaacacattataatggaatcagactctgtggaagcagttaatcaccttatggagcactcatatgataaccacccgttgttccatctggtgcaagaaatcaagagatag

SEQ ID NO: 21122 - DNA, 1863 bp, Glycine max
  Peptide Sequence Number=SeqID_137900
atgattttttcaaggattgcacgctccgtttcgagttcgtctcgcgctagaaatttattacacggtgatgggagattgggaacccatgtcggatcgccacggacgaatgcgtgttctgaaggagccgaaggggtattagggtctgttaggggctacgtgtcttctgccagagctcgcagtaatggcttcgtttcaaatttgcctgattttaaatctgttgcagcaaaccctacgattcgccgattgttttgcagcaaagctccaaagaaggagaattatgggaacttctatcccaaggaaaagaaggaagttccgaaaggaaacgacaaaaaatacgagtccaaagataactcgaatgcaaacacagaggatagtggaaattttcaggaagctttcatgaagcaagttaaatatctagtcaccccattattgttgatggggctatttcttacatccttttcgtttggtcctcctgaacagaaccagattagctttcaggagtttaaaaacaagcttttggaaccaggattagtagaccatattgttgtctcaaataaatcagttgccaaagtatatgtaaggaacactcccctcaaccaaacagataatgaagtagcccaagggacccaacctgcaattggatctggaggccagtataaatattatttcaatattggaagtgttgagtcttttgaggagaagctagaggaagcgcaagaagctctgggcatttactctcatgattttgtgcctgtcacatattcttttgaactggggtaccgggaatggattacgttggcttcaatactgttgcttttgggatttctcgtgtgtgcggtagggtttataaaaggtgcaattgatgctgctcgcggcaagggtgcccctggaatattcaacataggaaaagctccagttactaaagtagacagaaatgccaaaaacaaggttgggagatttctttttcttctatcaatgagatggctgctgatttttagttatttcctccaggcaggagtgctgatctattttaaagatgttgctggctgtgatgaggcaaagcaagaaattatggagtttgtccacttcctcaagagcccaaagaaatatgaagaacttggtgcaaaaattccaaaaggtgctctcttggttggtcctccaggcaccggaaaaacccttttagcaaaagctacagcaggggagtctggtgtgccatttctttctatatctggttctgatttcttggaaatgtttgttggtgttggaccatctagggtgagaaacttgtttcaggaagcaaggcagtgttcacctagtatagtatttattgatgagattgatgcaattggtcgagcaaggcggggtagtttttctggtgcaaatgctgaacgtgaaagtactttaaatcaattgttggtcgagatggatggttttggaaccacttctggagttgttgtgttggcaggaacaaataggcctgaaatcttagacaaagctcttcttaggcctgggcgatttgaccgccagataacaattgacaaacctgatattaaaggccgtgaccagatatttcagatctacttgaagaaaatcaaacttgatcatgagccttcatattattctcaaaggcttgcagcccttacacctggatttgctggagcagacattgctaatgtctgcaatgaagctgctctgattgctgcaagaggtgaaggaacacaagtcaccatggaacattttgaggcggccattgataggatcattggtggtttggaaaagaggaacaaggtatgtctttttaagttttatattactattagttacgcttgtgagatgggagaggtggagctgggtgttttttag

SEQ ID NO: 21123 - DNA, 237 bp, Glycine max
  Peptide Sequence Number=SeqID_137901
atgtacaaaagaaggaagaaaaggttgctaaaattggcaacaaaggatgagatagcgattcccggcacgccaaggttaagtttgaaggttagaaaagtgagggttggaaggtgtagaagaatggatagtaaagtgcaccacaacagtggccaagttgtgcctttactacgtaggaagattcgaagagggtggaggaagctattggcaatgaggtctggaattgcgaagcggcaatag

SEQ ID NO: 21124 - DNA, 556 bp, Glycine max
  Peptide Sequence Number=SeqID_137902
atgacaatttcagcaggttaccttgataaccctcgtgttgctctagccactgctggcatagtgatacaaaccacgtctcttatgtacactttgccaacggcactaagtgcatcagtgtcaaccagagtaggaaatgaacttggagcggggcagggtgaaagggcaaatttgtcaacggtggtggcaataggattagcacttgtaagctcaatatttggtttgttgtggaccacaatgggaagagaaaggtgggggagagtgttcactagtgatagcgaggtgttacaattgaccgtggcagtgttacctataattggactgtgtgagttagccaattgtccgcaaaccacaagctgtggaatccttagaggaagtgctaggcctggtattggggctgttattaacttttgctcattttacttggtaggagcaccagtggcaattgttttagccttctattggaaactcgggatggctagatgcttggtgggaaaggcttcatgtggcacatttgcatatgatgaggaccaaactgatgcactcaaatgtgaagaag

SEQ ID NO: 21125 - DNA, 357 bp, Glycine max
  Peptide Sequence Number=SeqID_137903
atggagcacgcgacacgtggcacagcgcggcgcacgagacagcagcagggtagcgcccctgacgcgggcgcgtctggtagcgccctgctgctgggcgcgactggtagtgcccagcgcgtgggcgcgactggtagtgcccctgacgcgggcacgacccaggcgtgcgcctgggtcgtgcccgcgtcaggggcactaccagtcgcgcccagcggcagggcgctaccagacgcgcccgtgtcaggggcgctaccctgctgctgcctcgtgcgtcgcgctgtgccacgtgtcgcgtgctccatggaagcgccttcctgggggacgctttgtaataaaaaaacagaccccctaggtaaataa

SEQ ID NO: 21126 - DNA, 111 bp, Glycine max
  Peptide Sequence Number=SeqID_137904
atgcagacacttactgctgattttgaggctattgatcttctacagaaccaggataatgctaaagccagtttagaagttcttgccactgatatacagttcttgagggaccag

SEQ ID NO: 21127 - DNA, 555 bp, Glycine max
  Peptide Sequence Number=SeqID_137905
atgaatgacatacttcaaccatttttacgcaaattcacaacgatcttcttcgatgacattctcatctacaatgaatccctgtcgactcacctcacgtttggaattggtgctcaaaaccttattacaaggcaagttttatctggaacgctccaaatgcttgtttgtccaatgacaattggagtacctaggtcatgtctcattggtttctaccggagacttatcaaggggtatgctgcaattgcctctcctttcacaacactcctataccgcgataagttccattggttaccgaaggctcaacaggcttttgatcacttaaaacgagccatgaccaaggccccaatcctagtttccctagatttctcctcaccgtttgtgttggaaaccaatgcttccggtaatgccacgggcgcaatcctgatgcaacaaagtcgacccatcgccttctttagtgaacaattcagcgtgatattgcatcaatggtttcactgtatacctaaacttatatacatacacctttccttaaatttatcaatgatgggaggaaaccattaa

SEQ ID NO: 21128 - DNA, 117 bp, Glycine max
  Peptide Sequence Number=SeqID_137906
atggctatggtgaaagtagctatcaagaatgtgtgcatcgcaaaccggtctttcccatcaacaaatatcttgcataatggaatagtgattagtggaactgtaggagctcttgattag

SEQ ID NO: 21129 - DNA, 162 bp, Glycine max
  Peptide Sequence Number=SeqID_137907
atgggagaaaatggatttgcacatcaacccaacctcattgagttgtgcaacttgaagaaatcaacggtggaatccacacaaatggagtcaagcattgggtttgttgtgttaccggagacacagaagattcggcagatgttgtgggagcttgtgattgagaag

SEQ ID NO: 21130 - DNA, 168 bp, Glycine max
  Peptide Sequence Number=SeqID_137908
atgtctcaattacgtgccaatagagtgaaggattggatcatcactaaatgggccaaggtcccgtctaataaggtgcctcaccaaccaaaagctctagataagtttgtggttcgtaaggtgacacaccattggcccacgaagccattttcaactttgtttaccctataa

SEQ ID NO: 21131 - DNA, 174 bp, Glycine max
  Peptide Sequence Number=SeqID_137909
atggtgagagagaagagagaattccctaaggaagagttctcagactttggttgttggagtggacttgggcctgtgtacttgcgcttagcgccctctgttcacttagcgcaagtgcctgtttttgagcttagcacgctaagctcgcttagtgcaggtaccggtgttcgggcttag

SEQ ID NO: 21132 - DNA, 918 bp, Glycine max
  Peptide Sequence Number=SeqID_137910
atgaaagttaaaaaattttatgtgtacattccgaaaagagatgaagagcaagttccagcatggatccaaattgacagactcaaggctatgttgagtgctgaatttgaaatgaaggaacttgggaaggctaagaggatactaggaatggacatcaacaaaaatagatcaaaaggaaaactttttctgtctcaacaaggttatataaagaaagttgttgaaaagtttagaatgcatgagtcaaaacctgtctcaactcctttgggacaacatgacaatttgtcaaccaaggatgcacccaactcagatgaagaaagggaaaggatgagattaattccttactctaatggaatgggaagcattatgtattacatggtttgcagtagacccgatttagcatatgttgtcaacatggttagcaggttcatgacaaatctaagaccaaaacattggggagctttaaaatgggttttcagatatctaaatgattcattatcttctagtttaaagttcaaaaggaagatgaaaagtgaagaacctatcaaaggttacacaaattctaattttgctggaaacatatcaactaggaaatctttatttgcatatgtctttaccttttttggcactgttgttagttggaggtctgtccttcaattagttttggcattatctacaactgaggctgagtttattgctcttacaaaagctgttaaggaagctagagtggaattgagctttcaaaacaacaagtttaacatgaaaagtctaagcacattaatgtccggctacacttcattcaagatgttgttgaaaccaaggagattttggttgagaagattccacacaaagatctttgttttgaaccataacatgtttcatgggaatttttatttgagtcatttgttacaaatcttagcttag

SEQ ID NO: 21133 - DNA, 156 bp, Glycine max
  Peptide Sequence Number=SeqID_137911
atgggactgtttttgagtgatccagtcaaaaggagggaatatgacataaatgggatgcgctacgaatatgattacaatatcattgattatctcaaccgttacaagggccttatattgacgtgcaatggccttggcataaagcattcgatatggtaa

SEQ ID NO: 21134 - DNA, 3744 bp, Glycine max
  Peptide Sequence Number=SeqID_137912
atggtgatttcttactctgattttgctaccaatccctctaatccatactacatgcatccgaatgagaatccttctcttgttctcgttcaacctgtgcttgataacaaaaactatcagatctggtgcagatcgatgaaggtggctcttatctccaagaacaaggtcaaatttgttgatggcactctttctcctccccctatctctgatcctctctatgaaccctggcttcgttgtaataacctcgttctctcatggcttcaacgttcaatctctgaagaaatcgcgaaatctctcctctggtgtgatcgcgcttctcttgtatggaaaagtttggcgaatcggttctctcagggtgatatttttcgcgttgctgatattcaagaggaagtagctcgtcttcaacaaggaactcttgacatctcttcgtatttcaccaaattgatgacgctttgggaagaaattgagaattttcgtccaattcgtgattgtacttgtgctataccgtgttcttgtggtgctgctacagatttacacaaattcaaggagcaagataaggtaatcaagttcttgaaaggtcttggtgatcaatattctcatgttcgctcacagattatgctgatgtctccacttccaaccctagacaatgcgttcaatttgattcttcaacaagaacgccagttcaatcttccttcaaccactgattcttcaattgagaatcaatcgtcggtgaatcacttctctcaaacgccttctcgtccttctaataattccggtcgaggtcgtggtcgtggatattcctccggtggccgtggcaaccggctatgcactcactataatcacaccaatcacactgttgaaacttgcttcatcaagcacgggtatcctcctggttttcaacatcgtaagtccaattcctctggaaatgcctttgtggtgaactctactcaagatgctggttctgctcacatttcctcatcatcatctgcttccacatcaacaaatggatcaagtgcttctttgtccacgattcaagagcaatatactcagattttacagctactccaacaatccaacttgcaatctacttcaccttcttcagttaattctgtttttgctacaaattctgtctctcatacctctccctctccttcatctggtaagcatctctcaaacaataccagtcactggtggattgctgacaccggtgccactgatcacattactcatatctttgacagtttttcttccacatatcacattgcacccaaaactatgaccatgcctaatggtgacactgtcactaccacaatagctggttcagttttgttatatgactcccttgttcttcataatgtttactactttccttcgtttcatgtcaatattatctctgttactactctatttgattccaccttatatgatgtgaaactctaccctaattgttgtaaaattgtgcagctacgtcatcccaagatgactggatttacagctaggaggattggcaaattgtatgtgcttgacaccacctcacctctggttttctctcccacacctggttctgtcaacacctccatctctcatgatcctgccaccatttggcattttagactaggacatttaagttctcatatacacaaatgtatttcatcttactttccctttgtcactttcaatgacaatcataaaccttgtaatacttgtcatttggctaaacaaagaaatttaccttttgctcatagtactactaaatctgttgccatttttgattttattcatgctgatatatggggacctctttccaccccttccatatctggccataagtattttctaacacttgtagatgattacagcagtttttaccttactaaaggtatcatccatcataggtcatgtgttgaaacacctcaacaaaatggcatcgtggaaagaaagcatcaacacattttgaatgtagcacgtgctctttcttttcactctcatctccctcataacctttggcacctctccatacaacaagctatccacattatcaacagacttcccacccctcttttgaacaacctcaccccttatcaaatgcttcattttattcctcccagccttcatcatttaagagtttttggatgtcttgcatactcctcgaccttacataaccatagaaccaaatttgcaccaaaggcaagaaaatccatatttcttggatatagggaaggcaccaaaggctaccttctttatgatcctatcacccatgagttctatgtttcaaggaatgtaatcttccatgaaattgtctttccttttgcctcacctccacctgccaataatcctgtcagtgtcaaccctgatattgctaccttagacacatctgacattctcctagatcttccactatccttacctccaccaaatgaacctacctcccctcctgcaccaaccagaaaatcacatagactaacaaaacctcctagttatctctctgaataccactgcaattttctatcctcaatgctgccagcatctaatccagaacccaaaacttataaacaagcttgtaagtttgattgctggaatcttgctatgaaatctgagttagatgctcttgcatccacaaacacttggtctgttgttgatctgcctgaaggtaagcaaccaattggttgcaaatgggttttcaagatcaagcatcatgctgatggatccattgaacaatacaaggcccgtttggtggcaaagggatacactcaactagagggtgtggattattttgacactttttcaccagttgctaagcttaccacaattcgcacccttctatctgtggctgctattaaggactggcacttagaacaacttgacgtcaacaatgctttccttcatggtgatctgcatgaggaagtatatatggatctgcctcctgggttcttgccgcctggttcttcttctaataaagtctgcaaattacataagtccttatatggactgaaacaggctagcagacagtggttctccaagttatccactgctcttatctcccttggatactcaccttcatctgctgaccattctttgttcacaaaactacataattctcatttcactgctcttctagtctatgttgacgatattgtcttgacaggtgatgatttgcaggaaatacaatctgtcaaacaattccttgactccacattcaaaatcaaggaccttggcaagcttaaatactttcttggattggaaattgcaagatctactcaaggcatctttctcaatcaaaggaagtatgcattagaattgcttgaggacagtggtttattggctactaagcctagtacaactccctttgattgctccttgaagcttcatgacagtgactcacccccttatgaagatgaaacagcctataggagacttgttggcagacttttatatttaactacaaccaggtatgacattgctttcattgttcagcaacttagtcaattcatctctcagccattacaagttcatcactcagcagcaattagagtccttaaatatctcaaaagtgctcctgccaagggattgttctattcttcctcctccacacaaactctctggttttgcagacttagattcggcaagttgccctgctactcgcagatcagtgactggttactgtgtctttcttggcacatctatgctgtcttggaaatccaaaaagcagtccacaatatcccggtcaagttcagaagcagaatatag

SEQ ID NO: 21135 - DNA, 1362 bp, Glycine max
  Peptide Sequence Number=SeqID_137913
atgagtaccaaccgtatgtttatccttctcgatgaaagctccaacatcactccccctattgaagaatgtctgcatacttcctccgatctcacttacctttggcatcaaaggtatggccacttaagctacaaggaactgaaaacactacagacaaagaaaatggtgcgtggactacctcaactggaagcctcaaatgtcccttgtgaagattgttttgtcggtaagctacaccgtaatcctattcctaagaaaagtgaaagtcgtgctaataaggtcttgaaacttatacatgcagatatttgcagaccaatagagccaatctcaaatagtggaaagaggtatctcttgtgctttattgatgattatagtcgcatgggttgggtctatttgctctttgaaaaatcaaaagctttggagtgtttcaagatttacaagaaactggtggaaaaggaaaacatcactcctcaagaagcttggagtggagtcaaaccttcagttgaacatcttcgagtttggggttgcatggcatgcgtgcacataccagaggcaaaacgaggtaaacttgacgataagagctttccttgtatcttgttgggtgtaagtgatgagtcaaagggttatcatttttttgaccctaagacaaagaggattgtagttagtaaggatgtagtgtttgaggaacagaagagttgggattggggaccaaattataaagaacaaatagaagcagaattggtttggggtgatgatggtttcagtagtgatgagagtgaaggggagtatagagatgaggttgttggtgataggttacaggaagacatggagttcaataatggtgatgacaatgatgggaataacatgaggggtagtgaagcagagagttcacaagaaaatgtgattgaagggagagtgaggaggacaccgacttggatggaaggatttgtaagtggtgagggcttgagtgaagaagaagcagaggcctacatgttaggagacatgatacgtgattatctaactttgtttgaggaagctgtgacgcatgagaaatggagaaaggctatggacagtgaaattagctcaatagaaaaaaaccagacttgggagctcatggacgtaccaactggagcaaaaacaattggaatggaatggattttcaagacaaaattgaatgaattgggtgaagttgataagtataaagtacgattggcggctaaagggtactctcaacaacatggaattgattattctgaagtctttgcccctgttgcacgcatggatacaataaggatgattgtggcacttgcagcatgcagaacatctttcagttggatgtcaaatctgcattcctacatggagaattga

SEQ ID NO: 21136 - DNA, 1345 bp, Glycine max
  Peptide Sequence Number=SeqID_137914
gactcagacggttagcctgcatcaggatatcggcgatgcccgccgcttcgaacagcatgcccccttcagggacgataatcaggaatgtatgcatggcgataataggaagaacaagcaaaacaggtcagacagccactgtataagaaaagcctcgccggttcaccctgcgggcataaaaaagcccgtcggcaagcgccgacgggccaacaaagcactgtcctcaagcctgcggcaggctcaccccgccggcgcgcgccaattgcgccagcagcgccgtttgaaacgcctcgtcgtataccgccgcgtgaggttcgaagcgctgttgatggtgccaatagccgccggacgccagagcctgcggctcatcgctgctcaccagccacgcctgcgtcacatgccccagcgccagatcgtcgggcgcatccgcgccgcccattttggtcggcacccagccgggatcgaccgcgctgctgatcacgtcaggccacaggcgcgccacggcggcggccagcgcggtgacgaacagtttgctgtccgaataggagccggctgcgccgccgagccagtccacgccgctcagttccgccacgccgtcaaagtgcatgctgctgctcagatagacgatacgcttggggcgttcgatcagggccgtcagcaggtagggcgcaacgacgttcaccggcatcacctgcggcccggtaaacataccggcgttgtggatcaccgcgtccgggcggccgaggcggttgacctgctcggcaagctgccggatctgctgcacatcggacagatcgccgatcgtcgcctgtgcgccgcgatcccgcagatcgcgcaccgcgtccaaacggccgggctcacgcgcatgcagaattacctgatgcccttcgtccaacagcgtttgcgcggcggcgcggcccagcccgtctaccgaaccggtaatgaaaatgcgcacggtcagcagcagcgtatccgcttcggcgatggcctcgtcctgcgccagctgcttgatcagctcgtccggctcggcggcatagctgcggccgaagatcgcccgggtctgcgcgtcgatataccccagttgatcgccctccttgccgccgccgccgaagtagttgcgatcccgctgatccaccagcgcgaagatgctgcggctgacggaaacccgcggctcgcgcgcatggcccgcctcttgccaggcggcgcggtaggcgcggatctgcttggcctgctggatatggaagggttcgccggtttcgtcgttcttgagcgtcgagctttgcaggttcatgcccagcttcgccgcccagacggcggtggcgttcgaaccggcgccccaccagatgcg

SEQ ID NO: 21137 - DNA, 576 bp, Glycine max
  Peptide Sequence Number=SeqID_137915
atgacacgggctgggaaaggaatttttcatggagaagactgctttttgacaatgaaattgatactgccatcggtttccttagagagcgcctacaatctgatatgggaggaaattgctggtggccagaaggaggattgcagtatggaactatggaagacaaagatacctagcaaaattgcgactgcccacaaagcagaatctgcgaaaaaggaacatacagatcacctatttattcattgcatcaaaatccaaccaatttggtgggaatcaatgtcatggatgaatatcaaaggcgctttccccttcagcccgaaacaacacttcatgcagcacatttctatccagatggaaggattaagggctaagcgatggaggtattggtggctaccagtaacatggtctatatggaagctcagaaacaaaattttgtttgcaaatgcagaatttgatactaatcggctttttgaagatgctatctttataatttggacttggcttagacaatttgagaaggacttcacaatccactataatcagtggtcaagtaatattagacaaggctttttgtttttgtag

SEQ ID NO: 21138 - DNA, 551 bp, Glycine max
  Peptide Sequence Number=SeqID_137916
atgggatcaagtcaaaagccttcacttaaaaagaggttctatccagtcaaggtcaagagcctagggatcactagtttacgagagttggggcaattaatgggtcaacttcaacggcaagccttccgcaaagtctatggtaagatttgggacctagctagggacttccagctagtgccaactgtgaaagagtttgaagaaatcctggaatgcccactggggggaaggaagccatatcttttctctgggttctatccctcaacgacaagagttgccaaggtagtgaaaatctcagcacaagagttggatcgtgtaaagcaaaacagaaatggagtagtcggagtaccaaggaagtgttttgaggaaaggcaaaggccttggcaaaatcaaggcgaatgggcttcttttatcgacatcttggcgcttttgatctttggaggtgtcctctttccaaatatggaagggttagtggacctagcagcgattgatgctttcctcgcctttcatcatggcaaggaaatcccggtcgtcgccattttggccatgcctgacac

SEQ ID NO: 21139 - DNA, 189 bp, Glycine max
  Peptide Sequence Number=SeqID_137917
atggcctttcaaaggggtaaaaggctcacattccctttcttccacatcatattcaaacttgtccaaataaataataaagtcatctcggctcaaacaagggtgtttaagcttatgagaatcctgaaactggccaaatacaggctaaaggcccaagtggagaaggacgaaggcccaagtggagaaggataa

SEQ ID NO: 21140 - DNA, 369 bp, Glycine max
  Peptide Sequence Number=SeqID_137918
atggaaattaaatgcacaacggaaagtaaaagagtagggaagaagaaaacaaacacacaagagtttttatactggttcggcaacaacccgtgcctacatccagtccccaagcgacttgcggtccttgagatttctttcaaccttgtaaaaatccttttacaagcaaagatccacaagggatggagaagagagacacaaaaagaattcaggcggttagtccttggcgaattctttttggcaaagggagaagagaatgaaaagatgaatagcataagttttcaaggtttagaaaaccaaaaaacttcagaaagcttttggtacaaagaagaagaagaagttcaaagagattcaaggcttgtaaaggattga

SEQ ID NO: 21141 - DNA, 231 bp, Glycine max
  Peptide Sequence Number=SeqID_137919
atggcatggggtgtcggagaagaaggagaagcaaccgtgccagatggaggcgaggaaggaaaggggggtgtcgtggaagatgcctcagtggaagcagacatgtgggagaaaaaggaatcaaatgaagacagtacaagtgaaggcttcaatcccttctccgtctctttgacgtttgggaactctatcggagtagtcgaaggaaaaactggaggaatctcagggaatcgctag

SEQ ID NO: 21142 - DNA, 1755 bp, Glycine max
  Peptide Sequence Number=SeqID_137920
atggctctggcagcaattaatgcgcttaatggaatctacacaatgagaggttgtgagcagccacttattgtccggtttgctgatcctaaaaggcctcgccaaggagattccaggggtcttgcttttggaggcccaggatttggtcctagatttgatgcaccaggcacaagacatccatccaatattacggatcctattggtgatcgtatgcctccccctaatgcttggcgtcccatgcatccgccaaatgtggggccaccttctaatgctggtcttcagggcatggggccaccgttgatttcaagatctggtgacatggcattgcctacaaatgcggccatgggttcaaatcttggaaataatctttccaatttcgagggcggtcctatgactagcttgggaggccccatagatggtcgttttcaagttcagtctatgccgatgtcacaacagaatttcaatcagcccatgccacaaattccaccagtcaatcaacaaatatcaccattgcagaaacctgttcagtcatcccaggaactgccacattcccaccagttataccctcaagcaccagttccctatccacaaacatctcttaggcagcatgcccagccacaacttcctcttccatctcagcaggtacatggagtaagtggacagtttccaacttctcagccccaaactcaacagagtgctttgtctgctgcaattcctcagaccaatcttgaaaccggcatgcaatctaatgctgcactaactactccaaatcaacagcaagttcctccctctgtgcagcagcagccacttcagcaatccccttctccgttagctcagatgttgtcacaacaaacacagactttgcaagcaagctttcattcatctcagcaggccttctcccagcttcaacaacaattacaaatgatgcaaccttctagtcaagcattaacattccagcaaaatgcagaagctaccaaaaagcagtctcaatgggctgggcctgggactgctgtagcacaagcagtggccagcactcgtgcagctgcacctgctgcagatgtgccttcatccacacctgctaattctgccttaccagcaataaaccagaacatggctcttgtcaaatgtaattggacagaacatatatctcctgagggcttcaagtactactataatagtgtcactggtgaaagtcggtgggagaaacctgaggagttggtattatatgaacagaaaaagcaacagcaaaggccatctgttcagcagtctcaaactcagtcacaaccttcaatactacctgcccagcaagttccccaaatccaacatgttcagccccaaagtcatctccaaggacaagttctccaccagcaacaaatacagcatccttcttctttgtcttcttcggcatatggagttacgggccctcaaaatgttcaggaagtgggatataaacagttacaggcatcggttatttctgctggtgatccaggacgctactcacaggtggaatacttaaatgcatttgctatgaatgttgaagagcggattgtcagactaggctatgcggctaatacagatgtcacagcttcaaaaggtagggacaaccatcttcattttgatgcttcaaaaagtgttttctgtgacatgctcatgttctgggacaacagtagtgttgccttttgcaacatagcacgccaggagagattcgtaccttctcgtagcagtgtcgagcttaaggaattaatggctttcattcac

SEQ ID NO: 21143 - DNA, 3702 bp, Glycine max
  Peptide Sequence Number=SeqID_137921
atgttcaccgaaggccttgacagaaatgcacttcgatgggttagagagaaggaagtcccgttctcaaacactgcattgagatctcgcaatgatcccatcagtgggatgaaaagtggtgctggcagagggtttgggttaccgcccccatcaaaattcagaagtgggcatcttcctgctaatgcaatccctgtatcaacagttatgctgggtgagactggcgacagcggttcaaattctgataatgacgacagcatcgaatcggaggaggaggtttatggtggcaggtattcattggattcgtcaccgcaagaccgaagagtccccaatggtgctgctaggagatatgggaacctcactggaccccggtatgcaagtgattatacatattccgaggtcagttcttccagggaaacattggttgggagacctggtactgtgagggatccattgatgaggggggcaacaaatgtaaggcagagtggcttcacagaggatgattcatcggattctgcagccagctccgaattctctaccacacaggtaggaggaagtatcaatggagcactgccaagaggtagaacttatttatctgaagggtatgcttctagtgtgccttcaaggatgaatgtgaaaagtgctgcagagaagaatggaagaatatctgatgatgaggaggatgacattcccagtgcacccccatttgctggttctactcaagagatcagacaaacacatgaggaaattcctgcttcaagagttgatgctactccaaataaagcggaatcaagttctttgaaatccatgtccggggataagatagaaaaccatgtcgaaaatgggagccctgaccaatttgctagaactgctactggttcagaggctgctacatcttcaaattctcacccacctcgccttccaacatttcatgcaagtgctcttgggccatggcatggagtgattgcatatgatgcttgtgtgcgtctttgccttcatgcttgggcaatgcagtgcatggaagctcctatgtttttggaaaatgaatgtgctttacttagggacgcatttggattgcgacagatactattacaatctgaagatgaactaatggtgaagtgcaatgcagagccttccagtgagggtgttgctccaaaacccaaaaaacttattggcaagatgaaggtgcaagttcgtaaagttaaaatgggcttggaccctcctactggctgtagcatgtcatcaatcatgacgcacaacattaaaatggaatccgtgcgacaccgtttctccaatttgcaatcatcactatctgctggatggcaagctctcagaagaattcgatttctaccacgtttgcctgcaaatggttccttggctcgacagagcttggcatacgtgcatgcgagcacccgctacatacaacaggtgtctggactcctgaaagttggtgttgtaacaactctaaggaataattcatcatcctatgaagttgggcaagagacatactcatgtttcttgaggctgaaaagcacagttgaagaagatgcaataaggttgcagcctggatctagtgaagtccatatgttttttccagatagccttggagatgatttgattgttgaagttcaagattccaagggaaagcattttggccgtgttcttgtccaagtggctgctattgctgacgatccggctgacaaattacgctggtggcctatttatcgtgaaccagaccatgagcttgtgggcaagttacaactgtatataaattattcaacaagtgcagatgacaatagtcatcttaagtacggttctgtagcagagacagttgcgtatgacttagttatggaagttgcaatgaaaatccagggatttcagcaaaggaatctattgttgcaaggtccatggaaatggcttttgacacagtttgcatcctattatggggtatctgagatatataccaagctgcgatatctatcttatgtcatggatgtggctacacctacagcagactgcctcaacttggtgtataacctgctagcacctgttatcatgaaaggcaatagcaagacttctttgagccaccaggagaaccgaatactaggagagaccaaggatcaaattgaacagatacttacacttgtttttgagaattataaatcacttgatgagtcttctttctcgggcatcatagaggttttcagaccagcaactggtcaagcagcaccagccttggaacctgctgttaaactctacaagcttcttcatgatatcttatctcctgaggctcaaactgcattttgtcattatttccaggttgctgcaaaaaagaggtccaagaggcacctgagtgaaacagatgaatatattacacaaaataatgaaagcagtttgatggatggcatggctatgtctactacttaccagaagatgaaaaccctatgtataaatcttagaaatgagatccatacagatatccagattcataatcaaaatatacttcctagctttgtggacctgccaaatctttctgcttccatatacagcacagagctttgcaacagattaagagccttcctcatatcttgtccaccaatgggcccatcatcacctgtggcagaacttgttattgccacatcagattttcagagagatcttgtaagctggggtattgattctatcaaaggtggagtagacgcaaaagagttgttccatttgtatattcttgtttggatacaagataaacgtctatctttgctggagtcgtgcaaattagataaggtgaaatggtcaggagttagaacacaacattctactactccctttgttgatgatatgtatgagcggctgaaggagacattgacagactacgaggtcatcatttgccgctggccagaatataccttggtcttagagaatgccattgctgatattgaaaaggccattgtggaagctttagacaaacaatatgcggatgtattatctcctctcaaagaaagcatgggtcctaagaaatttgggcttaataaatatgttcaaaaacttgccaaacgatctacatgtgcctatgtggttcctgatgagcttggaattcttttgaattccttgaagagaatgctcgacagcttgcgccctaggattgaatcccagttcaagacatggggttcttgcttgccacatgttggaaacacgacacctggtgagcgacttagtgaggtgacagtgatgctgagagcaaagttcaggaattacgtgcaagctattgtggagaaacttgcagagaatgcaaagttacagaataccacaaaattaaaaaagattcttcaagattcaaaggaaactgtggtggagtctgatttaagaactagaatgcagccactgaaagatcagttggctagtaccataagtcacctgcacactgtctttgagactcatgttttcattgccatatgtcgaggctattgggatcgtatgggacaggaaattttaagtttcttggagaacagaaaagagaatagatcgtggtacaaaggttcaatggtcgccgtttctattttggatgatacctttgcttcacaaatgcaacagcttctaggaaatgcattgcatgagaaagacctggagccacctagatccatcatggaagttcgttccatgctatgcaaggatgctcccaatcacaaggacaacactttttactattag

SEQ ID NO: 21144 - DNA, 963 bp, Glycine max
  Peptide Sequence Number=SeqID_137922
gatcttcacatctctcttgatcaacctatctcagtctactgtgataataagagtgctatctatcttgctcacaaccccatcttccatgagcggacaaaacatattgaaattgactgtcatgtcattcgtgagaaaatacaaactggcctcattcatctcctgccagtttcttctgctgcacaattggcagatgtacttaccaagccattgcctgctccttccttcaattcattgatttccaagcttggcctattagacattcatagtccagcttgtggggggctattacatgatcagcagttggtcatggaatctctaggcaaggagtttgacttggatggtaatcggataaggaataatcctgcagctttgctggctttatgttggtattgggctacagatggtgtaggatcaaaagatatggttatccttccgtataaggacagcctgctattatttagtagatacttgcagcagttggtcatggaatctctaggcaaggagtttgacttggatggtaatcggggaacaaggtcagccctgtatgccaataaccgtgaatccatcactgtcacagtgcaagaagtgacacccagatcagttggtgcccttatagccctttatgaacgggcagttggaatatatgcctcgcttgttaacataaatgcttatcaccaacctggtgtggaagctggtaagaaagctgcaggagaagtgttagcacttcagaagcgggtattggcagtgctaaatgaagcaaggtacagtgagcctgtcgaaccattgacacttgaagaagtagctgacctttgccatgccgcagaagatattgaaatgatttacaagatcattgctcatatggctgccaacgacagagcactgattgctgaaggtaactgtggttctccgaggagcatcaaggtttttcttggagagtgtaatcttgatgaactgtatgcttga

SEQ ID NO: 21145 - DNA, 104 bp, Glycine max
  Peptide Sequence Number=SeqID_137923
atggctgcaccactacacactggccttcaaagcatgttgaaggctgcagtggaatctgttcgctgggtttatggcatcttctggcaactttctccacaacaagt

SEQ ID NO: 21146 - DNA, 1248 bp, Glycine max
  Peptide Sequence Number=SeqID_137924
atgaacgctgataacggttccagagacgccaaactcgacaaccaacacgcaaaagacaaagaaaaggaggaactcaccgagaatatgaacaagttgcatattgaaggatcttcgtctgggagtggatcatctagcttcagaagaaaacctgtcatcattatagttgtgggaatggcagggagtgggaagacaacactcatgcataggttggtatgccatacacatttgaaagacattcggggttatgtggtgaatctcgatcctgccgtcatgacactcccatatgctgctaacattgatgtgagagacactgttaaatacaaagaagtcatgaagcagtttaaccttggccctaatggtggaattttgacttccctgaacttgtttgccaccaagtttgatgaggtaatttctgtaattgagaaacgggcagatcaacttgactatgttcttgtggatacccctggtcagattgaaatatttacctggtctgcttctggtgctatcattacagaagcttttgcatctacatttcccactgtagttgcctatgtagttgatacaccccgttcagaagatcccaccactttcatgagcaacatgttgtatgcttgtagtatcctctacaagacaaggttacctctcatcttgactttcaacaaggttgatgtagcagcacatcagtttgctttggagtggatggaggattttgaggcgttccaaacagccgcaagttcagatcactcgtactcatcaactttaactcagagcctttctcttgtgctagatgaattctacaacaatttaaaatctgttggagtttctgcagtttctggtgtaggaatggaagccttctttaatgctgtcgaagccagtgcagaggaatacatggagacatacaacatatatagcagggtgtttgaaatgactaaccaaataacttcattgtatcgtgcactgtttagggctgatcttgataaaagacgtgaagagaagcaacgtttggaggaagaccgcaggaaggagagcatggataaactgaggagggacatggagaaatctgggggagaaactgtagtcttgagcactggtttgaaggacaaagaagcaagtaaaagtatgatggatgaggaagacgaggacgaggaaatggatgatgatgatgatgatgatttggggatatatactgaagaggaagatgctatagatgaggacgaagatgaggaggttgataggttcggcttctga

SEQ ID NO: 21147 - DNA, 423 bp, Glycine max
  Peptide Sequence Number=SeqID_137925
atgactttgcgatcatcaattcatcatagatctaaagcagatattgcgggttttgctcatttaacccttgagattgtcaatgctaatgcctctataacattggaacatatacccaagtttcatggccaaacagaggaccctaagctaaaaatggccttgaaagattgtcttgtttcatacaacacgatagtcaaggtacatttgagagaggctctaaatgctatggacgtaggtgattatagggctgtacaacaaaaggcttatgttactattattgaagctgagtcatgcaatactaaatttaggaatctggctacttcacctttaagggataccaaccgatatgtgcaaaatctgtgtgctattgccatttcaattgctaaaaaattggttctgccataccaattaccaacttcgatttag

SEQ ID NO: 21148 - DNA, 417 bp, Glycine max
  Peptide Sequence Number=SeqID_137926
atggtactgaaaggagaggaatttcgtggcatgaacagtgatagtgttgaagtcgaatgggaatcaaagactgcttcaaacttggtagtgtgttattgtcatggacaacgtatgaaagagaaagccaacgtgaaaacgtacaaaaatataatgcagattgtgaatgtcgacgatggagtctcatcctcttcttcgtcaggacccatcgtcgaatatggtgtgcctctcacacgatgcataacccaagtggttgaggaggctagaacctccacacgctccaccatgcaccacttcttagtgcggtttagtcgggcgcaaactcaggcggcgccttctagtggtcggagtgccccaacaacaagaagatcaaaaccatgggcactcgaaacctttaaagtcaacaactttacattatga

SEQ ID NO: 21149 - DNA, 558 bp, Glycine max
  Peptide Sequence Number=SeqID_137927
atggactcagaatcaattcctcaatgccaaacgaaacatgcacatagagactgtccaaagtctgccagattctggaaccaccttcgtctggatgtcaatcttcaagatcaggatatggaggcaccaaactggctgcgttttttctgcatgggtaatcttggtgtatctggtattggcggaatcatcagagatagtaatggatcgtgggttcaaggttttgctggtttatgcgaagtcaagaccaacctctatgctgaactactggccatcctcaaagttcttcagatggcatgggattacaatggtcaagctcttatttatgaatcaaactctcgcactgctttgtccctgacattgcatggtgcagatcatacgcatcactattttcctctgatctcaagaattaggagcttccttcatcacccttgggagctttcctttcagcatgagtttcgtgaagccaactactgtgcggattggcttgctaaattaggagctagttctgctaatcatcctctggttttttatagttgtcctatagctatggctcacttgtag

SEQ ID NO: 21150 - DNA, 282 bp, Glycine max
  Peptide Sequence Number=SeqID_137928
atgaaggggcttatggatagatgtggtgatttccttttttgggtgaacaagaaagagtacaaaggtttccatgactatgcaaagttgaaaggagtgaatgttggtgaacctgttggacttgaagttcttgttgatggaacagtgccgacaggttctggactatcaagctctgcagcgtttgtctgctcatccacaattgctattatggctgcttttgatgtgaacttcccaaagagttatgataaggagttattgctggaattttatgtgccatttaagtaa

SEQ ID NO: 21151 - DNA, 237 bp, Glycine max
  Peptide Sequence Number=SeqID_137929
atggggtctgtttgctcggctgagaaaaataaaaacaaagaggttggagggaaaaccttggggaagaagcttaagaagttaaaaagcattgcaaagggaaaaggagattgttattcaaattcaaggactagtgatcgtggtacaaagcaaaaggagcgaaactctggattttccagtgaattcaacttatccaatcctagtcgaaaagaaggaaaagagggactttccctctgctga

SEQ ID NO: 21152 - DNA, 537 bp, Glycine max
  Peptide Sequence Number=SeqID_137930
atgtcgagtggaggaaaccttagttgcgtgttggtagctgtggatggcagcgaggaaagcatgaacgcgctgcgttgggcactgaacaacctcaagctccgatcccctgcacccgattccaccgatgctccttccttcaccgtcttccacgtccaatccccgccctccatcgccactggcctcaatcccggtgccatccccttcggtggccccagttccgtacattacattctctctaattcccatcctaacctttcaattcaatctttgagtttaagtgatctcgaagttcctgctttcactgcagccattgaagcgcaccaaaagcgcatcaccaacgccgtactcgatcacgccctcggaatttgctccgaattcaacctcaccagtaaggtcagaacccatgttcttgtaggagatccaaaggagaagatttgtgaagcagttcaggatttgaatgctgatgtgcttgtgatggggtctcgtgcttttggccccattaagaggtacaaattaactagtgacaaatctgcataa

SEQ ID NO: 21153 - DNA, 303 bp, Glycine max
  Peptide Sequence Number=SeqID_137931
atggagtctcatcctctcaacgtggcaaccatcatgatgaggttgatgacgcattttgtttgtgacttgagtgtggcgaagatgaaatccttcaagaacgtacaaatgttggagttgcgttttagatctgagtttttttttttttttccagatctaaggtggtccaatttcaatactggggatgtcgagagtgagtggttcctctatagtgacgcaacaacggtctttcaggctgcgatgaagggttttgtggtggtgatgacggggtggtgtcggagaggaaggagtggttgcaaactatga

SEQ ID NO: 21154 - DNA, 570 bp, Glycine max
  Peptide Sequence Number=SeqID_137932
atggaatcattagctcttatcttctacagtactcttgttttagctacgatttcagttccagcaactaactccagaatcatccatcaaaaaaacaatgccaatctgattgaagaaacttgcaagcagacaccccatcacgacctttgcatccaatacctctcctccgaccctcgcagcaccgaagcagatgtgacagggctggcacttattatggtcaacgtaatcaaaatcaaagcaaacaatgcattggacaaaatccaccaactgcttcagaaaaaccctgaacctagtcaaaaggaaccactgagttcgtgtgctgctagatacaaagcaattgtggaagctgacgtggcacaagccgttgcgtctctgcagaaaggagaccccaagttcgcagaagatggtgccaatgatgctgctattgaggccaccacttgtgagaacagcttctctgctgggaaatcgccactcaccaatcacaacaatgctatgcacgatgttgcaaccataactgcagctatacgcatgggatgtgatatgcctctgtcttgtgcttctactttcttctaa

SEQ ID NO: 21155 - DNA, 963 bp, Glycine max
  Peptide Sequence Number=SeqID_137933
atgcaattagtactattgtgtctactgatactgaagctcactccagcctttgcaaccaccccgaatgatgcctatggtggtgatagtagtggctgtccattagggactgacatataccaatacacttgccctgaagctgaggccatcatattctcttgggtggagcaggcagtgtctcaagactcaagaatggcagcctcacttcttaggctacatttccatgattgctttggttgtgatgcttcagtcttgctagatgacacacaggactttgttggtgagaaaactgcgggtccaaatttgaattccctgagaggattcgaagtaatcgaccaaatcaaatccgaactggaactagtctgtccacagactgtctcttgtgctgacatactcgcaactgctgccagagattcagttcttctgtcaggaggtccaatttgggaggtgcaaatgggaaggaaagatggcattactgctagcaagaatgcagcaaataataacatcccaggtccaaactccactgttgatgtgctcgtagctaagttcgagaatgtaggccttacacttaaagatatggttgccctttcaggtgcgcacactatagggaaagctcggtgcagaacatttaggtcgcgcttacagactagtagtaacattgatttcgtcgcatcattgcaacagttgtgctcaggacccgacacagttgcacatcttgacctggctacacctgctacgtttgataatcaatattttgtaaatcttctatctggggagggattgctcccatcagaccaggctcttgtgaatggcaatgatcagacacgacagattgtcgaaaactacgtggagaacccattagctttctttgaggacttcaaactttctatgttgaaaatgggaagcttggcatcaccaactcaaactaacgcccagattcgtaggaactgccgaactattaactaa

SEQ ID NO: 21156 - DNA, 492 bp, Glycine max
  Peptide Sequence Number=SeqID_137934
atgttagtggtaaaagggtatgctcaagtttttggagtagattattttgatacttttgctccagttgcaaggctagatacaatcagaatgttactagctattacaacacaaaaacaatggaagatttatcagtttgatgtcaagtcagcctttttaaatggcttcctaaaggaagaaatttatgttgagcaacttgaaggctttgctgcaaaaggagatgaagacaaggtgtatctattaaagaaggcactattcggcttgaagcaggctccaagagcctggtatagtagaattgacgaatacctgctaggctttgttaaaagctttatcattggttgcaacattgagcttattcaacaattcaaagaagacatgatgcaagtctttgagatgactgatcttggagaaacgtcttatttccttggaatagaaataaagcagagacaaaatgaaatattcatttgtcagcaaagtatgcaggggagatcctga

SEQ ID NO: 21157 - DNA, 810 bp, Glycine max
  Peptide Sequence Number=SeqID_137935
atggtgcttacctgtgtgataactgataaggacttctacctttacatgaattacgagaacatgacaagcgaaatcacactatctctgctgaaacgcaaatgcttttacatcgaccgtccaatcaagtgccacgtcatcgatccgcgtgaaatcgattttgaacggccaggatcagcgctgcagaaaaactgggggaagcgaagggaagaggctgaacgtaacattctttggtttctggatttgaagatgaaggccacaaaggaattgagccagcatgtggaggaaaatgaggtcacggtcttggttgatgaggaggaggacgaagaatacgagtccgaggatgaagtagtagacgacggagaggacgatgaagacgacgacgacgacgatgacgatgacgacgacaatgaagacgaggaagacgacgatgaagatgatgctcccgacggcggtgacgacgacgacgatgaagacgaagaagaagaaagtgatgtccagcgcggtggagagcctgacgacgacgataacgatgacgacgacgaagatgaagacgaggaggatgaggaggagcaaggggaagaggcggatttgggaacagagtaccttatccgccctctagtcactgctgaggaggaggaagcatctagtgatttcgaaccagaggagaatggcgaggaggaggaagaagatgtcgatgatgaggatggtgagaagtctgaggctccaccaaaaagaaagaggtcagataaagatgattcagatgacgatgatggcggtgaagatgatgatgagagaccctctaagaggtag

SEQ ID NO: 21158 - DNA, 1506 bp, Glycine max
  Peptide Sequence Number=SeqID_137936
atggactcttgttctaagagacttgcattctcggaaccctttatgtcacagaggagaaaggtgatttctgggttcagtttgggcgttggagtttctctccttttcctcactctcatcttgctcaacaacacttccctctccgttcccaaggttcaagtgtttctccaaggatccgattccaattcctcttcttcttcattctcgtggcgttttcccttcacaaccactctttcttccaacgcttccgtgagtcctctgcatagggttgaagtgaacgtgtcgtcaagtgagggttcggagaaaagttcggaggaaacccttttggggaatctcactggggatcagaaaaatgcaagcttgcatgatgggcacgaggaagatgatgaacattgttgttctttgaagaatgttactttggcggtgaaggaaaatgcgcaagtgggaaattcgtcatgcaatggtggtggtagtggtgtgggaaagtgtgaagatgggttgttgatgaaggaaagtaataataatgatagtattagtgttagtggtttgcttggggaatgtgacatctttgatgggaaatgggtgagggatgaatcgaagccttactatccattggggtcttgtcctcatgtcgatagggattttgattgccatcttaatggaaggcctgatagtgagtatgtgaagtggaaatggcagccgaatgggtgtgacattccaagtttgaatgcaactgattttctggaaaagttgcgaggacagaagctggtttttgtgggggattcactgaacaggaacatgtgggagtccatggattataattgttcagtagattttgtcagttcaccattcattgttcaagagtcaaatttcaaaggcataaatgggtcctttgagacattaagattggatttaatggaccagacaagtactacctatcgtgatgctgatatcatagtcttcaatacaggccattggtggacccacgagaaaacatcgaggggagaagactattatcaagtaggcaaccatgtataccccagactcaaagttctggatgcatatactagggcattgaccacttgggctacatgggttgacaataatattgacgccaatcgaactcaggttttcttcagaggatattcagtaacccatttcaggggtgggcaatggaattcaggtggaaagtgccacaaagaaaccgagccaatatctaatggaaagcacttacgcaagtatccctcaaaaatgagggcttttgagcatgtggtcatcccaaagatgaaaaccccagtgatatatatgaacattagtaggcttacagattacagaaaagatggacatccttctatatacagaatggagtataagacagcagaagaacagaccgctgctgaacaacatcaagattgcagtcattggtgtttgcctggagtacctgatacttggaatgaattactgtatgtttctctcttgaaatatggtaaaggccattggaaaagctga

SEQ ID NO: 21159 - DNA, 1602 bp, Glycine max
  Peptide Sequence Number=SeqID_137937
atgtgtaagaatgaaagttcattaagaagttgttgccatgatttcttacggaagttgttcttgtttagtaggcaatcggacatcaacttagttgaaataggaagtgatgttgtcaaagacgaagacagagcagctttattggagggaggagctttacagtcaggatctccaaaggcacggagcttaactgcctcgccatcaattatccgattccttttgatggatgagtatttccttcttgagaaccgtttaacacttagagcgatgtctgaatttggtctcatcttggcttacttttatttgtgcgaccgcacagatttctttgcctcatccaaaaagagttacaatagggatcttttcctatttctctattttctcctcatcatagtttcagcaatgacttcctttaagatacatcatgacaagtcaccattgtctgggaaatccatcctttacttgaatagacaccagactgaagaatggaaaggctggatgcaggttttgtttttgatgtatcattactttgctgcatctgaaatctacaatgcaatccgtttgttcattgctgcatatgtatggatgactggatttgggaacttctcatattattatgttcgtaaagattttagtctagcaagatttgctcagatgatgtggcggcttaatttctttgtggtgttcagttgtattgtacttaacaacagttacatgttatactacatctgccccatgcacactcttttcactcttatggtttatggggcacttggtattctccacaagtacaatgagattgggtcagtcattgctgtaaaaatcattggttgcttcttggttgttatcttagtatgggagatacctggagtctttgaatggctttggagtccatttactttctttctcggttatactgacccgaatcctgccaaatcacatctttctcgcttgcatgaatggcattttcgttcagggcttgaccgctacatatggataattggaatgatttatgcttattatcatccaactgttgaacgatggatggaaaaattggaggaagcagaaatcaagcgcagaatatcaatcaaggcaactgttgttctgatatgttcattggtgggttatttatggtttgagcatatatacaagctggacaaggtcacatacaataaataccatccttatacctcatggattcccataacggtttacatatgcttgcggaatgttacccaaagttttcgtagctatacactgaccctttttgcatggcttgggaagattacactggagacttacatctcccagatccatatctggttaaggtcaggtattccagacgggcaacccaaattgttgctttccctgatcccagactacccaatgttgaacttcatgcttactacttccatatatgttgcaatttcctataggctctttgacctgacaaatacactgaaaatggcatttgtacccagcaaagacgacaaacgtcttgtacacaatttaattacagcaacaacaatctcagttgttttatattctttgtccctcggcttccttagggtacctcagatgttggtaagggttattgcaataacttga

SEQ ID NO: 21160 - DNA, 403 bp, Glycine max
  Peptide Sequence Number=SeqID_137938
ttatgtgagtggtagcttgtcggatgagggtaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtattgtcagcagccaaagttgccaaaaagatgaagctaaaatttactaaagaatggattgcatatcttagattgcctcttccaattgatgtttacaaagaggtaatccacaaatgtctcaaggtagtcatgagatccaatgtaggattggaaggggggaagaaacacaaatggtggaattgtaagattaattcagcttatggccttttatttttcattcaaaacctttattaa

SEQ ID NO: 21161 - DNA, 699 bp, Glycine max
  Peptide Sequence Number=SeqID_137939
atgaaccagattcgcttcggtttatgttcggcgtttttaatgggcttcgtctggcacatgtcgcggcgcagcaagtctggcatgatcaccaccttcatcctgtcgtttatcagccacgccaccgcgattgtcgcgctgctgattccgctggcgatgattgtgcgtaaaaacaaatacatcccgattgctatcgtggtcgccagcctgccgctggcgtttctcggcagttcagcgctgatcgccgcgctctcaagccacctcggtgcgctgggcgacagggccatgggctatgccgatgccgattcacgccaggagcagggcattctgaccctgtcgaacctgaagaatatcggcttcgtctttatcttcagctacatgttgctgagcgataaaattaaaaatttcgacccggaaaagtttaatacctattacattctggtgatcacttttgccatcggcagtggcctgaggatggcgctacaggattacgcttctggtggtcgtctggcgaactatttgctgcaggttgagccggtgcttatttcgctgtgtatctgggaaacccggaagctgaagaaggtacttgccgtggctgtcaccattctgatggtgctatactatctctactacaacactgtatcgagcaagcagtcgattgtcggctatgaggtgtcacgcaccttccagctgttccgttag

SEQ ID NO: 21162 - DNA, 309 bp, Glycine max
  Peptide Sequence Number=SeqID_137940
caaaagaatgtttatacggataaccactcgggtatttccgcccgtcagcatgactcaaaagtcagtatgacagatcttgtaagtgcggaagatgatgtaaatctccgcgtgtcaacgggcttgtcggccgcgattgacgaagggtgcagaatgacaacattggccgctgcttgtcatcgggcctgccgcctctggatgacaaaagggtatctccgcgtgtcatcgggcccgccgcctccggatgacacaaggggtgcggataaccgtaaggtatctccgcgtgtcatcgggcccgccgcctctggatga

SEQ ID NO: 21163 - DNA, 801 bp, Glycine max
  Peptide Sequence Number=SeqID_137941
gttggattaatcatagggagaggtggggaaacaattaaaagcctgcagagcaaatccggggcgcgcatccagttgatacctcaacatcttccagaaggggatgattccaaagaaaggactgtccaagttactggtgataagaggcaaattcaaattgcacaagaattgataaaggaagtcatgaatcaggttaatatcttgttcgcggtggagctattaccaccacacattgcttgcaaagttttgttgttctggattagctcttgtaatatggtgttgaaaagaaaaggataccctaatgctataaagctcgtgctatgtgcatgtccagggaacgctgaaaaggaaaaagagataaaaaataatgagcgaatggaacaatataatttgaatgagttaccttttcttgttactttccttctgtgcttgaatcttctaatggtttcaaattctgatcctttgcttcttgttacagatgttgaatctctacatataaattgtggtggaaagcaggttgttgttggagatataacatatgatgaagatatggattcagctggaccaacagtttttaaacaaagtagaaataattggacatttagcaacacaggtcacttcgtggtcaatgatactttagctaaacaaggaaagcttccagcctatgccacagaaaatgaaaccaggctttatatgactgatgccgaattatataagaatgcacgtatttcccccatatctttgacttattatggattttgcttggaaaatggagactacacagtaaagccatactttgcttag

SEQ ID NO: 21164 - DNA, 351 bp, Glycine max
  Peptide Sequence Number=SeqID_137942
atggctggaccttttgagttgggttcatcaaagaagaaaccaggggatggagtgaatgatttactcacttttaatgctgaaaatatgcaaagcaacatgaaaattatttattacagccgaacatttttgtctataattggtggagttgttgctggaattttggggttcacaagcttgaaaggatttgtattttacttccttctcatgatggttacttcacttgggcttgtagccaaagccagattttcaatccactcctactttgactcctcgaatcgagttctacttgatggcttcctaggtggtctaatggagggaagcaagataaaatatgctaggcatcctccataa

SEQ ID NO: 21165 - DNA, 387 bp, Glycine max
  Peptide Sequence Number=SeqID_137943
atgctcaaagccaccataattaacaacttgaatccccattcccacaaagaaggtccagtctatatcactatcaccttatccaaacagaaaaaaagccactctttggaatcagattcccactctcaccaaaacagcaacttctctttgacccaattcaatgaacatcaaaccaaacagaacccagatgccaaaattgcttctttctttgccaccacaaaaccaagttggaaaatggagaatttgaatccaagcaagaggattgcagggaataaaaaggaggtgagagcatggagcaggagcacgctcacaacacaaccaaagaaaagaaccaaacacaggacaaaacaaaatgccaaagtggacacaaatgtagatgcacaactataa

SEQ ID NO: 21166 - DNA, 714 bp, Glycine max
  Peptide Sequence Number=SeqID_137944
atgaggctttttaagacgccggcgacggtggaggatggcatagtggtggtgatggccagggttgtgcaggggagggaagggagcaaaaaagaagatgcagggagtaaaagcctagaacaaccggtggattcccttgggtcaattagaactgtggggtatgataaggcccaatggcaaaaggaagagtttttgtgccctttccttcttcttacaatcagaaactctgaatcagacagcgtcggaggcatgggtgacaaagaggaagagtcggcaatgccaagggacgcaaagattgtgaagtctttgctgaaatcaatgggcgtggaggactacgaacctcgcgtcattcacaagtttcttgagctttggtatcgctacgtcgtcgatgtcttaaccgacgcacaagtctattcagagcatgctggaaaacctgcaattgactgtgacgacgttaagcttgcgattcagtccaaggtcaacttcagcttctcgcaaccaccccctcgtgaggtgcttctggagttggctcaaaaccgcaacaagataccattgccaaagactatagcaggacctggtatcccacttccacctgatcaggacacattaatcagtccaaactaccagtttgcaattcctaacaaaaggcctgcccaacctttagaagaaacagaggatgaagaagctaccattcccaatccctctcaggaacagaag

SEQ ID NO: 21167 - DNA, 633 bp, Glycine max
  Peptide Sequence Number=SeqID_137945
atggggaaggactacatttcaacacctactcctggaatcaagctacttcaatcagctgaggatacctacaatttcttggtgaattggctacaaagattcccacagttcaaatctcgggaattttttatatcaggagaaagctatggtggtcactatatccctcagcttgcagagttaatctttgatcgaaacaaagatagaaacaaatacccctctattaatcttaaaggttttattgtagggaacccagaaactggtgattactatgactataaaggggtgctggaatatgcatggagtcacgcagttatatcagaccagcaatacgacaaagcaaaacaattatgtgattttaaacaatttgattggcctaatgaatgcaacaaggccatgaacgaagtcttcctagattactccgaaattgacatattcaacatttatgccccggcatgtcgtctaaacagcacatcctcaatagctgatcatagcaacagtaacaatcctgaatcatcaaccaaggagagaaatgattatagactgaggatgagaatttttgggggctatgacccttgttattccaattatgcagaagaatatttcagtagaaaagatgttcagtcatttttcatgtag

SEQ ID NO: 21168 - DNA, 348 bp, Glycine max
  Peptide Sequence Number=SeqID_137946
atgggtactagtcaactacagcttgtagctggccttctaggagtagaggcaggccaagatgcagttgttcgagcaatgttatatgaacgggtgaatccatataaagtgactgtggaagagttcaccaatcgcatttcaaacctcagaaacaagctaggcaaccaacgaacaaaagatgagggtcttgaaattaatgtgcttgctgctgataaagattcactttcatattcaagaaatgtacaagaaatattgaggatactaaatggaggtaatgaacgtgtcccgggtagcttcttctctaaaggagcaaatggccgtctagccaaatcttacttaggagcaacctaa

SEQ ID NO: 21169 - DNA, 2997 bp, Glycine max
  Peptide Sequence Number=SeqID_137947
atgacggtggtcggactcttcctcactgccacgaagctcgccggagctctattcactctcaccgtcgccgccaacgccttctcctactcccgctttcgcaagaagaaccttcgcggtttccgctctcccatcgatgaatcccaagacactctcgcacactttaacgtcgctggggaagatgggtttttctttggtttggcgacagcgccagcacatgttgaggacaggcttgatgatgcttggatccagtttgctgagaaaaagagtggtgaaggtggtggtgactctgaggggaagcagagagtggatgctgtgattggttctgcttctggcgatggtggttcccagccggccataacatctccgaggagcaggaagcctctcaaggtggcgatggaggccatgatcaggggaattgagaagtatatggaagtggaagggaaagaaagagaagaagaagcccgtcctaatgtaactgcttggcataatgttccatgcccggaggagaggttaaggttttggtctgatcctgaaacagaaataaagttggccaaggatactggtgttacagtttttcgcatgggaatagattggacaagaatcatgccagtggagccagttaactatgctgcattggaacggtataagtggattatcaatagggttcgatcgtatggaatgaaagtgatgctcactctttttcatcactcgcttccaccctgggctggtgagtatggaggttggaagctggaaaagacagtggattatttcatggactttaccaggcttgttgtagacagtgtctcagatttggtagactactgggtaacatttaatgagccccatgtcttctgtatgcttacttattgtgctggagcttggcctggtggtcatcctgatatgcttgaggctgctacttctgcacttccaactggtgttttccagcaggccatgcactggatgtctattgcacactcaaaggcatacgactacatccatggactaagtaacccattaaattcaatagtcggtgtagcacaccatgtgtcatttatgcgaccctatggtttgtttgatattgctgctgtttcactggctaattcattgactctcttcccatacattgatgaaatatctgagaagctggactatataggcataaactactatgggcaggaagtggtttcaggtgcaggcctgaagctggtggaaaatgatgagtacagtgaatctggtcgtggggtataccctgatggcttataccgcatgctgcttcaataccatgaaagatacaaacatctaaatattcccttcatcattactgaaaatggggtttcagatgagacagatttgattcgccggccatatctcttggagcatttgcttgctatttatgctgccatgatcatgggtgtgcgtgtacttggttacctgttctggactatttctgataactgggagtgggctgatggatatggtcccaagtttggacttgttgcggttgaccgggcaaataatcttgcacggacccctcgcccctcttaccatctattttctaagattgtgaatacaggcaaagttacacatgaagatcgtgaaagagcatgggatgaacttcaaagagttgcaaaagagaagaaaacaagaccattttatcgggctgtggataaacaccgtttaatgtatgcagcatctgcaataaatgtggaaacatatgaatctgatagaataattgatcttcctggccaaccttcaagcccatcagtctcacacttttcaggttacatcactgtcaatgaaaaccatggaagggcccttttctactggttctttgaagctcaatctgaaccatccaagaagcctctccttctctggctcaatggaggacccggatgctcctctattgggtatggtggagttgttgagattggacctcttatagtcaacaaaaatggggaaggactacatttcaacacacactcctggaatcaagtggccatatttgacaaactacttgaatcagctgaggatgcctacattttcttggtgaattggctacaaagattcccacagttcaaatcccgggacttttttatatcaggagaaagctatggtggtcactatatccctcagcttgcagagttaatctttgatcgaaacaaagatgggagcaaatacccctttattaatcttaaaggttttattgtagggaacccagaaactgatgattactatgactataaaggccttcttgaatatgcatggagccatgcggttatatcagaccagcaatacgacaaagcaaaacaagtatgtgattttaaacaatttgattggtcaaatgaatgcaacaaggccatgaacgaagtcttccaagattactcagaaattgacatatacaacatttatgccccgtcatgtcttctaaacagcacatcctcaatagctgatgatagcaacggtaacggccctgaatcatttactaaggagagaaatgattatagactaaagaggatgagaatttttgggggctatgacccttgttattccaattatgtagaagaatacttcaatagaaaagatgttcagtcatcttttcatgcagatactaaaagagacactaacgtagcatggaaggtttgcaataattccatattgaggacttacaacttctctgttttctcggtcctacctgtctacactaaactcatcaaaggtggccttaagatatggatttatagtggagacgcagatggaagagtgccggtgataggaacacgatattgcgttgaggctctgggattacctttaaagtctaggtggcgaacttggtaccatgataatcaggttggaggaaggatagttgaatatgaagggttgacatatgtgacagtgagaggagcaggtcacttggtgccactgaacaagcctagtgaagctctctctctaattcattctttcttaactgggcaacatcttcctactactcatggataa

SEQ ID NO: 21170 - DNA, 579 bp, Glycine max
  Peptide Sequence Number=SeqID_137948
atgtctctcttaacagatgagttgaagtccaaagctgaggtttactatggggacaaagtttgcagggagaagttctctttgttgctggcagaaataggtctacctgatgggttattaaccattcaagacattgaggaatgtggttatgtcaaggaaataggctttgtttggctgaagctcgagaagaagagagagcaatggtttgataaaatacttgtttgctatgatacagtggtcactgcttatgtggagccaaacaagattaagaatctcactggggtgaaggctagggacttcttgctttggttcactttgaacgagatttttgttaaggacaatccagaagctcctgtcatcactttcaagtctttggttggtttgtctatgtcttttccattgtcattgtttgaagcagggaaagaagccaataaggaagaagcaaaggaagagaagtggtggaggatgatcattgatttatcccaagccttcctattgaagatcctcacttgggccttagcaggccgcaccaaaaaagaggaacccaaattctttagaacgccttcatcttttgcaaattga

SEQ ID NO: 21171 - DNA, 197 bp, Glycine max
  Peptide Sequence Number=SeqID_137949
atggtgttggcttccccaaactcaataaggagcgaagggattctacccagcaacgagcttattcccgttgtggacctaacagcagaaaggtcacaagtgacaaagctcatagtgaaagcgtgcgaagagtacggtttcttcaaggtgataaaccacggtataagccacgaagtgatatcaaaaactgaagaagcagg

SEQ ID NO: 21172 - DNA, 276 bp, Glycine max
  Peptide Sequence Number=SeqID_137950
atgaaaagtttgccacttatgttggtggtaaccttggattgctttatttgcctcaaagacatgcttatggataggactcgaaatgattcaagccagcttgtgcaagatttgagcttgaacctttacatatttgacatgaggtggcttgatatatacgcatgtactcccccgggtgttggccctgtgaaagagggtcaaacaattactgctggtattacaggccttgtggacgtacagtttaatgttgaaaaaagagcaaggcctgttctttcttga

SEQ ID NO: 21173 - DNA, 333 bp, Glycine max
  Peptide Sequence Number=SeqID_137951
atgtttgggtatcctccacatgagaaaaggactccttcttttccttccttccatcgggggaaccaactgattgttctacctcctatcccggccaagagctggtcccaatctattctcctcttttcaatgcacgagcgatggctcaggagcggacatggatgtcttgtgtcttgtcggaacaagtgcgaaaccaaccaaacacagagggcggatctgccaagacagctaccaccggactttccttgctatggtggtaaggccaggaaagcgtcgattgctgctaggtctaccaaaccatccacgtttggaaagaggacgaatcccaaaaattag

SEQ ID NO: 21174 - DNA, 261 bp, Glycine max
  Peptide Sequence Number=SeqID_137952
atgaaaacactgcatcgctgcacaccagattcattcgatgatcaagtaaacatttcctacgttcaaataaaccgaaacccccgaattatatacgcatacggtttctccccattaatacagaagaggtatgctctgcaatttcaagttaagaattcccccagagaagagaagaaaaaactcacaggaaatcggaggcgaggcgaggcgaggcgaggcgaagggcaaagtcgaagtgttcttacgaacggagcaaaacgttag

SEQ ID NO: 21175 - DNA, 1863 bp, Glycine max
  Peptide Sequence Number=SeqID_137953
atggaagttccttcggaggtaccatctactgacactggcaccagcaccggcaccggcgaaaccatgagcaagaatgcgttgaagcgggagctgaagaacaaacagagagaagaagaaaggaagcgcaaggatgaggagaaggccaaaaaggcagctgaagcacaacaggcaaaggataacaaatctgcaccagctgatgatgaggatatggatccaactcaataccttgagaacaggctaaagtatcttgcagttcaaaagacagaagggaagaacccgtatcctcataaattctttgtcactatgtctattgatcaatacatcaaggaatatggaggtttaagcaacgggcaacacattgaggatgtctctgtgtctttggctggccggatcatgcacaaacgcacctctggttctaagcttgtcttttatgacctgcacggtggtggttgcaaggtccaggttatggctgatgctagggatgttgttgttgaaccaggccaaatgaaaaaactgatatctctgcaatgcagtaaatcagacttggatgaggctggattttccaaattccattctaatgtgaagcgcggtgacatagttggtgtcactgggttcccaggcaaaagtaagaagggcgaacttagtatttttcccaagaattttgtgtcgctgtctcattgtttgcacatgatgccaaggcaaaagtctgctgctgctgctattgataatgtaaatttgaagagaaatccatggataccgggaagtactaggaatcctgaaacatatattttgaaggatcaggaaactagatatcggttacgccatttggatttgatgcttaatccagaggttcgagacatattcaagaccaggtctaaaatcatttcttacattaggaggttccttgatgaccttgatttcttggaggttgaaacacctatgatgaatatgattgctggtggagctgcagcccgtccatttgtaacacatcacaatgatcttaacatgaggttattcatgaggattgctccagaactgtatcttaaggagttggttgttggtggactggatcgtgtttatgaaattggtaaacaatttaggaatgagggcatagatttgactcataatcctgagtttactacctgtgagttctatatggcttataaggactacaatgacttaatggatctaacagagcaaatgttgagtggtatggttaaggagcttacgaaaggcagctataaaatcaagtatcatgcagatgggattgataaggaacctattgaaattgactttactacaccttttagaaggattgacatgattgaagagttagagaagatggcaggtctaagtattcccaaagacttgtcaagtgaggaagccaatcaatatttgaaggatgcatgcgtgaagtatgagatcaaatgtcctccccctgagacaactgctcgtttgttggataaacttgtgggtcactttttggaagaaacgtgtgtaaatcctacattcatcaaaaaccatcctgagatcatgagtcctctagcaaagtggcacagatcaaaaccaggcctgactgaacgttttgaattgtttgttaataaacgtgaactttgcaatgcatatactgaattgaatgaccctgtagtacaacgacagagatttgctgaacaactcaaggatcggcaatctggcgatgatgaagcaatggccttagatgaaacattttgtacggctctagaatatggtttaccacctactggtggttggggtttgggcattgatcggttgaccatgttactgactgattcacagaatattaaggaggttcttctcttccctgccatgaaacctcaagactga

SEQ ID NO: 21176 - DNA, 437 bp, Glycine max
  Peptide Sequence Number=SeqID_137954
atgagcttaatttttctcccttccaacccatcaccaccacaacctcctcaaaccttgtgacctcaagcttttctccctccttcgcaaccgcaaaatcgaagaagcagggctcgcctactcccaccccacgcagctccctaactccacctgccccagctgcttggtccctcaactctcttaccagaacacactctcttctctcatgtgcgtccagtccatcatcatgtgcgtccgcaatgagcgtcaacttcaccgtctcgacgccacctgtctcaacttcctcgtcgtcttcggtcaaccacacactctatgttgcctccctccttcgctccagctacctccccccacgtcaagacctggacactgtcgtcgcccgcctcgcctcctcccctgacctccacgatggccccatcgaggtcctctgtgaaagtcactag

SEQ ID NO: 21177 - DNA, 237 bp, Glycine max
  Peptide Sequence Number=SeqID_137955
agtttacaggtggtggcgcctccaggatctattccttcagtggagcagttcactgagatggtagcctggcccggaacccaaccttttcttcacagggaagatgaaagtcccacaacccaggtacctcagcatgtggaggatgagtcatctgaggccaccatcccagagccatttgttataggagaagaggcagaggagacacaggtgagacaagtagctgttgccacacctgattga

SEQ ID NO: 21178 - DNA, 420 bp, Glycine max
  Peptide Sequence Number=SeqID_137956
atgggtagggatagccatgaccccacttcctttcactcttccattgcccttctacaagagaggtttagacagcttcagagagtaaaagaaatgagggaggagagggagcttcagaagatgctcaatgaacctaaacaattcagttccaacaccaacacctctataagtagtagtacttatcacaattccaacaattcaatcctctctcaccctgaattgatcatgccatcaaggtcaccaccccatgtttccctctctctctggccaacatctcagggcaagcaagaggactatagaagtactcaaaccccggtttcaatgaactatgcacattcacgatccatgcaagtttcgtggaagaacgccaatgattgtgactctggtgccgattctggtgttgacacttctcttcacctgtga

SEQ ID NO: 21179 - DNA, 435 bp, Glycine max
  Peptide Sequence Number=SeqID_137957
atgaagcccaaggtggagtgcaaaactggagaagaaaggcccaatagaggccataaacgatctaaggtgagaacagcagcaacagagagtgtagtgttgttgaggttttttgtagcagaattcagtgcgatgaacacagacatcactgcatcgacgaagccagagtacccagtcattgatcgcaaccctcctttcaccaaagtcgtcggcaacttcaacaccctcgactatctccgattcgtcacaatcaccggcgtttccgtcaccgtcggctacctctccgggattaagcctggaattaggggtccttcgatggtgacagggggtttgatcggtgtgatgggtgggttcatgtatgcttaccagaactccgctgggagactcatgggtttcttccccaacgatgatgaggtagctcgctacaacaaaaaataa

SEQ ID NO: 21180 - DNA, 501 bp, Glycine max
  Peptide Sequence Number=SeqID_137958
atggccctactagggtgttgtttgtttctcattcttttcctacttggattagcagaatcacagtctcaaactttcaaccacccttttaaccgcacagacatacaagcagcaataggtgacatgagagcaaaatcttactatggattcgcgatgcttttgcagatgctgaatggaacatcacagccaaataatagggacttaactttcttgatgccagatgataaagaactatctgcttcatccatttctattgatgaagtggaagagttcttactaaaacatgctattccaatgcctctatattttaatgatttatctcattttccaactgggacccttgttccatcggggaatagaacccaaatgattaggatccataaccgtgccaggggggatttctttgttaataatgctcaaattgtttctgctaatgtttgcttgagctctgtgatcaagtgtcatggagttgatgcaataattgaatatgatcatggtaattga

SEQ ID NO: 21181 - DNA, 438 bp, Glycine max
  Peptide Sequence Number=SeqID_137959
atgagtagctatttgggtgtaggtgttagtcctgggaatgtcccagtttaccacagcacaaatgtgaacgtgttagataggaggatcaagataacagagttggtgttgaggtgtgtgatccttggtttaggggttcttgcagctgttcttgtggggactgattcccaagtcaaggagtttttctcatttcagaaggaagctaaatttacagacatgaagtctttggtgttcctggtggttgcaaatgggttagcttctggctactccttaatccaagggttgcgctgtatcattagtatgatcagaggaagagtactcttcagcaagcccctagcttgggccattttttctggtgatcagaatttatgctctctacatgtgtcagaagcccaacttgggtcggtttggatatggtttgagattaaggctcaaatttag

SEQ ID NO: 21182 - DNA, 468 bp, Glycine max
  Peptide Sequence Number=SeqID_137960
atggcttctaggaaaagaaaggaaccatctacacccacccaagaagcttctgccagagaggaacgtggtggtctactatacaagttcgatgagttcaaggaggaacttgaaagacgccactgggacgaggagttgactgactttggggatggcaacattgatgttgccattgtgaaggaattctacgtcaacctccttgaccccgaggataaatcacctaagcaggtgagggtgagaggtcacttgattaagtttgatgaggatacgcttaatactttcttgaagacccctgttattgtggaagagggggaatcactctgtgcttattctagattttcactcctaaggcctgatcctcaggaattagctgctaagatctgtatcccaggtaggggattcgagcttaatgctgatgggcaacccctgaagattttgaggaagaacatgaccaccctagctcagacatag

SEQ ID NO: 21183 - DNA, 1302 bp, Glycine max
  Peptide Sequence Number=SeqID_137961
atgtggggctattcaagcaagtctgtgcggcaggtatggcttaaagtcatactggccacactatgtgctgcgctgctgtcatgtagtgacaacaatacacccaaacaactggtacgtgcaaagcctaaaccagacccttacaccatccgcttcgtcaccatcaatagtcccagcacttatttcatcgatagccagaataattacgcaggacttgaatacgaccttgcgaaacggtttgtcgagtttctaggcccgccctattcgcttaaatttatcgttgtcgatagttttgacaaggtatttccaaccctgttgagaggggatgccgatattgctgcagcagatatcagcattaccgctgcgcgtaaacgccaggtactatttggcccggcattcaaccaggtgcaatccatggtggtatttaaccgcgacaacaataaagagcccaccaaggccgaggcgttattacaaaaacgtatcgttctccctcaaagcaccagttttgtggagcgtatgcgtgagctgcaatccaaacttcccgcactgacctggagagaaacggacaaactcagttcggaacaactgatcgaagcggtcgcgcgtaatgagatcgacttcaccgtcgcggataatcacctgctggccatcatgcaatataactatccacaactggatgccggcatgatgctggggcagacagacaaaattgcatgggcgctcaataaattaaagggggaagagcggcttaaacaggtggaagcctttttcaagaaaattgagaaagacggcaccttgcgtaacttgctggatcgctatcatggttataccaaacggttgaagcctgtagatatcactgcatttttaagcaaatctcaaacactgttgcccaaatatgtgcgcctgttcaaaaatgcacaggaaatcaccgacatagactggcgcttgctggccgcccttagttatcaggaatcacactgggataactacagcacctccccaaccaatgtgcgcggcctcatgatgctcaccgaacaaaccgccaacatgatgaatgtcactgaccgcctggatcccaaacaaagcatcgttgccggtgccaaattcttcctatggatgaaagaccgcatcccaacacgcattcccgagccagaccgcacttttatgactttagctgcctacaataatggcgttggtcatcttgaggatgcgcgcattatcgcgcagcgacttggactcaacccggacagctgggccgatgtgaaacgtggttaccagttacttaacgacccggggatcctctag

SEQ ID NO: 21184 - DNA, 462 bp, Glycine max
  Peptide Sequence Number=SeqID_137962
atgcaccaccaccatagaatcaagaaagaagctctcagtctgtcaatccttactatgtctggacctggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccg

SEQ ID NO: 21185 - DNA, 981 bp, Glycine max
  Peptide Sequence Number=SeqID_137963
atgcgtcgggagggattggcaaaagacagtgatatttggaccgacaaacttagagatttgaggctctgggcttcctacagaggtcagacgttatcacggacagttagaggaatgatgtactactatcgtgccctcaagatgttgacttttctggattctgcatcagaaatggatattcgggaaggtgcccgcgaacttgtttcaatgaggcatgatgatttagagagttccaactcaaagtcgccttcctccaagagtttaagtagagcaagcagttctgttagtttgttattcaagggtcatgaatatgggactgctttaatgaaattcacatatgtgattgcttgccagatatatggaactcagaaggaaaaaaaggatcctcatgctgatgaaattttgtatctaatgcaaaataatgaggcccttcgagttgcttatgttgatgagaaaaccactggaagggatgagaaggagtattactctgttcttgttaagtatgaccaacagttgcagatggaggtggaaatttaccgcgtaaagttgcctggacccttgaagcttggggaaggaaagccggaaaatcaaaatcatgccatcatcttcactcgcggtgatgcagttcagactattgatatgaatcaggacaactactttgaggaggcacttaaaatgcgaaatctcttggaagaatacaggagttactatggtatccggaaacccactattttgggagttagggaacacatttttactggttctgtttcctctcttgcttggttcatgtcagctcaggaaacaagttttgtcaccttaggacagagggttttggcaaatcctttgaaggttagaatgcattacggtcacccagatgtgtttgacaggttttggtttttgactcgaggtggtatcagtaaagcttccagagtgatcagcataagtgaggacatctttgctggatttattgtactcttcgtggag

SEQ ID NO: 21186 - DNA, 914 bp, Glycine max
  Peptide Sequence Number=SeqID_137964
agcacaagagatttgctgaaatctatagactctttgcccgtagccattttgtgaaagcaattgaattggggctgatacttgtaatttatgcatcacatagtcctgtagctactgacacatttgtttatatagccttgaccatcactagttggttcttagttgcatcatggattatggcaccatttgtgttcaatccttctggctttgattggttaaaaactgtttacgattttgatgactttatgaactggatttggtacagtggaagtgtatttgctaaagctgaacagagctgggaaaggtggtggtatgaagagcaggatcatctaaaggtaactggcctttggggaaagcttttggagataatcttagaccttcgattcttctttttccagtatggaattgtctatcagttaggcatttctgatcataataccagtattgctgtttacttgttatcctggatttatgtgtttgttgtatctgggatttatgctgtggtagtctatgcccggaacaaatatgcagccaaagagcatatctattatcggctggtccagttccttgtcataattcttgcaatacttgtgatagttggtttgctggaattcactaaattcaaattcatggatatttttactagcctgttggcgttcatacccacaggctggggtctgatatcgattgcccaagtattccggccatttttgcagtccactatcatttgggatggtgttgtttcagtggcccgtatatatgatataatgtttggagtcattatcatgtcccctgtggcactactatcatggttgcctggatttcagaatatgcaaaccagaattcttttcaatgaagcattcagcaggggcctccggatattccagattgttacagggaaaaaatcacagagttga

SEQ ID NO: 21187 - DNA, 1152 bp, Glycine max
  Peptide Sequence Number=SeqID_137965
atggcgtcccgtgtgaaaccttcttctcggtacagttcctacgattcacgctcctccacttcctctcacttctccgacccttcttcctcccatgaattcaacaacctcaaaaccaaaacctcttcttcttcttcttcctctcgcgctctcgttaaggccaaaccctcaaacaccgccaaggtggaccccaccttcaccaccatggtcaagaagttcatggacagaaaacccaagtcctccaccgccaccaggttgattattccctccgattcgctcgcgaaggatttgaagaaggacgctaagaaagtggcagggttctctgccctgcagaagaagctcttcggaaagggcgcttccgagaagaaggagaaggtgaaggccttgacggaggtgaagaacaacacgaggacattggctatggtgctcaggagcgagagggagcttctcagcatcaacaaggagcaggagcagcaggtttctcaactcaagcaaatgcttgaggacaagaacaaagaggtggagaagttgaaggatttgtgtttgaagcaaagggaagagatcaagtcgttgaagagtgcgatactgtttcctgatgttatgaattcacagcttcaagagcttctagagaagcaaggttcggagctgaagcaggcaaaacaggttattcctgctctgcagcagcaggtttcttctctcactggtcagcttcaaagccttgcggaggatcttgctgaggtcaaggctgataagtattcagcaaaagcaggtcttccaggatatggaagttctccaagaacaccaacacatgcccgggaagatgcttctaacttttgggaattcagctctgatgacctgtctgatgacctattactgaatgatctaaatccatgcttaaccccctgtgctgttaagtcaagatcaagggaatttgagtgtaggggctctggctcaatgcattatgaaagcttatctgatgaggatgatgctaaagtatatcctgagatgagttttagctctcatgatcgcaagttttccaaaagttccgactgttgccataactcaagcaaaataagtgtggcaaccaaagcaggtagaagatctgatgagagcaaattagcctatggaggcagaatgaaccataaatttgtatga

SEQ ID NO: 21188 - DNA, 300 bp, Glycine max
  Peptide Sequence Number=SeqID_137966
atgagacatcattgggccttattgcctgctaccattatgaagcaaagcaggcgggaaaaaaaccatgagccttgccacaacagtgaagaaatcgcccataattggtcggaaaagggatggatatttgagaaccagggagtgcggaaaagagctctacagagtctagggcttacacttgcaggggcacacaaacaaatcttgaaacagcattcagttgggggtaaaacagtcttcagccccatatttgaaatagtgacaacaaaggtcgcaaactgctgcaattcgcaccactccacatga

SEQ ID NO: 21189 - DNA, 156 bp, Glycine max
  Peptide Sequence Number=SeqID_137967
atggctggaggcgttgacgccagacgcacgatgaccaacgacggtgactacaatggcaaggagcgacgccaatggctacaatggcaagaagtggcgcaacggagaggggtggtggggttggtggggaaggttctggagaataaaggatttttgtga

SEQ ID NO: 21190 - DNA, 627 bp, Glycine max
  Peptide Sequence Number=SeqID_137968
atggggcttacgaaggaggagagtagtcaaatagaatcgcacacaactccatgggaaatgccacgtgtcagtgaaaagaatacatgtgctgcaccggaatatccctcaaaagagaaagaaatacaattcccattataccctctggggttcttggtttggttcttctcttccttgtttctctcttcccctcccccgttgattcattcaccagtcaccacatggcacagaaacagaagaagtgaagagaaagggtttttcctagtccaattcacgtcggtctcggaacgacccatcgtaggtttaagaatgtctggtggtggtggtggctgtggcggtgttttcgtgacgtgggaggagcaggtgatatgtcaggagcgtgggaaccgagtgattcacttttacctgaaggacgctttggggaattcggtgcttgctgttgtggggactgagaggagtgtgaggcacatgatggcacgccgagaggttgtggactggctcacttgtttggtctcgcgcaatcggtcacaccatgcaggttgtttgttatgcccaactaatgttttcgaaaaattatctgttaatgtgatttcagctagagctttagggtgtttggtatacccacaatag

SEQ ID NO: 21191 - DNA, 1692 bp, Glycine max
  Peptide Sequence Number=SeqID_137969
atgaaggaaacaagaagaaaggtagtgattcattggagttgtgctggaaggcttgtggaatgtctgttaggccaaggagcaggcgaagggaaaaaggctctgtaccactgcaattattgtaataaggatataacaggaaaaatccgtattaagtgtgccatgtgcccagattttgacttgtgtatagagtgcttttctgttggagctgaggtgacacctcataaaagcaaccacccttacagggttatggataatttgtctttccctcttatttgcccagactggaatgcagatgatgaaattttgcttctagagggaattgaaatgtatggcttgggaaactggacagaagttgccgagcatgttggaaccaaaaacaaagagtcatgcatagaacactataggaatgtatacctgaattccccgttctttcctgttccggatatgtctcatgttgttgggaaaaacagaaaagaacttcttgccatggcgaaagggcagggtgaagacaagaaaggaatttccatggcggatcttagtataaaggcagaatcttccttttctccatctagagtcaaggttgaagattcgcataaagctggctctgctaatcgtttggcatccagtttgaattcagagtcggatggcccctcgggtaacacacatgctgcaaaccaaaaggcatctaatgtgggccgtggaaaaggtggtccaggaatcattaaaatggaagattctcaactagacagagattttggaggaaaaaagcctacttcctctggaaatgaaggtccttctttagtagaatcgagtggttataacgccaaaagacaggaatttgatcctgaatatgataatgacgctgaacaactacttgctgaaatggaatttaaggacactgacactgatgatgagcgagagctgaaactacgggtgttgcgtttctatgcaaaaaggcttgatgaaagaaagcgaaggaaggatttcatacttgaaagaaatttgttatacccaaatccatttgagaaggattttacacctgaggagaaggcaatatgtcggaattatgacttattcatgcgctttcatactaaggaggagcatgaggaattgcttagaaccgttatctctgaacatagaactcgtaaaagacttcaagaccttaagaaactgctagagatggacattttactgcttgtggagagtaggaaaattttcatgctaatcagtctggaagcccgggctgctggttgccgcaattcagctgaagctgatagatatctggcacaaaagagaaaaagggaagctgaagaaagtgctcgtaggacaaaagaaagtgctcagggtggcccaagcaatctaggggtttctaatgcattgatgtctccagactctgctggcaaggatttgagaggaagacctgcagggcctgctacttctagttctgtcaatgaaatggacgtgacaggatactatggggcagatttactttctgaatcggagaaacgtttatgctgtgagctaaggttgcctccagccatgtatctaaagatgcaagagcagctgtctctacaaatacttgctggcactgtcactgcaaaatctgatgctcatcaattgttcaagatggatgccatgaaaattgacagggtgtatgatattctcattaaaaaggggattggttccccctga

SEQ ID NO: 21192 - DNA, 1833 bp, Glycine max
  Peptide Sequence Number=SeqID_137970
atgaatgtcttatacagtatgaactgtattgtatgtgtacagttggatgattcagcacaagccgttgaatctcttaagattttaacgtctgggatcaatgtcaataatagaattttacctgataaaatgatttctaggaaactaaaattccaaagttctgatattcaatggtcaggcttttcttggttttgtgctaaacagctgaagcactactcagggttttgcaggaatggaacaaccataaatgttcattcatttgtatatattatggctgaagaagaaaaccactatcttggttacgtggaagatatgtatgaagacaagaagagacaaaaaaaagtgaaggtacggtggtttcaccatggtcaggaagttaagcatgtgattccacagctgaatctgcaagagggagaggttttcatcacacctcatgtgcaggtgattagtgctgagtgtgtcaatggtcctgcaacagttttgactcctaagcattatgagaaatacctagctgctgtgcctcatacctctttatctgagatccatatgtgctttaggcagtttaagaacaataagcttaagcccttcacacttacaaagttgcgtgggtatagtaaccaaactgttctttctagtttgaatagtcctactctctccaagagaaaggcaaagtttgaaaaatcgcgcacagatgatgatgagaacttcactcaagatgatgctttaaggtccagcaataagaggaatagaagttctaaggatcatgtacttgaaaagggtttttcttgtctgcaaatctctgttcctgtgaaagaaatgacaaaatgtgaaccaaaacaccctagtttaaaattaaaactatcaagaaaaacattgggtattaaggttattggaccaaagcctcaactgtcttttcaggttggtgcaaagatagaggttctctgtcaagatagtggcatcagaggatgctggtttagatgtaaaatcttgagtatgtctccaaggttgctcaaggtccagtatgatgatttgctggatatagacggaccacagaaactagaggaatgggtccctgcgtctagagtggcagctcctgacaaattgggtatgcgaagttcgggccgcctaacagttcgactatgccctcctgaatataatacaggtcatacttttgagattggagcaccagtggatgcctggtggtgtgatggatggtgggaaggtgtcgtgactgcagttaatgtctgtggggatggagtcctgcaggtttatacccctggcgaagagaggtttctaaaggtcgagaagaagaacattcggatttcccgagattggatcaataacaggtgggttgatatacagggaaagcccgacatttgcagctatttatcttcaaatgccaggtccagcatcaggatgtcagctaattctgcagtggtagatggatctatgtctgattgctctgcaatattagaaagtaaaccaacaccaagtgccaaagttgaagttgctaagaaggttgagccagaattatctggtttggaagcacctgttaacctggaaaatataataacaactttgagggagccactctatgccattcatgaagacaaggataacaactctggtgatggctgcgatgatgaagctgacaaggctgtgaagacacttctggccttaaatgaacacaaggataagtactcaggtggaggcaataatggtgacactgacaatgatgttgacgttgatgctgacaatgatgaagatgatagtgaggaagatttcgattgttctgaatcaaaactcgatgcagcagaagcaatacaagttgcatga

SEQ ID NO: 21193 - DNA, 693 bp, Glycine max
  Peptide Sequence Number=SeqID_137971
atggatattcaaaatcaaagtgaggatcatgtccttagggaatattatttaaacaacaaacagtttttgaaaagaacttggcagtttgttctctcagtgtctgtgttttctgtttttgtttggtactcttctggcctttccatacatcctcagtccttcaatgcctacttctccacgtgccttttctactccatgatcactcacacccttgagaggaaatacatgtttctcatttgtaatggaatccttgcatttgtagccaaaacctcactcaggacgtcgaactcttcagattctgctgacagctttgaccaccttcaaaatctgtcagagacaaagacaacagcagtttctgacatggttgttgtccctttgggaagttttgaatccccagagaatgttcctcttatggttgaagaacaacaaggggagaacaatgaagaagtttcagaagctgatgaagatcaagaagaatctcacattacagaagaagaggatatcaaagaggaggatgaagaaggagaagcagaaagtgaggctgaggttgcacaagattatgaactagaagaaacaacaacaacaaatgaagagttagtaaatacagaagaactgaacagaaagtttgaagagttcataaggaaaatgaaggaagagatcagaattgaagctcaaagacagcttattgcagtttag

SEQ ID NO: 21194 - DNA, 2076 bp, Glycine max
  Peptide Sequence Number=SeqID_137972
atggcgtccatgccttcgaaaaacatatgtattcggaggcaacaatgcccttgtggagattggaaatgttatattacatatgagggtgatgctgaggagggttctgcagcaccagaattggtgaaggcagagaaagcctcttctggggctatggttactccctatgttggaatggtgtttaagagtgatgatgatgcttttgagtattatggcaattttgctaggaagaatgggttctctattaggaaggaaagatctagaattagccctcagttggggatttacaagcgtgattttgtttgttaccggtctggctttgcccccgtgaagaagaagcctaatggagaacaccatagagataggaaatcggtcaggtgtggatgcgatgcaaagatgtatctctccaaggaggttgtagaaggggtttcccagtggtttgttgtgcagtttagtaatgtgcacaatcatgaacttctggaagatgatcaagtgcggcttttgcccgcgtatcgtaagattcatgaggctgatcaagagcgtatactcttgctttccaaagcagggtttccgatacatcggatagtgaaaatgcttgagctggagaaggggattcaaggggggcaactgcctttcttggaaagggatgtgaggaactttgttcaaaaccgcaagaaggttgttcaagagaacgaggcattgctcagtgagaagagagaaaatgatgtattggaacttcttgaggcgtgcaaagccatgaaagaagcagatgatgactttgtttatgattttactgtggatgcgaatgataaggttgaaaatgtagcttggtcgtatagtgactcggttaatgcaaatgctatgtttggtgatgtggtttattttgactcttctcatcgatcggtcacttatggattgctttttggagtatggtttggtattgatagctacggtagaaccattttttttggctgtgttttattgcaggatgaaacgccccaatccttctcatgggcattacagacttttgtccggttcatgagagggagatgtccacaaactattctaactgatctagacccagggcttagagatgccattagaagtgaatttccaggaactaaacatgtcattcctcattggaatattctatacaaggtaccctgttggttttctcctcctctgggttcccggtatacagaatttaaatctgagtttgatgccttatttcacattgagaatacagaagaatttgaacatcagtggagacagatgatttctctgtttgaacttggttcagacaaacatactgatttattatattctgttcgagcatcttgggcacaagcctatgtaagaggttactttctggctcaaatggcaacaatagcctactcaaagtctatagatgcatttttgaaagggatcttcactgcacatacgtgtttgcgtagcttttttgagcaggttggcatttctgcaagttttcaacatcaagcacaccaggagactcaatatatacatctcaaaacttgcataccaattgaagagcatgcacgaagcattctcacaccttttgcttttaatgccttgcagcaagagttattgctggcaatgcaatacgctgcgtccgaaatggccaacggatcatatattgtccggcacttcaaaagcatggatggagaatggcttgtaatctggttggcagaagatgatcagatacattgctcttgcaaggaatttgaatcatcaggaatactatgcaggcatgctcttcgtgtacttgtaataaagaattactttcagctgcctgataaatactttttaggtagatggagacgggaatgctcattacttgttgatgatgatcaaaataatctgggtattggtgaggaatggtttcaagaatatcagtccctcgctgaaactttatttcaagaatcatcaattacaaaggagcgatctgactatgttcggaaagaactgacaaaagaacttactaggcttcttaatgaggttagaaatctccctgaggctgatggagtctgcatgaacacgtctgtttcaccagccaactag

SEQ ID NO: 21195 - DNA, 1658 bp, Glycine max
  Peptide Sequence Number=SeqID_137973
atggtggctagtgaagagatatatggtggggaagaactttctcttgtccaaccagaccctatggggttgcagattgatcgtttgcacaaccaactcacagaaaaggtcaaggaactagcaaattgccagagtgaaatcaaggccttaagggcaactgaagctaaaaaggacaaggccatagaagagctgagaaatgaagtcggtaagctggacgataaactaagacttactgaggatcatctcaaacataagaagctagaaatcaagaaactgacagaggaaaagaaagatgcattggccgcacaatatgcagcagaagcaactcttagaaggttacatgcagatcaaaaggaagatgattttgttcctcttgagagtgtcattactcctcttgaagctgagattaagatgtataggaatgagattgcatcacttcaagaagataagaaagccttggaacgactcacaaagtcaaaagaggctgcactgcttgaagcagagaagattttaagaagtgcactagagagagttttaatagttgaggaagaggagatcaaaatcttagagaaaacacatcgtcaaaagattttggaagttgaaaaacttagccaaaccatccatgaactggaggagatcatcctatccagtggagtcaatgctaatgccattcgtgattatcagcgacagatttctgaattgcaagaggagaaaaggacactggagagggagctagcaagggtaaaagtttcagccaacagagttgcaactgttgtggctaatgagtggaaggatgagaatgacaaggtcatgcctgtcaagcaatggctggaagagagaaggataatgcaggcagagatgcaacgattaaaagataagctagctatatcagagagaacagcaaaggcagagtcacaattgaaggataaactgaagctgaggttaaaaacactagaagaaggcttaaagcatttctcaaatcacccagtcagttcaaattccgtgtctgcaaaatcagaaaagtctaagatcttaagcttcctaacgaccaatagcggactgagaaacagatccacatcacaaccaaggggatctgctattggaagctctttgttccaaaagtcaaatgcaaaaagcaacacagacagtgttactgggagcctaataccaggcagcattatgaaaaagaaatatggttcggcagaaaatgtgttgaagaaaggtatatgggcatcaagacacaaagttgctgatagtgatgaaaaagaaaatgagatgcaggtgaacgcaggcatgaattcaaataaatgcaatgatgaaaaagaagcagcagaaattaaaaccagtattgatgataatgacgactctaaaagcaatagctgtaatgatttaggcagcaatgatgtggtctcaggttttttatatgataggcttcaaaaagagttcatcaatttgagaaagtcttgtgaaattaaagagagtaatttgcacactaaagatgaagaaataaagattctcactaagaaagttgatgcattgacaaaggctatggaaatagagtggaaaaaaatgaaaagagaagcagctgccagagagaaggaggctgcatcaacaaaatcagatgataacaggaaactcagacgctcaaactcctctagaag

SEQ ID NO: 21196 - DNA, 3042 bp, Glycine max
  Peptide Sequence Number=SeqID_137974
atggctcagccttaccctctttgctcttcccgttcagcttcttccttctcatcccattatcgcatacccttcttcaccatcatcccttctcattccaaaacccttctccacgccccacgcttctccttccaacccttcaacactctccaagacgccgcaaaactcgacgacccagatgcaaagtctccatctttatccaaaaaatccttctgggtcaatcccagaagccccagagccaaacagcttcagcagaattcccctcatgccaggtcatcatctctcaccaagctcgccaagtcactggactcgtgcaaccccaccgaggaacacgtctctgaaatcctcaacgttttggggaacaatgttgcagaacgcgacgctgtgtttattctcaatacgatggctaatcccaacactgcacttctcgcccttaagtacttccagcaaaagattagccccggtaagcacgttgttctttacaacgttaccctgaaggtgttgagggaggtaaaggattttgaaggttcagagaagctgtttgatgaaatgcttcaaagaggggtcgagccaaatctcattacgttttcaactataattagctctgcttccgtgtgttccttgccagataaggctatggagtggtttgagaaaatgccctccttcggggttgaacctgatgcgagtgtagcctcctttatgattcatgcttatgcgcatagtgggaatgctgacatggctttgaaactgtatggtcgtgcaaaagcggagaaatggcgggttgatactgcggcgttctctgcattgattaagatgtgtgggatgttggagaattttgatgggtgtctaagtgtttacaatgatatgaaggttcttggtgcgaagcctaacatggtaacttataacgctctgttgtatgccatggggagagctaagagggccttggatgccaaggctatatatgaggagatgataagtaatggattttcacccaattggcctacccatgcagctcttttacaagcctattgcaaagcacgatttcctgaggatgcgctgggagtttataatgaaatgaagaaaaagggaatggatgtgaatttatttttatataacttgctttttgacatgtgtgctgatgttggttgcatggatgaagctgttgaaatctttgaaaacatgaaacgttcggggacttgccagccagacaatttcacttactcatgcttgatcaatatgtacagttctcatctcaaactcatcgagtctttggagtcgagcaatccatgggagcaacaggtctctgcaattttaaagggtctgggggacgatgtttcagaaggagatattatatttattctcaataggatggtggatcgcaacactgcatcctttgttcttagatactttcagaacatgattaatttcactagagataaagaggtgattctttacaatgtggtcatgaatttgtttaggaagtctagggattttcaaggagcagagaagttgtttgatgaaatgcttcaaagaggagtaaaacctgacaacattacattttcaactttggttaactgtgctagcgtgtctggtttgcctaataaggctgtggtgttatttgaaaagatgtctcactttgggtgtgaacctgatggtgtcacatgctcagccatggtatatgcttatgcacgtactaataatgttgacaaggctgtgaacctatatgatcgtgcaaaagctgagaaatggagccttgatgcagtaacattctcaacattgattaagatgtatagcatggcaggaaagtatgataaatgcttagaagtctaccaagaaatgaaggttgttggtgtgaagcctaatgtggtgacatataacactctgttgggtgccttgttgagatctaagaagcaccgacaggccaaagctatatataaagagatgaaaagtaatggagtttcaccagattttataacatatgcatcacttttggaagtttatactagagcacaatgtagtgaagaggctcttggtgtttataaggaaatgaaggggaatggaatggatataactgcagatctttataacaagcttttagctatgtgtgctgatgttggctacacagatagagcatctgaaattttttatgaaatgaaaagttctgggacttgccagcctgacagttggacattttcatccatgattaccatgtattcccgcagtggtaaagtttcagaggcagaagggatgttgaatgaaatgatccaatctggatttcaacctactatttttgttatgacatcactcatctgctgctatggaaaagcaaagcgaactgatgatgttgtgaagatatttaaacagctcctggatttgggcattgttccaaatgatcacttctgctgttctcttctaaatgttctgactcaaacaccaaaagaagagcttggtaagctaacagattgcattgagaaggctaatacaaagcttgggactgtggtaagatatttgatggaagagctggagggtgatgaagcctttagaaaggaagcattagaacttttaaattcaattgatgctgaagtaaagaagcctttatgcaattgtctaattgatctttgtgtcaagctgaatgtgcctgaaagagcacgtgaccttctggatttaggactcatgcttgagatatatacaaatatccagttcaaatcccaaactcagtggtctttgcatctgaaagaactctcagttggagctgccatgactgcattacatgtttggattaatgacttgtctaaggcattggaatcaggggaggaccttcctccactacttggaattaatactgggcaaggaaaacacaagtattcagacaaaggcttggctagtgtatttgaatcacatttgaaggaactcaatgctccatttcatgagtctaaggctggctggtttttggttacaaaggctgcagccaaatcatggctggagtctagggattcaaccgaatcaattgctggtttgaactctctggaacatgtgccatgttaa

SEQ ID NO: 21197 - DNA, 2079 bp, Glycine max
  Peptide Sequence Number=SeqID_137975
atggctcagtcttaccttctctgttgttcttcttcttttcctcttcttccttcttcttcttcttcttcttccttccattatcgtaaacaaatcactaataccacttctatcccctcttactcttcccgccattccaaacttcccaacttcccttcttcccatcaatccaaaacccttctacaagacacaatactcgatgacccagatgcaaagtcttcgtctttatccaaaacttccatctgggtcaatcccaaaagccccagagcaaaacacctttggaagaattcctatcacaccaggtcttcatctctcaccaaacttgccaggtctctcgactcctgcaaccccacccagcaacacgtttctgaaatcctcaaagttttgggggacaatgttttagaagctgatgcagtgtttattctcaattccatggtgaatccctacactgcactcctcgctgttgagtacttcaagcagaagattaaacacgctaggcacgttattctctacaacgttaccctgaagctttttagggaggttaaggatttcgaaggagcagagaagctgtttgatgaaatgcttcaaagaggggtcaaccctaatctcattacgttttcaactatgattatctgtgcttccgtgtgttctttgccgcataaggctgtgaagtggtttgagatgatgccctctttcggttgtgaaccggatgacaatgtgtgctcgtctatgatatattcttatgctcgaactggtaatgctgatatggctttgagactgtatgatcgtgcaaaagcagagaaatggcatgttgacacggtggtgttctcggggttgattaagatgcatgggatgtcagggaactatgatggatgcttgaatgtttacaatgacttgaaggttcttggtgcaaagccgaacttggtaacgtataatgctctgttgtatgccatggggagagctaagagggccagggatgccaaggctatatatgaggagatgataaataatgggttgacaccaaattggcctacctatgcagctttgttacaagcctattgtagagcacggtttaacagagatgcactgaatgtttacaaggaaatgaaggagaaggggaaggatttggatatacttctttataacatgctttttgacatgtgtgcaaatgttggatgtgagggtgaagctgttaaaatttttgaagacatgaaaagttctgggacttgccgtccagacagttttacatatgcatccttgatcaacatgtactccagcattgggaaaatttcagagatggaagccatgttcaatgaaatgatggaatctggatttgagcctaatattatagttctgacatcccttgtccattgctatggaaaagccaagcgaactgatgacgttgtaaagatatttaatcagctcatggatttgggcatcagtcctgatggtcgcttctgtgattgtcttctgtatgcaatgacccaagtaccaaaagaagaacttggtaagctaacaggttgtgttgagaaggctaatccaaagcttgggtctgtgttaagatatataatggaaaagcaggagggtggtggagattttagaatggaggcgtcagaacttttgaattcaactgaagctgatataaagaagtccatgtgcaattgtctaattgatctttgtgtgaacctggatgtgccagacagagctcgtgaccttctggaccttgggctgactcttgagatatatacagatatacagtcaagatctcaagcaaagtggtctctgcacctaaagagactgtcagttggagctgctctgaccgccttaagtgtttggataaatgacttgtctaagactttggaactaggggaggagcttccaccactacttggaattaatactgggggtgggaaacacagattttcagataaagttttgcctactgtatttgaattgtatctgaaggaacttaaagctccatttcataaggctgccaataaggctggctggtttttggctaccagtgaagcagctacatcatggctgcaatctaggggttcagtagtggttcttccccaatga

SEQ ID NO: 21198 - DNA, 3075 bp, Glycine max
  Peptide Sequence Number=SeqID_137976
atggctcaatcttaccttatctgctcatcatcatcatcttcttcttcttcttcttcttctcctccttgttcttctgccttccattaccgtaaacccatcaccacttctatttccttctcttgcttttcccgccatttcaaacttcccaccttccctttatctcataatcccaaaacgcttctccaagtccaagccacctacactccacaagacccagatgcaaagtcttcgtctttatccaaaacttccatctgggtcaatcccaaaagccccagagtcaaacacctttggaagaatccctatcacgccaggtcttcatctctcaccaaactcgccaagtctctcgactcctgcaaccccacccagcaacgcgtctctcaaatccttcaagttttgggggacaaagttttcgaatccgatgccgtcgttattctcaattccatggtcaatccctacactgcactcctcgctgttaactactacttcacgcagaagattaaaccctctaggcacgttgttctctacaacgtcaccctcaagctgtttagggcggtaagggatttcgaaggtgaagagaaggtgtttgatgaaatgcttcaaagaggggtcaacccaaatctcattacgttttcaactataattagctctgcttccatgttttctttgccgtacaaggctattgagttttttgagaaaatgccctcctttggggttcaacctgatgccggtgtaacatcctttatgattcatgcttatgcgtgtagttggaatgctgatatggctttgaaactgtatgatcatgcaaaaacagagaaatggcgagttgatacggcagcattcttggcattgattaagatgtttgggaagtttgacgattttgatggatgtttaagagtttacaatgatatgaaggttcttggtgccaagcctatcaaggaaacttatgacactctgttgaatgtcatggggagagctaagagagccggggacaccaaggctatatatgaggagatgataagtaatggattttcacccaattggcctacctatgcagctcttttagaagcctattgtaaagcacggtgtcatgaggatgcgctgagagtttataaggaaatgaaggaaaagagaattaatgttgatgtatttctttataacttgctttttgaaatgtgtgctgatgttggttgcatggatgaagctgttgaaatctttaaagacatgaaaagttcatggacttgccagccagacaattttacatactcgtgcttgatcaacatgtacagttctcatctcaaactcaccgagtctttggaatcaagcaatccatgggagcaacaggtctccacaattttgaagggtataggggacatggtttcagaaggagatgttatatttattctcaataggatggtaaatcccaacactgcatcctttgttcttaaatacttcctgaacaggattaatttcactatagataaggagttgattttttacaatgcggtcctgaatttgtttaggaagtatagggattttgaaggagcaaagaagttgttcgacgaaatgcttcaaagaggggtaaaacctaataactttacattttcaactatggttaactgtgctaataagcctgtcgagttgtttgaaaagatgtctggctttgggtatgaacctgatggcatcacatgctcggccatggtatatgcttatgcactttctaataatgttgacaaggctgtgagcctatatgatcgtgcaatagcagagaaatggtgccttgatgcagcaacgttctcagcattgattaagatgtatagcatggcaggaaattatgataaatgcttgaaagtctaccaagaaatgaaagttcttggtgcgaagcctaatgtggtgacatataacactctgttgggtgccatgttgaaagctcagaagcaccgacaggccaaggctatatataaagagatgaaaagtaatggagtttcaccagattttataacatatgcatgtcttttggaagtctatactatagcacattgtagtgaagaggctcttggtgtttataaggaaatgaaggggaatggaatggatatgactgcagatctttataacaagcttttagctatgtgtgctgatgttggctacacagatagagcagctgaaattttttatgaaatgaaaagttctgggacttgccagcctgacagttggacattttcatccatgattaccatgtattcccgcagtggtaaagtttcagaggcagaagggatgttgaatgaaatgatccaatctggatttcaacctactatttttgttctgacatcacttgtccattgctatgggaaagctaagcgaactgatgatgttgtgaaggtatttaagcaacttctggatttgggtattgttccaaatgatcacttctgctgttctcttctaaatgttctgactcaaacaccaaaagaagagtatggtaagctaacagattgcattgaaaaggctaacacaaagcttggttctgtggtaaaatatttggtggaggaggagggtgacggggattttaaaaaggaagcatcagaatttcttaattcaattgatgccaaagtaaagatgcctttgtgcaattgtctaattgatctttgtgtcaaactgaatgtgcctgaaagagcatgtgaccttctggatttaggactggtgcttgagatatatccaaatatccaatccaaatcccaaactcagtggtctttgcatctgaaagagctctcggttggtgctgctatgactgcattacatgtttggatcaatgagttgtctaaggcattggaatcaggggaggaccttcctccactacttggaattaatactgggaaaggaaaacttaagtattcagaaaaaggcttagctggtgtatttgaatcacatttgaaggaactccatgctccatttcatgaggctaaggctggctggtttttggttacaaaggctgctgccaaatcatggctggagtctagaggttcaattgctgatttgaactttgaactctatggttttacgtgttccaacttccaacaatga

SEQ ID NO: 21199 - DNA, 405 bp, Glycine max
  Peptide Sequence Number=SeqID_137977
atgggaaactgtatgggttaccactctcaaccaaagaagcaaaccagatatcctctaattgaaggaagagaattagatgcctcagtgccagttgaaaagatgaactctgctcctaataagcattacatagtggtgcgtaggaagctgcggcatggggaggtttaccagcttgcaccattcatgttgcaatcggatatgccttgtaggacaactaacaacagaaagttgaaggctaggagtgtgaagattgtggtgactgcagaagaattggaatcgctgttaagcggatcaaagaggctccaaatccaatgtagagctgcacgtctcaggcgaagttatggtttgagagggtgccaaaaatggttaccttctttaccaactattcaagaggtgcataactattaa

SEQ ID NO: 21200 - DNA, 720 bp, Glycine max
  Peptide Sequence Number=SeqID_137978
atggctgaaaaggtgaccatcatgaaactcaaggttgatcttgagtgtgagaaatgctacaagaaggttaagaaacttctcggcaaagaaattcgggaccagaagttcgatgagaaggaaaacattgtgttcatcacagtggtgtgttgcagcccagagaagataagagacaagctttgctacaaaggtggaggctcaatcaaaagcattgagatactggaaccgcccaagcccaagcccgccgggcccgagaagaaggaggccgagaaacccaaggccgagcccgagaaaaagaaagacccagagaagcctaaagcagaccctcccaaagccgaaaagcccaagaccgagcccgagaaaaagaaggacggtggtggcgagaagcccaaggaagagcccgaaaaaaagaaggacggtggggagaagcctaagcccgggcccgagaagcccaaggataagccaacacccgcgccgttacctgtgcagccacatatagcggcaccgatggcggtcccagttgggatgctctatgctcctcctccgtgctacggaggcaggcccgttgggcctggctacgagtacggtgggcccatgctctgttacgacggttactatgcaaggcccgtttacgatagttacagtggaggcagaccctgttatgggaaccgttgtgatcaatatttcagcgaagagaatccacaaggatgcacaattatgtga

SEQ ID NO: 21201 - DNA, 393 bp, Glycine max
  Peptide Sequence Number=SeqID_137979
atgaagagggtgaagttggagatcgaaagggtacgtccactgcttcttcctcttctctctctctcattcgctacggcgacgacgctgagtataagggtcaagctttttttggcatcaggtgacctctccgatttggcgttgcaagagatgctaatccccattaccatcattggcacatcttgcttcatcgattctccttccagcttcggaactcacgatcctggaaaaccccctccacgtgatggtttctctcagtttctttctaagatctctgctcttgggaagttgaacaaattcacaaggcttatgagacttgttcgataccattgcctatggttattatcaagctatattacaaatttttcaggaaattacctcatatcgctgttgtag

SEQ ID NO: 21202 - DNA, 489 bp, Glycine max
  Peptide Sequence Number=SeqID_137980
atgggtgaaaacaaggaagaagaaaagaaagaagagaccacagaggaaaagaaggaaaaagagcctccagagatagtgctcaaggttgatatgcactgtgaagcttgtgcaaggaaagttgcaaaagcattgaaaggatttgaaggagtggaggaggtgactgcagatagcaaggcaagcaaagtggtagtgaaaggaaaggcagcagaccccataaaggtgtgtgagagactacaaaagaaaagtggcaagaaagtagagctcatttcacctttgcctaaacctccagaggagaaaaaagaagaagaaatcaaagaagaaccgcagccagaggagaaaaaggaggagagaaacatgaccaacatggcatgcttattacaaagtgaaaatggaaatactttgggtggagtttccatttccatagtttttatgttttggtttcttgttcctgttgtttccaaggaagatggatgctatatgcaagcatga

SEQ ID NO: 21203 - DNA, 2118 bp, Glycine max
  Peptide Sequence Number=SeqID_137981
atggcttcgtgcatttgcgcttcccactcttctcttttccacgatcgccattatgtttccacctcaatctcttcttcattttctctgcgcaatttcaaattcccaaacgccgcttcctcccacaaatccctctcgcttcactccaaagcctctcaggcgctgcatcaagacgctgcttctcacgacccagatgcaaattctttatctttatccaaaacccgcatctgggtcaatcccaacagcccccgagccaaacacctccaaccgaaatcgcccagcgccaggtacagctacctcgccagactcaccgagtcgttgaactcgtgcacccccagcgcgcaacacgtgtccacgatcctcaagggtctccgtgacaacgtttcagagcgcgacgctgtgttcattctcgataagatgacgaaccccgaaaccgcaccctttgttctcggtcacttccgggacaagattaaaccctccacagacaaagaggtgattctctacaatgctactcttaaggcgtttaggaagtccagggattttgaaggtgcagagaagctgttcgatgaaatgcttcagagaggggtcaaacctgataacattacattttcgactttgataaactctgctaggatgtgtgccttgcccgataaggccgtggagtggtttaagaagatgccgagcttcgggtgtgaacctgacgccatgacgtgctcggctatggtgtctgcttatgcgcaaactaataatgttgatatggctttgagcttgtatggtcgtgcaaaggctgagaagtggagccttgatgcgtcaacattctcgacgttgattaagatgtatggcgtgttagggaactatgttgaatgcttgagaattttcggagaaatgaaggttctcggtgtgaagcctactgtggtgacgtataacactctgctgggtagcttgttcagatctaagaagtcttggcaggccaagaatgtatataaagagatgataagtaatggggtttcaccggattttataacctatgctactcttttgcgaatctatgctggagcacaatatagggaagatgctctcagtgtttataaggaaatgaaggggaatggaatggatatgactgtggatctttataacaggctattagatatgtgtgctgatgttggttgcatagaggaagctgttgaaatttttgaagacatgaaaagttctgggacttgtcagcctgacagcttgacattttcatccttaattactgtatattcctgcaatgggaaggtttcagaagcagaaggaatgttgaatgaaatgatccaatctggatttcagccaactatttatgttctgacatcacttgtccagtgctatgggagagctaagcaaactgatgatgttgtgaagatttttaagcaactcttggatttgggcattgttccagatgtttacttctgctgttgtcttctgaatgttatgactcaaacaccaaaagaagagtttggtaagctaacagactgcattgagaaggctaatacaaggcttggttctgtggtaagatatttggtggaagggcaggagggtgatggagattttagaaaggaagcatcagaacttcttaattcaattgattttaaggtaaaaaagccgttatgcaattgtctaattgatctttgtgtcagcctgaatgcgccgaacagagcacgtgacgttctggaccttggactgatgcttgagatatataaaaatatacaatccagatctgaaacccagtggtctttgcatttgaagaaactctcagttggagctgctataaccgcattacatgtttggataaatgacttgtctaaggcattggaatcatgggaagaccttccaccactgcttggagttaatactggacagggaaaacacaagtattcagacaaaggtttggctagtgtatttgaatcacatttgagggaactcaatgctccgttccatcaggctccagataaggctggctggtttttggttacaaaggaggcggccaaatcatggctggagtctaggggttcagctgaaacaattgatgatttgaactctcaggtttcaggtgcttcaacagtggcgcttcagtatcaatag

SEQ ID NO: 21204 - DNA, 453 bp, Glycine max
  Peptide Sequence Number=SeqID_137982
gattatgttcctgaagacattggaagcatttctagttttgaacctcctcaatcaccagactctagctataacaacttgcaacttagttctgaagattatgcaaaggagccgccattggttcctccatatttacaaatgacgcttcttaacgttccgtcaacaaatatggaagtccaacctcttacatccagacctcagcatgtagtgctcaatcatctttacatgcagaaaggaaagggtagcccttcagtggttgcacttggtacaactcaacggtttgtagccaaatatgtgactgtggtgctgtacaagtctttgcagagaaattctgaacttcataaggatcattacatgaaagtgaagattgtggtacatataatgcaattgcttgatggccattcatcatgcaattcagtttccattcttacatcatttgatgatgctattctctag

SEQ ID NO: 21205 - DNA, 429 bp, Glycine max
  Peptide Sequence Number=SeqID_137983
atggtctgcaatgacaagactgacatgactggcagattacttgttgagtcatttaccttcgattgtcttatcatgaactatatcattatcaactgggcccatctagttcggtactacatgcataaggcattacgggccaatgcacctttgccttatccctaccttgatgttgatggtcagtgggttcgcaaacaagacttgcctccgcctattcctaatgaacgtaccccatttcctccaccacaaagggatgcttcctcttctctgctgactgaagtcctcacagagctctgcgatcttcgagcatttatgggtgagcattttgatgcgatggatactcactttgatggaattggtactcgtatcactaggcttgaagatgatataagcttcatcaggcgttgcttcgatcccccgactgacttttag

SEQ ID NO: 21206 - DNA, 513 bp, Glycine max
  Peptide Sequence Number=SeqID_137984
atgatgccttatttgaacgcaacggacttgcaagcagccatgatgtcattgaaggaaccttcccgagtgtgggaatacaattactggactgatgtaacggaaaggaagaggcccattgccaaagcactccgtgagtactacgatcttgacgaagccatagaactcgttaaaaaaactgccacggcgaaattcgatgaaacgatagaactccacattcaaactggaatatactacaggaaacctgaacagcacatcagaggaacgatcgtgcttccacacgggacaggtaaggaagtcaaggttctggtgtttgccaaaggtgaaaaggcaaaagaggctttggaagcgggcgcggattacgtaggagctgaggatcttgtagaaaaaatagaaaaagaaggttttctcgatttcgatgttgcaatagccacacctgatatgatgagaataatcggaaggctcggaaagattctgggaccaagaggtttgatgccatcgcccaaatcacgaacg

SEQ ID NO: 21207 - DNA, 939 bp, Glycine max
  Peptide Sequence Number=SeqID_137985
atgggtgaagtagaggaggtgcaagagcagatgaaggccgacacagaggccttgaaagagcaaatggccacaatgatggaggccatgatgagcataaaggagataatggaggtcaatgcagctgcaatagccgctaccagcaccattgttgagcggctctcgtttagtgcaaaaaacaagcatgccttcccaccatatggcttgcctcccaactatacaccacccaatgtggcatacactcccagtgaggatgtcaataactccgcttccatactcattgaaagccgacaacctcaaactgatcatgcatatgtctctcaacccatgggggagacacatgaaattccctaccacaatctagccgacttcaagccttgcctcagatatgccactgaagggcaagcagttggtggtatacccgtgcaaaatactttggaggtccctcagtatcacccacaaccacaccccttgcattccacagcaggtaaaaaccctcatgctatgacaaaaatgggaaagttggatcatctagaggaaaggctcagggccattgaaggaggtgaagattatgcctttgctaacgtagaggagttcttcctagtacccaatatcatcacccctcccatgttcaatgtgtcggactttgacaagtataagggaactactttccccaagaaccatctaaagatgtattgtcggaagatgggtgcatacgcaaaagataaggaactgctgatacatttcttccaagaaagtcttactgggatagctgttacctggtacactaacttggaaccttcccgagtccattcttggaaagacctaatggttgcctttgttaggcagtatcagtacaattctgatatggctccggataggatgcaactacagaacatatgcaaaaagggggcacgaatctttcaaagaatacacctaaag

SEQ ID NO: 21208 - DNA, 411 bp, Glycine max
  Peptide Sequence Number=SeqID_137986
atggttcaagagtgggtcgtgactacaaggtggcaactgagaaaaacaatattcaaaggctttatggttggaagtaaaggggtggaagttaattcaatgtgctcaccattaagatatgtttggggcagtgggttggagagagaccaagttaagttttttgctagcattttaaattgtaggttgatgagcattcctttggtctacctggggattcttgtgggtgcaagccctaggaaggaggctacatgggatccaatgccgagaaaggtggataagaagttggcatggtggaagaacaaagtattatcactagcagaaaggatggggtgtttaccacaactcatgggggttatggggccaaattttagaatccaaacatcgaggttggaaagggttgagagaggaggatga

SEQ ID NO: 21209 - DNA, 759 bp, Glycine max
  Peptide Sequence Number=SeqID_137987
atggaaagagaaaggagtgagggtgggacgttgtgttggggatggatggatggatggatggtggtcactggtcacgtcatcacaattcacaaggagccttgtgttgtgtttgttcccatggcaggacgccaagccaacactgagtgcttccggttacgggctgaaaaagcccgaaccggaggaaaggaaactcagtacggttatcatatgggtcctgtaccaacaattggcccgtcagtggtgtgggtggagcaaggtgttttgtgggtgaagtacatcaattttaaaaagggtttaaatgggactttggatcggatacactctttgatgacacctcttctatgttctgaaactaacaccttggataactttgaagtagtgcctggatcatttgctgacttgaatatgcaaagcataaggaaatctatcttgactcgtgtgaatttgaggagatcaaccgaaagatggtttttggctggggatgagggtgctcataagcaattgagatgttggtgctcttcaacagctgtcagctctgatcaaatactggaccgagtgattgcactggccaagaaatatgataaaattgatggctcaaaggtcactgaaacagctgattttcaaaaagacttgaacctggacagtttggaccgagtggaactcattatggcccttgaagaagaattttctattgaaatccctgatgagaaggctgataagcttgcttgctgtgctgatattgcaaaatacatagcagag

SEQ ID NO: 21210 - DNA, 153 bp, Glycine max
  Peptide Sequence Number=SeqID_137988
atggtgttgcttcttaggagattgaaaatcaatggaggtgtgaggaggttgggtgtcgcggtggtgggagttgcaatgaggtcgagatcagaaaggaaaacaccatcgagaaaagggttgcaccattgttctgaagaatatctggaaagatga

SEQ ID NO: 21211 - DNA, 345 bp, Glycine max
  Peptide Sequence Number=SeqID_137989
atggcttccaagggcacagttgcatccacttatgttgctctattcctatgtctcaacatgctttcctacactatggtgagctccacctacaatatccctgtaatccctgatccatcagtgccttatcaaaagggtacctgccctatagatgcacttaagttggggtcaccaccaaccctcccatgctgcaacctaattaaaggtcttgctgatcttgaagttgctgcatgcctttgcactgccctaaaggctaacgtccttggcatcaacctcaacgtcccaatctccttgagcgtaattctcaacaactgtggaaggaataacgctggcttccagtgcccttaa

SEQ ID NO: 21212 - DNA, 258 bp, Glycine max
  Peptide Sequence Number=SeqID_137990
atggttccattccacaagactttacccccaagggtgggcaatgggggcggcggggacggacctgatagggcggagcttctgggggttggggcggtgggagaggaggtcggcggcgaagacgaggtcgccggaatcggggaacggagcgacgtggtcggggacagggaagtggtcgccggcgaagaggtgaaaaatggaggggaatggggtggttactggttggtaagtaaaatgactactgcgttaccccgtaggtaa

SEQ ID NO: 21213 - DNA, 525 bp, Glycine max
  Peptide Sequence Number=SeqID_137991
atgaagaaaataagagtcaagattggagtggcaagcactgttcctatacgatccatgtctacttcaacaatttcatcagcaattacatcagaaacggctgcagaagatcaagttcaaagggttaacctactaagatcaactgatgacaattatgatggtgttattgtggaactggatcagcctatggattctactacgttcatctcgatccttagagcttcagtttctcattggaagaagctgggcaagaagggtgtttggataaagttacctattcatttagtcaatctggttgaagctttagttaaggtcctagttgttcaagagaatagtggactatttcaaggaactggagtctggaaattccctactggagttgttgatcagggagaagatatttgtgtagcagcagtaagagaggtcaaagaagaaacaggggttgattcagaatttgtggaagtattatcattcaggtggcaatgtttatgccaatttgtatacttgatgggaagttccaatgattga

SEQ ID NO: 21214 - DNA, 243 bp, Glycine max
  Peptide Sequence Number=SeqID_137992
atggttggagcattctcgcaaaacatcgtgaccctgactggtctccctatgatcttacttagtgagagtgacctgacaaactcattgtgtgctaggaatgtgataactcactccctgtgtgtggttgtgtttggatcctgtgatgatcttgaacttgtgttcgggggagcagaaaataggtggatgactatgaagaatctcatgctagaggacacgggaacacaacgctctgatagaatgtga

SEQ ID NO: 21215 - DNA, 306 bp, Glycine max
  Peptide Sequence Number=SeqID_137993
atgcttttcttgcttatcaccatagcaaggaaagttcggtcgtcactgttttggccgatgcttatgaaagggaaagcaaattgggagaagctcttggctggcatggtaggggcatccgttaattggttcccccgatggaaggaaggaagggctggagttttgtcttcatgtgaagggttcccaaacattcccttgatgggaatgagggattgtattagttataatcatgtacttgccataagacaactaggctatcctatgagaggggcaccattgaaagagagtatcgcgcctttcaatgcatga

SEQ ID NO: 21216 - DNA, 222 bp, Glycine max
  Peptide Sequence Number=SeqID_137994
atgaagacgttaacacctcaagctcggatgtggggttatgcaattagaaggctaatttctcatacaagagaaactaagagaaagtttgagagtgtgtatgaagggggcacaatgaatactcctgactctggcaaagtttttcagtattggcattgctgtggttctgaagatccattcgatcctggttgcactgcttctcctcattcttcatatgatgattga

SEQ ID NO: 21217 - DNA, 591 bp, Glycine max
  Peptide Sequence Number=SeqID_137995
atgtctgcggttattggtattcagtatctgcagtatgcacataaaaaatgtgttcaaagatggtgcaatgagaaaggtgatactatatgtgaaatttgccaacagcaacttaagcccggctatactgcaccgccattgcctcctctgttacattatggtggttctccaataacttttggatggaactgggagatttcaagaagggatcttcatagccaccagttcatagcgatgtttaatgctaatcgtgaattcctagaccttgacttttcatattcgtcagcaccttctacaagaagcttgatatttttccgcattattgccattatttttattgttcttcttcttttacgccatacacttccgatcatatttatactcagtggagcaagagcatattcattggcagtgtttatgctagtagtgttgagaatcattggaatgattgtaccagtgtatataatggttaaagctattattgcaatgcaacagttccaatatcagacactcgataatcagcattcccctatgcaagcacacggggaagatgaaataggacaatctcagttgcgtgtcattcatattcagtga

SEQ ID NO: 21218 - DNA, 201 bp, Glycine max
  Peptide Sequence Number=SeqID_137996
atggtttccgtgaagaaatccaagtcgaggcacttccgtaacgcttccgagacgtttccgtggatgatttcgcgaagattttccgccgttcttcgttcgttcttcggtcttcaaccgaactacgtaggtctgatttccttatcaaaaattgaggaatacgtaggagcaagggaaacaccctcgtcgaccacaaaaagataa

SEQ ID NO: 21219 - DNA, 372 bp, Glycine max
  Peptide Sequence Number=SeqID_137997
atgatgttcactaagaccaaaatctcggctaggatatgtggttcagtcgaccagcatgaaaaggttcgagacttgtttaaggctatcgatgaacaattcatcacttcagataaggcaaataagcacattgatcatgaagttctcctctctctgacttatcagtgtgaaagaagaaaggcttgtaatggagatgggagagagtgcaatgctacaactgcttatgggaagaacaaagcaactaagtctcaagctaatcaaaaagggaatggtaaaataccacctcaagctgatattaagaaggtgacaaagtgtttcttctataagaagaaaggacacagaaaaagaattgtcccagattccagaaatggctga

SEQ ID NO: 21220 - DNA, 375 bp, Glycine max
  Peptide Sequence Number=SeqID_137998
atggccttcaccttttcggggtctacctctattcctttctggctcacgatgaaaccaagcaatttccctgatttgaccccaaaggttgacaaggtgttcttcctcggatttagatttagcaattatgtcgtccacgtagacctcgatctcttgatgcatcatatcatggaacaaagctaccatggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 21221 - DNA, 339 bp, Glycine max
  Peptide Sequence Number=SeqID_137999
atgggcacgggagaaggggatcagcctatggaccaggagctggacacaagtcctaggaaacccatttatggaaagtatattctagaagagaggcaggggttgttaggagttagtagagaggtggcagttagtcactgtggaggtagcaggagactgagtatggggttggaggcatgcttttgtttcctcaagagctcctggaagcctatgctcctcattgaatgcagggataatcaaagaaatatactttgtggctggatcaacaatatgtgggcaaggaacctaaatatgcaagagtatcaagcaaaaccatatcataacagtgagctatcttcataa

SEQ ID NO: 21222 - DNA, 321 bp, Glycine max
  Peptide Sequence Number=SeqID_138000
atggcccatgatgatgctcttcttaccaatcagagtaggcatcatcgtggtatggtcgcctctgatttatgtcctattttcgtctttacaccaaaatccattatgcatcgtattatcaaatccatgaaaaaattttccaacttggtttgggtgattggattctcctcaatgctgtttgacttcaagatagctatcaagttcattgaggagggttatttacctactcatgaatgtgctcaacttgtcaatatgatccagcagactgtagcaatgcttgattccaatcatagaggcatatctttagggaggacaaccaagtga

SEQ ID NO: 21223 - DNA, 465 bp, Glycine max
  Peptide Sequence Number=SeqID_138001
atggaaagcaatttccacgtagatgttgcagactctagtagcagaggcgacactatggtgcagcttgtaacaccacttcaccctgccttgcctcttgagagcataaacaacttccattgcggtaacagtcttcctcctctcgtgcttgaggtagggaaccacgccgatgagaaagtcccttgtgacaccgcggaggaacttgtccttttgggtatgtcggagctgcttgtaggtaccccaaccgagcctcaagctgtacctaacccacaaaatactctccttgataccaagtgtctgattggtaagcgctttaatgatgctcaaacacaaaaggagatgaaaatggttccattcaacattgttaaggttccaaatggcgatgcatgggtggaagctaatgcacaacaatatttgcctagccacattagtgcctttgttctcaccaagatgaaggaaattgcataa

SEQ ID NO: 21224 - DNA, 171 bp, Glycine max
  Peptide Sequence Number=SeqID_138002
atgaaaactgttcacaccccctttaacacaccgaaacacctttccattgtgtatattgttcatagaaaatgtgcttccaccaaggatatttttggaaacaagaataacaaggacgcaatgggggccggtaaagagaaccgagcgagtaaggctgcgtttgggtcgggttga

SEQ ID NO: 21225 - DNA, 297 bp, Glycine max
  Peptide Sequence Number=SeqID_138003
atggtggatggctgtgtggagaggatgccatggaaagaggtggtttggcagttggtgtgggctggtatggcagccatggaaggcaaccattggagctcaatgaaagcaccaaatgttatgatcacaaaatcagagaagagaaatagactagcttcgaaggctaggacctccagaaagaaagaatttagcactagcaggcacgctaagaagtggcagacaactatgttcttgcttatcgaatcctatcctgccgcatcaccatttcttaacagaattagttttacacaaaatccttga

SEQ ID NO: 21226 - DNA, 615 bp, Glycine max
  Peptide Sequence Number=SeqID_138004
gttgtaattattgatgatggaagtgctgatgagacaaaaagagtagcttttgaatttgtgaggaaatacacagtagacaaggtaagggtcatccttctaggaagaaatcacggcaaaggagaagcaatcagaaaaggaatgatgcattcacgtggtgaactacttcttatgcttgatgctgatggagcaactaaggtcactgacctagaaaagcttgaaaatcagattcaagctgttgccaaaagggaatatcaccatggagattcaagcgatagtgatcccagatttagaatatctgatatcccagctgctgtatttggctcaagagctcatctagaggagaaagctttagctacatgtggtttcaagatgtttactagggctgcagccaggaagcttttttcaaatgtacgcctaaaaaggtggtgcttcgatgttgagttagtctttctgtgcaagtggtttaggatctcaatttcagaaatttctgtgaattggtctgagattccaggatccaaggtgaatcttctgagtatacctaacatgctttgggagcttgtgctcatgtctgtggggtacaggactggtatgtggagaatttctaattctgcctga

SEQ ID NO: 21227 - DNA, 339 bp, Glycine max
  Peptide Sequence Number=SeqID_138005
atgaataggtggatgactatgaagaacctcatgctagaggacacgggaacacaacgctctgataggattatgtatgtgaggggtagagggtgtcacattaaccaacgaagctcagaaatagatgaaaggttaagtgactttccttctaagatttatgggaaatgtaattcttactatgatcatcgtcaatatgaaaaatatgatttcacaagcttaggaaagaaactcagtactacgaatggaaatgaaagagagcaacaaatacatgaagacaatgacaattcaaagctcctcctaaagcaagaaaatgattcaaattcgaaagaagtcacagaataa

SEQ ID NO: 21228 - DNA, 1260 bp, Glycine max
  Peptide Sequence Number=SeqID_138006
atggcagacactgaggatattcaacctcttgtttgtgacaatggaacaggaatggttaaggctggatttgctggagatgatgccccacgtgctgtgtttcccagcattgtaggtcgtcctcgtcacactggtgtgatggttggcatgggccaaaaagatgcatatgttggtgatgaggcacaatctaagaggggtattttgactctcaagtaccccattgaacatggaattgtgagcaattgggatgatatggaaaagatttggcatcataccttctataatgagcttcgtgttgccccagaagagcatccagttctcttaactgaggcccctcttaaccccaaggctaatcgtgagaagatgacccaaatcatgtttgagaccttcaacacccctgctatgtacgtagccatccaagctgttctttcactgtatgcaagtggtcgtacaactggtattgtgttggattctggtgatggtgtcagccacactgtccctatctatgagggttatgcactcccacatgccatccttcgtcttgatctggccggtcgtgacctcactgatttcttgatgaaaattttgactgagcgtggttattccttcaccacctcagccgagcgggaaattgtaagggatgtgaaagaaaagctgtcttacattgcccttgactacgagcaagaactggagacagccaggaccagctcatccgtcgagaagagctacgagttgcctgatgggcaggtcatcactattggcgatgagcgtttcagatgtccagaggttctgttccaaccatccatgatcggaatggaagcttcaggcattcatgagacaacatacaactccataatgaagtgcgatgttgatatcaggaaggacctttatggtaacattgttctttcaggaggaacaaccatgttccctggtattgctgacagaatgagcaaggaaatttctgcattggcacccagcagcatgaagatcaaggttgtagcaccacctgagagaaaatacagtgtctggatcggtggttctatcttggcatctcttagcaccttccagcagatgtggattgcaaaggcagaatatgacgaatctgtgtgttgcaacgtcatggtcgtccacaatagcgtcgtggtagttcccgatgaggagagggggggagagctgtcggaaatcacttttccgaagtggcgtgcggtggttgaagtaaatgagaatggtgggctagcggaggagataaggggtttgaggtag

SEQ ID NO: 21229 - DNA, 573 bp, Glycine max
  Peptide Sequence Number=SeqID_138007
atgccactgaggggcagacattttgtggcatacccctgtcaaacactttgggggcctcaatattgcccacaaccccaacccttacattttgtgatgggaggagggccccctgctatggtggaaaaggagaaatttgatcatatagaggaaaggctgagggtcattgaaggaagtggaaattatgcctttgctaacatggtagagttgtgcctagtgccagacatggtcattcctctgaagttcaaggtgtcggatttcgataagtacaaggggactacttgccctaagaatcacctgaagatgcactgtaggaaaattggggcatacgcgaaagatgaaaaattattgatgcatttcttccaaaaaagtcttactggggcagccgtcacctggtatactaatctggaaccttcccaggtccattcctggaaggacataatggttgccttcattaggcaatatcagtacaattctgatatggctccggatagaatacaactacagaacatgtgtaagagggagcatgaatctttcaaagaatacgcccaaatgtggagggatctggcaacttaa

SEQ ID NO: 21230 - DNA, 795 bp, Glycine max
  Peptide Sequence Number=SeqID_138008
atggccaaagaaaaccagggatttgccataggaatagaccttggtacaacctactcgtgtgttgcagtgtggctggagcaacataatagagtagaaataatccacaacgaccaagatgctaagaggctaattggtaggaaacatagtgattccactattcaaaaggtcaaaatgatgtggccattcaagattgttgctggtgtcaatgataaaccaattattattgttaattacaagggtaaggagaagcacctttgggctgaggaacgaaaaactaccaaagatgtcggtgccattgcaggtctcaatgttatgcggataatcaatattgaacccactgctgcagctattgcttatggccttgacaagaggactaattgtgttggagagtatcgcaacttatctcacaatgggatgacgaatgaaaataaaagaagaggacccataagggtacatggattacattcaactcttaagaaaagaaaagaaaagaaagaagaactaactggctattgcacaaggtacaaggctagcaagagaagcgatgtagggaatgatcctcgattacgattcggcaacatcttggcttcacttttcttctatttccttcctctcatttcgtctttcttcatccctaaaccttctgaacccccaaaactcttcccctacatggctatttatagaaaaagccatttggggcagggacagttcgcccaggcgagctggttgcttaaggctgaaggtatttcatggtccaggcaagccaaatgctctcctgagcgagctaagatctag

SEQ ID NO: 21231 - DNA, 1490 bp, Glycine max
  Peptide Sequence Number=SeqID_138009
gccatgcagagatcaaagcattagagcttaatgatacctggattcttactaaccttcttaagcacaaaaatgtaattggttgtaaatgggtgtacaagatcaagcacagatctgatggttcaatagagaggtatatagccaggctagtggctaagggctacactcaagtgaaaggacaggactatctagatactttctctccactagctaagttaaccacagtgagacttctattggctttagctgctattaatcagtggcatctcaagcaacaagatgtgaacaatgctttcttacatggcaatgatttgtctaaaattcaaaggattacacatcttctagttagtgctttcaaaataaaggatttaggagatttaaggtactttctgggtttcgaggtagccaaaagttctattggtataaacctctgtcaaaagaagtatgcactggatattctcagtgatgttggcatgcttggttctaagccagtgtccaccctttgtgattatattaccaagttgtatcaacacctagggtctcctcttttagtagaggatgtttcttcttataggagattaattgggagattgatctatttgactaacacaaggtcagatattacagatacctcaaagggacttccaggtgtagggatttttctgtctgctgctagtaatactcatttaaaaggttttagtgattcagattgggctggttgtattgatactaaaagatctatcattggttatactgtgtacatcggtgattcattaatctcgtggaagtccaacaagcaagaaaatatgcttattggtcttgtgaaattacttcctgtttcttctgcaaatcagttagctgacatctacactaaggctctctgccttgctgctttgttgactcaaggcattaagaatgttcctgatttggttctgttggatgttatgtcgctgtcacttggtatagccgtaaaaggatatcttttgagtgttgtgattcctaggaatactactattcctggcgagagaacaagagctagtgataacaatttactgggtttttttagtctttctggttttcctcctactcctcagtaccatccttttgatatatgctttgatatagatgtgaatggtattttatctgtttctgctgaggaaaaaaccaccggctataagaatgatattgcaataactaatgatgaaggaaaattgtcagcagaagaaattaaaagaatgattgaaaaagctgagacttaccaggctgaggataacaagttccttaggaaggctaacgcaatgaatgctttggatgattacatttacaagatgaaaacgattttaaagaaggacgatatcagcttaaagctttgctcacaagaaaggcagaagatcagttttgcagttacaaaggctaccaatttgctccatgatgataaacaacagaatgaagcagtggtgtttgaggattctctgaaggagcttgccatttga

SEQ ID NO: 21232 - DNA, 330 bp, Glycine max
  Peptide Sequence Number=SeqID_138010
atggaccgaatcgacaagatggagtttctattggagcactacaacaaagacaatgaggagttggacgttgatgcggtggacttcgagaaaccagatttggcagtttccgacgagttgcagtcgaaaaatgacaaaactaatggagaagttgaagagtatatggttttctcttgtttttctaactcgattcactctttatttctgaaagtggatcctctgggtgctcaacaggaggtcttagaaatagctaacaacttgggtctcaatgtttctgttgttgtggctcgtgaggtgtttgtcactaatataggtattaagatttccctgtaa

SEQ ID NO: 21233 - DNA, 204 bp, Glycine max
  Peptide Sequence Number=SeqID_138011
atgtcgctgactttgcaatcttgtgctcaggaaacagatgatctgtatgatgctatggaaaaagttgtagcaagaagtgagtatcgtggagtttatcttggtgaacatgttgctcttaaggttttgagatcaaagctattgaatgatgccttagaggatgagtttgctcaagaagtggccattctgaggataaatcatgcttag

SEQ ID NO: 21234 - DNA, 1098 bp, Glycine max
  Peptide Sequence Number=SeqID_138012
atggtgatctcttctgttcatgccacactatttgccagggcctctttcttttgccaaagtagtggcctaagaagctttagatcgtgtttacctttctcatcttcagctgcttctgtctcctctcacaatctttcacggaagaaatggaggcagccagtgttgtcagtgttggatcttggcggagtcaagataagcagagaagatgtggtgagggatgatccggcaaacaatgtgccagacaatatattttcaaaacttggagtgcagcttcaccggagggatcaacaccctcttgggatactgaagaatgcgatatacgagtattttgacactaattattcaaataagttcaacaagtttgatgatctttgtcctattgtttcagtgaagcagaatttcgatgatgtcttgtttcctgaagaccatgtaagtagaagctataatgatacttactacatagatcctcagactgttttaaggtgtcacacaagtgctcatcaggcagaattattgagaagtgaatacacccatttccttgttacaggagatgtttaccgtagggattcaattgattcaactcattatcctgtcttccatcaaatggaaggctttcgggtttttgttccagaagaatgggagggatctggaatggatgccacattatttgcagcaacagacttaaagcaatgccttgaggtggtgaaggacggaagttgtggaaacatcctctttgagggtgctgtggaaatgcgctgggtggatacttatttcccatttactaatccatcatttgaacttgaaatttatttcaaggaaaagtggttggaagttttggggtgtggagtgacagagcaagagattctgaagagaaatgggaaacctaataaggttgcttgggcttttggcctagggttggagaggttagctatggttctatttgacatacctgatattcgtctcttttggtcaaatgatgagcgatttacctctcagtatcctccttgttacaaggacatgagtttctggatcagtgaatcatttactgaaaacaatctgtgtgaagttgttagaggaatagccggggatcttgtagaggag

SEQ ID NO: 21235 - DNA, 201 bp, Glycine max
  Peptide Sequence Number=SeqID_138013
atgcagaaaaagagagaccagcagaggccaaagtgcaggatttcttcgagggaaaggatcagtgcatgcatgagcatcaactctgatgaggctgttgcttatggagcagcagtccaagctgctttgttaagtaaaggcaacaatcgtcaaggctcatcgatccacatgtcggtccaatgttctgaatcatttcaattctaa

SEQ ID NO: 21236 - DNA, 423 bp, Glycine max
  Peptide Sequence Number=SeqID_138014
atggcgctcattttcatttccatagacacgctaccaatagaaacaagtgattacgcagtttatgaagaaatcaacttcaattatgtctatgcttatcgatatatgctctctacgatagttattgggtttgcgtataacctcctgcaaatgggcttttcaatcttcactgtggtctcagggaagcgtgtattaagcagttatggtggctatctatttgatttctttggtgaccagatcatatcataccttctgatttctggttcagctgctgaatttggttacgacgtacaacggcgtagagttacaaactccttcactgaaaaggcaaatgtttcggccagccttcttctagttgggtttttgttcactgccacagcatcaattttcacttcctttgctttgccaaagaaagctatcaattaa

SEQ ID NO: 21237 - DNA, 327 bp, Glycine max
  Peptide Sequence Number=SeqID_138015
atgggaccaccaaaacttcaaaaactctttacggaaaaggataggaatacgaagaacaccgggatgaagcattttcggaaaaaagttcttccggaagaagaaggtgggcttccgaaagaaccttcttctggaagttttccagaaatgcgtctttcgaaaaatttttcgaaagaagattcttccagaagaagtgatcgcagaagagtaatttcactcattcactgtttgctgggtgctccagtaatattgctaggtgcatgtagcatgtcctcatttaaagacgctctttgcatctattcctttctaaccccattaactcatggctaa

SEQ ID NO: 21238 - DNA, 438 bp, Glycine max
  Peptide Sequence Number=SeqID_138016
atgctcatcctgtctatctctgcctataactctacttatagcacgaccaaaacctcgtgttctaaccatgatctgcaaatcatgtggaacacaagtagttcttccggaaagtttccggaaaagtggctctttcggaaagttcttccggaatacccaaaggtcatccggaagaatccttcttccggaaagtttctggaagaactacttcttccggaaactttctggaagaagtgttccgaaaactttccggaagaacccttcttccggatgacccttggttacttccggaacaaccctacttccggaaattttttggaacaacttcttccggaagtttcggaagaagtcttcacgattcttccagaaacagccaccgtaaccagtccgctttccccattttctccggcgtcttctacccctaaggttccactatcctag

SEQ ID NO: 21239 - DNA, 120 bp, Glycine max
  Peptide Sequence Number=SeqID_138017
atgccaacaccacgggatggccttaagcctaagttgtattttgaagaaattgggcatgccacattgcccccattcctttgctattcattcctaaacatgcacccaccaagtgctcggtga

SEQ ID NO: 21240 - DNA, 833 bp, Glycine max
  Peptide Sequence Number=SeqID_138018
atgccaagaggttgattggtaggagagttagcgacccttctgttcatagtgatatgaagttgtggccatttaaggttattgctggtgctggtgagaaacccatgattggtgtcaattacaagggtaaggaaaagcaattttctactgaggaaatctcctctatggtcctaacaaagatgcggaagattgcagaggcttaccttgggtcgactgtgaagaatgcctttgttactgtgcctgcttacttcaatgattctcagcgtcaagccagcaaagatgttggtgtcattactggcctcaatgttatgagaataataaatgagccaactgttgttgcaattgcattaggactagacaagaaagccactagtgttggtgagaagaatgtcttgatctttgatcttggaggtggcacctttgatgaagaacaagagggagattactggaaacccaagagccttgagaagggcattgacttctattcaaccatcactcgtgctaggtttgaggagctcaacatgaacctttttaggaaatgtatggagcctgtggagaagtgtcttagggaagcaaagatgagcaagatcaccgttcatgatgttgtcctcgttggtggctctacaaggattcctaaagttcagcagttgttgcaggacttcttcaatgggaaagatctatgcaagaacattaaccccaatgaagtcgctgcttatggagttgctgtccaggcaactatattgagtggtgaaggaaatgagaaggttcaagatttgttgcttttggattttaccccattgtctttgggtttggaaactgctggagatgtcatgact

SEQ ID NO: 21241 - DNA, 1028 bp, Glycine max
  Peptide Sequence Number=SeqID_138019
gcgcggcgctggggaggtatccggtcacgacgttccagccgacgcggccctgcgtgaggtggtcgagcgtgctgagtcgtcgcgcgaaggggtaggggtgctcgaacgcggtgccggccgtgatgccgaagcccaggttctcggtcacggcggccatcgcgctgaccagcaggatcgggtcgttcacgggcacctgggcgccgttgcggatcgcggcctcgttggtgccgccgtacacgtcgtaggtaccaaggacgtccgcgatgaagacaccgtcgaacgtcgcgctttccagcagcttcgccaggtccgtccagtacgagatggcgatggggcggctcgggtcgagcgtcggcgaaatgcgcggacacaatttcgatccggctcaggcgggctcgtcctggcgccgcgggctcgggtcgggagggaggatctcgatgtcgtggtcggccgtgcgctgtgcccgccaccagatcacgaagccgaccgcggtgaagacgccgtagaacaggtacatcagcccggtggcgtaatagccggagctgaacagcagggggattccgaccgcgtcgacggcgatccagatcaaccagaactccgtccaccccctggccatcccgtacgtggcgaggagcgagccgacgaacgtccacgcgtcagcccacaccggctcccacgagccgagcgcgcggaacacgggcgtcagcgcgacggtgccgacgatcagcacgaggaccatgccgatgcgtgcgctcgtcggcgcccaccgcggcaccacgcgtccgccctccgcgtgccgccagcggatccatccgtagatcgccacggcgatgaacatgatctgccggccggcctggcccagcagatgaggcagcgacgggtcggggctcagggcggagccgaggaacacggtgagcagcagcaggttgccgacgatgccgaccggccacgcccacaccttgcgccgcataccgccgagcgcactcgccagcccgaatgcgttgccgacgacttcgcggacgaggagc

SEQ ID NO: 21242 - DNA, 354 bp, Glycine max
  Peptide Sequence Number=SeqID_138020
atgacacaagatcacgagaaacttgattcagatttaattgccacttgtgtagtaggcatgatcagagaagatccatcaataagaatttctttgattcaagagaggattaacagtgaatttgcgtacaaggctttcaagtactgtaagccaatcatacaagttgacgacacacatttgtacggaaaataccgtgggaccctcttaatggccacatcacaagatggaaatggtggtgtccttcctctagcattcgcggtggtcaaaggtgagacgttgatagcgtggtcatggtttttggcacacttgcgtgaacatgtcacagataaaaatggtatttgtctgatatcttattga

SEQ ID NO: 21243 - DNA, 618 bp, Glycine max
  Peptide Sequence Number=SeqID_138021
gtagccttaaaaatctgccaagatgacaaaattcagaggcaattagccaaagaaaaagctcaaacaaagagggatttaggttccttctgtgaacaatttggcttaccagcctgcccaaaacaaaagaagaaacaaacctctaggaaagaaatccaggatcataaaccagccaataaaagaagattttcaaaaagaagatactctcaaaaaccctcgactagtaaggaaatagaaaatcctaagcaaaaaataaaatcaaaaataacatgctacaattgtggaaaacaaggccacattagtaagtattgtagattaaagaaaaaattaagaaatcttaacctagaacccacaatcgaagaacaaataaacaatttactcatagaaacttcggaggaagaaacagaaactgaaacttcatcctccgtactttccgacgaaaatctaaacttaatccaacaagatgatcaattatcatcaacggatgatgatgataagaaaatcaacactctaacaagagaacaagatctctcgtttgaagcaattaattccatccctgacccccaggaaaagaaggttttttctggaaaaactcaagaagaccttagaagtcagacctag

SEQ ID NO: 21244 - DNA, 363 bp, Glycine max
  Peptide Sequence Number=SeqID_138022
atgaaagagtctaagatgattaaaggttactcatatagactacttgacattgctaacaaggttagattgttgggcactaaatttgcagattccagaattgttgagaaaattatggttacgataccattgagatatgaagcatcaataaccactttagagaacacaaatgatttgtctaagatcactttgtcagaagtattgcatgatttgcaagcccatgagcaacaaaggcttatgaggcaagatcatattgttgaaggagctttactagccaagcaacaaaatatgtccaaatccaagaaaaacaaggattttgatgcaattagagcgagttcaacatcaactagtgcaaaaggaaattga

SEQ ID NO: 21245 - DNA, 1800 bp, Glycine max
  Peptide Sequence Number=SeqID_138023
atgtcgtgccattcggccaaagtggtcatagggctgccatttaacaacactgattatatgcggtcttttggaacagaaggaaggaaaaaggatggcccacaaatccctcccagtgacaaggtttatgagtatatacttttccgtgggactgacatcaaggatttacaggttaaatcttctccacctgtccagcctactccacaagtcaacaatgacccagctattattcagtctcactatcctttcccggtgaccacatctacaagtttgccttctgctgtaagtgggtctttgactgatcctagctctcataccacacaacttggacttcccgggtcaaattttcaagggcccttacctttgtatcaacctggagggaacataggatcgtggggagcttctccacctgctcctaatgcaaatggtggtcggcttgctatgccaccaatgtattggcaaggatattatggtgccccaaatgggcttcctcaattacaccaacaatctttgcttcaaccgccacctggtttatcaatgccttcatctatgcagcagccaatgcagtatcccaattttaccccccctttacctactgtatcttctaatttgcctgaattgccatcatctttgctgcctgtgagtgctagtacccctagtgtaacatctgcttccttgcctcctaatttgcctccagcaccttctgctttgcctcctgctccttcagccttgcctcctgctccttctgctttatctcccgttccttctgcaacgcttgcttctgaaatttttccagtatcagtagcaaataaggcacccaatgtttcaacttccgcagccatgttagcttctaacttaccatcactggctttgctgaccaatcctgctcgagatatcaatgctatagtgccacccatttccagcaaatcgaatgcaatttcaggttcaagcttgccctaccaatctgtatcccagttgtctcctgcagttgttgaatcatcgacttctatccacacagaaacatcagcaccttctttggtaaccccaggacaattattgaagcctggaccaattatagtttcttcggctcagccttcacaagcacctcataaggatgttgaagttgttcaggtatcatcaacatcatctcctgagccatctgtaccagtttctgtggaaactcaaccaccaatactgccattgccagtaacttcacggcccaatcacaggcctggtggagctcctacccaaactcatcatcatggctatagttatagaggacgtggaagaggaagaggaactggggcatttttagaatcacttgtaccgatagaaatcgagaatggtttccgctcagtcacaaaattcactgaagattttgatttcacagcaatgaatgagaagttcaaaaaggatgaagtatggggtcatcttggtaaaagtaagtctcattcaaaagacaataacggggaagaaaatgcctttgatgaagattaccaagatgaagacaatgacgatgtatcaaacattgaggttaagcctgtttataacaaggacgacttctttgactcgctctcttccaacatgcatggtaatgcttcacagaatggaaggactcgatactccgaacaaatcaagattgatactgagacgtttggcgattatgtgaggtaccatggtggtcgtgggggccgtggccctggccgtggtggacgtactcgaggtggttattatggaagaggaggagggtatggctactctggacgagggaggggacgcggcatgccaagtcgcactttgtag

SEQ ID NO: 21246 - DNA, 1302 bp, Glycine max
  Peptide Sequence Number=SeqID_138024
atggagaaggcagagagggatgctctatactccaccattcaaggctttgttggtaattggtggaatggctcagatctctatccagatccttgtggttggactcctattcagggggtgtcttgtgatctgtttaatggattttggtatgttactgtcttgaacattggaccaatccacgacaattctctaagttgtgccaaaaatttggaattcagaccacagttgtttgagctgaagcaccttaaagctctatccctcttcaagtgctttgaatcacaacacaagcatcatcaagctaccatccccaatgctcactgggaaaagcttgctggcagcttagaatcacttgagtatagatcaaatagaggtctcattggaaaaattccttcaagttttggtgccctcaagaaccttcagtcactagtagtattagaaaatggtttaacaggtgaaattccaccagacattggtaacctcaacaagttgaagaggcttgttcttgctggaaactattttagtggacacattccagatatttttagtgcactaagtgacttattaattcttgatttaagtagaaattcactatctgggactttaccttcgacacttggaagcttaacttcccttttgaagcttgatgtgagccataaccatttggaggggaatctgctgaaagaacttgctgatcttaagaatctgacccttatggatcttaggaataacagattctctggagggttgacattgagtattcaagatatgtattctttagaggaaatggttctgtccaacaatggaataggtggagatatcaggaccctgaagtgggaaaaccttcataacttagtcattttggacctatctaacatggggttgaaaggggaaattcctgagtctatgtcagaattaaagaggttgaggtttttaggccttagtgacaacaacctcacaggcaacctttcaccaaaactatctactcttccttgtctcaatgcactatatgttagtggcaacaatttggtaggagagcttaaattctctatggagttttatggaaaaatgggaacacgttttggggcctggaacaaccctagcctttgctaccatcttggagtaatgtcaacaagtcatgttccatatggggtaaaaccatgccagcaagagatcaaattgctagaatctaatacaaatgatgggtatgtgaagaggactttccattccctggcctctttgagccatgctcctaatggcttctggtggatttttctagttctcttaaattcttatttaggtctttaa

SEQ ID NO: 21247 - DNA, 2913 bp, Glycine max
  Peptide Sequence Number=SeqID_138025
atgggcctcctattgattgagaagaaagaatggaattcaaagtttgatcagctgaggcaagaactagctgaaactgaagagattctaaaacgagaacagtcagcacatttaattgcattatttgaagttgagaagcgagaggaaaatttgaagaaagcattaagcacagagaggcaatgtggggctgatcttgagagagctctgcgtgcaatgcaagaagagcatgcccaagtcaagtcttcctctcatacaaagctagctaaagctaacgcattggttgatggaattgaagagaagtcttcggtggttgacaagaaactgcttgatgcagaagctaagcttgctgagataaacagaaaaaatgcagagctggatatgaaattgcgacaggtggatgttcgtgaaagtttgcttcaaaaggagcgtttgtctttagctactgatcgagaatcatttgaggcaacattctacaaacaaagggaagatttgaaggactgggaaaggaagctaaagcaaagagaagatatgctatgtgatggtaggcaaaatcttggtgagaaagaagaaaagatagttgaaactgagaagaaccttaagcagaaagaaagagaccttgaagtgttggagaagaaaattgattcatctaattctttagtgaaagaaaaggaagctgagataatccaaagagtagcagatttagatgtggaagagaagaaagtgaattctttaaagagcatgctggagatgaaagagaaagaattgcttgcactggaactaaagcttagtgctagagaaagagaggggatcgagaagctccttggtgaacaaaaggctactctggatttaaagttgcagcaggttgaacttgaaatggaacaaaagcagaaatccctcgttgaggagtttagcagcaaggaggaagccttggagcagagggaggtcgaagtcaaccatagggaaaaaaaggttggaaaagaagagcaggccttgaataagaaggctgagagaataaaggagcaaaataaggagattgaagcaaagttgaaatccttaaaggagaaagaaaagactatgataattaaagagaaagagttggagaaggaaaaacaacaactgcttgctgaccgggagagcctggagaatttaaatgctgaacttgagaagatgaaagctgagatttctcagaaggagttgcaaatatgccaagagactgagaatttgaagcttactgaagatgatagggcagagcattctcgtttgcaattggaactaaaacaggagatagagcataccagattgcagaaggactttattatgaaggaagctgaaaacttaagggaggagagacagaggtttgagaaagagtgggaagtgctggatgaaaaaagagcagaaattactaataagcagcatggtattgatatggagaaagaaagtttaagaaaatttcagaacagtgaagaagaaaggttgaaaagtgagaaacaacatatgcaagatcatataaagaaagaactggagatgcttgaatcggagaaggaatcatttagagattcaatgaagcaagagaaacatcttttgtctgaaaaggtgaaaaatgaaaaggcacaaatgcttcaagattttgaattgaagatgaggaatcttgagaatgaaatccagaaaagacaggaggaaatggagaaagacttgcaggaaagggagagaaactttcaggaggagatgcaaagagagcttgataatattaataacttgaaggatgttactgagaaggaatgggaagaagtgaaggctgaggggattaggttagaaaatgagaggaaggtacttgagtcgaacaagcagcaactgaagtcaggccaacatgagatgcatgaagattctgaaatgcttatgaatctcagccggaaggttaagaaggaacgtgagcgccttgttgctgaaagaaaacattttcttgaacttgttgagaagctaaggagttgcaagggctgtggtgaagttgttagggattttgttgtatctgatattcagttacctgactttaaggaaagagtggccattccctcacctatctcccctgttctgaatgacaatcctcctaagaactcccaggacaatatagctgcttctgagtttaacatctctggatctgtaaagcctgtgtcttggctccgtaaatgcacaaccaagattttcaatctgtccccaagtaaaagagctgatgctgttggtgctttagacatgcctgggacatcaccactgtcagatgtcaattttagtgtagagaacatagatgaggagctgcctacatctcttcctaatataggagctagagttatttttgacgaacgtcaaccagcaggtgggatggcacatcactcttcagatacaccacacctccaatctgataacattggtaaagaggttggtgatgaatactctctatccgtgggtgatcacagccgcgtggatagttttgtagatggagatccaggtgattcgcagcagtctgttccaaagcttggtcggcgcaaacctgggaggaaaagcaaatctggaattgctagaacacgctcagtgaaggctgttgttgaagaggccaaggagttcctaggaaaagccccaaagaaaatagaaaatgcaagcttgcagtctctcaatactgatcatatcagagaagacagtcgagaagactccagtcacactgagaaagccattggtaacactagaaggaaacggcaacgggcacaaacttctaggattacagaaagtgagcagaatgctggtgatagtgaaggacaatcagatagtattacagctggtgggcgcaggaagaagaggcaaacagttgctccactgacgcaagttactggggagaagcgatacaatctcaggcggcataagatgtaa

SEQ ID NO: 21248 - DNA, 2481 bp, Glycine max
  Peptide Sequence Number=SeqID_138026
atgaagactctgatgatacaggggtgcaacaagtggttatgcacaagttggactcaaaagtcaaaagtcgtagccttttcttacaacccatgttacccatttaagcttatgtcatttcttcgttctatccacaccagcattgctgattcctatcaatctatatttcactccaatcagcttcttaatgggttgtcaaaatctggccaaattgacgatgcccgagaattgtttgataaaatgcttcaaagggatgagtatacatggaacaccatggtatctggttatgctaatgtgggaagattggttgaagcaagagagctttttaatgggttttcaagtagaagttctatcacttggtcctccctcatatccgggtattgtagatttgggcgtcaagctgaggcttttgatttgtttaagaggatgaggttggagggtcagaaacctagtcagtacactttaggaagtatcctgagggggtgttcagcgttgggtttgatacaaaagggggaaatgattcatgggtatgtggtgaagaatggatttgaatcaaatgtgtatgttgtcgctggccttgttgatatgtatgcaaagtgcaggcacatttcggaagctgagattctcttcaaggggttggccttcaacaagggaaatcatgtcctgtggaccgccatggttactggttatgctcaaaatggtgatgaccataaggcaattgagttttttcgttacatgcacacagaaggggttgagtctaatcagtttacatttcctagcatattgacagcgtgctcttcagtttcagctcattgttttggagaacaggtgcatggttgcattgtacggaatggttttggatgcaatgcatatgttcagagtgcgttggttgatatgtatgccaaatgtggagatttaggtagtgcaaaaagggtattagaaaatatggaggatgatgatgttgtttcatggaactccatgatagttgggtgtgtaagacatggatttgaagaggaagctattctcttgtttaaaaaaatgcatgcaagaaatatgaagattgatcattatacatttccatctgttctgaattgttgcatagtaggtagaattgatggtaaatctgttcactgtttggtaatcaaaactggatttgagaactataagcttgttagcaatgctcttgttgatatgtatgccaaaactgaagacttgaattgtgcatatgctgtgtttgaaaagatgtttgagaaagatgtcatctcatggacctcccttgtcacaggttatacacaaaatggctcccatgaagaatccctgaagactttttgtgacatgagaatttccggggtaagtccagaccaatttattgttgccagcattttgagtgcttgcgcagaattgactcttctggaattcggtaaacaagtgcattctgacttcattaaattaggtctaagatcatccctgtcggtgaataattctcttgtaaccatgtatgcaaaatgtggatgcctggatgatgctgatgcaatttttgtttcaatgcatgttcgggatgtaattacttggacagctcttattgttggttatgcacggaatggcaagggaagagactccttaaaattctatgatgctatggtttcaagtggcacaaaaccagattttattacatttataggattattatttgcttgtagtcatgctggtcttgtggatgaaggtcgtacatattttcaacaaatgaaaaagatttatggaatagaacctggccctgaacactacgcctgcatgattgatctgtttggacgcttaggaaaacttgacgaggcaaaagaaatactaaatcaaatggatgtgaaacctgatgcaactgtatggaaggcactccttgctgcatgtagagtgcatggtaacttagaattgggagagagggcagctacaaatctttttgagttggaacccatgaatgctatgccttatgttatgttgtctaacatgtatttggcagctcgaaaatgggatgatgctgcgaaaatacgaaggttgatgaaatcaaaaggcataacaaaggagcctggatgcagttggattgagatgaacagcagactgcatacattcatttctgaagatagaggacatccaagggaagctgagatttattccaagatcgatgaaattataagaagaattaaggaagttggttatgttccagatatgaatttttcattgcatgacatggatagagagggaaaggaggctggtcttgcttatcacagtgagaaactggctgttgcttttggattacttgcttccccaccaggtgcaccaattcggatatttaagaatcttagagtttgtggagattgtcattctgccatgaaatatatatcaggagttttcactcgtcatatcatattgagggattcaaactgttttcatcattttaaagaaggagaatgttcatgtgaggattactggtaa

SEQ ID NO: 21249 - DNA, 702 bp, Glycine max
  Peptide Sequence Number=SeqID_138027
atggggaagctatcatcttggaggcataggcaattatccttggtggggagggtatgcctcatcaattcggtattcacatccttacctttgttctatagattaagtctattcttagggattttttgtgggggaaaaggggggataataggaaattgggtaaattggaggaatgtatgttgccttagaagtcatggaggattgggagttgaggacttgaagttattcaatgtagctttattagcaaaatggaggtggaacttgtttcatcaacaagacactttgttgggggatatattgaatgcaaaatatggggtgagttggaaggttgttgtgggtgagaaaattagcttttggagggaacctttggtggaggagcaaaatgaggagtctataaaaaaatatgcggcagtgggaaggagatgtgtggaagtggaagacaagtggtggtggaaaattcggcttataaagcactacatgagctacactatatctcacaatcccaagatgcctttgaagaataggcttccgacaagggacaaccttaacaagaggcggtgggtacaacttgtgacggtgttgccaagaaatgtggaggatcatatgtggcaacatggggcttcaatcaaagatgaagtggagcaagaaaggcagtatgttctatggttatgccattatatggtctgtatggaagaaaaggaatga

SEQ ID NO: 21250 - DNA, 333 bp, Glycine max
  Peptide Sequence Number=SeqID_138028
atgagggtgaaagaaaatgaatgcaaagagaagaaagatatgtttggtgtgtttctaaagagaaaaatattgatgcagcatgaggagtcacatgagaactgggacacgatggtgtacatcaccatacctcgaccacgacatttagtaacgatgcaagacatggtacaggctctctgcaccgacgagcactttcatcgcgtgataggcaatggcgactgctcccttgatcaacgggattgtttcaagaaaacccaaagacgtgtgggcagtgcggctaagaattggaacttatcttgtagatggaaaatatttcaagcccttggatttggctga

SEQ ID NO: 21251 - DNA, 394 bp, Glycine max
  Peptide Sequence Number=SeqID_138029
aatggtgtaagaggattaacgttggatatgaatgattacaaagatgacatttggttatgtcaaggaccatgctctaaatatacagcttttctaccagcaatctatgttctaagagaggtcagggcattccttaaaacacatccaacacaaatcatcaccattttcattgaggatcatgtaacatcacgaaatggtgtgaataaggtgtttaatggagcagggttgaggagattttggtttccagcatctaaaatgcctaaatatggcggtgactggccaaccgtcaaagaaatgatacgtaggaatcataggctaattgtgttcacttcaaatgctactaaggaggctcgtgaaggaattgcatacgtgtggaattatgtcgtagaaaatcaat

SEQ ID NO: 21252 - DNA, 1326 bp, Glycine max
  Peptide Sequence Number=SeqID_138030
aagccaacactagcaacaacccttttcgccgttttgctccttatcccttcttcacttgctctcaaggaaggacaaacatgcgtagccgacaagaactgcgactcgggtttgcattgcgaaacttgcgtggccaatggaaacgtgcgaccacgttgcactcgggttcaaccaatcaaccccacttcaaagataaaagggttgccgtttaatcggtattcatggctgacgacgcataattcatttgcgattttgggtaagaaatcaatgacgggttctgttattctgtctccaaccaatcagcaggacacgatcacaagccagcttaatgatgtggatttgattcttcacgtgaaagagaaattatcccttgtgaatttgataagagtgagactcatatgtgacaaggatgtggatttgattcttgacgtgaaagagaaattatcccttaatggagtacgagggttgatgcttgacatgtatgatttccagaatgatatttggctgtgccattcatttggtggccagtgctacaactacacagcttttcaacctgccattaatgttctcaaagagattcaagtatttctagacgcaaacccatcagagattgttactattttcattgaggattatgttacatcaccaaaaggcctaacaaaggtgtttgatgctgctggactgagaaaatactggtttccagtgtctagaatgcccaaaaatggtggaaactggcccaccgttgatgatatggtcaagaagaatcaacgtttagtagtcttcacttcaaaatcatctaaggaagcttctgaagggatagcctatgagtggcgatatttagtagaaaaccaatatggaaatggaggcatgaaagctggttcatgccctaatcgtgcagagtcaccatctatgaacacaaaatcaagatcattagttctagtgaatttctttagagatcttcctgatgtaactaaatcttgcaaggacaactcagctcctttgcttagcatggtcaatacatgctatgaagcagctgacaaacgatggcctaatttcattgctgttgatttctacaagaggagcgatggaggaggagcccctgatgcaatagatgttgctaatggtcatctagtttgtgggtgtgaaaacttggcctcatgcaaggctaatatgacatttggagtgtgtcagctacctgaggctgaagccactcctccccttgcagcagcagcacgtaacactagctttggtattcgaaattgcaagccagtttatttgctgtggtctttagccaccactgtttttggggccttgctcgtggcattttga

SEQ ID NO: 21253 - DNA, 318 bp, Glycine max
  Peptide Sequence Number=SeqID_138031
atgtctttacgtactaagcccctctatctttcgttctcgcatttcttcttgtcgcctcaacttcttcatcgtggcactgcgggagatgaaggagatggcgcctcgacttctttccgtcactctctctctcttagtggagacgtgaggattgttgacgttaagactgatatgcatgacatggtttcccttcaagcaactctaccacacccaatgagctcaaaagcccaccatctccctcaagcaactctaccacacccgccattgctgagagaatctcctcggcttctggtgccgaagcggaaccggaatcctttctga

SEQ ID NO: 21254 - DNA, 369 bp, Glycine max
  Peptide Sequence Number=SeqID_138032
atgacttaccttacaccttcactgaaactagaaagggtcattcaaacggttgataaaacattcatgccaaacccaattgtgaccattgttcatccatacatacaacaatgttcaacaaacttcagcatcttcctagatattgacgcaaagcggttgcacgacattgtgctactagatctcgcggggcaaggtggccggtgcggcactgcttggaacttaatggcagggcggtgttgcttggtagacaatgttagggggtggaaagtcggatgggaaggggaggagtgtaaggatttggtgagtgggcaaaatggagatttcatgttttttaaaaaaggttggggtgaggatagtaaaaggtggagctga

SEQ ID NO: 21255 - DNA, 637 bp, Glycine max
  Peptide Sequence Number=SeqID_138033
ggttttccttcccaactccgattcaaacacttacgatgtcaccaaaacgtcgttcctcttgatgagcctctctaaggaaggacacgtggtcgcattttttgatcctaacaggaggagatccgatttcaaactcgagaatcggagcgaattggtggctgtggatgggggtgatgacgatgtcgtggtggtggggagcagatcactactggagagactgatggtggagatttaccagcggttcgcgaacccgcagagccccaagagtgataggtctaggaggcagaggcggcacattgaattaaagtggtcacgtcacatttatattttggtacttaaattttatgaatttgtggatttaaccatgtatattgcactttgcagcatagagtttgactgcgatgatgatttgtttgctattgttggggtttcccagtgtgttaattatcagcggaacgggtttggaggcaggttcaggtcgggtattaataatctcatctccaaccccaaactcgatgttgactatcgaggaaaatccaaactcgaccccgattctagtcaactcgagttttttccatcaaaattgggacccattgccattcctattatgtggccaccaacacaaaaccaaattttttaa

SEQ ID NO: 21256 - DNA, 636 bp, Glycine max
  Peptide Sequence Number=SeqID_138034
atggttcatatgtatgaccagttagatgaggcttctaggaccaccacacgacagattgcggggtacctgactctactacagtgctggatctatgagcacttccctagtgtgcaccagtgcgccacagatgatacataccaggaggcgtccccacgtgcttcctggtggctgacgtcgaaggcgcatatgaagggaatcacaggagcaccttacagggcacgttgtgatgctttgaccgtcatggatgtgtcctggttgccatacactgagcatcggggggttagggcctttgagctaatttcatcattccagggtcagctgagatggggtcctatggtggtcacagctcgaccggagagggtggtacgacagtttggttacattcagagcatccctccaccgcctgttagtgctcgattgtcatatgatgatatagatgacaggtggatgcattttgcggagcacgtactacctatgggtgagctttgtctagtgcctgggcaagtatctgcggattacatagagtggtttttccgcatatctcacccattcatgataccgacccaggcaggtgaccagcccagagatgcaccagccgcagaccctgaggagtacatacagctgcccagcccccag

SEQ ID NO: 21257 - DNA, 321 bp, Glycine max
  Peptide Sequence Number=SeqID_138035
aaggaaggaagaatcaggattctatcttcatgcgaaggatttccaaatgttcccttaatgggaacaaggggttgtataaattataatcctgtcctcgccataagacagcttggctaccccatgagaggagcgccattagacgaaagcatcgcgcttttcattacacggggtttcagtgaccccaatgcaaatgtactccaaggagttcgcaaggcatgtgatgcggtggcagcaatagtgagctcaagctccgaagaggtgaaaggaatcatcacgggtcaaaggcatgatcttgaaggacgagctaaaggcttgccttag

SEQ ID NO: 21258 - DNA, 252 bp, Glycine max
  Peptide Sequence Number=SeqID_138036
atgccggataaccaagataatattgatgcacaatcccatccaggcccacttgggccctccagaatattcctccagaaggctgttgcttctggaggaagcaacctggctcgcctgggcgagctgggcggcaaccacctcccctattttgctataaataggggaggaagtgaagaagaaaagggttcagcccctttggcacttctctctctttcgaatttgcttggaaaaattgtttccgtgaagaaaatctaa

SEQ ID NO: 21259 - DNA, 229 bp, Glycine max
  Peptide Sequence Number=SeqID_138037
tcagttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggaga

SEQ ID NO: 21260 - DNA, 777 bp, Glycine max
  Peptide Sequence Number=SeqID_138038
atgcggcgactagttggtgttggcctcggcctcatgtcgtcgtttgcgcagggtgagcctggcgcagatcacttgggcatgtatacgcaggcgcaattccagacggtagaagggcattgccagcaatgccaggctttgccacaaaccttatggtatttccgccatgagacatttgccgtgccaatccccggtttgccagtatcccgcttagatgccagcaagcggggggctgacgatatccaggcgctcaatccggaggccttgcctgaattgatctgggcaggttcaagccagtattggtcacgggcggtactcaatgccgcagcaacacaagtcactaccgcacaaggcgaacaattaaattttaaactggttccaaaaattgccagcaaccggtcatactggaacgcggataccagcgcctttttgagtcagtcaccaatgtttattcgtggtgagtttgcagaccagaccctggtggcgcgaaccgtatggccgcaggctttcaagctagatttaacggccggcctgcaaccactgcaaagcggcgagaccttgcaatcactggttcaatttgccaatggcggcgcacaaagcccataccaaagccggttgttgtgggagaaagcacctggtgcagcacaatcgtcttccggaaaaactgcgttgggcattttgctcaatggtgcccaaggcgatgatgatgaagcgcatggcgggcattttgcactcgccactggcgtggtaggggcggagggtgaatacggcacttggctg

SEQ ID NO: 21261 - DNA, 225 bp, Glycine max
  Peptide Sequence Number=SeqID_138039
atggaggatttctccctcccccggattcatcttaaaccgaccgagatgacatccagcacgagagcaagaaaaggaaatggtctccgtgcagcttcaatccggttgacgccactcgataggaagaaaagagcatcaaggtttttcgaattgcttcaagccctgtttcagcggagagcatggattcccctggcacctctcttccacagcttggcacgtttaaagaag

SEQ ID NO: 21262 - DNA, 522 bp, Glycine max
  Peptide Sequence Number=SeqID_138040
atggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatgggttcgatgaggaggccatcgcccagctgctatatatggatgacgttgctcctcagcaacatcctgcccaccgatcataa

SEQ ID NO: 21263 - DNA, 231 bp, Glycine max
  misc_feature (222)..(222): n is a, c, g, or t
  Peptide Sequence Number=SeqID_138041
atgtcttctgcctacggttacgacgactacgatatccatgatgatcagattgagatggagatggactttctgcatgaacggtatcaggaggacaacagaaactatgacgtgtttttgagtttcagaggggaagacacgcgtgcttctttcacttcacatctctataccgctcttcgcaacgcgggaatctttgttttcaaggatgatgagacacttccaagngggaaataa

SEQ ID NO: 21264 - DNA, 135 bp, Glycine max
  Peptide Sequence Number=SeqID_138042
atgaaggtgcagcaggcgggccttgtcgctgatttaggggtggcctttgtggttgattgggtggtgggtaatgagaatggccgatattggctgagtaatgacattgctggcttggtgggacacttggccacgtag

SEQ ID NO: 21265 - DNA, 201 bp, Glycine max
  Peptide Sequence Number=SeqID_138043
atgaccaccgcgataacgttctggcggatggcgcctatgcgggtttcaatttccgtttctaagcgcggcaaacgggattgcctgccggcaatccctctttttatgcaagagatgggtattcaacgtgtctactgtttctggcgacgaatgactgctgcatccggccaggcccaatacaccggcaatgataactacttttaa

SEQ ID NO: 21266 - DNA, 231 bp, Glycine max
  Peptide Sequence Number=SeqID_138044
atgttagtttgtaggccaaagaagagaaggtgcaaaaagctgtttatgaactcgcttagcgaggaagattggctaagcgagccttatccgctgagcgaggcaggttgctcgcttagaggatgggaaaccctagaagaggataagttagagatctgcatgctcaatgcgcagccaactcgcccagcgaggacgttgtctcttctcacgcttagtgcgcccaagctcgcttag

SEQ ID NO: 21267 - DNA, 708 bp, Glycine max
  Peptide Sequence Number=SeqID_138045
atggagcttacatcactggatgagggagaatccttacccgcttactccagatactgcaagatgcctactgatatcagattgattgaggctgctttgtgtatacccagccggggtgttctctcatactccaacctggctccgacttcccacacctcggatttgactacggatagagctaggttaatctttggcctaggctctcaactggacatgaatgtaggagctctcatatctggccagatcacatctatggcccagtctaattcctctagacttgggttccctgcttttatcacaactctatgtaggtccagaggggttgcttctgacagcctagtcttcaaacgcttgagcccggtcattaacttggcctatatcaggaaaaactattggaaccctgctgatctggcatttactattggaggggctaggagagcgagggcaaggccagtcgaggctccttccacatctgcagctcctcttccagcacgtacctcagcagctctttctaccccatcttttactcagcctccccttcacagggaagacgaaggtctcactgctcaggtaccacagcagagggaggatgagtcatcagagtcttccacgctagagcccctgatcagaagaaagagggtatttgaaacacaagaagctgcagccacgtctgagaaatctcttaaggacactgctgagccttcagaacca

SEQ ID NO: 21268 - DNA, 342 bp, Glycine max
  Peptide Sequence Number=SeqID_138046
atggtcaccaccagaataccgccggcgatgcggaacgaatcgatagagatgccgaacatccgcaggatcccttcgcccaggaaaagcgacgtccacaaaatgatggcgaccgacaggttggcgcgcaaacagaccgacaaagaacttgataaagccggaaagatccaacagagattggcccacagatgctccgcattaatcgctataaaaaagagtcatcgctcacagttatcaagaatgattcccaacaccggcaagctgaaagggagtagaacaaagtcggcggcagcccagccggttcccttctcctcactgcctgcccctccggttggcgtagggtga

SEQ ID NO: 21269 - DNA, 200 bp, Glycine max
  Peptide Sequence Number=SeqID_138047
atggtcatgttggtgcgcatgatccacactcatctctttgcaatggcatgggtgaaaccttgccccggtatgcacagtagttgtgcgatagccttcctctggttgtgctcgcacaattggccctcctttgagatcaagggcccactgaaagtgaggacgcgtagccctcaaaaggcgagggagagcgcaaccctccaaag

SEQ ID NO: 21270 - DNA, 621 bp, Glycine max
  Peptide Sequence Number=SeqID_138048
ggagcggctgcattggtccacacgtacaagcatatgaacgacgcgtcgcaagcctctacacgacaggtgggctgttacattacacttcttcagcactttcctacagtgcatacatgcgttgtgcatgatgcttatgatgaggggagcccacgggcctacaggtggcttatgggtaaggctcatatgacggggatcaagggagccccgtattggagacgtatggatgccctgactatgactgaccgggttcttcgacagtttggcttcattcagaccgtccctccaccgccggtggagccaaactacatggagtggtttttttggatttcgcacccgttcgtcacgcagaccgaggagactgctgagccgagacatccacctccccctcatgatgaggagttcgtcgagccacccatccccgaggtttcagtcgcgtccgatctctctacgcattcaatggatttaggagcgattgttgaggatttggagcgggtcatcaacctcaggatggtcactgaaggcactgacttatatgacatcatgactcattgtctgaggagagctagaggtgatgccgcagatggaagtcttaggccgcgacagagacgccgcatagattag

SEQ ID NO: 21271 - DNA, 834 bp, Glycine max
  Peptide Sequence Number=SeqID_138049
atgcttttgcgctacgccggactgggcttgctgctgttgagctgggcactgatcgaggcgcgtcagacggtcgataccctcgagcaactgaccatggcaccggtggcggccacgcttcagataactgcagtgaatcccgcgaagaaccagctcacggcgcaggtaatccgggcaggtgaccactacgtctttccaccgttgtttgtcacgctgcgtaatgtcagcgatgaggtcgcctggtgtgccggacagcgctggcagatgcagctgcggctacgtgcggtgcacgcccggctcaacgagggcgaatttgatctgcagcgttttgccattgctaaccacagcgcgctgcaggggcgtattgtcagccagcaggctgagtctctgcgctgcagctggcggacgcggtttatcgatcatcatctggcgcgtttcaccgggttaacgcagcccgcaataatacaggcgctggcctttggcgtgcgtgaggcgatgactccggcacagcgagccttactgcgcgaaaccggtaccgcgcacctgatggccatctccggcatgcatatcgcgctggcggccagcgtaggctggctactggcgcgcgtcatccagttagtgttacctgccaggcgaatcggctatttgatgccgctgctgatcagcgggttaacagcggcagcctattgctggatctccggcggtcatccgccggcacagcgcgcgatgctggcgttaacgctgtggctggcgacgcgtatagctggctggcagctgagcaactggcaggtgtggacgctctgcgtggggagtttgctatggcttgatccgctgccg

SEQ ID NO: 21272 - DNA, 258 bp, Glycine max
  Peptide Sequence Number=SeqID_138050
atgggtcaacttcaatggcaagccttttgcaaagcctatggtaagatctgggacctaactacggcagaggtctccgtggaggcaattgcctcactcacccagtattatgaccaacccttgaggtgcttcaccttagaggatttccagctagtacccactgtggaagagtttgaagagatcctgggatgccactgggtggaaggaaaccatatcttttctcagggttctatccctccatggctagagtttccaaagtag

SEQ ID NO: 21273 - DNA, 2521 bp, Glycine max
  Peptide Sequence Number=SeqID_138051
atgacggtgaacggagtgatgagtatcaatatccgtttttcagataaattatttacagaaaatacgatacaaaaacttttattcgcttatcagtctcacctggaagctatagtgaaagagagtgaagattcatctgtgattctaactccatcagaccttacttacaaaggattatcattcagcaccattgaggagatcagtaaagggaatgatatagaagatatttatgagctttccccgatgcagcagggcttgtattaccattggctggtagaccctcacggctcaatttactatatgcagacctcctatcgtattaaatcatctgaactgaacttatctctggtagaaaaagcatttggaatgttgctcaaccgtcattccattctccgtacttcctttgaaaaccgttatggagaagtgcctttacagattgttcataaaaaagctcatgtagacttcaaacatttgatattagaatcggaacttgaactggacaatataaagcaaggggatgtaaaccgaggctttgttttaagtgaacctacacaaatgcgtttggttattgtggagttaccggatggctattatgaattcatctggagtcaccatcatatcattatggacggctggtgcctcagtattctgatcaatgatttttccgcaattttaagttctttggaacacggaacagaaataaatctgccggaaaccaagaaatattcgtcttatattgagtggttaagagaagtagatgaccaggaaacaatgaaatattgggaatcctatcttagcggtgttaacgtgccagcagtaattccgtttgaacgagaccgtgcttctgccaacgaacctaagataattgtaagcaataagattaaaattgaaggagattctttcaaaggaattgaaaaattatgcaagaatattggaattacgatcaacacgtatattcagggagtctggggatatctgctttccagatataacggatcagaagatgctgtatttggagcagtagtgtctggccgccctcctgcactggaagatgttgaaaatattgtaggactatttatcaataccattccgatcagagtaaaatataaaaaggaagatacagttaaagaatttttccttgatttacataccaagtccattcaaagcagtccttatcattattctaaactttcagatatccagacaatttcggggttaggaaataacatgattaacaatatcattgtttttgaaaattaccctgttcaggactctatcatggacaactatgtggataatgaaagcagctcatcaattgaagagatcaaaaacgtagaagtagttgatgaaaccaattattactttttgattactgtattcccatcagaagactcggtaatgcttgatattaaatatgatgcttctgtcttcaacagagtattaatggataacatcggaatgcattttactaatttgttaaaaaatatattcattgatggcgaaagaaaaattttagaagctggttatttaggcgagaatgagaaaaaacttttattagaagatttcaacaataccacttctttttatcctgagaatcaaagtatcgttagtttatttgaggatcaggtaaagcagactcctgatcatactgcaattatttatgaggatctgaaattaagttatgccgagttaaatgatagggcgtctagccttgcctgggaattgcagaatacccatggaataaaaaaaggcgaccatgtaggtgtgatgcttaaccgtggggaaaatcaggtcatttctatcctgggaatattaaaactgggtgcagtgtatgtgccgattgatgccaaccttcctgaatccagaaaagaagtgatgacctccggtttgactttactgatcactgaatcttactacttctttgatcttgatttttattccggtggatctttttcaatagatttagaattgacaggagaaattaattcagaatttaattctgaagttttagaaaaggatgatattgcctatatcatttatacatcaggctctactggggaaccaaaaggtgtgatgaatacccatggaggtatactcaatatgacacagtttcaaaaggaattctttggagtctctgcttaccacaatgtagcgcagtttgcctctttttcttttgatgcatctattttcgagatttttatgaccttactttgtggaaagtcccttcatattcttagcgatgtagttagaaaagattcctttgcctttgaagaatatgtagagaagcattctattgatatagtaacgctgcctcctgcattcttcaacttactcaatgtagagaagcttcaaaacctgaaagcagtaattacagctggagaatcggcagttatcgggaagacaaaagaatttcttcagcatggtactttttacaatgcttacgggcctactgagacaagtatttgtgctactgtgcataaaatagaaaaaggaagtgatttggcattatcaatcatacccattg

SEQ ID NO: 21274 - DNA, 258 bp, Glycine max
  Peptide Sequence Number=SeqID_138052
atggagggggtgcaaataaaaattttgaaatttttgaattgtgccttccagagtgtttttcaaagctggattgcttctggaggaagcaacccagctcgcctggacgagctgggcgacaacctcgtccccttttttcctataaaaaggcaaaggggggttgttctatgggtccctaatccccctggctatgcatttcaactgttttgggtgaaaaaaattgttttcgtgaagaaaatccaagccgaggtgcttccgtaa

SEQ ID NO: 21275 - DNA, 228 bp, Glycine max
  Peptide Sequence Number=SeqID_138053
atgaccgatgcgtatggagaaaatcttgttgagaggggcattccacctatgagcgcatacaggaattgtagttgccagttggtgatcgatgccctttcgtttaacggatcatttttgttgtctgattggaacgttttgaaaacttcaggctatgtggatgagaagcaaaacgaagcttgtggttgtattgcaatctctaaactcccaaaattagatcaaactttttga

SEQ ID NO: 21276 - DNA, 345 bp, Glycine max
  Peptide Sequence Number=SeqID_138054
atggctaattgttcaaacaataatgctaaagaatccacaaatgatgaagtggctctcatgtccagaaaattcaagcaggacgtttcagacaatgagaagagtaaaagttcagatgataagcaagccaacatctatctgatggcatatacagacaaaaaagttaaggtaaaaacttgttctaaatcggatacctcttctagtgcttcgtcagacgatgaagaagatatgccttatgatgccttggatcttcttcatcaatggagtcctttaattcttgaagatgaatggaagcgggatgaagaaggaagaaagatgattggagacaccacttcaaggagaagatga

SEQ ID NO: 21277 - DNA, 573 bp, Glycine max
  Peptide Sequence Number=SeqID_138055
atgacagagaggtatgcctggggagtggctgctttggttgatatgtacgaccagttgaacgatgcatctatgagccacagtcgacaacttggcggttacatcacactgcttgctggatttatgagcactttccctcggtcgcggagtccaccgctgatcaggactacgacgaggcttccctgcgagtgcgcaggtcacgatactggcagaggtgtgggcagaggagatcgtgatgattccaatgatgctccgcaacgtcgacggcctacggcatccgcacgcaggcaacgagtacttgtcactgttgtggacgatgagccagtggtccttgcgacaaaggctgacggagcttcggttgaggctgacgtatatgcggatgagccgatggcaggaggtgatgtacaggacactggagcagacactcttgcagacacaggcgcacatgctgctgaggatgagcttgagggatttccgggtggtccgagggacccatccgtgctgaccgagtatgcggatcacgttgcaggcaacatatggacgggagatgtatttataatattgaattttagttag

SEQ ID NO: 21278 - DNA, 435 bp, Glycine max
  Peptide Sequence Number=SeqID_138056
atggctccaaagaagcttctctctaagcatgcaaggaaggatgccgcgagagaaggatccagtgcggccccacaagcggatatacaatttgacagatgctggtttcgaagcaaggagcaccaacgccaccgctttgaagcgatcaagagttggtctttccttaaggagagacagtcatggaattctatgtcaatgcatggcccatggaggagggagtcaaggataagcgctcctaggtgtgggtgtagaagcaagcttcatgatgaatcaagattgattcaaagaagttttgatgataacaaaggtgatgacaaaaagttcaaagatcaagaaaaacttcatgataacaaagatgatgatctcaagaatgaaagaatgagttcaagatgttcaagattgaatcaagaacacttcaaggttcaagaggaaatttga

SEQ ID NO: 21279 - DNA, 180 bp, Glycine max
  Peptide Sequence Number=SeqID_138057
atgaaaggaaatgcaaaaaatgaaagcaaaagggcacaatggaggcttggggttgcagccaagggtggctcccgtaagcttgttggaggtttctggggaagaagatgggcctatattactaaaccctcgatccctcgtcaggctgaatatccaagcttcatccgcagatccctcatttaa

SEQ ID NO: 21280 - DNA, 303 bp, Glycine max
  Peptide Sequence Number=SeqID_138058
atgccacttccagctctagtatctacagcccaggagcttgtaaccgaggagcctccagcagcagcaacaaaggatgaggatgagctcactcctcctaagccttttgattttgatgtaggaacacatacggctcaggaggagaaggctactccagagcagattctagagccatctccatcccctgtgcatgcacttgatgatgccacaccagtggtggagcctgagcagactattcatgattctttagcagctccagcactggatcttaatgaagaccagccacaggaggagcaggacgtttaa

SEQ ID NO: 21281 - DNA, 141 bp, Glycine max
  Peptide Sequence Number=SeqID_138059
atgcccagggcacagaattctatagcagccatagtgcctattttgggaaaagagccctggaagcagcaaagaggagcaacttgtgcattgaagcctagtttaggcctagtcttacatgagggatctgcagatggagcttag

SEQ ID NO: 21282 - DNA, 405 bp, Glycine max
  Peptide Sequence Number=SeqID_138060
atgatgatttcttttttatggggatcgggtactcaacctgggaagggtatcaattggcttcattggtacaaacttacaatgaaaaaggaatttggaggtatgggttttagaaaccttcatgctttaaatcttgctatgctagagaacacatgtgagaaagccaaacaaatatggatactagcaaagctttgggatgtcatccaagatagatttgaaactaccgaaagcttcaatgatctcatcttcaaccttcttgaacaactccagcctcatgagactaatcaattggctatcctttggtgcatttggaagattcgtaatcaaaagatttgggaaaacgttgacccgtctccctccattgttgttctaacgatccgcctcgtcgctacggtatccacactctaa

SEQ ID NO: 21283 - DNA, 318 bp, Glycine max
  Peptide Sequence Number=SeqID_138061
atggctcaaaaaattcggagagcgggatattactggctcactatggagagcgattgttgcatccatggcataggcgtgattggggccattgagcctaaagcttcaaacggacatcacttcatcttagttgccattgactacttcaccaaatgggttgaagtagcttcatatgctaatgcgactaggagtgtcgtgattagtttcatcaaaagggagataatttgccgatatgggttgctaaggaaaattatcaccttcaatgccaccaatctgaacaacaagatgatgaaggagatgtgtgaggatttcaaaatctaa

SEQ ID NO: 21284 - DNA, 537 bp, Glycine max
  Peptide Sequence Number=SeqID_138062
atgtttcaatcatcatatgatgtccgtggtggcacaagtcgtctagcttctaaccataaagcaaacaaagagaaaaaggagagtatcattccagatgatttttgggcagtggagacatcctcttgtgactcaactgcagatgaaccaattgaaatttctagttctccttccactccaacaagaatgaaaaatcagtgtcatctaagacctgacaagttcatattacaaagaactgttgcaggaagacctcaaacacaaaagaaagtttcaaacaatgcagtctcccatgtagaggttcggaaggaattgctcactgtgaaatcagaaaaagatcagaaaaatgctcaaaacgctagtttaagagggaacttcaaaaacaaaagccaacaatcctctgatgtcaacaacaatggttctttcttttacatggagacggcttcaaaccgaagcctatttccacgttcggtgtatcttgtcaatgttgtcatagggattttgttgttaatagttattagttgggatgtattatcatgttag

SEQ ID NO: 21285 - DNA, 258 bp, Glycine max
  Peptide Sequence Number=SeqID_138063
atgaaggcaacaccagatctggacagtggtggtgttggaagggaggtggcggcaagggtgatgtcagagctaaggggcgagggagtcgaagtagggaaggcacgctatagtcgcatctgtcatctcacacagtggttgccgctaccgagggtggttcaaaatcttccatgttgctgcgcctcaccacctgcaccatgctttattttcacgggaacaattaacacatgcgtagtgttgttgcagcaatgtgatgaataa

SEQ ID NO: 21286 - DNA, 999 bp, Glycine max
  Peptide Sequence Number=SeqID_138064
atggagaacaacataatttccatatgtgatcacatgcctgtaggattcagattccgtcccacagatgaagagcttgtgaactattacctcaaacacaagcttcttgccgatgatttccctgtccacatcatccctgagatcgacctttgcaaagtggagccttgggatgtaccagaaagatcagtgatcaaatccgatgacccagaatggtttttcttcagtcctgtggattacaagtacttgaagagtaaaaggtttaacaggacaaccaagcgtggctactggaaaaccactgggaatgaccggaacgttaagataccgggcaccagcaatgtcattgggactaagaagacccttgttttccacgaaggccgtggtccccgtggtgtcaagaccaactgggttattcatgaataccatgctgttacctcccatgaaagccagagggcttttgttttatgccgcttgatgaagaaagctgagaaaaaaaatgaagggggaattgaggcaccaacctttgatgaaggggagcccagtgtacacttgttttctgactatggaaatcaggcaagagcagaagggattgcatccttcatggacatatttacactctgccatgtagatattattcccggagtagatatggaagaaatctttcaggcagtggatcgggccgagaaattctcccccccagtacaacggtctcaaactggcattgggctggaagattttttcgcaaactctccattgtttaatgcccactttggaagcgaaaacatcaatatgcaaacttcacttgaagttaccgacgatgaagagttggtaaattcattttgggttgatgatgaagaatttgttatcaatgaagaaagaagacactgttttgtcaatagttccacccaaccaaagtcatttagaagggtatacaatgaaagcagtgaaatagatgctgaagttgtctctaatctggttaacatcgtgtgcattatggtgatgtga

SEQ ID NO: 21287 - DNA, 372 bp, Glycine max
  Peptide Sequence Number=SeqID_138065
caatcactacgcatcgctccaaactcgtgggtggaggacgcatgaacgaaaacgcaattcatggggctccgaaaaagggcgaaaacacaattcaaggggctccgaaaaagggtagagaatggagaattgcactaaccaatcactacgcatggctccaaactcggttagagaatggagaattgcacaaagcaatcactacgcatggctccaaactcgtgggtggaggatgcatgaacgaaaacgcaattcatggggctccgaaaaagtgtagagaatggagaattgcactaatgaatcactatgctcggttcccaactcttgggtggaggatgcatgaacaaaaactttcttcgtggggctccaaactcaagg

SEQ ID NO: 21288 - DNA, 252 bp, Glycine max
  Peptide Sequence Number=SeqID_138066
atgtcaggactcatacgttattctcctcaaattttaaccagcccacatcaattagaccttgccccttacgcttcagggccctacaatgctcaatggaatgccccggggcttctccatgacaagcacacgttgcgtttgagtcgtattctcggagaaatggaggttgatgaaccttggctggggttatggctaccattgcagtatcaagtggtgtttagcattggtcgtgtggtaggagggttttgtggttga

SEQ ID NO: 21289 - DNA, 124 bp, Glycine max
  Peptide Sequence Number=SeqID_138067
atggctctgaatgttaatcattatccaccacgccttgaaccaattgatggaaactggatcgctgttgatcatgagcctattccacatgcatttgcagtaaacatacataggcctccagatccag

SEQ ID NO: 21290 - DNA, 460 bp, Glycine max
  Peptide Sequence Number=SeqID_138068
atggagttcttctcaaatgagaattttgaatgctttcaagcatttgaaaactccaatcttatgccattcatgtctctgaaattacctgtttattctgaactagtcaaagctttctattctaatttagaaatccatgaaggtaccctaatgtctgaggtttatgggattaagatagtcattgaccaatccctattttatgatttaacaaaattgcctagtgaaggtgtaccttttgagggtgcactgattgatgattggaaattcgatttttctgtgcatgatgcccgccggttggtttgcaccagccaagcagatatgaccggaaggcttcttgctggttcattggcttttgaaagtcgcatcctcccttaccttattgttcgcattttgcttcctagatcttcaaaccttgcccaggtttttgaagaagatctcattgtcatgtgcgcctttcatgaag

SEQ ID NO: 21291 - DNA, 282 bp, Glycine max
  Peptide Sequence Number=SeqID_138069
atggacaacacgtttgacgatgaagttgaatcggctgttacaatcgacgaatacctcgaggaagttgaggaacgggaactggagagaactaatgtcaaaaacaactctctctccctccgtcctcatccgtatggtgtcaatccaagtcaacttgagcaaatgcaaataccgtcattcaccacacgcctactcctacaaacaattatactactatcacctcgcatcaattataaccccgtggtccccaccacacagaaaaggcaacgtcctccaataacttaa

SEQ ID NO: 21292 - DNA, 1593 bp, Glycine max
  Peptide Sequence Number=SeqID_138070
atgtcggaacccaagatacgtgatgtgctgatcagctgcgccgaagacacacaccaaggttttgtgggccatctctttaaatctctcacagatctcggattctccgtgaaggtagtctcaggagaccatcgggatcttaaggaagaggaaattgaatgcttcagggttttcattattgttttttcccatcactatgcaacttcttcatctcgcttggataaacttaccgagatcataaataagtacggtgcggcagaagatcgacgcatttttccatttttcttcgaggtggaaccgaatcatgtacggtttcaaagtggtagttttgaaatagcttttgattctcatgccaaccgtgtggagtctgagtgtttacagaggtggaaaattactctgaaaaaagtaactgatttttctggctggagtttcaatcggtccgagaaaacatatcaataccaggttattgagaaaatagttcaaaaggtctctgaccatgttgcttgctcagttggattacattgtcgagtggagaaagttaatgatcttttgaaatctgaatctgacgatacagtgagggttttggtatatggagaatctggaataggcaaaacaactgtagttcgtggagtttgtcgttccaatggggggaaatttgcctattattgctttcttgagaaggtgggagaaaatttaaggaatcatggatcaagacatctcataaggatgcttttctctaaaataattggtgacaatgatagtgagtttggaactgaagaaatattacggaaaaagggaaaacaactgggaaagtctcttttggtttttgaagacatttttgatcaagagcagttggaatacattgttaaagtagcatcagactgctttagtttcaactccaaagtcattattacagctgagaaaaattgtttcctaaaatgtcctgagattgaaatatatgaggtagaaaggctcacaaagcaagagagtactgatttgtttattttgaaagcgtttaattgtcggaatccaaaaattaagcatttgaaaattatcacacaagcagtaactatggctccttgggttccatatactttggaactgatagcttcctactttcgtgaaaaaagtgcagaacattgtcagcgtatattagatgaatatgaaaaaattccaaatgaaaaaaagaaacaagtgatagttcaaatgatctttgatgctttgagctgtgatcagaagaaaatgttaattcatattgcctataacctcattggacaagaaaaggcaatagttgaagacagacttcatcgtctttttggtgtttgggcaaaagatggtattgacatgttgcttcataaatctcttgtaaagattgatgagcaaggtcaggtgacaatgcaccacttgacacataacatggtaaaagatatggagtatggcaaaaaagaagaccaacctgcatcaaattatgggagcatgtgtgatttgatggaattggacaaaaacgggtatgtcatggaagaaatccaaccttcgtctaatgattacgaaccaatggaatatgaatatcaaaattgttctacctcctcttcttga

SEQ ID NO: 21293 - DNA, 345 bp, Glycine max
  Peptide Sequence Number=SeqID_138071
atgtttcgttgtgtggatcaacttgatccacgaaagtttcctgcagatcaagttaatccgtgtaacataggcggaccaaacgcggatcaagttaatcctgcatccatgttgctccacgtttttaaagaaaacaatgtgtttccttgcgcattgtctccttcttttctcccttcgatcggtgcttccccgcttgttcattttcttgcgattggtttggttcgatgccgcgaaggtgaagttgaaggtgaaggtgaaggtgttgcggtggtcatcggcggtatagtatacgaggtacgcagtgttgggtgcgttttggtgtacgacagatcgtgtggatcaagttga

SEQ ID NO: 21294 - DNA, 189 bp, Glycine max
  Peptide Sequence Number=SeqID_138072
atggaatgcactaaagaggacatagagcacactaaggataatggtggtcaagaaccttacattggaatgaaattcgagtcaaaggaaaaagcttatcttttctacacttgttatgctaaaatcattggatttgaggtatcaatcaggcccaaaaatagtgtattaaagctttgcaacatgttggagtga

SEQ ID NO: 21295 - DNA, 442 bp, Glycine max
  Peptide Sequence Number=SeqID_138073
gtacttaggagctaaagagtggaaaaagagtcagaaattgaatattttggctcaaaaggagatgttggcacctaaccatggttatactgacttgaccaaggctgttaggatggtcatactccctttaccattgccatgcatgggatctcgtgagaagttcaccatggctgcgattcacgggatgcttcaggagaagggcactagagcacctgtggttacaaaggagcgtggatatcgcaacacggggttttgcgacatttcggaaggaaatgtgcaagatattcaaaagaggggaaaaatggtcattttggggacattttctagcccttgtgatgcaatcctccctaggaagggaccagtcactagaaccatgagcaagaggctccaagaagattgggctagagctgctgaagaaggccctagggttctcatgaacctcagg

SEQ ID NO: 21296 - DNA, 780 bp, Glycine max
  Peptide Sequence Number=SeqID_138074
atgatgccggtcagagcgagggccagcgcgaccgtcacccacacgttgccgaggaagcgccgccgtgggcgtggtggctccgtcgtcatcatctgctctcccgctcgcgcgctggggtgtcgacacaatactcccccagacgatggactccgcagcggggtcctcccacgtgcagcgtctgctgatccccgatgtgcttcgcggcgtggcgatcgtggcgatggtcatcgcgcatgcggctccgttcctgcccgatgcaccctgggccgtgaaggtcgtcacgtcgaacatcagcgacctcgcctccccgctgttcgcgctggtgatggggatgtcggccgagctcgtgtggcgccgcggcggacgccccggcatcacgatgctccagcaactcatccgcggtctcttcctcatcgccttgggcgtctggatggccacctgggggtcatgggtggacgtgatcctcgcctatctgggagtcctcatcaccctcggggcaccgatcctgctcgcgcgcaccccggttgtgatcgcggtcgtggccgtgctgctcctcatcagccaaccggtgctgatggtcgcgcgaacctggacctgggtgtactccgcgccggcgccggtgggagacatcgtcggctggttggcgctcggaccgcactatcgcgtcatcaatctgctgccgttcttcctcatcggcgccctcctcatccggcacgcactccgccgagacgcgctgctgaccgggctggcggtcgccgctccggtggcgtatgtcgtctg

SEQ ID NO: 21297 - DNA, 705 bp, Glycine max
  Peptide Sequence Number=SeqID_138075
gcgctggaaaagcgcggctggcatgagcgggtggcccgctccactcccacgatcctggagccgcattcgcgaacgtacattcacgcggattggccgtgcgatattgatgtccacgagcgcttcccgggtttcttcgccgaaccgatcgagatcttcgacgagctatgggagcggcgcgaggccgtctacgtcggcggcgtcgcggtgatgattccgtctttgacgtcatcgatggtgatcggcgcgctccatgcgctgcgaaacatgtcgataccgcgtcaccgtgctgagtgggacgcgatcgtgaccatgctcgacgagcgcctcgatcagatgcagcgcgatgacttcgtgcgaatcgcggaggtgggtcgggcgcagtgggtgcttcgtgacgcgatcgagcacatgggtctcggtcccgttgcacaggacgtgtctgcggcggaggctcagcgctggacgtcgaatctgttgttcggcgcggacggcggagcggccggctggctcatcgcactgcgtcgaggaccgatgacctcgcgcgtggcgactctgcttcgagccgtgtgggtgccgcgagagttcgtcccccgaaacgacaagtcgtcgcccgtctccagaagtgaggtgctgcgctaccagttcgagcgctggcgtcgtggcttccgggctacgcgcaactacttccgcggatcgagacagtga

SEQ ID NO: 21298 - DNA, 1015 bp, Glycine max
  Peptide Sequence Number=SeqID_138076
aagacaacacgtcctcgccttcagagaactgcacgtcctcaccttcagagggctacacgccctcaccattagaggaccacacgtcctcgccttcagaggactacacgtcctcgccttcaaagggcaacacgccctcaccttcagagaactacacgtcctcgtctttagagggctacacgccctcacattcagaggactacacgtcctcgccttcaaagaacaacacgtcctcaccttgaggactacacggctacacgccatcgctttcagagcactacatgtcctcaccatcagaggactacacgtcctcaccatcagagggctacatgccctcgcctttagaagactacacttcctcgctttcagaggactatgcgtcctcaccatcagaggactacaagtccttacctttagagggatgcacgccctcgccttcagaggactacacgttcgcgccttcagagggctacacaccatcgacttcagaggactacatgtcctcgctttcagagggctacacgccctcgccttcatagagctacactccctcaccttcaaaggactacacatcctcatcttcaaaagactacatgtccgcaccttcagagagctacacgccctcaccattggaggactacacgtcctcaccatcagaggacttcgcgtcctcacctttagagggctgcacgccctcgccttcagaggactacacatcctcgccttaagaggactgcatgtcgtccccttcagggggacacatgccctcgccttaagaggactacacgtcctcgccttcagagggctacacaccctcaccttcagaggactacacgtcctcgctttcagaaggctacacgtcctcgctttcagaaggctacacgccctccccttcagaggactacatgtcctcaccttggggctacacatcatcgccttcagaggactatacgtcctcgctttcagagggctacacgcccttggcttcatagagcaacacaccctcaccttcagatga

SEQ ID NO: 21299 - DNA, 576 bp, Glycine max
  Peptide Sequence Number=SeqID_138077
atgctgcggcgtcttgccgtccaggtagtaaccgccactggcgtaggccggcacggactccaactcgaccgcgccgaggaacttgtgcagcggcaggccggcggccttggcattcaagtcccacagcgcgatgtccagcgcgctgatcgcgcgcatcaccgtgccctggcgcccctgcagcagggcctcctggtacatcgcctgccacagcccctcgaccgcgtgcgaatccttgcccagcagcaccggcgccagcaggctttgcaccgcggcctcgaagattgcgccgccggcgctgccgacgtagcagaagccgatgccttcgatgccgtcggtgctgcggaccttcaccagtccgtagtggcgggtggagacggtgcggttcgaaaacgaggtgaccttgtccaaaggcacggcggctgcgcaaacgtcgatggattcaatgatgggcacggttggctcctgatgaggggaatattgcgggttgcacggccggcgcgccttgcgccggcgcaacgctcagacgcattcttgccgccaccaaagaaacaaacaattatcttgaaccatatttag

SEQ ID NO: 21300 - DNA, 594 bp, Glycine max
  Peptide Sequence Number=SeqID_138078
atgcttgtcggccaggccgaacagcacgtcgagcgattgcgccgggtcgcggtcgatggcgcaagggtcgagtccgcacaacacgtccgcgccctccgccagcgcccggtccagcaacgccgccgtgcccggccgcaccagcaggccggattgcggaaacgccacggtctggatctcgacccggccggccagcgccgcgcgcgtgcggtgcacgccctccaggtgacgcaggccggcatccgtatcgacgtcgacgtggctgcggatgcgcgtggtgccttcacgcaggaaggccagcgccagcgcgcgcgaatggctggcggcgtcatggccgctggcggcgcgccaggcacgttcattgtcaatgcggtcggtcagcgccgggcccacctggttcacgtaccacggagaatcccaggtggtcttgtccaggtgcgtgtgcccttcgaccagtcccggcaacagcagcgcgcccgccccgggctcgcgcgccacgccggcgggcgcctgcaggtttggcccgatgcgttcgatacggccgcgggaaatcaatacgtcgaccgccgcgccatcgagcagtcgaacgtcgtttaa

SEQ ID NO: 21301 - DNA, 276 bp, Glycine max
  misc_feature (179)..(179): n is a, c, g, or t
  Peptide Sequence Number=SeqID_138079
atggggttgaaccaagctcatgcttttgcgaaaaaggttcatcaagtcaagttgaagtatggaagtaaccatcttgcaaaaaattggggcaaaagatggatcagaaaagaacatgctttatggtgcccttatcgaacccgtgctagagctagagtaatgggtgaagtaaaggagtgcanagggcagatgaagaccgacatggaggccatgatgagcatgaagaagataatggaagccaatgcagttgcaattaccgctaccagcactgttgctaag

SEQ ID NO: 21302 - DNA, 324 bp, Glycine max
  Peptide Sequence Number=SeqID_138080
atggctccgaagaaactctccacgaaaaggtctagaagggacgccactgaagaaggctctagtgccgcctcagagtttgatagtcaccgtttccggagtgctgagcaccaacagcgcttcgaggccatcaagggatggtcattccacagggagaggtgtgtccagcttagggaagacgagtaccctgacttccagggagagatagctcgtaggcattgggcatggctagtgacccctatggctaaattcgacccggagatagtcatagaattttatgtcaatgcctggcccactgaggagggggttcgggacatgcgctcatgg

SEQ ID NO: 21303 - DNA, 160 bp, Glycine max
  Peptide Sequence Number=SeqID_138081
tgccaaagtggttgttgcactaagcgaactcagtgggcttagcgcgtatccatcactaagcacggcttcagtgcgcttagcgctcagtgcaccattagcgctaagcgcaaatccacttactcgcgctaagcgcgacagcgcgatttcagaacctatttaa

SEQ ID NO: 21304 - DNA, 285 bp, Glycine max
  Peptide Sequence Number=SeqID_138082
atggtgtggaggacactgtctgtgaaaaatacagcattggcaaggagaaatggactcagttctgtcagacccgtagagaccccacgtgggaggatgtgtggaaaaaggcacaggccatgcaagcaaaacatctccccctacgtgttgtctcgtgggggttatgaatatttagaacagaagctcatggctgagaagacaaagaaaatactggaggaagctgctcagtccggaagcactgagggcatcattgaccctctgtctcccatcagacaacacgtaaagtag

SEQ ID NO: 21305 - DNA, 132 bp, Glycine max
  Peptide Sequence Number=SeqID_138083
atgagtgcaggaatcaagatgttttctacaagcagcaagaagtcatggtttagggtgttgatggaagaaattggagaccaagcagctagaatgttaacttctagagcagctatatcagactacaacatctaa

SEQ ID NO: 21306 - DNA, 102 bp, Glycine max
  Peptide Sequence Number=SeqID_138084
atggcatccttcaaccagatgcagtcccaatttcagtctcagatgcaatcacagggacttgcactacctccagagccagaggttggtccctcaggtcctcgt

SEQ ID NO: 21307 - DNA, 498 bp, Glycine max
  Peptide Sequence Number=SeqID_138085
atgcgagccaaagtgaggccacgaacccctttcaaagggcatccccatccaccagaccatttacagggacactcctactcctttcaactgcccttactgcgctcacaccgctctcactaccctcagagttttgtgaaggaaggtgagaatccagctaaaaaggtctccaaactgagttttgaaaagggggaagaaatagctaaggttcaattccttcccatgaacaaaaaagttaaatctatcacggaatgcattaagatggcttattcgatgcttattgatatgtgttctgtacaggattctttggacgagcaagcgtcacaaggatcgttcgtcccccatggacgtcaggatgtcctgactactgccattgggcgaccagagcaccctggccgtgttcgtgctgctggagccggtgtcaccataaagcaatactttggatcggttccacggacgtcccgcagttcttcctccatgcctcctgaagacctacaatag

SEQ ID NO: 21308 - DNA, 243 bp, Glycine max
  Peptide Sequence Number=SeqID_138086
atggcatgggtatcgtcggacataccaatagtctctcaggctgagccagttaatgtagacataggacatcggttgtcagcggtgttagctttggtcaacttaaaggcacgatttggatggagtgacaagagcttcactgagttgcttgtgttattgaaaaatatgcttcctgaagataacatgttgccaaagaaccactatgaggcaaagaagattttatgtccagtgggaatagagtactag

SEQ ID NO: 21309 - DNA, 237 bp, Glycine max
  Peptide Sequence Number=SeqID_138087
atggaggggatcatagtactcacccccaattcaggcagacatacagaaattggtgcacgtgtgagcacaaactggagtaacgctgaaactagtgtcaacccatcaggggaagaagatgttgctattgttataccgattatgggattgtatgtgcaacgtgatcattctacacacttggtggccttgggaaaaatatatgagggtgatgcaatcctaccccgcaagggcattggatag

SEQ ID NO: 21310 - DNA, 288 bp, Glycine max
  Peptide Sequence Number=SeqID_138088
atggatgctgccatatatgagaaagaggaggcttgttaccactcactcagttacattatgatacccagtgacagttgtaactgtcataacaccaacaaatctagctgcacaaatacactgctaccagctctgatagaggcagctgaggttgacactagagaggggacacgtggcagcaaagtgcaagagaattctgttatgactggagaggttgcaacaggaaaagcaatgactataaggggagatgctgaaaagagaaggcagaaaaagaatttgggtattgattag

SEQ ID NO: 21311 - DNA, 285 bp, Glycine max
  Peptide Sequence Number=SeqID_138089
atggataagagcttgaaggtaggagaagatgagtggagcaagagggaaaaagggggaaatgagggcaaggaagtttgcatcaagggtggaaataagggaatggataacacaactcaagctatggacatagtggtggatgtgatagctaattctaggaatttttggggcagaatagggtatgaagtgattgacctaaaggaagtgcagtggcattcagatggtatttgggggctttgtttaaaaggaatgaactgcttaatcactccagaagagtctatgccatag

SEQ ID NO: 21312 - DNA, 399 bp, Glycine max
  Peptide Sequence Number=SeqID_138090
atgacaccagtagccttttattttgcttattcattgggaaatggaagggctttttgtgctggtggtgatgttgcagctgttgctcgtgatggaagtaaaggtgactggaggtttggtgcaaatttttttcaaagtgaatttaaattgaattacttgatggcaacatatagtaagccccaggtttcaattcttaatggaattgtcatgggaggtggtgctggtgtttctgtacatggaagatttcgtgttgttactgagaatacgatacatggtttgccacatggtatccagagcctcaagagattcaaaagtggtgcctgtccactggactcactgtcttctgtcttttggtcaaaattcttctttatttttttaagctttcaccattctggctggtga

SEQ ID NO: 21313 - DNA, 321 bp, Glycine max
  Peptide Sequence Number=SeqID_138091
atgtccaaatccttaaaggcaaacgctaaccggatgaagaatgaagaatggatgaagaatgaacgaagaacggtgaagaacgatgtaggaatcaatcacagaagcgcctcggcctcattttttttcttctttctccttcttctcactaattttacaaaaatgctctcaatatatgaagctggaccccttaccccaaccccctcatgcctatttataggaaatgaggggatggaggttgaacagcagctcgcccaggcgagttggttgcttcctccagaagtttccttactcgcccaagcgagctggtttcttcactcctaa

SEQ ID NO: 21314 - DNA, 285 bp, Glycine max
  Peptide Sequence Number=SeqID_138092
atggagccagaaacagcaaagcttggatcctctcttcttgttgattctgtgaaagaactagcaaagaaggcactaatcgaagttcctgagagatacgttcatccaaacattgaccctccaattttagtcaacacagactctttattgccacagctccctatcatcgagctacacaagttattgtctgaagatctgaaggaactggaaaagctagactttgcatgcaaagattggggcttttttcagtctctactatctaaacttattgggactaaaagagattaa

SEQ ID NO: 21315 - DNA, 339 bp, Glycine max
  Peptide Sequence Number=SeqID_138093
acttatcaaggtaaccatagtggcgtctacccagacttatcttccttgaccggaagtggcgtctacccagactcatcttccttcattggaagtggcgtctacccagacttatcttccttaaccggaagtggcgtctacccagacttatcttccttaaccggaagtggcgtctacccagacttatcttccttcattggaagtggcgtctaccctgacttatcttccttcacgggaagtggcgtcatccaaatctctgtaacctgtatcaaacgatccgctcctactcaggttcagatcagttacttcattttttatgacaagttgaacttgaacatgtga

SEQ ID NO: 21316 - DNA, 373 bp, Glycine max
  Peptide Sequence Number=SeqID_138094
gttgtaccatctgtggtgaggcttatgaagcaggccaatgtattcccattgaagaacacactcaagaagttcactatacgggaaatcaacagagataaggatatactcaaggaggattttcaggcttccaacaaggtccttataaccaacaaggacagtcgagatcacatcctggcaatcaattcaacaaagaccagggtaacaatgtcaaatcataaaatcaccgagtcagcactgaaaaaccttgaggttcaagtgggacaattggccaagcagatagctgaaagtcatccaacagatgaggatagtgtcatgcccaagaagaaagctgctgaaaagaaaggtattgatgatgagaaagatgatgtgagag

SEQ ID NO: 21317 - DNA, 724 bp, Glycine max
  Peptide Sequence Number=SeqID_138095
aggactacatgtcctagcctccatagggctactcgccctcaccttcagagggctacacgtcctcaccttcagagggctacacgccctcgccttcagagggctacacgccctcgccatcagaggactacacgtcctcgccatcaaaggactacacgtcctcgccttcaaagggctgcacgcccttaccttcagaggactacacgtcctttccttcagagggctacacgccctcgtcattagaggactacacgtcctcgccttcagaggactacacgtcctcacctttagaggacaacacgccctccccttcaaagggctacacgccctcgccttcagaggactacacactctccccttcagaggactacacatccttacctttagaggactacacgtcctcgcctttaaagggctacacgccttcgcgttcagagggctacatgagctcaccttcaaagggctacacgctctcatctttagaggactacacgtcctcacctttatagggctacacgccctcaccttcagaggattacacgccctcaccttcatagggctacatgccctcaccttaagaggactacacgccctcgccttcagagggctacacgccctcgccatcagagggctacatgccctcaccttcaaaggactacacgtcctcgccttcaaaggactacacgtcctcactttagtctcgcacttttgttaccctgacccatga

SEQ ID NO: 21318 - DNA, 327 bp, Glycine max
  Peptide Sequence Number=SeqID_138096
aatgtttatacggataaccactcgggtatttccgcgtatcatcgggcccgccgcctctggatgatacaagggtgcagaatgaccaaatttggtctctgcttgtcatcgggcccgccgcctctggatgacaaaaagggtgcggataaccgtaagaatgaccaaacttggtctctgcttgtcatcgggccccgccggcctctggatgacaaaaagggtgcggataaccgtaagggtcagtatgacaaagattatggggcggccgacaaaagcaaggctcttgctcctacgtatcctccaatgaggaattcagacctacgtagttcttga

SEQ ID NO: 21319 - DNA, 231 bp, Glycine max
  Peptide Sequence Number=SeqID_138097
atgactgttaaagagaggctaaatcatgaagtgctaaaagtgacagttaggctcagctcagcatttgggctaagcgcgcataccacgctaagtgtagcttcaacgcgcttagcacgacagaagaatttggcagagcataaatatttaggttacgcgctaagcgctgcggttgtctttagccaggctcagcgcatgactggtgctaagctcaaatccactaactcgtgctaa

SEQ ID NO: 21320 - DNA, 264 bp, Glycine max
  Peptide Sequence Number=SeqID_138098
atgtcgagccagcagaggcaaaagcaacacacccagatgagaaaacaaggttcttgtgcagagatcaaacctcagagacccaaaagctccaattttgaaaacgggaaatttgttctcaaggcttctctttcaccaacaacaaaaagggcaagagataaagggagaagaaaaaaaaatgtagaactggaacaaggtcacgaagcctgtacagaatggacagtgatggatttgaagccagcaaaacaaaaccataaaatcttttag

SEQ ID NO: 21321 - DNA, 282 bp, Glycine max
  Peptide Sequence Number=SeqID_138099
atgactaaagcacgtcaaaagggggtacggaaagtaaatgaaatgaaaataaaagcacgcgaaacaagtgaggaccagaacttaccggttgaagaccgaagaacgacgaagaacaaacgaataacggttgaaaatcttcacgaaatcacccacggaagcgttacggaagtgcctcggtttggattttcatcacggaaacaatttttctcactaattttaagtgattctcagataccaggagggttgaacatttttgttcttccctcctccccctgtttatag

SEQ ID NO: 21322 - DNA, 297 bp, Glycine max
  Peptide Sequence Number=SeqID_138100
atggaagttaaaatagcagcatctataacagctgtgtggaatgggaagtggaaggagattcacatttcacattcaccacctgattattttccttccgaatacaatgaaatcaacacatgctccatttatgaatgcgctaacaacaaatttgcctatttaaagaaacatataaaagcgcaatttgagaatttcaataatatccagttagaaacagaaaatctaaattgcacccctttttaccttgaggcgagggtttacttgttgccagttggacatcccactttacgcgctgcttaa

SEQ ID NO: 21323 - DNA, 4188 bp, Glycine max
  Peptide Sequence Number=SeqID_138101
atggcaagagcaaaacaagggtcacattggtcatttcagaaactgccgtccgagtcttctaattccggcaagttgaatccaatcaccgtaacttcatattcatataccccccgaacggaccaaagtttcactcactctcccgccaccatgaccaccgtaacggtcacgactcgagctcagatcctccgccacaccgccgcattcacctcctccgtcctctcgcaatccgaactccggcgccgcctcatcgccactctcctccgcgacaccccactctccgaccaaaaacacctaaacctcgccgcagacactctagagagcgcgatctcgttctcgagcccccccacccgctcctcgtccctctctctcgccgagaagctcctcctccctctcccggacttccccctctcctcgctcctcctttctctcatccacgcccttcgtagtcgccctaccgaatccgccgttagcctcctccgaatattccactccaacaataacgcttccctcgctcgttccgaaatcgctcctgcgctctacgagtgccttttctctctccacctcttccccgtcttccgctggttcgatgaccagaggacgcggattctctcctcgagccgtaacgatgacgattacatttattcggtaacttcggaggagtactccgtgttgctgccttgcgcgaaggtgttgtcgaagatgagcgaggagcaggccgcgaagctcagggaggtggagagagagtacgaagatgttctcaaccagaactgcatggttctcgccgagtatttcaaagaggttttggtcaacgaaaacggtgacgctgctgtggtcagtccaccgtcgttggtacttaagagcgccgctgaagatggccacggcggcggggagatcagaaaggaggagatgatgcaaatgaacgtgttggagaacggacggtataataatttttcattttttttaaagaaaggttttcagccaatatggtccgaaagggaagcatctattgaatttttgagccccagtaccagcagcagatcttcccaagcgccattttatcctcaaagagtcttgtccagaatcctcaagccccaaaaagcttcaaaaacttggacaacgccagtctatttaaactcaaccgctgatactgatttttctttagatgagagtttgcttagttcttcttcagattctgaggcagaaaatgacgaggaaaaggacaaaactgttgcattgttggagcctcgacaaagccaaattaaggaacaaatgccaactatcttcaaacaatcaagaggttccccagattatccaatggcagacttggataccccgctgcatggaattgggaagcatgcacatcccaaggactttgtctgtccaataacaagttacatatttgatgatccagtgactcttgagactggtcagacatatgaacgtaaagctatcgaggaatggttcaatagaggaaacttaacctgtcccatcacacgccagaagctgcaaaacacccagctacccaaaacaaattacgtgctcaaacgactaattgcgagctggaaagatcgcaacccccatttggtcccaccatcgtatgagattccgtacgaagaaaccgaggaagctgtgaagctaacaatcccttcaacttctcctaatagcgttataacgcaagccacggtagatgggatgatgagtgagttacgctgtgcaatcaataacctttatatgtcagaggttctccaggaatctgaaatggccgtgcttcaaattgaaaagttctggagaggagtgaatgtgggagtggatatacatagcatgctatcgaaacctgcgataatcaatggatttatggagatccttttcaattctgttgagccccaggtgcttcaagcatcagttttccttttggcggagatggggtccagagacaatgctgttattaagactctcacacgtgtggactctgacgtggaatgtatcatggctcttttcaagaacgggttgacagaggctgttgtgttgttgtatctgctaaacccttccactgtgaatcttgcagagatggcaatagtggagtctctaataacagttttcaataagaaagaggaagacttggttaagatgtgtttgaagcccaaaacagctgcagtgcttttacttgcacggattattggaggcagtgaagagataatttcatcttcggttgtcaatacccttttctctgaaaaagcaataggaactattgtcggcagtttgggagctaacttggcaaaggagaggattgctgcagtggagatcttgttgagatgcatggaagaagatggcactagcaggaacaacattgctgataaagcagagctgacacctcttttggaaaccttaatcggtgcaactgatggagatcgatttaagattattcagtttttctctgagttagtcaaattaaataggcggacattcaatgaacaaatcctccacattataaaggaagaaggaccttttagtacaatgcatactcttcttatttatttgcagacagcccttcaagatcaatgtccagttatggctggcctcttactccaactcgatcttctggttgagccaagaaaaatgagcatataccgggaagaggctatggatactcttatttcatgcctgagaaacgcagatttccccgttacccaattagcagctgctgatacagttatttcactgcaagggagttttgacttctctggaaaccctctaaccagagaagtccttcttaaacgtgcaggtatcgagaaaagttccagaagtcttgtacaggaagaagagaaggcagctgatgattgggaaagaagaattgcatctgttctagttagccatgagtttggcactcttttcgaggctttagcagatggcatgaagagccgaaatccagaactacgatcagcatgctttatatcagctacatggctcatatacatgttgaccattctaccagatacagggatacaagtagcagctcgagcctgcttgctgaagcagttcatagctaaattaaattctactaaggatgtagaagacagaatcctttctatgcttgctctcaatagctttcttcatttctctgacggcttaggtgatctaacttcctacactaaggatatcataaaagggttgagagagctaaagagatcctgtcctttagcaactaaaatgctaaaggttctggttgaagaaaatgaatctaaagcggacatttggatacatacacagctcataaaagaagactgcagcgagaatggagaggttctgtctgtcatttgctttaaggataaatttttttcaggacatacagatggcactattaaggtctggacattaaaggataacttattctatctgttgcaagagatccaagaacatactaaggctgtgacaaacttggtgattttagaatctgatgacagactatacagtggttcacttgaccgaactgcaaaggtgcatgatatgaaggaccagattcataatttagttgtaaccaatagcttagcttgtttcattccgcaggggactggtgtcaaggttcagtcattgaatggagaatcaaagttattaaattctagtaaatatgtgaagtgcttggctcatgttcatgggaaattatactgtggatgccatgacagtagtgttcaggagatacatttggccactggaacagttaacactattcaaagtggttataaaagattacttgggaaagcaaatcctattcatgcactgcaaattcatggtgaacttgtatatgcagctggctctaacttggatggatccgctataaagatatggaacaattccaattacagtatggttggatctctacaaactggatctgatgtgcgggccatggcagtgagctcagaattgatttatttggggtgcaaaggaggtacattggaaatttgggataagaaaaaacacaatagagttgacacgttgcaaatgggtacgaattgtagggttaattgcatggctctagacggcaatggagaagttttggtaattggaacttcagatggacagattcagttactgaatctatggttaactgcaggcttggggaatgaattaaaagaagatgctgaaagtgcaacggtacaggaagacatagatgaaacttaccttgacatttga

SEQ ID NO: 21324 - DNA, 174 bp, Glycine max
  Peptide Sequence Number=SeqID_138102
atgacaagggacctgaaagaggaatgccgagcttcaattctgagttacccaattccaattcatggtcaagggaattggaaaggaggattgatgtcataccttgaagaatttgagtcaagaagcaaggggtcaaccaccttaagagctattggactaagaagcactccaaattga

SEQ ID NO: 21325 - DNA, 369 bp, Glycine max
  Peptide Sequence Number=SeqID_138103
ctgcatcactgccggcatcaagtgttccagaggtgtgtgcaattgcaccgcagcgtgcagcatggtttcttccaagcccaacagtttgcaggcttgctggttatagtgtttgagttgttggtgctggtctatgacaaggacgccattaggcatttcgcgtgtaatgagggcgttggttttggccagatgttcaatgtcctggccgcgttgggtagccaggttttcgctgctttgcatgcgagcagtcaggggccaaagctggctgccaaacagcatgccggaggctccgagccgatagaggctgtacagccgcaagtgctggctgtcaggagttctttctgcaaaagtgttaactggtgcaagcattaa

SEQ ID NO: 21326 - DNA, 210 bp, Glycine max
  Peptide Sequence Number=SeqID_138104
atggaaaaaaatagaagaagaaaaacagagtccccacaaagaattgcgagaaaggagaaggggagggttgtgacttgtgacggtgaaaaggtggtgcagcggagagtaagatttccgtttgagactgaatgcaatgattcttgcatacagtttgcattaatcattgtattcaatcttgaattgtccgtttggacagtttggggaaactga

SEQ ID NO: 21327 - DNA, 477 bp, Glycine max
  Peptide Sequence Number=SeqID_138105
atgcatggggctccgaataaaagtggagaatggagaattgcactaggcaatcacttcgcgtggctccagactcattggtggaagatgaatgaacgacaatcaattcatggggctccgaataaaagtggagaatggagaattgcactcggcaatcactacgcgtggctccagactcgttggtggaagatgcatgaacgacaatcaattcatggggctccgaataaaagtggagaatggagaattgcagtaggaaatcactacgcgtggctccagactcattggtggtggatgcatgaacgaaaatcaatgcatggggctctgaataaatgtggagaatggagaattgcactaggcaatcacttcgcgtggctccagactcaatggtggaggatgcatgaacgacaatcaattcatggggctccgaataaaagtggtgaatggacatttgcactaggcaatcactttgcgtggctctag

SEQ ID NO: 21328 - DNA, 201 bp, Glycine max
  Peptide Sequence Number=SeqID_138106
atggagcatgaaacattccttgcaacttggttagtagagattgatttctctcccaatggcttgagattctcaaatttgcaaccacagcctaggttaatcaaccatgaaaaacctatgctatgtgggtggcacaagcttcatcccttgaaaattgagggtaggagatttgccctggattcagctagggactactttccttag

SEQ ID NO: 21329 - DNA, 332 bp, Glycine max
  Peptide Sequence Number=SeqID_138107
atgaatttcaaatcctccccaatatttgttaatgcacatgcttggtgtagcttcggccttgcaatcgggacttgctgcgccgacaatctatgcgtcttgaatggtgcattctctgggattagtaggaggttccagcgtgtggacagaggagagggatttggtgaagaaggcaacgcggcggtggtgtggcgatggcggcgcaacgacaaagtgggatcgacaaagagagggagaaggaagctttctagaacaaaaaatggaaatgtagaaacaaggttgaggaactctagttatgctagtgcatgtggacccgtgcaacgtgtaaatcccag

SEQ ID NO: 21330 - DNA, 744 bp, Glycine max
  Peptide Sequence Number=SeqID_138108
atgttatccctcagccatatgcaatcacagggactcgcactgcctcctgaacctggtgttggtccttcaactgctcgtgtcagtacaaaggagagttgtgctgatccctcagggaacaatcaagacacgggtgactcatacaaatgcgggttgtatattgaagaatatcctcctcgcctggttgccctaggaagagtttatgaggggtccacaagcattcacaacattcctttgctgcatgatcaagtcaaggttggtgttgaggagattagagatgcaaatgctcccattcctgtacccactaaagaggttaaggtcatgggacaggctcttaacacattccttgcttggccgacacatcttgtcaagcgtttatcagaacagggagttgtgggacccgcgaaacctgtagatagaccggatgatgaggttgatgatcccctatatctaatgacattgaccatcccacagctttttctgaagccattgcaggttatgtgggatgctaccttgtttggcctattttatgaaaacttccctttgtacataaagcatgaagatctgtctgaaattgcacacggtggtcaatatctcagcatatctgttatacagttgtggattctacatatgactgagacaagtatgcgagccgggaatatcgatgtgtatggattcctcgaaccacagtctatccagagatctggccaatcacaatttgaatcagaaagttacattaagaattga

SEQ ID NO: 21331 - DNA, 377 bp, Glycine max
  Peptide Sequence Number=SeqID_138109
gttactgtgaaaacaattgtggggttgctgatgttgaagaagcgcgtcatctcggagcacgtgcagagagggctcgcgggggagacgactacgccgagagaaagaagcgcgaagtagaggatcggaacttggaggatgtttggggagagaacaagtgcggtgtcacctttggttttggcgcggtggaggagctcgccgtaggagaggcggtggccggtggtggagtcgataagggcaatggaggagtccaggaacagcgagttgcagcggaggcagaggacgaaggaggcggcagatacggcaacgttgggaagagggaggcggagcgggggcttaaggctgtggaaggttctggaatcgcgaagaagataagataa

SEQ ID NO: 21332 - DNA, 174 bp, Glycine max
  Peptide Sequence Number=SeqID_138110
atggaagtaatgtattggttccgaactaatgtctatgcaaaaagccctaaactttttagggtcctaaattgttggttcatggatgatactttaatggagatggtggatcaatcatggaatctttccaagtacaaggaaagcagcttttgtgctaacggagaagtgaagctgtga

SEQ ID NO: 21333 - DNA, 1935 bp, Glycine max
  Peptide Sequence Number=SeqID_138111
atgaaggaggtagagtttttcactgagtatggcgatgccaacagatacaagattcttgaagttgttgggaagggtagctatggagttgtttgttcagcaatcgatacacacactgggggaaaggttgcaattaagaagattcatgatatttttgaacatatctctgatgccattagaatcctcagggaagtcaagttgctaagacttttaagacaccctgatattgttgagattaagcggatcatgttgccgccttcaaagagggagtttaaagatatttatgtagtctttgagcttatggagtctgatctccatcaggtcatcaaagctaatgacgacttgacccgcgaacaccatcagttttttctttatcagatgctacgtgcaatgaagtatatgcatacagctaatgtatatcacagagaccttaagcccaagaatatactggcaaatgcaaactgcaaactcaaagtttgtgattttggattggctagagttgcattcagtgatgccccaacaacaactttttggacggattatgttgctacaagatggtacagagccccagaactatgtggctccttcttttcaaaggatagtttggctaaaatttattatacaccagcaattgatatatggagcattggatgcatttttgcagaggtgttgacaggaaagccactgtttcctggtaaaagtgtcgtgcatcaattagatttgattactgatcttcttgggacaccaccacctgaaactattgcaggagttcgaaatgacaaggcaaggaagtacttgatggaaatgcggaagaaatctcctgtgccatttgaacagaaatttccgaatgcggatccattggcacttcgcctattgcaaagacttttagcatttgatccaaaggatcgaccaactgctcaagaggcactagctgatcccttctttaagggtttggccaaagttgagagagaaccttcttgtcagccaatttcaagattagaatttgagtttgagaggagacgagtgacaaaagatgatgttagggagctaatatatcgggaaatattggaataccatccccagttgcttaaagattacatgaatggaactgaaggcactcacttcctttaccctagtgcaatagatcaattcagaaagcactttgcttatcttgaggaaaatcatggtaaaagtggcccagtgatacctccagaaaggaagcatgtctcccttccaaggtccattgttcactctagtacaattcctcctagtacacaaccatcttttacttcatacgagaacaagcatatggcagaagaggcatcaaaggttacgagatcagtagaatcaaattccggaagtcaattaaggagttcgcgacctccgccaagagtgccagcagaatttaaaatcaagaatagcgtggaacaacagaaaagaaacaaaaatgaattacactggctcaggaaagctcataaatcgatatggcactataaagtgaagctgaatatgaaaccagccaaaccaggtcgaatcgtagggccagttttgcactatgacaatgggagaaccttaaaagacacttatgaccaaaggatcttctaccgaaacacgcttcctcaagccgtctctccacactgtttccatagggtgcagcaacctactatcacaaaaactacttcagaaacatacaagaatatcccccaaggcaaacatcaactcccatcccaacagtgtagcatgccagctagaccaactattgatctaaataccaacccatactaccaacagggaaagagtgatcacttaaatgatcctgttgcttccattgatgcaaaactactgcaggcacaatctcaatttggtggagttggtgctgcagcagtagctgttgctgctcacaggcattcagggagctttcagtatggattgtcatag

SEQ ID NO: 21334 - DNA, 285 bp, Glycine max
  Peptide Sequence Number=SeqID_138112
atgtcaaaggttgaaggttccaagtatgaagaacttagaatgtggagaattgtagagaatcaagcaaaaatagaagctttatggttgtccaaattggccaccattgtcaaggataaaattcaaaaagctaagaaaaaggataaaaagaaggccaatgatgatgatgaagactatgtacctgaatatgaagggggacttagatcaaattcttcaagtgaaaattacgagaacgacaaacatgatgagtttgctattacaaatgatcttgagtcacgaaaaaggaag

SEQ ID NO: 21335 - DNA, 639 bp, Glycine max
  Peptide Sequence Number=SeqID_138113
ggtacatcctttgtggtacaagtagagggtacatatacttgggttgttgtgactgagaacaagagagggtacatctcttgtggatcagttctagtggagggtacatccactaggttgttcaaagagaacaagggagggtacatccgttgtggatctttgcttgtaaaggaatttacaaggttgaaaagaaatctcaaggaccacaggtcgcttggggactggatgccacttgatccaacaggtagctcctccaggatccattctatcagtggaacagttaatggaaaaggtatcctggcccgaaatcctgccttttattgtgagagacggtgggggtcccagtgctcaagttcctcagcaggtggaggattagagatgagacccaatgaggctgcttctcctgagccagtaccagtaccaactgatccaccatctctagtggtggatccatcttctcctgcgccagaagtagctttcccatctacacctcttattatctctaaagaccccatagttccagtacctgggttagccactactcctcctgctacccccgttctgcattttgcagatgaggaggagggacaaactactactcgcccggggactctagtgctacatttggatgataaggagtag

SEQ ID NO: 21336 - DNA, 285 bp, Glycine max
  Peptide Sequence Number=SeqID_138114
atgagttatgatgataaagggcctgccatagatgttgttgtctggtatgatggagaggtttggagggttgctcttgacacacatagtcttcatgatgatccagattgtgggaagcttgctaactttatacccttaaccaattatagtgctcttggtccatggcatggagtgattgcaaatgatgcctgtgtgcgtctttgccttcatgcttgggcaatgcagtgcatggaagctcctatgtttttggaaaatgaatgtgctttactgagggatgcatttgggtaa

SEQ ID NO: 21337 - DNA, 369 bp, Glycine max
  Peptide Sequence Number=SeqID_138115
atggacagagctaggttggtctatggcttggtgtttaacatggacatgaacatcggagcccttatctcaggtcagatttctttcattgctcagagtaactcctctaggctcgaatttccagccttgatcattgccctctgccgagctagaggagttacctctgacagtctaacctatgagagcctgagcccgaccattaacatggcttacaataagaaaaattgttggaatgtggatgatctgacaattaacttcagaggggcaaggaaggtaaaggctcgaccaactgatgctccctcttcttctactccaccagctccttccacttctgctactcctacaccagctcctccaggcctatctgcctag

SEQ ID NO: 21338 - DNA, 204 bp, Glycine max
  Peptide Sequence Number=SeqID_138116
atgaaaaggtgttatgggaaggcattggctgagaaaaatgttccaaatcacaataaatcatttagaggaaccaaaaatggtggcaacctgcatgttccaaaaactgatactgatttgacagagagaggagcatataataagaatgcgagcttcaccaggccttggtggtgccacaatgatctctttgttggaatacaagtgtga

SEQ ID NO: 21339 - DNA, 673 bp, Glycine max
  Peptide Sequence Number=SeqID_138117
atgccgggagcagacaagcccgtcaggggcgcgtcagcgggtgttgccgggtttcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgacagcagaggatcccccaacatcagcatctgcatctgctcatgcaattggaatcgataatgattccttagttaaaagtatattataccctgcactctccctttccaacattcttcacttcaacgtgcagatcatggtgggcaaggatgagcccgaggacaaaatcatcaaccgctttaagaaggaggtcctcaaagccagtgtgcttcaggagtgcaaacacacaaggttctttgagaacaaacacgacaagatcaagaggaaggcccacgaagcttctagaaggaaccgaaaaaggaagccacaatcaagagcttgggcaaaaaataaacatggttctataaagaagaaaaaggatgctgctaatgatgatattgatgattgggaacttccacatgtagatattccgggtaccgagctcgaattcgtaatcatggtcatagctgtttcct

SEQ ID NO: 21340 - DNA, 348 bp, Glycine max
  Peptide Sequence Number=SeqID_138118
atggaatttggtgatattgttgttcattttaacattcttgatgccatgaaacatccatctaaggatcattctgtttttcgtgctgagataattgatcagattgttgatgattatatgtttgattttgattttgttcttcatgagagtgaatttgaatttgagtctgattctaattttctgggtgttgtacctcttgatgttgattttttagagtcggaatgcactaaccatgttgcaggaagtacatatacttctgacttgctttatgaggtacaggctaagtctccagtgttgctttctcttgagaatcaagcacagctctctttgaggttttgttattactattga

SEQ ID NO: 21341 - DNA, 1265 bp, Glycine max
  Peptide Sequence Number=SeqID_138119
gtgatgcacacaagactgaggaaaaagaggatgaggtgtattatgaggccacatttgagttaccaacagagttcgggaaagttggtgctgttttggttgagaatgaacatcacaatgagatgtttttaaagagcatagtctttgatggtttccctgatggccctgtgcacctcacctgtgattcatgggttcagcccaagtatgataatcctgtcaagagagtcttctttacagacaagtcatacttgccatcacaaacaccaagtggattgagaaggttgagggaagaggaattggaactactaagagggaatggagaaggagaacgcaagagctctgatagaatatatgattatgatgtgtacaatgatcttggggatcctgattctaacattaacctcaaaagacctgttcttggaggctccaaacaatatccatatccaagaaggtgtcgtactggtcgagaacacactgattcagatccatcatctgagaagagaagtttagatttttatgttcctcgcgatgagacattttctgatgtaaaacagtcacaattcacaatgagcacaatatcctcaggactgagtgcaattttagaatccttagatgcaattctcactgaccaaaatcttggatttagaagcttcgaagacatagacacgatctacaaagaaggatttaagttaccacctcttaaaggcaatggcctaaatttcctccaaagaaccgttcccaggttgatcgaggctgctaatgatagccagaaccttttgcgctttgataccccggaaacacttaaaaatgaggaatttgccagagagactttggcaggggaatggcctctaagaagtaaactagaatcccaaatctatggtccaccagaatcagctatcaccagagaagtcatcgagccacatatactaggttatggcacaattgaagaggccattaaagagaagaagttgtacatgttagactatcatgatctattgttaccatatgtaagcaaagtgagagagattgaaggaaccacactatatggatcacgaacactattctttctcactaaacaaggaacattgaagccactagctattgagctcactaggccacctattgatggcaagccacaatggaagcaagtcttcactcctgcttcttattcaatttctcattcaaccaatctttggctttggaggcttgccaaagctcatgttcttgcccatgatgctggtgttcatgaacttataaatcattggtga

SEQ ID NO: 21342 - DNA, 336 bp, Glycine max
  Peptide Sequence Number=SeqID_138120
atgaatataggtagttgcttcttgagccaaggcaaactctctttcccagcaagtagtaatattagggttccgagagaggttcgcatagggtgcgtgtctcggcacgtgaaggctgtgatgaggaaaaagagtggcacctccaacaacaaccctaataaggctcagaatgcgaaggccattgtgattgtgaagcgaagtggtggtggtgggctactaacgaatctcgttagagatggtgttgaagggattgaagagttggttgggaaaactcttattttggagcttgttagcaatgagcttgattcaaagaaattaatatgtggcttgagtacgtaa

SEQ ID NO: 21343 - DNA, 381 bp, Glycine max
  Peptide Sequence Number=SeqID_138121
atgggggtgggtggtgatggggtcgccaagccagaagtgatgaaagggctgccgaaaatggtggagagagagggagggagaatgaggtccctcccctccctattcgctcctcccatcaccccctcttcctctcctccctccacaacaagcccctcaaatctcgacgacgtcaatggtagtgtcgatatggaggagtgtggtgtgaaggagcaagtgagcaaggttgaccttgaatatcttgcacagaagaagttgccatggcccatggcccatggcaatggtggaggtgtcatcatcgttgtcgttgatgttgtcaatagcgatgacgacgaatgtgatggctatttggttgttcgaggtgtgatgattgtggagtttgag

SEQ ID NO: 21344 - DNA, 222 bp, Glycine max
  Peptide Sequence Number=SeqID_138122
atggctggtatactcttccttttgaaacagcaaaatagtttagagattacgagtgtaattatatctgcctcccttgctgaagagcaagagaagaagttgttatcagttttcaagaagcataagaaggctataggctggaccctggcggacattcctgtgaagaaggaggtaactgagcttttgcaagctggaatcatttatcctatctccgacagccaatgg

SEQ ID NO: 21345 - DNA, 195 bp, Glycine max
  Peptide Sequence Number=SeqID_138123
atggagctccagatgcacacatacatgcgtcatttggctgactatgccactattgcatggcctagagataggcctatttttcaggaggaggcgggacctacaggcgctcaaggatctgcccaaggagatggaggaagagttgaggatgatgaagacatgacagatctggttgattatttcattggaggagactaa

SEQ ID NO: 21346 - DNA, 192 bp, Glycine max
  Peptide Sequence Number=SeqID_138124
atgtggaccaccacgggggagaagcttgccgcccagctcgcccaggcgagccaggttgcttcctccagaagcaacagccttctggagggcccaagtgggcctgctttcgaagaagttacgaaaactcacggattgcgaaaaatacctcctttcgattttcgtcacatcacggaattttcacggatcgcgtaa

SEQ ID NO: 21347 - DNA, 318 bp, Glycine max
  Peptide Sequence Number=SeqID_138125
atggtgggagcaggtttgaaaaaggatcttagagtgtctagggttgtgccaggagggtctcttaatgccttcctttttcttctcatcggagttatttcacaaagacttgccatgggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 21348 - DNA, 291 bp, Glycine max
  Peptide Sequence Number=SeqID_138126
atgatgttcctggctctttttggcctgccattagctggcatgttcctgcaaattctattctcttgctatccttcaacatttccagagaggttttgctgccaagtttcttctatgatccagctggctgctcattttaaatgtaaggcatttgcacatgagtttctagctcctctattccattggccccatctagggggaaatcagtacttcaattcccaatccaagtggaaggatgaaagggtgcaaaagatggggaggcttttgcatttttggatagcattcgaagaataa

SEQ ID NO: 21349 - DNA, 913 bp, Glycine max
  Peptide Sequence Number=SeqID_138127
atggcaactcgtagatatgcttttggaagagctgatgaggccactcatccagactccatgagggccactttggctgaatttgtttctactttcatctttgtctttgctggagaaggctctggccttgctttggttaaaatttaccaggattcagctttctcagctggtgaattgttggcagttgcacttgcacatggatttgctctatttgctgctgtttctgcaagcatgcatgtatcaggtggccatgtcaacccagctgtgacatttggtgctctcattggaggcagaatttctgttctccgtgccgtatactactggattgctcaaattctaggtgctatagtggctgccctcgttctcaggcttgtcactaataacatgagaccatcagggttccacgtgggacaaggtgttggagtagggcacatgcttatacttgagatagtcatgacatttgggctaatgtacactgtgtatggtactgcaattgatcccaaaagaggtgctgttagcaatattgcacctttggcaattggactcattgttggggcaaacatccttgttggtggaccatttgatggagcatgcatgaaccctgctctggcttttgggccttccttagtgggctggagatggcaccagcactggatcttctgggtgggtccactgattggggcagcactagcagcactgcttagcccgcatctggcggctcagcgcgcatctgacggtgtagcgcacggtcacttatgccagttggactctgcatatgcgcttagcgagcacatgctaaaagaagagaaggctcaagtagctggtgtctcgctaagcgaggcatgcagctcgcttagcgtgctgggaaactctagaagaggatcagttagagatgtgctcgcccagcgcgccgcaa

SEQ ID NO: 21350 - DNA, 1776 bp, Glycine max
  Peptide Sequence Number=SeqID_138128
atggtcttgtgcattgaacttgaggaatactatccagaagaaagagatgctttgatgctcataagggattctttgaattcttctgtcaatttgcatgggaattggacaggccctccttgtatagacaatcatagtagatggattggtatcacttgttcaaattggcatgttgttcaaattgttcttgaaggagttgaccttagtggttatttacctcacacattccttctaaacataactttcttgagccaacttgacttcagaaacaatgcactttctggaccactgccaagcctcaagaatttgatgtttttggaacaagtcctattatcattcaataacttctcagggtcaattcctgtggagtatgttgaaattcctagtctacaaatgttggagctgcaagagaattacttagatggtcaaattccaccctttgatcaaccatcattggcaagtttcaatgtgtcatataatcatctgtcagggcctattcctgaaacttatgtgctgcaaaggttcccggagagtgcatatggtaataactcagatctttgtggagagccattgcataagttatgtcctattgaacctcctgccccatctccttctgtttttcctccaatcccagcactgaagccaaataagaagaggtttgaagcatggattgtcgctttgattggtggtgcagctgcactgtttcttctttctctgatcattattattgctttcatgctttgtaaaaggcgaacaaatggaaaagaatcaacaagaaatgattcagcagggtatgtttttggggcatgggcaaagaagatggtgtcttatgctgggaatggtgatgcttctgaaagattaggcagattggaattttccaacaagaaattgccagtttttgacttggatgatttattgagggcatcagcagaagtgctaggaagagggaacttaggcattacatacaaagcaacacttgaaacaggaactgttgttgcagtgaagagaattaaccacatgaatgaagtgagcaagaaggaatttatccagcagatgcaatcgcttggccagatgaagcatgaaaatctagtagaaataatctccttttatttttcagaggagcaaaagttgataatttatgaatttacctctgatggcactttgtttgaactcttacatgagggtagaggaattggaagaatgccacttgattggaccacaagactttcaatgatcaaagacatagcaaagggtctagttttccttcatcactctttgcctcaacacagggttcctcatgccaacctcaaatcatccaatgtcctaatccatcaagatagtaaaggttaccattgcaagctcacagactgtggtttcttgcctcttctccaagccaaacagaatgcagaaaaactagccataaggaggtcaccggaatttgttgaagggaagaaactgacacacaaagctgatgtctattgctttggcatcattatgctagagattataactggcagaatacctggtcatatcttaggtgaaattgaggaaacaaccaatgatctttctgattgggtaagaactgtagtgaacaatgattggtccacagatatattggatttagaaatactagcagagaaagaagggcatgatgcaatgctgaagctgacagagttagctctagagtgtacagatatgactccagagaaacggcctaaaatgaatgtagtattggtgagaatagaagagatagagcaaatgagaaaagagaatgactaa

SEQ ID NO: 21351 - DNA, 687 bp, Glycine max
  Peptide Sequence Number=SeqID_138129
atggctcaagctggagaaactcttcatgacaaaatcaatctacaacaagttgcttttgaaacaatgtgtgtttggcctccgaataaaaataagaaagaaaaaggtagcaagaagaacaaagttgatctaaaggacatctgtagttactgtaaagaacctagtcattggaagaaagattgtttaaagaaagtaaagaaatattttgttgctttagtggttcaaaatgattcctcatcaaaaaacgatttggttttggttgttgttggtgaacaaccacaacaatattccgaacaatgggtattggactcgggttattcttatcatatgtgtccacatagaagcttgttagtaatgcaattttcgtgggtgccatggattcaaaaggtttttcttgctgagttgaagctggagttatgcaaatcagaggaaaaaggaagtttaaggaagcaaaatcagacgaaattcccaaaggttgtgcacactacaaaggccacattggactatgcctattttgactattgggggccttcaagagttccatcactgggaggcacaaggaccaccgctagcagcaatcctattcctctgggccaagcggaagatgttcatatcggtactagcttgagtcatgattcctacaaaatagaacaagtgataaatgaacaagttacagcaaggaacccataa

SEQ ID NO: 21352 - DNA, 903 bp, Glycine max
  Peptide Sequence Number=SeqID_138130
atggcaggaagagaagttcgtgaatacaccaacctcagcgaccccaaagataagaaatggggcaaggggaaagataagattgacgatgaagacattactttccaacgcatggttgcaaaggtaggattcgacaaatttctatgtctatgggatgaacacctcagcatgaaacttggtgttatggatggacttttgtaccttagcgaggaatccatattggggattttgctgataacatgccccggcagggatattggcttcctgtattgggtggctgatgcaagcagatgcaagaggttgctggggagcgcggaggttaccttcatggacgaggcgtttaaatgtgcagccttggacagtgatgatctactttatctcaaagagcaaatggaagccgaggaggatgcagaacgcctcctgcgtcgcactgaaaaacgggcatttgctgcatttaagatatccttttgtgcggtaaagttgcgccttgatgactggttggtcatgggtttgaatccggaaacagcctttttgtatatccaagctgaatacagagctgcaagtttagcagattcttcacctgcatcagtaccactggcatttcgggttgagccaaagcccaaaagtgggatcaggcagcaagacttgctgaagaaagttgttgagattaaacctaagcggccaagatctgatgcaaatcgtaagcctgatcacgatccttcgaaagagaaagagcagtctttgccaagaacaaagaaagtggaggagcaacctttgtctggatcaaagaaagcagaggaacatgctccattggggtcacaagaagccgaagctaagcctaaggttgaaagctccagtgggggattactgggcctggcatatgatagttctgatgatgatgaatga

SEQ ID NO: 21353 - DNA, 1464 bp, Glycine max
  Peptide Sequence Number=SeqID_138131
atgagagaaaatatttcagaatcatggctattagttatgagcactgtgatactggccactgcaatatttgcaaagctatttcaattcaagttaaggacggaagataaaagcaaatgcagattaccaccaggaaggagaggctggcctttgattggtgacagcatcaattggtacaatgctgttgcaagttctcatcctcctcagtttgttgaagaaatggtgaaaaggtatggtaagatattttcatgcagcctatttggaaaatgggcagtggtgtcagcagatccaagcttcaaccggtttgtaatgcaaaatgaaggaaaattattcaagtcaagttacccaaaatctttcagagatttggttggtaaaaatggtgtgatcacagtgcaaggagatcaacaaaggaaactacacggaattgcctccaacatgatgcgcctagagaagcttaagttccatttcttgaatgatgtacaaaaggtcatgctccaaactttgagtaattttaacaacaaccaagtcattcttcttcaggatgtttgtagaaaggtggctatacacttgatggttaatcaactattgggggtttcaagtgagtctcaagttaatgaaatgtctcagttgttttctgactttgttgatggttgtttatccattcccatcaacatccctggctatgcataccacactgctatgaagggaagggagaaaatcattggcaagataaacaagaccatagaggtacacagacaaaatggtgcttccattgaaggtaatggtgtactaggaagattactagaggaagaaagcttgcctgatgatgctgttgcagacttcattatcaatcttctctttgcgggaaacgaaacaaccaccaaaacaatgctctttgcagtctatttccttactcaatgtcctagagccatgaaacaactgctggatgaacatgattctctgaggagtagtaattctggagatgaatttcttacatggcaggattataaagcaatgacattcactcaatgtgttattgatgaaacactaagacttgggggcattgcaatttggttaatgagagaagcaaaagaagacgttcaataccaagattttgttattcccaaagggtgctttgtggttccatttctttcagcagtccatttagatgagaatgtatacggtggagctctaaatttcaacccttggagatggatggaacctgaaaatgaggaaaaaagaaattggagaactagttcattctatgcaccctttggaggaggtgctagattctgtccaggagcagagttggctcgcctccaaattgctttttttcttcattactttgtaactacttacagatggacacaaatcaaagaagataggatgtccttctttccctctgctcgattggtgaatggttttgaaattcgtctaatgagaagacatgataatgaaacagattaa

SEQ ID NO: 21354 - DNA, 1848 bp, Glycine max
  Peptide Sequence Number=SeqID_138132
atggcaatgccaatagctcaatcatgtaagaaatttccatgtcgcatttttcttctcttgttcttcttgcttggtcacacaagctcacaatctttgtatgatcaagaacatgcagttttgcttaacataaagcaatacctccaagaccctccattcctctcccactggaattcaacttcctctcactgttcttggtcagagatcacatgcaccacaaactcagtcacttccctcactctctcccaatccaacatcaacagaacaataccaaccttcatctgtggcctcaccaacctcacacaccttgacttcagcttcaacttcatccctggtgaattccccacatccctctacaactgctccaagttggagtacctagacctctcaaggaacaactttgatggcaaggttcctcatgacattgacaaattgggtgctaatttgcaatatctcaaccttggctccaccaacttccatggtgatgttccttctagtattgcaaagttgaagcaattgagacaacttaagcttcagtattgcctattgaatggcactgttgctgctgagattgatggcttgtccaaccttgagtacctggacttgtcctctaacttcttgtttcctgaatggaagttgccttggaacttgaccaagttcaacaaattgaaggtgttttatctgtatggaaccaatttggttggggaaatcccaaagaacattggagatatggtgaccttggagatgctggatatgtcaaataatagcttagctggaggaattccaaatggtttgttcttgctgaagaatctgacctcactccttctttatgcaaatagtctctctggggagataccaagtgtggttgaggcattgaacttggtctatcttgatcttgcaaggaacaatcttacagggaaaatacctgatgcttttggaaagctccaacagttatcatggttgagtttgtccttgaatggcttgtcaggtgtgataccagaaagctttggcaatcttccagctctcaaagattttcgcgtgtttttcaacaatttatcaggtactcttcctcctgattttggccgttactcaaagcttcaaacctttatgattgcatctaatggtttcactgggaagttaccagagaatttgtgctatcatgggatgttacttagcttgtctgtttatgacaataatctgagtggtgagttgccagaattactaggaaattgcagtggtttactggatttgaaagttcacaacaatgagttttctggtaacattcctagtggtctttggacatctttcaatttgacaaatttcatggtgagccgtaacaagttcactggtgtgcttcctgaaaggctatcttggaatatttcaaggtttgagataagttacaaccaattttctggtggaattccaagtggagtatcatcatggactaatttggtagtgtttgatgcaagtaagaacaattttaatggaagtattccatggaagctaacggctcttcctaagttaacaaccttgttgcttgatcagaaccaactcagtggggcacttccatcagatataatatcatggaaatccttagtaactctaaatttgagccaaaaccaactctctggacaaatccctaatgcaattggtcagttacctgcccttagtcaacttgatctatcagaaaatgaattctctggcctagttccttctctaccccctagactcaccaatctcaatttgtcttttaatcatttgactgggaggattccaagtgaatttgaaaattctgtgtttgctagtagctttttgggcaattctggtcttgtgctgatacaccagcactga

SEQ ID NO: 21355 - DNA, 936 bp, Glycine max
  Peptide Sequence Number=SeqID_138133
atgacagaacaaaacattattggtagtggtggatatggtatagtataccgcattgatgttggttcaggctgtgttgctgtgaaaaagatttggaataacaaaaagttagacaagaagctcgagaattctttccgtgcagaagttagaatactgagcaatattcgtcataccaacattgtgaggttgatgtgttgtatctctaacgaggattctatgctccttgtgtatgagtatctggaaaatcacagcctagataactggctgcataagaaggttcagtcaggttcagtcagtaaagtggtccttgattggccaaagaggttgaaaatagccattggaattgctcaaggtttgagctacatgcaccatgactgttcaccacctgttgttcatagagatataaaagcaagcaacatccttttggatactcaattcaatgcaaaagttgctgattttggactagctaagatgttaatcaagccaggggaacttaacactatgtcatctgtgattggctcatttggctatattgctccagaatatgttcaaacaacacgagttagtgaaaagattgatgtgtttagctttggggtagtcctattggaactgacaactggtaaggaagcaaattatggagaccaacactcatctctttccgaatgggcttggcgtcacgttcttattggaggtaatgttgaagaattgctagacaaagatgtcatggaagccatttactcagatgaaatgtgcactgttttcaaacttggggtcttgtgcactgctacactgcctgctagtaggccttccatgagggaggcactacaaatattgaaaagcttaggagaaccatttgcttatggagatcagaagaaatttggccactactatgatgctattccccttctcaagagttcagacaaggaaactagattgaat

SEQ ID NO: 21356 - DNA, 378 bp, Glycine max
  Peptide Sequence Number=SeqID_138134
atggcaaggagggcaaggatgacaaaagacccttcatgggaggatgttcgaaagaaggcgcaggccattcagaaacaaaaccctgctcctcacgtgttgtctcgtaggggttatgattttttagaacaaaagcaaaagaaacgattagaggtagcaacccaatccaggagtactgacacagtcgttgatcctccatctcccattagacgacatgatgtattgactgctgccattgggcgaccaaagcaccctagtcgtgtccatgctcctagagccggtgtcacgatcaaacactactttggactggcttcaaggggctcccgcacctcttcatccatggctcctgaagacctagagcagctaacacaaaggatctaa

SEQ ID NO: 21357 - DNA, 330 bp, Glycine max
  Peptide Sequence Number=SeqID_138135
atggccaacaacaatgaagaagaggaagaagaagcagtggtgcaaatggtgaagttgggttcttacggtggtgagaggagacgatgctactttggggtgtttaggaacccacactttccaaacccaaagcctttgtctctcaagcttccttgcaactctcactcgactcttgtggccactctctctccattcttcaatccccttccactttgggcattttggacttttgatctagggggcacctggactaatggagcaatgatgtgggatagtggaattgtattggagaaggttctagaggattttgttgactcagggatgctttgctga

SEQ ID NO: 21358 - DNA, 645 bp, Glycine max
  Peptide Sequence Number=SeqID_138136
atgaaggtcgatatgaaggccatgaaggagcaaaggataacaatgatggaggcgatgatggctataaggaagataatgaaggttaacattgttgcagttgttgctaccagtactgctactaagagggacacaactcacctgcctatttttaaacaaggaagtcacccagtgatagatgtggaaggtcaaggaggtgcgatgggcgtagcttcatatgggcctcagtacacccagagccacaatagatctatttttccaccatatggcctggctcctgtaaaaaggatgaaatttgtgaaggctagcaactggtgtctcgctaagcgaggcttcgcatcatcagctcactcagcgaggcgtttgtctctttctgtgctaagcgcgcccagttcactcagcggatattcactaactcgcactaagcacgaacattgcactaagcacgacttcgaggacataaagccctttttaaagcctgaagtgaaggaaaagagagagcttggcaaaaagcgtggattagaacgtagagagcaaaacagagcaaggaggtcgaaaacctcagctttcaagaggattttaggtttaggagtaatttctaggttcctaaaggctaagttcgacgagacatccgagaatgaggtttaa

SEQ ID NO: 21359 - DNA, 555 bp, Glycine max
  Peptide Sequence Number=SeqID_138137
atggattacgcaacaatgcttgtttcgagggttctgaagggagcaaacaagggaagtaaagataagacattaatttcgttcgagtggaacatcattcggctgatcaatagcccaaccagtggaacctgtcattcagaaagaatagaaaaggcatcaggtatctctacatactaccggacccttgagtctgatggtagaaacgagactttttcgcagtctcggtcggaagatgctgacatttctaggaaaggtgcagaagatgacgctcgcttgcctctagttgacaaaggtgcagatgatgacaagatgctgacatctccaggaaaggtgcagaagacgacgttaatctctgcgtgtcaacaggctcacttgcctctagctaacagaagggcgaggacagaaattgtcatcccgggtcaaggttcatgggatgtcccacattatttccatgacacgcacgcaacagtgatgattcagaaattttatgcaaaactggtcacacatgcacctatgtggacactcaagcatcaagtttttgtggtcacgcaacactag

SEQ ID NO: 21360 - DNA, 270 bp, Glycine max
  Peptide Sequence Number=SeqID_138138
atggtcataacttttcacacagatgtcagattcgggcgcataatacatcgagacgctcgaaattgcacagcggatgctattgagaaattcaaattgtcatcacttttcacacggatgtccgattcaggcaaaaaatatataatgacgctcgaaattgaacaacgaaagctctcgagaaattcaaatattcataacatttcccatggatgtccgattcaggcacataatatattgagaagctcgaaattgaacaacggaagctctcgataa

SEQ ID NO: 21361 - DNA, 465 bp, Glycine max
  Peptide Sequence Number=SeqID_138139
atgaattgtgttttcgttcatgcgtcctccacccacgagtttggagccatgcgtagtgattgcttagtgcaattctccattctcatcccttttttggagcccatgaattgtgttttcattcatgcgtcctccacccacgagtttggagccatgcgtagtgattgcttagtgcaattctccattctcaacccttttccggagcccatgaattgcgttttcattcatgtgtcctccacccacgagtttggagccttgcgtagtgactgcttagtgcaattctccattttcaacccttttttggagcccatgaattgcgttttcgttcatgcgttttccacccacgagtttggagccatgcgtagtgattgcttagtgcaattctccattctcaacattttttcggagccccatgaattgcattttcgttcatgcgtcctccaccttcgagtttggagccatgcgtaa

SEQ ID NO: 21362 - DNA, 138 bp, Glycine max
  Peptide Sequence Number=SeqID_138140
gagtggaggtcaatttgtggtcatgttgggtgtccaactcgcttgatgacagtgaagtctcatctagagttttcctcttttagtggtgcattgtcactgatatttcctatcgccacaatgtattacctaggaggatga

SEQ ID NO: 21363 - DNA, 201 bp, Glycine max
  Peptide Sequence Number=SeqID_138141
atggaagtggatgaagcagttgctttagtcattgaagaacttggcattgacagagaccgcacaattaatgagaaggaatttgttgttgggtttgagaaatggtttagctcaactttagctcctgcttttgtagcaatgccaacttcaccactctttcatttgtgcatatatataagacttgggaagaggctgacatcgtag

SEQ ID NO: 21364 - DNA, 312 bp, Glycine max
  Peptide Sequence Number=SeqID_138142
atgcatttagaagccaatatagatgcaacagacagagaagaaacttcagcttctgcacagtggatccttgatattggtgatgggattgttgggcagcaaaatgatggttatggttcaattgaaattccaaaagatctattaatcacaaaatatgatgacccactatatgcaattgttaattctacatttccaaatttatctcaccatcataacaatcatgaatactttcaatctacagcgatattagcttccacaaatgaaatcgtacaacaagttaatgattatatactatcattgatcccaggtgaataa

SEQ ID NO: 21365 - DNA, 507 bp, Glycine max
  Peptide Sequence Number=SeqID_138143
atggacaaggccaagtcaccaggacacggagggcttttgatttggacttggaatgaggagtgggtagtactgggcaagttggtcaaagaaatggtcaaagggaagctagtgtattatattgttaatttgacccaaggatactcatcactagccatagcattagttctgccagaatcaagtcgtttagttgcttgtgaaagacatgccaaatctcttgatgttgccaagaagtattatcagctagctggtgtttcacataaggtagatgtaaaacttggacttgcaatggattctcttgaatctttaattctaaatggtgaaagaggaaggaactcttccacattcagaaggttgaaattgttattgcttctggaatatatacaagttgatctcaattacgcctggatgaatgtcacaaccaaggaagatggcttacagaacactgatcctaaccctacagaaaagtggtgggttgcaatgggtcataggcatgaaaaactattctaa

SEQ ID NO: 21366 - DNA, 315 bp, Glycine max
  Peptide Sequence Number=SeqID_138144
atgcaggaaattcaatttcatttttatgaagatgggaaagagtttgagggaaggagagttagtgaaaaaagaagaagagggcaaagccatcatgtcaaatctggaaaaagcaaccatgaaaaaaaggaggaaggggagtggatcttagatctgaaaaaagaaaccatgttgagggcgaagctgtatctctcgacggtggcatcgatagggagaagatcaagtggttgtcctcggagtcgcaattgtcagagaagaactctttggccaaagatgggaggacatggagtggatctgaaaaagtctagagtacaataa

SEQ ID NO: 21367 - DNA, 732 bp, Glycine max
  Peptide Sequence Number=SeqID_138145
atgtcagagctctccataggagtgcaggccggacaggaacatgttcacgcccaggaacgcgaaacccgtcaccagcaggcccaccagggcccagtaggcggcggcgttgccgcgcaggcccttgatcagccgcatgtgcagccaggccgcgtagttgagccagacgatcagcgcccaggtttccttcgggtcccactgccagtaggcgccccaggcgtcggccgcccacagcgcgcccagcaccgtggccacggtgaagaacgcgaagcccacggcgatggccttgtacatgatgtcgtccagcacctcgagcgcgggcaggcgctcggcaagctggcggcggcccagcaggatgccgccgacgatcagcgcggccacgccggcgtaggtcatccagtaggccggcatgccgctctggcggaagatcatgggttcgaccgccagcagcacgcccaggacgaacagcggcgccagcttcacccacgaggaggtcttgccgtgcgccttgacgaggtaggcgaaggcgaccatggccgccagcgagaacgtgccgtagccgatgaagttggcgggcacgtgcaatttcatccaccagctttgagcgccggcaccagcggctggatctgctgcgcgccgcggtcgaaggtgtaccagatcaggaaggcgaccgcagaggcgatgaccagcagcacgaagccacccaggctgcgcgtgtcgtacttgcgctcgtag

SEQ ID NO: 21368 - DNA, 689 bp, Glycine max
  Peptide Sequence Number=SeqID_138146
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatg

SEQ ID NO: 21369 - DNA, 184 bp, Glycine max
  Peptide Sequence Number=SeqID_138147
atggcccgcaccaagaaaattgcccaaatgatgtataaggcagcaaaggaaattactgacaagattgattccttggaggagcaggcctcacagggttcttttgtcagtcatggacgtcaggatatattggctgctaccattaggcgaccagaacacccttttcgtgtgcatcctactagagctg

SEQ ID NO: 21370 - DNA, 438 bp, Glycine max
  Peptide Sequence Number=SeqID_138148
atggcgccaaacatcgtcggagaagaagaagctgacgacattcatgcaaatcataatgatcatgatgaagaagaattaattaacatcaagtggacaagaaaagccatacacttgagaccattggctactagaccaattggagcagagagactcatggtccatgtggatcctgcaaccagcaaagccaacggtccccacagaaagaagttaagaacatatttggggatcatcgctcgtgataaggtggatttgacatacgggaattggaaacaagtccttgcggcccaaaaggatttgatatgggaggatattcatgacagtgtcgatgacattgtatgtgaaaagtatggcattagtaagcagaagtggacccaattttgtcagagccgcaaagatccttcgtgtgaggatgtgcgaaagaaggcacgggccatctag

SEQ ID NO: 21371 - DNA, 840 bp, Glycine max
  Peptide Sequence Number=SeqID_138149
atggagttgacctctctagactcagaagaagaaaggacacacagcatagagtgtgtttgtttggttgatgacttgggaaaccgtaccatgcgaccctgtctctctaatgctgtgaaaattcaggcagaggaattgaccaaagaggattttaaaggctccaagtggttggtgttaagatatgcaatacttaatttggaagttattaaagcagccattcttttagcaaaacaggaaggtcttcttgtttccttggacttggccagctttgagatggttaggaatttcaaacaaccacttctgaagatactggagtctgggaatatagacctttgctttgccaatgaggatgaggcaacagagcttctacggggcgaacaaaatgctgatccagtaactgctgtagaatttcttgccaaatactgccaatgggccgtagtaacactgggtcctaatggatgcattgctaaatatggaaacgagattgcacgtgtcccggcaataggagaagcaaaggcaactgatgcaacaggggcaggggatctttttgcaagtggatttttgtatggagtgatcaaaggtctgtcacttgaagagtgctgcaaagtgggcgcatgcagctatgaagcaccgacactggacacaatacggacacggacacgtggataccggacacttatacggacacgtgttggataccggacacagcaagggactggagtattcgtgcttcataggcatgcaatagtgggtctgttgttcgctctctggcggcgaagtcactttgaagaattgccactgaatgtacaaacaaatgcaaataaaggatcttcccacgcctga

SEQ ID NO: 21372 - DNA, 738 bp, Glycine max
  Peptide Sequence Number=SeqID_138150
atgcagcaagatataagggattttgtgagaaagtgtattatttgccaacaagccaaggtagaacaagcattgccagctggcttattacaaccacttccaattcctcaaagaatttgggaggacattgctatggactttattacgcatttgccatcttcacatggttattctactatccttgttgttgttgatagactatctaaatttgctcattttataccattaaaagctgaattcaccagcaaatctgtggcaaatgcctttattattaatataatcaagatcgtgtttttatcggtgccaattattcaaagcctagggcaccacattggctatgagttccgcttatcatcctcagtcggatggccaaacgaaggtgttgaacaagacactagagatcctggtttgagatgcttcattgggctcaattttggtacaacacttcctttcatcgcatcattgaagttcattggtagctcaaagcagccttatttaccattaccattaacagtgggtgaaagtggtttgatggttcaacccatagcagtattggattcaaggtgggaaattgctggtcctgaggaagatacatgggaggatgtgacttgggttaaggcaagttatcctcacttcaaccttgaggacaaggttgtttttaaaggggagggtaatgtaacatgtgggaagcaggagggaaaattggcgcgagtcagttacaaaggaaggacatgtggttga

SEQ ID NO: 21373 - DNA, 330 bp, Glycine max
  Peptide Sequence Number=SeqID_138151
atggatcagactggagaggaaaggaagttgcaactaagtgaattagatgagatatgtttagaagcctatgagaattccaaattctacaagaagaagaccaagaagttccacgacaacttgatagctaagaaggacttcgtggttggacagaaagttttattgtataactctaggctcagactcatgagtgttgagatcaaaagtgaatccacagataagatcttcaaggtcaatggacaccagctgaaaccattcctcacaaatccctccttagtggatgtagtggtggaggagacctccttacttcaccctacttctctttcgccatga

SEQ ID NO: 21374 - DNA, 1203 bp, Glycine max
  Peptide Sequence Number=SeqID_138152
atgtatgatggaaaatttacaaccttacaaggagagaatgatataattccaggacgggctcatttacatcatatcaggaggatgttgaatacagatgttattgctgagatttttactatgcaattaattgagcccaattctgtacaatttcctttgttggagttgcccactgatatggagcctgaattggccttacttttgcattcttatagtgttgtgtttggaactcctacgtcattacctcctccacgagctcatgatcattccattcccttagtggatggttatcaaactgttaaagtcaaaccttatgggtaccctcacagccagaaggaggaaatagagaaattggtgaatggtatgcttgaagaaggaattattcagccaagtaaaagtcctttttcatctccaattcttttggatcatttgtctcatttggaatttgtgttgagcagtttgaagcagcatcaattgtttgctagattctctaaatgtgcttttggagttagagaaattgattatttgcgacacaacttatcaagagctagtgtagcaatggagacaacaaaattacaagctattttggattggccattaccaaattctcttaagcaattaaggggatttctgggcttgacaggatattatagaagatttgtgaaaggttatgctacaatagcagcaccattaactaatcttttaaagaaggactcgtttaagtggtctgcaagtgccactactgcctttaataagttgaaggaagtcatgacttcagctccagtcttagccattcctaacttcaaggaaccttttgtactagagactgatgcttcaggtattggaattagggctatattaagtcagagtgaacatccaatagcttatttttccaaaaaactatcatccataatgcaaaaacaatctgcttacattagagagattcatgccattacggaagctttggctaagttcagacactacctattgggccataaattcattatccgtactgatcagaaaagcttgaaggaattattagagcaaaggttgcaaactcctgagcaacaacaatggttacccaaatttttgggatatgattttgttattcagtacaagctgggtaggcagaatattcttgtggatgcattgtccataagtttttctatggcgtggtctgaagcagtaggagtgtggatgacttaa

SEQ ID NO: 21375 - DNA, 573 bp, Glycine max
  Peptide Sequence Number=SeqID_138153
atgaaggtgaaggtgtcagtgttcattgttgcggtggttagttcgtcgttgacggcatatgagcaacacaaccagaagaagaacacgcaaagcccacatgaagagcaccaccaccacgcggccaacaatggtgaaaaagcaagaaccacgtcgctgggaacagttgagcatcccccttacttgtccaacactgaaggcatagggagagagagagttctcgaggaagaagaaaaagagtatgacacggacgtgacgacatggagcccggcggggaggctgttccaggtggagtacgcgatggaggcggtgaagcagggctcggctgcgatagggctccgatccaagacccacgtggtcctcgcatgcgtcaacaaggctaactccgaactttcatcgcaccagaagaagatcttcaaggtcgacaaccacatcggcgtcgccatcgccggcctcaccgccgacggccgcgtcctctcccgctacatgcgatccgagtgcatcaactataactacacctacgagtcaccgctccccgtagggagactcgtcgttcagctcgccgataaggctcag

SEQ ID NO: 21376 - DNA, 606 bp, Glycine max
  Peptide Sequence Number=SeqID_138154
atggattatcaactatgtgatgttttatggcaatcagttgagccagatgttttggagatccttagatcattcaaaacatatcgttctttctggaaaaaggcccaagatatctttgccaatggcatccaaagtctgtttgatgcgactatgaaggttacgactctcaagcagaccagccatgacatgattgcacatatgggaaaagctagggctactgtggaagagttgaagaggttccttgtggctgattcattggaggaagtgaacagaaagctggataaattttacatggttcttattttgaggagcctatactcagattttgatcatgtgcatgatcaagttcttgctggagatcaagttccttcaatggaatctctcatcaccagacttcttcgcgtgcctcatgtattgaaggatgaaaatcttgctgatgttgtggaaacctcagccatggttgcatctcgtgggagagggggaggccgcaaaaatagaagaggtcgtggtggaagaggtggacatcctcattgcacttattgcaagaagatgggccacactcaagagaattgttactcattgcatggttttcctgaaaaagtagcatag

SEQ ID NO: 21377 - DNA, 282 bp, Glycine max
  Peptide Sequence Number=SeqID_138155
atgagataccaaggaagaaggggattgaagaatgaagagagtggccacaagagtcgagcgaaagttgataggaagcttgagagacaaaggcattgggtttggaaagtgtgggctgctgaatgccccaaagcagcatggtctcctccgcagcagattcctctcaaccaaccatggaccgaacctcaccatcgtaaggacccaacttcaccattggtgccactcgttgttgttggccatggtgtcctcgctctctctgtctctcggattcaattgggtttttaa

SEQ ID NO: 21378 - DNA, 618 bp, Glycine max
  Peptide Sequence Number=SeqID_138156
atgacagtgttatgcaaagagcttgaaggtagcaccatatcctcccaccaaggcctaaaacccaacgaagagcttttcaagatgcaacttggacctaaacttgggcagtgtacgcagatctgtagggacctcactagtcatgagcaccgacgcattgccagcgtgctacacaaaaacacagatttgttttcttggcagctatccaacatgctgagaattcatcccaacattatataccataaacatgtcgtatatccccaggccaaaccaatatcacaaaagaaaaggaagatgggagaagaatggtgcaaatctatcaaagaagaagtggacaaactcctcaatgccaacttcatcgaagaagttagagtgtgccccaaagatgcataccctctgcccagaatcgacaagctagtcgatggagcgtctgggtttcgcgtgctaagcttcttggacgcttactccggatacaaccagatcaagaggcacgctccaaatgaggagaaaacaacattaatcattgaagacgtagacttttgctacaaggtcatggctttcggcctaaaaaacgtaggcgctacataccaacgactggtggaccgagtctttaaatcatag

SEQ ID NO: 21379 - DNA, 294 bp, Glycine max
  Peptide Sequence Number=SeqID_138157
atggctattgaaagagtatatatcacaaacaatacatcagttgtacaagatgaagttctttcccatagattgggtctcattccaattcgtgctgatcccaagctatttgaatatctagaaaatgcaggagatgacaagaatgaaaagaacaccattgtcttcaagctacatgttcgttgtcaagtgggtcaacctcgtattattggttattcaacatttaacatcgatgctgacgtaagcaccgatatggaaacacacatttgttacatcgttcatgaggtaacaccgacttag

SEQ ID NO: 21380 - DNA, 621 bp, Glycine max
  Peptide Sequence Number=SeqID_138158
atgctgcttagacgcaaactcgggcaatgcatgcaactaagcaggaacctcaccatccatgagcatagatgcatcattgacgtcctacataggaatgcggacttgtttgcttggaagccatctgacatgctaggaatccaccccagcattatcttccacaagcttgccatctgtccccgggctaaacaggtatcacaaaagaaaaggaagatgggagaagaacgacgcaaagctttcagagaagaagtagaaaaactccttaatgctaacttcatcagaaaagttagatactccacatggctcgccaatgacaaatggcgaatgtgcacaaactatactgatctgaataggggtcatgcgctttggcctaaaaaatgcagacactacataccagagattgatggaccgagttttcaagcagcatattggataaaatgtcaagacctagaagaagtcattggaaagctctgcaaatatgacatgtgcctcaacccggaaaaatgtactttcggggtcgacggaggcaacttcctaggcttcatgatcatgcatcggggaatagaagccaaccccaaaaaatgcactgttatcatggagatgcatactcctactaatgtctag

SEQ ID NO: 21381 - DNA, 297 bp, Glycine max
  Peptide Sequence Number=SeqID_138159
atgatgcttacctctgtgtcaggaagttgttgggcattttctgttgtggctactatggaaggaatcaacaaaataaaattagggaagctggtttctctctctgaacaagaacttagagactgtgatgttgaagatggaaaccaaggctgtgaaggtggcttaatggacacaacatttgcattcataaaaaagaatggtggtttaaccacttccaaagactacccttatgaaggggtagatggcacatgcaactctgagttctacaactctgcactaatgcatgatacacttctttaa

SEQ ID NO: 21382 - DNA, 708 bp, Glycine max
  Peptide Sequence Number=SeqID_138160
tgctaggatctgatgtagtgtacagtgagggggatgttttggatctgctagagacccttgtgcagctctctggacctaatacaacaatttttttggcgggagaactccgaaatgatgccattcttgagtatttcttagaaactgcaacggataatttcactatcggccgcttggatcaaaagctctggcaccctgattattgcagcaatcctgcagtggcatggagagctggggaagcattggtgatggaggaagtagaagtgagtcctccccaaccaatggagattaggattaaggttgtctccacctctctctgtcgcagtgatctctccgcttgggaatctcatgccatatttcctcgcatatttggccacgaagcatcagggattgttgagagtgtgggacagggagtgactgaattcaaagagggggaccatgtgctaacagtattcattggagaatgcatgtcatgcaggcagtgcacatctggaaaaagtaacacttgccaaattttgggattggaaaggaggggtttaatgcatagtgatcagaagacacgcttctcattaaaagggaagcctgtttaccattattgtgcagtttcaagtttcagtgaatatacagtagtccattctggatgtgctgtgaaagtcagcccccttgcacctcttgagaaaatatgtcttctgagctgtggggttgctgcag

SEQ ID NO: 21383 - DNA, 1599 bp, Glycine max
  Peptide Sequence Number=SeqID_138161
atggactcatcaccagaccagacccgcaagaggaatcagaatcaaacgctggcgcaaaaatcacttttcctctatttttctttcctcttcttcctcctcttcttttcctcctcgcaccactctttttactcccacacctccctccaaccctctgctttcgccactccatactccaccaccaccaaattgccagtgtctctctacgtgcacgatcgtattctcttccctgatcacgtgcttctcacgctatccaacccacaagttttccctcctcacaaactccactgcctctactacatcctcatcaacaatccagctttgtcgaacccggtttatgacgttctcgtccgcccggttctctccacggaccggtacgacgaattccggtccatcgcgaggtgtccgcttcccagcagaaacttctccgccgtcgaattgagctggcgcgatggagacaatgataaccagcctttccggttcccggttaaaccgaccgcgcagcatagcttcgacatgctagcgtacgaggtagccttagacaacgacacagcagttatcttcgttaaaggactaaacctccgaccccacaaaatttccaacgcgagcctattgcgatgtcacttcggacctcaaaacggtgcgttttggttcacaacaaaagccgttgcggcggcgcaggaagtcgtgcggtgcgagctgccgcagagtattcagaacaatccacacaaggctcgcggaataagcgccactgtgagtcacgtgcgggacgaggcaatgatcccttcggtggcgaaaattggcgggtacagagaagaaataaacagaggtaacaagaaaaagaacaagttagaactttgcgcctgtaccatggtgtggaaccaggcacgtgcgatgaaagagtgggttatgtaccacgcgtggctcggcgtggagaaatggtttatatacgataacaacagcgacgatgaaattgatcacgtggttcgcgagcttgaggtaaagggttacaatattaatagagttgcgtggccttggattaagagccaagaagcagggttttcgcattgtagcttgagggctaaggaggaatgtaagtgggttgggttctttgacgtggacgagtttttctacttcaacgaaatgaggcgaaatgctttgatatcaattgttggaaatttatcgaattcgattgcggaaataaggacggggtgtcttaatttcggaccttcgggattgaggactcaccctagaaatggagtgagcgtagggtacacgtgccggcttcggacgccggagaggcacaagtcgattattcggcctgatttgcttcatgttagtcttttgaatgtggtgcaccattttgaattaaaggagggttttagatcgcttaacatgcctcaatctgttgcggttataaaccactataagtaccaaatttgggaaatttttaaggccaagtttttcagaagggttgctacgtatgtggtggattggaaggaggatgcgaacataggatcaaaggacagagcgcctgggctaggaacagaagcaattgaaccgcgtgattggaggcttgttgccctgggaaaggtcttctga

SEQ ID NO: 21384 - DNA, 696 bp, Glycine max
  Peptide Sequence Number=SeqID_138162
atgcatgtctttgaaatcaaccctgctgatggcaaggatgttgagggtacaaattctggatgtagtgttcaaggttcaactgtggactcttcccaattagagccttcagtaggaaaagctgaaactcaaccacaactattggaagaaaatgccagaagtggggactcctttcatcttgagctttcagcagatgaaactgaaactctagcacagcctactgaagagaatatcagaacaaacttgggcaatatgttctgttccattcttatgaaactatgttcaatggcgaataaaacttctgaatctgctaatcctgggaatcttttagttgagactgatctggtaaattttgatacaacatctttgatagctcttgtatcaggaattagtaattgtggaacagagaaacttttggccactccagagagtgacatgaggcagcggtttaagggaaactacgattttgtgattggtcaatatcatgacagggttgttcttgatactccctcagaacgcatgatggacctcccaacaactaggaagctggcattgaaaaacaaggttgtctttggcaccggtgaccattggcatgccccaactttaaccacaaatatggcatttgtcagagctgtttcacagacggggatgtccctttctacctttgaacatagaccaagggccttacctggtgattag

SEQ ID NO: 21385 - DNA, 213 bp, Glycine max
  Peptide Sequence Number=SeqID_138163
atggcagaacatcagagacttcaggtccataatgtggaggtagaagcaccactgccaccacagtatatgcctcttagagaagggctcaatcaggttcctcaagatcagaaaagcaactgcaggactcctttaaaacttcctaattattcaatcgacaggctgaggataagtgatttgagaggaggaattctattggacctggttgaatcatga

SEQ ID NO: 21386 - DNA, 321 bp, Glycine max
  Peptide Sequence Number=SeqID_138164
atggctttgacatatcattttattttctatctcttcaagaagaataatactattggtgtcattggttgcagaaatcccccaccttgggggaccgtgaaatatctctctgaaaaaattcctaaggatacttcaagcaaggtgcgaataaaccgcgatttgtactcttatgaaaggatcatggagacagcaccaacattgcctgatttttcattggccttgaaaccagatgaatatcaacttcctcaagtggactcatcttggagaacagagaacataaaagtgggacaaactgatcctaaccatctcaagggtgacaagtga

SEQ ID NO: 21387 - DNA, 654 bp, Glycine max
  Peptide Sequence Number=SeqID_138165
atggctgaaacttccaaatttcattcagccttagctatcaccaatgtgaaaacactcatccccacattggacttggaatcaggacaataccattcctgggcggtgtcattcaaggttcacgcaagggttcataacgaacttgaacatatcatcccacctaccgatgcaaaggagaaagttgtgtatgacaaggtcaaatctgatgatctccctctctggaaacggctggatgcggcacacaatgttgtggatctctttcatgataataaaaactcaagggcactgtatcttaacaaggcattcaccaacataagtcttgctgattttttgacgaccaatgcgtattgcaatcgtctcaaaagtcttgctgaacaactagccaatgttgggactctcgtcaatgatcaaatggctcaaatgatggctccgatactagtggtggatatggaaaacaccaacaacagtggtagcctgggccttggatgcagtgggcttcatggacttgccctccttctccatatcctttctactttcagtcctagaccaccacaacctggtcttcttagaccgaagcctcagcaggcaacttacaatgcaaatgtacctagcccaactgatattgaagcagctcttcatactctcagccttgcttaa

SEQ ID NO: 21388 - DNA, 171 bp, Glycine max
  Peptide Sequence Number=SeqID_138166
atgacaacaaaaacaataactgaaagcagcaatgtaaatcacaaaaaagtgcggcgaccttggtcatgtggctccactccctcccaagaaactgagcagactcttcccctgtctgggcatcgggccagtctccaggccatgcgacctcagtcccaaactgctccggggtag

SEQ ID NO: 21389 - DNA, 495 bp, Glycine max
  Peptide Sequence Number=SeqID_138167
atgagtgttgcgcttagcggacgctcactaagccaacaaattggcttagcgagaagacttaggtttcctgctttgattatcgctttatgccgagcccgaggggttgtctctaacagcctcacatttgagcgcctgagcccggccattaacttggcctacatcaggaagaactgttggaacgttgatgatctaacagttgctttccggggggctaagagggcgagggcaaggccagctgatattccatctacttctgcagctccagcacctactccagcatctacttctgcagctccttcagtcccagctcatgttgactatgagcgctttaaagccatgcttcaaattagtgtcgcaacctacccttcggcgggagggcgacgcgggactcacgggatgcgtgttccacaaaaggaatacgcgcggagtcgccaccaacgtttatttgaggaaaacgtcggaaaaaccggaaaaggcgcgatctacgaactttaa

SEQ ID NO: 21390 - DNA, 363 bp, Glycine max
  Peptide Sequence Number=SeqID_138168
atggctaagcacgcctgtgcgcctaagcctcagtgtctctctgttgaggctgagctaagcgccagcatatggcttataggaaaagaaaggcaccatctacacccacccaagttagatttgacagatcaagattcacttcccaagaggcttgggaaagatacagacattattgtgcctaggaagcttctgccagagaggaacatggcggtctactatatagagttcgatgagttcaaggaggaactcgaaagaagccactgggacgaggagttgactgactttggggatggcaacattgatgttgccattgtgaaggaattctatgccaacctctatgaccccgaggacaaatcacctaagtag

SEQ ID NO: 21391 - DNA, 330 bp, Glycine max
  Peptide Sequence Number=SeqID_138169
atgaacaagcattccttcccaccatatggcttgcctcccaactatacaccacccaatgttgcgcacactcccgatgagaatgtcgataactccgcacccatgcccattgaaagccaacaaccccaatctgatcatgcacatgtctctcaacctatgggggagacacatgaagcaccccgagaccacaatctagtcgacttcgagcttcacgtcggatatgccgctgaggggcaggcgttttgcagtgtacccctgccaaacactttgggggcccctcagtatctcccacagccacaacccttgcaaagtccttgcttttatctttcatag

SEQ ID NO: 21392 - DNA, 441 bp, Glycine max
  Peptide Sequence Number=SeqID_138170
atgaaggtaggaaagggtgactatgaggttgaatggagagaaaatccaacaatagggaatgctggtggattagtgacttcgtggaagaaagggattcttgaagtggagaatacttatgttggtgatggcttggtgaggtttttggaagagaggagaggtgaccaaaatgtggaggtgggaaactttgagatggaagagttcaacttgttcattgaggagatggaggtaggagatattccgatgatttgggaagttgttagggttaccggttttgtatgttcctcgcatacacccaacagtcacttaccccgaacacttttgggactttatttatacacccaacagccacttaccccgaacacttttgggactttatttatacacccagcagccactttgatgcaatcctatcctgcaaggggattggatagaagactctaa

SEQ ID NO: 21393 - DNA, 264 bp, Glycine max
  Peptide Sequence Number=SeqID_138171
atggagtcgtcatctgtcgcaacctacactacgacggaagtgcgagcgaaaagccaaagtgcatcttctcatgaagaaaacgcgtggagtcgccaccaacgtttattgaaaggaaacgttagaaaaaccaaaaaagggttgtggattttgaaaataagggttcgggagttgtttacgcatggggaaggaaaatggacaattggggcaatggcagctcgcccaggcgagctgatgcttactcctgaagtaactggctctccctag

SEQ ID NO: 21394 - DNA, 1770 bp, Glycine max
  Peptide Sequence Number=SeqID_138172
atgttgcgaggaagagcaagagcttcccttcattggttccctcttcttcttcttccacacttcggttctctttcaaattccacacactttcgttcttcttcaaacttcacaaacagagcccaattccttgattccatgagagacctcaaaagtgaagaagctgctctgagtttcttccacaaaatggttgtcatgaaccctctccctcgcgagaaggatttcaccaaattgttcggcatcatcgtgaagatgaaacattacgcaaccaccatttcccttatcaaacacatatattcattagggatcaaacccgatgtgtacacactcaccattatcatcaattgtctgtgccatttgaaccacacagtgtttgggttctctgttttgggagtcatgttcaaaattggtgtggaccccacagtggtgacttttgccacactcattaatgggctgtgtgcagaaggcaatgtggctcgagcagccaggtttgctgacagtttggaagacatgggccatcaatccaacagttacacctatggcgcgataattaatggattgtgtaaggccggtgacacgtccggtgcgatcttgtatcttgagaagatcaagggaagaaactgcgatttggatgttgttatagcttacagcacaatcatggacagtctttgcaaggatgggatggtatgcgaggctttgaatttgttctccggaatgaccagtaaaggtattcaacctgatcttgtcgcttataattcactaattcatggcctttgcaactttggtagatggaaagaggctacaactcttttgggtaacatgatgaggaagggaatcatgccaaatgtgcaaacttttaatgttttagttgacaatttttgcaaagatgggatgatttcgagggcaaaaactataatgggtttcatggtccatgtgggagtggaacctgatgttgttacatataattcggttattagtggtcattgtttgctaagtcaaatgggtgatgctgtgaaagtatttgagttgatgattcacaagggcttcttgccaaatcttgtaacttatagttcattaatccatggatggtgtaaaactaaaaacataaataaggctctctttttgttgggtgagatggttaatagtggactaaatccagatgttgtcacttggagcactcttatcgggggcttttgcaaagcagggaaaccagaagctgccaaagaattgttttgtacaatgcatgagcatgaccaacatcccaatctccaaacatgtgccattattttggatggactattcaagtgtcaatttcattctgaggcaatatcattgtttagggagatggagaagatgaatttggaacttaatgtcgtaatatacaacattgttctggatggaatgtgtagttttggaaaacttaatgatgcacaagaactcttttcttgtttgccaagtaaaggcataaaaattgatgttgttgcttatactacaatgattaaaggtctatgtaaagaaggactattggatgatgctgaaaacttattgatgaaaatggaagagaatggctgtctcccgaacgagttcacttataatgtctttgtccgaggattgctgcaaagatatgacatttcaagatcaacaaaataccttttgctaatgaaaggcaaaggtttatcagcagatgctactacaactgaattgcttatcagctacttctctgctaataaagaaaatagtgcattacatgtgtttttgcaggagtttgtttga

SEQ ID NO: 21395 - DNA, 393 bp, Glycine max
  Peptide Sequence Number=SeqID_138173
atggctgaaatccccatcctcacagtgcctgatttctgtcaaaccttctgcatagagactgatgcttctaataagggactgggtgcagtcctcatgcaacaaggaaggccagtggcttttctaagccaaacattgccagaaagagcccagaaaaagtcagtgtatgaaagggagcttatcgccatcgtcatggctgtacagaaatggcaacattacttacttgggaggaagtttgtcatccatacagatcataggaatttgaagttcctgaaggatcagagagtgttggggagtgagcagttcaggtggacttccaaactcgttggttttgattttgagatcctctacaaacccggaagtgacaacagggctgcagatgcactgtcaagatga

SEQ ID NO: 21396 - DNA, 492 bp, Glycine max
  Peptide Sequence Number=SeqID_138174
atgtttgcaacctcctcctcgtgtttgccatcccctcgtcgcgattgccacctcctcgacggcatcgttcccatggaaaggagtgcatcgtcatacaacttcaagttccaaactcgtgtgatgtgtttgtgtaacgtaaaagctccactggtgacattgtggactaaggataatccaaggaggcatttttatggttgtggtttatacggggttacaggtagaaaatggtgtcaattttttgagtggcacgatccagttgtcaacagtcatgagaagaggatcattgtagcattgatgaagaaggttgatgaattgaaggttagagaaaaaggggaatatgatgtaatggtgacctatattgatcccatggtgcaattttgtttggacagaaaaaaggacaaattctctttgcaagtggtgaaggaacttaagaaaagtgatgttgggttcatgaaacatgtggaagaacttcaagaacatgtgtgcttgtaa

SEQ ID NO: 21397 - DNA, 480 bp, Glycine max
  Peptide Sequence Number=SeqID_138175
atggaaatccaggctgaggacaagttgtggagtattatgcaagatttatcaagcaactcatctgcacaccctgttacacttttcagaataggaagttatgagcccttagctgttaaagctgttcacaaccatccttttggaacagcagaggtattaattcagtggaaggatcttcctgattttgaagcaacctgggaatctgtcacttccattcagcaacaatttcctgcatttcaccttgaggacaaggtggctcttttggggggaagtattgttagacctccaattagagagacttacacaaggaagactcacaagaaaatagaaggagaagagaaagggtatcagggaacacattgtcccattggaggattcatcaagaaaaacacagttctagcacactccttccagcttaataattcattctcgttcagcaactataattggggaacactgaaaagtgaaaacaactttctgtaa

SEQ ID NO: 21398 - DNA, 465 bp, Glycine max
  Peptide Sequence Number=SeqID_138176
atggggagaattagtgaatggggatatggagtaagtaggaggttggtgaggcctcaaactcactgtctccgatcttggagcccttttccgttcatggtgtcgaaagcgaatgcaaggatggaaacttgcatgaaagctgtcgagaaagcaatcgaagagaaccacagagctcgagaattgggactgacttccataaagttagttagcatgaaaatggtcaagggtaccatgctggaagttgaccaagggtttaatgtggaagtcaaaagggtagaagaagagaagacaagggaagccgtgtatggactagtggcccaggtgttgacacagtttgagcaagttttccaggagcctcaagggttgccaccacatagagagagagaaagatcatgctattactatccaggagggcacaaggatacccaatttaaggccttacaaataccccaatcaccagaaggatga

SEQ ID NO: 21399 - DNA, 213 bp, Glycine max
  Peptide Sequence Number=SeqID_138177
atgttgcaacctacccttcggcgggagggcgatgcgagggctcatgggtgcatcttccaagacaggaaaatgagcggagtcgccaccaacgtttattcgaggaaaacgtcggaaaatccgaaaaggtgtggtctacgaactttaattgtgaaagggtgtttccctcgctcctacgtattcctcaattgggatgaggaaatcagacctacgtag

SEQ ID NO: 21400 - DNA, 378 bp, Glycine max
  Peptide Sequence Number=SeqID_138178
atggtggtgctgatggtcggtgacaaagacagtattagtggtggtagcaatggtagtggtggaaataattgtggcagtggggcagacattggtggcagtgacagcaatgacgatggtagtcgtgatggcattggcggtggttgtgacaacaacattggtggtgatgggagtagtggtggttatgacaatgacggtgatggtgatagtaatgtcgatggttggtggcactatggtaataaaagtgatactagtggtgatggtgacattggtggtggtggtagcaatattattaatgttggtgacgatggtagtagcaatgacggaggtgatattggtggtagtgacaatgaatgtgtcactagtgatatctatcggtga

SEQ ID NO: 21401 - DNA, 1281 bp, Glycine max
  Peptide Sequence Number=SeqID_138179
atgggctgcgtggtgtcaactacgaaggactctggtggaaatagaaggaggccagggagtattggtgaagtttcagtatatgttcctggtttgaggattcctaagcctgttgattttgctcaatcacttggcaattatttgtccaagaatatagtggaacacctgtctgctcttagaatgcgcatagttataatggctggtcaagaaggtcctacaattacaagaacaaaaagaaaaactcagcatggaggttcaatgctggctgatcttctgcaggctcttgaagattacttgcctgttgttctgggattagttaaggatggaagccatttacaatataaagtacaatttacttgggtgaatcaagaggatgacaaagaggaaacaaccatgtctaatgcttggtatgaggtgttgtcagttttgcatttgatggcaatgctatcactatcacaggctaacttgttactgcttccaagatcatcatcctctgatggtcatctgccaaaagtatcagaagaaagcagacgaacctctgttgatattttccttaaggctgctgggtatttggattgtgcagtcaaacatgttcttccgcagttgcctgtggaactcaggagaaatttacccgtagacctagcagaaggagttcttcgagcactctgtctacaagcattaggacagaatttgtgtgatggaatatatctgtatggtgaatcttcctgggagaaaagttctgtgataccgatattgaatggaagcttggagaaggaaaatggtatagatatacaacttggaatggcaattgatagtaccaaagccactcttgcagttaagcgtaggcttgcatgtgagatggtgaaatgctggcagcaggctcaagataacattatgaatcttccattagcaaatggttggggtgaaaaacattgtctttttgtgaaatggaaatatgttgaagcaaagactttcttagtggtgagaaacagtgtgatttggatatatgagataaggtatctgcatggtagttgtggtgtggttgtaaatgctcaagctgcagcatattattatcatggtttgattcttgatgagggaaatacagaaaaatctcatgggatggctgtagctgctttgcaagcagcagatgagtattacaaagaaagtaagaagttgtgtgaggcattcaacgcagcatctccattgtcaagaaaacagggtttagccttctttaagaacttgctgtaccaacagttagatgtaatgtacatgttttctaaataa

SEQ ID NO: 21402 - DNA, 294 bp, Glycine max
  Peptide Sequence Number=SeqID_138180
atgagacatgacaaggggtgcccttgtcaacgtttaaatgtgacaacaagagaaaaggcttcaaaagcacagtggtggcaaattgaagaagctgaggaagttaatggaaagcacaagagtgcaattcaattcaactcaaaatccaagaaagcagagattttgaaaggttcccagaagcacaaccaccctgaaggtgaagatgaagatcgcacaaccaaaatttcaaaggaatgggactcaataacttttgcttcaaagagagcaacagagacagatagagagaaccttccgtga

SEQ ID NO: 21403 - DNA, 1467 bp, Glycine max
  Peptide Sequence Number=SeqID_138181
atgggtataaagccatgggtattgactattgagtactttttcaaccactatagcagaatggaacaaaatgcgtgcgaggaattgtcgaaaattgcttcggatttcaagtgcgagaagaaggttctcgaaacagttgatgaatcaatcgtatgccccactccacagaagaacgaggaacccttaatcgttaaattcagagagggacaaaccaaccttcctgaaaaatactctgcacttgtagatttgtttggtcacacaagctgttcactcaggttgctgcgtctgtgtaaaaagtctccaacttttcaaaatgtttgccgacaggttgaagttctttcgaagagggaattctcccatgcccatcttgcgcagatgaagtatatactccctaaaagtgtgtgtatagataaggtgcttgttcatgataagaaaagcttgtgtatggtgcctgatatgaagatcacgttgagatttgaggttgtgaaagattgctctggcgaatctgatgatctggctcttcgacgatattttaaatctaagctgattgatttctttgatatgcatcctgaggttgctgacattccagaggccccactgccagaaccctttggcaaaaaaacttgtagattgaattttgaagaatttactggccaatccccacatgtaaattcttcaacggaacttttgtcaatttccaatcaaactgaaatgttgccagagcaattgcaactgtatccatctttccgtagacacttttctaggaagaataataccgaccaggcagaaaaggctcaatgctttttacccacaaaaacttctccatcatctcatgcatctgattgtctggataatgaagaaagtgaaaaaacactgcagaaagaatgtgtaccattatttgatggggtggctaatcctattactgaaagagggcaccagaaggaatcattttctatgtctttgcagcctagctttattaatacaccagtacagatgatccgccctccatattctgttacgtgcagtaattctgaaagcccggatatgaaaaatatctcctgtgttgctgatagttttattgcagagacacctgcccagtcagcacctgcaagattattgcccatttccgatgttaagcttcaggacatgcctacccaaaagtcaacatcatctcataagccagcaaaaagagtgcttgacttttcactcatgggggacaatgatggcttgggcattggagtagacaagttagaatctagcagagctctgcatgaatttgatagcttccctgaatctagcagaggatgttatgaggattgcaattcttttgggtctgtttctgcacctcaggaggagggcacacatgcatgcggagatgaaaaaagtgggataaatgagatgtttatgggaactggcaagataatgatgaagataaggagtgagaaatgtgttgaaagattgaaactgtaa

SEQ ID NO: 21404 - DNA, 435 bp, Glycine max
  Peptide Sequence Number=SeqID_138182
atggcagaaatgggaaagttggatcatctagaggaaaggctcagggccattgaaggaggcgaagattatgcctttgctaaactagaagagttgttcctagtacccaatatcatcacctctcccaagttcaaggtgccagactttgtcaagtacaaggggactacttgttccaagaaccatctaaagatatattgtcagaagatggggacatacgcaaaagatgaggaactactgatacatttcttccaagaaagtcttactggggtagctgttacctggtacactaacttggaaccttcccgagtccattcttggaaggaccaaatggttgccttcgttaagcagtgtcagtacaattctgatatggctccgaataggatgcaactacagaacatgtgcaaaaagggacatgaatctttcaaagaatacgcctaa

SEQ ID NO: 21405 - DNA, 621 bp, Glycine max
  Peptide Sequence Number=SeqID_138183
atgcaacaaaattcagtcaaggaaacaaatctacctgatgacaatgacattttatccaacatagagagtagtcttcacaaacaacaacataatgatgtaaatgttttatatggcgatggcgagcatgcaaaagaatcattacaaatgtttgatgcaaaagatggtgagcagaatgaagcgaataatatgtcattacaaattcatgaagctcaaagcaattctaatgttgccagacaggttgaacatcccgatcagaagggtgatttctctgatgatttggttaatgcaatcaaaagagttgagtctcggattttgtctttccaactttcttcaaatttaagtgattccactaatgcaggtcatcatactacacatgaggcagcaaattcagacagtcctgtaatacagacaaacaatggggctttaggaagtcagatgagtggtggaaagtccctcttggaaggacatagtttgatgaaccagaagacatgtaaagcaagttgtgagggtgaaaattcgatttcagcaaatgcatttgtggaaaccttttgtgctgtaaatcagaatcattggcttcataatagtgcaaaatatgcaaatagcatggatgaaccaaaatag

SEQ ID NO: 21406 - DNA, 408 bp, Glycine max
  Peptide Sequence Number=SeqID_138184
atgcttctttctgaaatagttggagagaaggatattgagataggaagtgttagtaaaggaagttcaataataaagcacagagtcattgtaactactcgggacaaacattttcttgaaagtcatggggttgatagaaaatatgaggaagaggatttaaatgaggaagaagcacttgaattgcttaattggaatgcttttaaagatgacaaagttgatccatgttataaggacatttcaaaccaagcagtggcttatgcttctggcctttcactagctttggaagtagtagtgatggaggttatgggtaaagaaattgatcgacaagaatcaccaaaggagcttaggaaacacatgagttaccgtcgtgaaaagtcaaaactttccatgacggttctcaaatcatcttag

SEQ ID NO: 21407 - DNA, 183 bp, Glycine max
  Peptide Sequence Number=SeqID_138185
atggcgattgatggccttgccctcctgtcgtatgctatttgcactaatggttactttgaaaggccgtctttggaaaaacatgcaaagagactaaaaacctttactcaactcaaggaggataaaaagttaaatatacaagtgatgcaatcctaccctgcaagggcattggataaaagactctaa

SEQ ID NO: 21408 - DNA, 784 bp, Glycine max
  Peptide Sequence Number=SeqID_138186
gatccaagtccgttattgcaagaagagaaaagccaccacttcatcagatggtaatgaaaccaactctattggaccagagatcaaaagaagaactcataagactgatcatcttgaaccatggaaaacgagggttctaccacaagatcataaactggaggaggcaaactcaaagtctgactcttcccgcttgagttctcggcaaggcagtgccaatagtagtagtgactctgaggactactccttgctagatggaacacaatgtccatcatcaggacgaatggtggatgaagcatatgaaggcagttcagaagagagtaacaacttatatctcgagaaggatgatggcccttctcgactaaggaggctgaaaaataagttgggactaatctttcaccaccaccaccatcatgatgatgttcatggtcatagacatactatttggaatcagttgcagaatatgttccaccataaagacaagcatggggtgacaacaaataaagtagacaagacaaggagaagggatgttggaagagtgttgccttggagaaaccaggttggacagtttcatagaattgcggaaggggttttgagacacatccagcattcaaagaaaccaaagccttccaagcttgatgggatgaaacagttaaggaataccacacatggacatagtcagaagaagccatgctggtggcaaattcttcgaccacaccggagagtgaagctgaaaaagaaaggccgagttaaaatggggtttatgagccaaaaatcactaaagaactag

SEQ ID NO: 21409 - DNA, 291 bp, Glycine max
  Peptide Sequence Number=SeqID_138187
atggtggactgcaggggtaaaagtgccatgcaacattatgtggcagcacgtccaatgttcattgatgtggaaataatgaatgcagacactaagctggttcttggtgaccaggctgcccaagctagtcctagtaatgttgttcgtgggctttcctccttgtacaaagaaatcacagaagctgcaacaatcacgaccatattcccttcaccaagtgaagttatgtcaattttagttcagatgtcgtaccggatgtcacgacatcacgcttcagaacatgcagattatatttga

SEQ ID NO: 21410 - DNA, 639 bp, Glycine max
  Peptide Sequence Number=SeqID_138188
atgggtggcttattacaccatttgacctcaagaaacagagttaaagtgggtttagaggatctgaagaagggagtgagagagaggatattaagggatgatgaaaggtggctatctttttttaaaggattcgggatgtggggaaaaagggaaatgcagaaaggattttcctgtgcactagtgaagaaagaagcatattctcaactcaactacccaacaaaagggataagagactgtccgttgagacttgagaaggcaacaatggaagagtacaatggatgcaggaaacacatcaaaatgattaaaaatgcatgtatgtctccatttgagatgcaagacatcttactgccttccggcacaaatggtgttaaagacctacacatttctgcttctcatagtagtagcctagctctctttgcttctctaggaaagaaattatcagtgctcagcttggacagcggcaaccttgttgtcaattatgacctacagattggtattgcttgtttgatggaagcttgcttgtggggcttctatggaggctggatctttgagcttcaatggggtcctttaatggtgattttccaccatggagatgcagcagaagacaaaggagaagaggtgagaggaggcaccatccattaa

SEQ ID NO: 21411 - DNA, 406 bp, Glycine max
  Peptide Sequence Number=SeqID_138189
atggtggaagttgttgtcggtgagatgtgtgtggtggcattgttatcgatggtggttgaggggaactccatcgtcatcgttgcgaaagttgttgtcagtggtggttgggaacaggcagaggtggtgacagcgacgagaagaagaaacttagatgctaagagagagattggatgtcatggtgagggtggtgcaaacacagtggcagaggagagtaccgccatcaccaaccatgaccggaagggggttaatggcggtggtgggaagaatgaggaattgcgcgaccctagcttacatgaaattatggggtcggcggccaatggtttaagcaagctggtcacaatgtctggcactggggaagatagcaagagctccgagttgtcgtcagcgatgaagaaatgtaggcgag

SEQ ID NO: 21412 - DNA, 1581 bp, Glycine max
  Peptide Sequence Number=SeqID_138190
atgacaaatgagaatacaacaggcattgagatagattatgaatatgaagattgcagtaattctaagcgcccaaaaatgacttctaaagtatgggaagaaatgcagcgaattcaaaccactgaaggtagtaaagttctgtgcagacactgcggaaaactgttgcaagataactgtgggacttctcatttaaagcgtcatttgatcatatgccctaagcgtcctaaaccactggatattattactcaagattcaatgcctacagtgtgttttagaggtcccagtagtgtcaaagattctggattaaatacagtgcttatggttcgcccattaaaggtcgaacctgaatctcaaatcccatgtttttctcagactccaaatattcgagttccaactgctattgcatccattgaaaattctcccagtcccgtacaagaactacatccaaaaactagttctgctcttttgctgcctagcatagaatctcccaagaatcaaggggaactgactctggatgatgtagaaatgaaagcattttatgcttctcttgatgcccagacctcagatatgtcaccttcccaagacaccgctgtcattactgaattatccaattcaacaccttgtgaagagaccaagaaagcattgacaacgctgaaggaccttctttgcaaagacttctctgatctattgcatactggacaatctggttccatcaaatcttccatagaatacctttccaagttgtctgcagatgatggagtctcagcagaaatgaggttgttgatattagaagtttcaagagaattcactcgctggagttgcgactacaatgatgccagtaggaaaatagagtctgccagcaccaacatctcgaaagcagataaactagaaggaaatcttgaagctaacaagaacgagttcaaggaagttatgtccttagaaaatgagttaagcaaccagttatcatgtttggagaaaaggaagaaagagctagaagagcagataaatgcaattaaagctaacatttctgtttttcaatcggctaaggtaacaagtacaaagagaaaaagggaagtttttgaagaagcaaagattctgaaagtacaaagagatgagttgagggaacaagtgcctcacttgagaaatgagttggaagtggccaagaaaaaccaagctcatattcgagctgaatggtcaaagcttggagaaaaatttaacaaaagcttgaatgagatgaattgtgagcacttgcatggcaaatctatcgaggattgggaaattgaccatgttccaactctcactgatctcaccattgatttccctgtggtgacactgtgcaaccagccaacagtgtggaggctcagcaaggtggggtcaggcttctggtttgtgagcactagtgatcttagcttcaagttctgccatagtgtgcctggtgtgctttgtgctcctgtggggacttttgaagatgctgatggaaccaaagtcatggctgtgggggataacattgagccttactatgtgaggttagagcgagtctccacctttgggaaagagaagaaactaccttttagcattgtgtag

SEQ ID NO: 21413 - DNA, 153 bp, Glycine max
  Peptide Sequence Number=SeqID_138191
atggagggttggaccttccatgtaaaacgatgccaccgtcaagcattcgttgtccaacacgcactggtagccaaagaactgggtgattttaaaaatccaccccagtggaaggagaggagtgagtgcgacggcagtggagaaggaaggtggtga

SEQ ID NO: 21414 - DNA, 275 bp, Glycine max
  Peptide Sequence Number=SeqID_138192
cttgtggttacgtgagcatgaactactttcaatatatatatgttgtttacacaaatgagcacatcttaaaagcttactccacacaatggtggcctcttgggaatgaagcgacaattcctccttctgatgacgcatggacacttatccctgatccaactacaattcgtgcgaaagcaggcgtcgatgtccaatacaatctgaacgtggaacttgatttcttttgccccgatgtctccccgcttcaacttggtcagcctcagcagaaaattggtgac

SEQ ID NO: 21415 - DNA, 183 bp, Glycine max
  Peptide Sequence Number=SeqID_138193
atgtttgcattcaagagtgctttgaaaggacttgacgatactccacaacctaaatccaaggctggtgctaggtggattattgttaaatatttcaatgatgctagaccactggaaccagagagattgaaggcgcttcgcatccagtgggaaaagtattatttgaaagttagaagtgaaacttag

SEQ ID NO: 21416 - DNA, 285 bp, Glycine max
  Peptide Sequence Number=SeqID_138194
atgagaggaagtcaaagaagacaaaacttcaaacctaaaagaaggactgaagagtcatctcaaatcccgaaatgctttgagtgcaatcaacccggacatatgagggctgattgtccaatctttaagagaaagatagagaagtctgaaaagaagactattggagataagaaggcaaagaaggcctatatcacatgggatgataacgacttagaatcgtttgatgattctgaaaaagaaatggttaatctatgtccaatgggaaaaaattatgaaagcaatgaagag

SEQ ID NO: 21417 - DNA, 612 bp, Glycine max
  Peptide Sequence Number=SeqID_138195
atgcaggatgccgccaatgctgctaaaagtgctatggttagtgtgataggactggactcagagaaggtccaacaattgtgtgatgcagccaatcaggaagttcctgaagctgagaaggttcagattgccaattacctgtgcccaggaaactatgctgtctctgggggattaaaaggagtagaagtgctggaatccaaggcaaagtctttcaaggctcgaatgacggtgcacctagctgttgctggtgctttccacactagttttatgaaaccagctgtgtcaaggttggaagcagcattggcaacaacagaaatcagaaccccaagaataccagtcatctccaatgtgaatgcacagccacatacagatcctgactcaataaagaagatattggcatgccaggttacctcacctgttcaatgggaaacaacagtgcagactcttctaaccaagggtctgaagaaaagctatgaactcggacccggaaaggttattgctggaatcatcaaaagaacggacaaaggttctgtttgccattttgcaatttgcagagctccaaacatcggttcatgcattccaaagcagcaaaacaaagcaaacagagaaaagtaa

SEQ ID NO: 21418 - DNA, 477 bp, Glycine max
  Peptide Sequence Number=SeqID_138196
atggagcatcggggggttagggcctttcaggagattgcatcattccagggtcagctgagatggggtcctatgatggtcacagctcgaccggagagggtggtatctgcggattacatggagtggtttttccgcatatctcactcattcatgatatcgacccaggcaggtgaccagtcgagagatgcaccagctgcagaccccgatgactacatacaaccgtccagcccccaggttccagtggcatttgacccccctctacatgtggtaagattctttgcgcgtttaatgtttgatgaattgatgattacgacggatgagacgattgcacagaggttggagcgtgtgctcaaccttcggatagtcactgcaggcacagagttatatgacattatgcaggactgcctgacgatcgcgaaagggggacccagtgctgatggaactgtcagggctcgtcagagacgccgcacggaccattga

SEQ ID NO: 21419 - DNA, 225 bp, Glycine max
  Peptide Sequence Number=SeqID_138197
atgatagcagatgtggacaaggatggaagtggagcaattgattatgaagaatttgagtacatgatgacagccaaaataggagagcgggacagtaaagaggagctcatgaaagctttgcatactattgatcatgataaaaatggaaagatatctgcatcagacaacaaccgcattgcaaaagagctaggtcaaaatttcactgacagagattcaggagatgattga

SEQ ID NO: 21420 - DNA, 249 bp, Glycine max
  Peptide Sequence Number=SeqID_138198
atgtttgcatcagctttgaactatgtgaccttaagattgcttggagaagacattgatggtggagaaggcgctatagaaaaagcaaggacatggattcttgatcatggaggagccacttatattccttcctggggaaaactctggctctcgatgcttggcgtatatgaatggagcggactgaagccaatcccaccagaaatatggttgtttccctattttgttcctttccatccaggttgtcatgaatga

SEQ ID NO: 21421 - DNA, 246 bp, Glycine max
  Peptide Sequence Number=SeqID_138199
atggaatcggcaagagtggtagcagcaagggcgatgaaaggggtgaggcgggcagatgatgtagtggagtatgaggaagttagggtaattggtttatcagttattggagcccttaatgaaatattgacacctgagcatcaaagtgaaatacgtggctatgtgttcaatcaccaagtaaacatcggttattgtcagtggcggattcaagaccctgctggattactgggtgcaaattataaaaaataa

SEQ ID NO: 21422 - DNA, 267 bp, Glycine max
  Peptide Sequence Number=SeqID_138200
atgacgataccctgcacctctgaaaagcctgcacctctgcatctctgcacgctgctctgcaagcctccccttcttcgcctacgccccgttgcaggtaactcgccaatcaaactggcgaaaagcattgcccctaactcgccagctccagtggcgaaaaccactggctatttcgctagtggcagtgaaggaaaagccacgtgtccgttccagggtggtatcgccagctccagtgacgagatacttcatgcatggctgggttctacttaa

SEQ ID NO: 21423 - DNA, 294 bp, Glycine max
  Peptide Sequence Number=SeqID_138201
atgtatgattgcccttttatacaagcaaaacaaagtgcacgcgcttcttcattcattggtgatgatatcaaaatcgcaggaattgcatcaccaccgagatcctcagtcctttctttgcttcttcagcccaaatctctctttgagagcatcttcatggaggacagcggcaacctcatgaagctgaatgggattttcatcaactcgtttgaagaactagaaggagaggcgctagcaacactcaatggaggaatagtggttaaagggttgcccccagtgtatggtgttggatattag

SEQ ID NO: 21424 - DNA, 369 bp, Glycine max
  Peptide Sequence Number=SeqID_138202
atgagtgaagaacaagatgaatctcttagtgttcatagcccttattacttgcatcctaaatcacctaattcttgcagctactgtggtagagataatcacatagtagacacatgttataggaaaaatggttttccacctaacttcagctccaatagaggaggtggaggctttggtagatgggggacaggaggcaaaaacaacaatggtaaagtttgcacccactgtggtattactagtcatatagtggatgagtgctataagaagcacgattatccacctggtcaaaaattttataaacctcaaggagcttcagttaataacattgttaaggaaaaagaaaatgttttagagactaatgataatggttaa

SEQ ID NO: 21425 - DNA, 213 bp, Glycine max
  Peptide Sequence Number=SeqID_138203
atggttgatggtcccatcttggagtcccaggctgcctccctcatgaagaaccttctagaagccgccgcacattgccattgcctcgttgttgcccaccattgcacactacaaactctccctcattcgctggccctcttccttctccaaattgaacccaaaaattgttttttttcattgagtcacgatttgtcttgcgaggctgaagctgagtag

SEQ ID NO: 21426 - DNA, 567 bp, Glycine max
  Peptide Sequence Number=SeqID_138204
atgagatgtacaatgctaatctatttcttcattccagataccgaatcagccaaagtatcaagacaacagcttaaagaagcaatttatgcttccttgtttgacattaatgtccctgttgtttgtgctatcaaccagaatttgtttctgctattgagtatattgagtcacagatgtaagaaagtgagatcgccaaagcacttgattaagtgtagtagaagttttactctctgtcgacttatgagtctagacattggagcaaagaaccttgtttacaactattcaaattatcatctattaaatgccactctggctctgtacgctgcgaaacgaacttttggaatagttccaaacgcggcactacaaaaactcattcttcttcttctttggccaagttattccttgatgacaatttcacgctctcaagcctcaagcttaagcaaccctctgattcaggcgcttcacaatccttatctctctctagtgaagggactttataatcagattggattcgttatgttaatgtggtggagattattgatgatgacgcagcactgttggagaatttag

SEQ ID NO: 21427 - DNA, 567 bp, Glycine max
  Peptide Sequence Number=SeqID_138205
atgaagatgacattggtaacattggtccttatggttgccttgagcacaaaggcacttcttggtgcagctggtcctgcacctgagcaagtgctggacacatcagggaagatagttcgagctcgttcgagtggccttgatatggcaagcacaggtgcagattgcccacttgatgttgtagctgttgatggttaccaaggccagcctttgatctttacacctgttaattttaacaaaggtgtcattcgtgtttccactgatctcaacatttatttccccgttggcacaagttgtccacagaccacagtgtggaagcttaaggactatgattattcagcatcacagtggtttgtgactactggtggtgatttcggcaatcccggttcgcaaaccatggcgaattggttcaagattgagaagtatgaggatgcttacaagttggtctacggtccaagtgtgtgcaacgattgcagttatccatgcagtgatattggaatataccaggatgaatatggcaagcgtcttgctctaagttctgaaccatacaaagtgaagttccagcgggcttaa

SEQ ID NO: 21428 - DNA, 324 bp, Glycine max
  Peptide Sequence Number=SeqID_138206
atgtcgataatagggttatgtatgggtgagactccatttctatcaagtgtgtgcgaatttgtcttcacgcgagaatgttccatgctttcagaacctgattctccaaggctaggtctagatttaaagaaagattggaaacacaaagagagaaagagaccaactgtagagagccttttccatgatggttcatttaaaatatggggactgaaaacagcaatggcgagggagagcgaagaaagagactctgatgtctcgctaagcgaggcttgtgcgcttagcgagaatcatgcgctaagcgaggcactcagcccacttagcgagtag

SEQ ID NO: 21429 - DNA, 693 bp, Glycine max
  Peptide Sequence Number=SeqID_138207
atgaagatgacattggtaacattggtccttatagttgccttgagcacaaaggcacttcttggtgcagctggtcctgcacctgagcaagtgctggacacatcagggaagatagttcgagctcgttcgagttactacatcgttccggcttcccccgatttaggtggccttgatatggcaaccacaggtgcagattgccctcttgatgttgtagttgttgatggttaccaaggccagcctttgatctttacacctgttaattttaacaaaggtgtcattcgtgtttccactgatctcaacatctatttccccgttgccacaagttgtccacagaccacagtgtggaagcttaaggactatgattattcaacatcacagaggtttgtgactactggtggtgatttcggcaaccccggttcgcaaaccgtggcgaattggttcaagattgagaagtatgaggatgcttacaagttggtctactgtccaagtgtgtgcaacgattgcagttatccatgcggtgatattggaatataccaggatgaatatggcaagcgtcttgctctaagttctgaaccatacaaagtggccgttagagtggtggaaaatgggcaaaacactttgttctggaggggtttccatggtaaatggagggagagcgtatttatgggagtggagatagcaataccacaggaatag

SEQ ID NO: 21430 - DNA, 288 bp, Glycine max
  Peptide Sequence Number=SeqID_138208
atgacggtgtcctcaccaccgacgttgacatactaccaaacaacgtcggtgccactgacgttgtattcttgcattacaaagacgggtcctaggatgaccgatgttgttgttgtcgacatacaacgacatctggaacaaagacggtgtggggcccgtcgtagataccggttttcaaccgattttggagaaggaagagggccaaagaatgagggagaatttgtagtgtgcaacggtgggctacaccgaggcggtggcaatgtgtggcggctttcagaaggttcttcatga

SEQ ID NO: 21431 - DNA, 210 bp, Glycine max
  Peptide Sequence Number=SeqID_138209
atgaaggaggcagctaggaaggcggctggtggtgttggtgggagttgcgaggctaataaaacagagcctcccacgaagctaagagatgtggacaagcacagaagcggattcatacaccaaccgagaaaacgagaccaggtttggggacattttacaatggaaactaaaaacaacgctattcctgtggtattgctatctccactcccataa

SEQ ID NO: 21432 - DNA, 312 bp, Glycine max
  Peptide Sequence Number=SeqID_138210
atgggcacaaaatctatcctaaggctcatgagaatcctagggccttctcctgcatctctggcccaatcttcttggagtcttctatccaatgcccttgggggattccttgactacttcaatgttgatgtctctaatgagattgtggattttaccgaagcatctagtgagattactgaaaggcatctcaagaagcttggaatgagatttgttcaacatgaatggataatggctggagagccagcagctggaaatttggaacagatggaagaagatgatgaagctgaagctccacaagagcctacacatcaatga

SEQ ID NO: 21433 - DNA, 411 bp, Glycine max
  Peptide Sequence Number=SeqID_138211
atggaagaagaactgagtcagttcacaaagaacaaagtctggaaccttgtaccccctcctaagaatcattcaataattggaaccaaatgggttttcaagaacaagctaaatgaaaagggagagacatcaagctatatcagaaggatgtcaagagtgttttttctgaatggattcaccaatgaagaagtgtatgtgagacaaccacttggatttgaagataaggaaaaacctcagcatgtatacaagattgtcaaagcattgtatgagttgaaacaagccctaaaggcctggtatgaaagattgagttcattcgtagttcaaaatggtttatctagaggcatagtagacactacactatttagaaaaatattacaaaggtatgattggtttccatttagatgcttaccctga

SEQ ID NO: 21434 - DNA, 282 bp, Glycine max
  Peptide Sequence Number=SeqID_138212
atgactctgtgtagggactctaacaagattcctgccccacatagtgtcccgttgaataatccactaacaattcaattacccatgctaccattcttcccaccaggtcgtcatttcagctatgaaatcaaaaaacaaagcaaaaaggaatggcaaaatggtcttttcaaaaatatttttgaccccaaattcgcccaggctagcatccagctcgtctgggctaaagatgtaacttcaaccctaagcaagcaactcgcctgggcgagtggatgccttcaccattaa

SEQ ID NO: 21435 - DNA, 138 bp, Glycine max
  Peptide Sequence Number=SeqID_138213
atggcgagggagagtgaagaaagagacccaaaggaaagaggggtcgagagtgacagggaagaagtagcaaatcaacatgttatctattatataaatgaggaaccttttccaagacgtgacaatctccacaatttataa

SEQ ID NO: 21436 - DNA, 159 bp, Glycine max
  Peptide Sequence Number=SeqID_138214
atggttgtggcaaagaagagaaacttgacaccatcagttccctctataaaggtcgatgcaattgtttctgcagatgcttttgagaatttgaaacctgctcctgatattttcttagctgcatcaagaatattgaatgtgcccccaatgaggatgcagtga

SEQ ID NO: 21437 - DNA, 159 bp, Glycine max
  Peptide Sequence Number=SeqID_138215
atggcctcagagtggggattagaagataacttgagagaccccaaggataagtgggaaatggaggcagctaggaaggcggctggtggtgttggggggagttgcgaggttattattaagagacaaattgaggagtggaacaggaattctcaagctacttag

SEQ ID NO: 21438 - DNA, 207 bp, Glycine max
  Peptide Sequence Number=SeqID_138216
atgactttgtggcttccgttgcactcatcgcacactatgaatctgaagcctccgcaagaatcacaggtgttgttttggttggagcgcaagaggcgtttgatgagctggtggagctcgtcgcggaagtcggtgatgctcttgtgcggccgtgagcgggtggccaaggcaagagtcaaaggaagcgctaaagagtggagggagaaatga

SEQ ID NO: 21439 - DNA, 649 bp, Glycine max
  Peptide Sequence Number=SeqID_138217
atggcgggaggttttaaagacaagttgggtgaaggaggatatggctctgtgttcaagggaaaattgcgtagcgggtcttgtgtggcaataaagatgttagtggctcgtggaattgcttatctccactatgggtgtgagatgcagattttgcactttgatatcaagccccacaacattctactagatgaaaacttcaccccaaaggtctctgactttggattggcaaaattatatccaatagataatagcattgtcccaaggacagcagcaagaggaacaattggatatatggctccagaattgttttataataatattggaggaatatcccataaggctgatgtttatagctatggaatgcttttgatggagatggcaggcaagaggaaaaatctaaatccccatgcagagcgttcaagtcaacttttctttcccttttggatttataatcatattagagacggggaagatatagaaatggaagatgtcacagaggaggaaaagaaaatggtaaagaaaatgatcatagttgcactttggtgtatacaattgaaaccaaatgaccgtccctcaatgaacgaagtagtcgaaatgcttgaaggagacattgaaaacttagaaatacctccaaagccaactttgtatccaa

SEQ ID NO: 21440 - DNA, 141 bp, Glycine max
  Peptide Sequence Number=SeqID_138218
atggtagtgatagtgactcctcttctgggccgaaaggatgcaacatgtctcattctcacgaaccaatattcaaacgaagttgataatcaggggatgatccctgtgttagttctttctgctttgaggttttcctgtggtgtg

SEQ ID NO: 21441 - DNA, 717 bp, Glycine max
  Peptide Sequence Number=SeqID_138219
atggcctgccggtggcggtggccgcagccgctggcgctgacgcttaactggcagcagcggcagggcgaactggtggtgcgccagcaacaggaaccacagccgttgttacagctgccgtggcaggtcgatgcgcagcaaatccgcatcactgccggtcactggcgctggccgttcgggtcgcaaccgctgtcgggcggcgtggcgctgacgctggatgactggcagcaggggctggaacagacgcagatccgcggccgcttcaatttactgaccgccggacgcggcgggaaaggcaacctggtactgagcgttgggccgggcaagctgagcctgactgacagcgcactgccgttccagttaaccggcgaaagcaaatttgccgacctgcagctgtacggcaccatccccggacaattacatggcatgctcagcgatccgcagctcagcctgcagccgggcgcactgctgcgcctgcgcggacgcttactctcgacgctggaagtggatgaagcgcgctggccgctggccggcgtcagcgtggcctcgcgcggcatcaacggccggttacaggcaattctcaacgcgcacgaccccagtttcggccgcttcaggctgcatctcgacgggcgcgccagcgacttctggccagacagcggacgctggaactggcgttactggggcgaaggggtgatggcgccgcttagcgccaaatgggat

SEQ ID NO: 21442 - DNA, 495 bp, Glycine max
  Peptide Sequence Number=SeqID_138220
gctgaattggagaggcataacttccataagcacctcaacaatttagctgatagtagcattgacctagcattggtgaaggagttctacgacaacctctacagtcctgaggggccttcaccaaaacaagtcagaatacggggccacttgataaggattgatgcagacaacctcaatgccattttagaaacacttgtggtgcttgctgagggtgaatctctacccgattactcaagatactgcaggatgcctactgacatcagggaaattaaggtttctcggtgcatacctggccgagggtttattttaaatgctgaaggtcaccttgggaagatcctcagaaaagatctaatcactcttgcccaggtttggagtgttctctcatactccaacctggctttgacttcccacaccttggatttggctgtggatagagcgaggttaatatttggcttagttactcagctagacatgaatgtcgaagctctcatctcttaa

SEQ ID NO: 21443 - DNA, 373 bp, Glycine max
  Peptide Sequence Number=SeqID_138221
cttgtgctgtttgaatgttgttttgcttggatgttgtggaagcttgggaggattgatggggacccggggatggtgggtttatgcgcgctttgtggatgtggaaaacttgttgtgcaccatcgcccgaccgccacctagtaccacatgtgatggggtgaaacttcctgcttttattgttgacctcagagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctagggaagcctctggtaatcgattaccaaggggtgtaa

SEQ ID NO: 21444 - DNA, 360 bp, Glycine max
  Peptide Sequence Number=SeqID_138222
atggttgaactagccaaaataaacactaaaagaggtgtgaaagataaggtgaatcctaagagtgtttggatgactacattcatggttcccaatctttcactcactatcctaaggaaaaattgccaaaaattattacacaaatggaagtttggtaacctattggaggctcccaacacacttccaatgaaaggcctttttgttacaaaacttgaaagcaatgaagtgcttcttagtccaatagctcttaaggtggttggcccctttcttcttgactcaaattcttcaagggatgacaccaatcctccttgcaattccctatatggcaacccaaaaacaagaaaacaaagagacaagcaataa

SEQ ID NO: 21445 - DNA, 157 bp, Glycine max
  Peptide Sequence Number=SeqID_138223
tgtgttccttcctcgtcctaccgtatttgggggaggatggtgcgtggtagctaggagagttgggtctgcttcgacaaccgaactgacagcggtagcgatggtgatcgaggccgtacccgaatcaaataaccatgaaaatgcagtaactaggaagtga

SEQ ID NO: 21446 - DNA, 414 bp, Glycine max
  Peptide Sequence Number=SeqID_138224
atggaacaaaagaaagttttgactatggtcttatttgttatggctcatggtttattggcaataacagtccatgcatctcaacaacttcctgcagcatgcgattgcaagcgcgtttccgatccgcaatgtctccctctcggtgttcttcacgagatccctaagtcaagaatgtgtccgggtccaaatccctcaaccattctctcccaggcacaagaagaggttgaattgtgtttttttaaaaaaaaacttcttaccccattgtccggaagctcttcgctatgcgaaggtatgagggagggaaattgtacgcagccttacccttgcatatgcaaagagactgtttccagattcgaacccatgaccaacaagtcaccaaggcacaactttaccgctgcaccagggctcgccctctga

SEQ ID NO: 21447 - DNA, 699 bp, Glycine max
  Peptide Sequence Number=SeqID_138225
atgaagctcgtttggtctcccgaatcagccttacaagcttacatagacacggttaaatcatgtgagaaattcaaggaaaccggggtaccagagttgctatcagccatggctgcagggtggaacacgaaattcatagtagaatcatggtcctacggtggtcccatagctgcaagcgtaggcctagcagttgcagctcgcaacacgggtgcaagacacgtgtgcatagtccctgatgaacggtcgaagatgcagtacataacggccttagccgagatgggggtgtcgccgccgccggaggtggtggctggggaggcggaggctgcggtggcgcggctggcggggctagactttctggtggtcgattgcaaaaggaaggagttcgctagggttctgagggtggctgaggtgggtccaaaaggagcggttttggcatgcaagaatgcatggcagagaaacttttgtggcggcttcagatggaacatggtgctacaaaaaggtgtccgtatagttaggtcagttttccttcctgttgggaagggtttggatattgcatacatagggagtagtagaagtggtgtatcaccggcaccaccaccaccaccagcaacaacttcaaagactcgtcctagccgttggatcaaacacatagatcaacaatcaggagaagaacaccttttcagagactcatcatcccattag

SEQ ID NO: 21448 - DNA, 1724 bp, Glycine max
  Peptide Sequence Number=SeqID_138226
atgaccggcattccgattgcgctgattatcggcacgccggtttccagcctgttgttagagctgcacggatggctggggctgcacggctggcagctgatgtttctgttggaggccattccggcgattgtgctgggattgatcgtcccctttgcgttgcccgataggccggaagatgcccgcttcctcagcgcagatgagcagcactggctggtgacaacactggctgctgagcggcaaaaactgccgtcgcgcggccacggcggtctgctgaaagcgctgttcagcccgctggtgttgttgttcagcctcacctattacggactggcgaacctcaacggcgcggtgagcaccttcctgccgctgatcatcagcgaaaccggcttaagtcatgttcagaccggattcatcaccatcatcccttacgtatttggtctggccggcatgctggtgctgggacgcatagccgatcgtcccgggtcgcgtctgctggccaattatctggcgctgatcttctcctttgtcgggctgttatgcgttgcgtggttcgataactcgctggtgaaaatgatgtttttgtgctgttcggcatttggctttttcggtgcgatgccggtgttctggggattgcccgcgcagtttatcccggcatccgtggtggcgggcggcctcgccctgatcaatgcgctgggcagtattgccagtgtggtgaatccgtgggtcatcggcgtgatacgcgaccgcagcggcagttataacggcggattttactggctggcggcgatggcgatgctctcgatcattaccctgagcctcatcttccgtcgccagcgtttaccggcttaccaggccagcaatgaacaacgcgtgatgccgggagagggtgatttctgggaggagcgtctcgcgcgtcccaccgatatctatgcgcagtttcgtaccgtgaataatcatgacggtggcgttcagctggaagacggttttgccattaccactgtgtttcttgagatcgtttctgatgagggcgtggacgggctggcagggccggtgccgcatgccgttgcatcaatcattcatggccaactgcggccgttgttgctgggtcaggatccgcgcgacaccgagcgtttgtgggatcagatgtaccgggcgcagattcatgggcgtcagggcgatggcatgctggcgatcagcgcggtggattgtgccttgtgggatttgcgtgccaaatggatgcagcaaccggatatggcacgggtgcacgagcgggcgctggagtataaggcgctgggatatcgcggacaaaaatggtttttccgccacggcccgatgagcggcagagaagggctgaagaaaaatatcgaactggcaaaaacgctgcgcgaagccgtcggggatgattacgatctgatgtttgattgctggcagtcgatggatgtgacgtatctgctcgaactggcaaagggcatcgagccgtatcgcccgcgctggctggaagagtgcgtgatggccgacagaatcagcagtatgcaacgactcaaagacaaactgtccatcccgatggcgggaggcgaacatgagtacacgcgctggggtttcaaacgcttctttgaatccggggcgctggatgtgattcagcccgatatctactggtgcggtgggctttcagaaacgctaaaaattgccgctatcgccacccagaaacgatctgcaggtgatcccgcacg

SEQ ID NO: 21449 - DNA, 732 bp, Glycine max
  Peptide Sequence Number=SeqID_138227
atgaggagaacactgatgaacgaagatcgtatcagcggaaactggaagcagttcaaaggaaaagtgaaagagaaatggggccagcttacagatgacgatttagacgtagccgaagggaaacgcgatcaattagtcggccgcattcaggagcgctacggctacggtaaagatcaagcagagaaagaagggtctgcggtgatcgtccttattgagcgaaagcagcgcgacaaaactcactacggcggtggccatcacataccaggcgggaatgtcggcgttgccggtttgcttcatcaggccggtaatgatcagacccgcgcagccggaaaacagcgcgttggagagcgaataggccagccccagcccggtgtaacgtacgcgggtcgggaacatctcggccagcatcgccggtcccggtccggccagcatgcccaccagcgcaccggcgataaataccaccagcgccttgatcgccataccgctctccggatgctgcagcactttcagcagcgggaaagccagcaccagcagcaaaaacgtcgccagcagcattactgtgcggcggccatagcgatcgctgagtatgccggccggcaggatggtggcggcaaagccgaggttagagatcaccgcaatcagcagcgcctggttgaagccggtgtgcagcgcggcctgcagataggtaggcatgatcaccaggtaggtataaccggcggccgaccataccattaa

SEQ ID NO: 21450 - DNA, 267 bp, Glycine max
  Peptide Sequence Number=SeqID_138228
atgctaagcgtgcggcctcgattcttgtgctcttccagattctctcatcctgctaagcgcgatgtagctgcgcttagcggtagatgcacgctgagcccacagtgttggatatatgagcattttcccagtgttcatgatagtgtgactgatgatggctatgccgagatgtcaccacgtgcctaccggtggcttactatgaaggcttatatgaagggattaacagcatcgacgtaccggacacgtatagatgcactgaagatcactgac

SEQ ID NO: 21451 - DNA, 1473 bp, Glycine max
  Peptide Sequence Number=SeqID_138229
gttgacgccgggctgagcgaggccgcgcgcggcctgccggataccgactggcatattccgctgctgtacgactttgtgcgcgacctcggtgccagcgtactgatcgggcactactcgcgcttcgtgatcgatctcaaccgtccgccggacaaccagccgctgtacagcacggccaccaccgggctctatcctgaaacgctgtttgatggcacgccgaccttcaaacccggcatgacgccggacagcgcggcgcgtcagcgctatctggagactatctggcagccctatcatcagcagattcagcaggagctggcgcggttaaaagccgaacatggctatgcgctgctgtttgatgcgcactccatcgcttcggtgattccgcgcctgttcgacggccagctgccggacctgaacatcggcaccaacgatggcgccagctgttcggcggccagcatcgcggcgattgagcaggtgtgcgccgcgcaaagcgactacagctgggtggtgaacggacgctttaaaggcggctacatcacgcgcgcttacggccagccagcgcagggcgtgcaggcggtgcagctggagctggcgcagctgaattacatggatgaggcgccgccccgtttaattgatgcgggtcgccatcacggtgaccccgtttctcatgtggcggacgtacatccgctgcctcactccccaatgctgtgcaacccctgccctgaaagggtgcacgatgcgtttcgcctgacgccgattccctccgtttaccgtctttgccgatctggcacagcccttgctagcttccaacagagacagccagatttgttaaccaccaggagaagacgtatgacacaccgtgccccctttcgccgtttctgccttaccacgctgtttgccagcctgatgctggccggcgtggctgccgaggctaaagagtggaaatccatcaccatcgccactgaaggcagctatgagccgtggaacctgacgctgccgggcggcaagctgggcggcttcgaacctgaactgatggaagatctgtgcaagcgcatgagcattcagtgcaagctggtggtgcagaactgggacgggatgattgccggactgaacgccgggaaatatgacgtcatcatggatgcgattgtgattacgccggaccggaaaaaagtggtcaacttcaccacgccgtacgcgtcaacgccggcgaccttcatcaccagcaaagataacccgctgctgccggccgataagaacatcatcaaactgcacgacgacgaggctgccatcaatgcggccatcgccccgctgaaggcggcgctcaagggcaaaaccatcggtattgcgtccggcaccgtgtatacgccgtttatcgataaatacttcaaagacgtggccgacgtgcgcgaatacaccgcttcggcggatgcgattctcgatctgcaggcgggccgcattgatgcggtgtttgatgac

SEQ ID NO: 21452 - DNA, 918 bp, Glycine max
  Peptide Sequence Number=SeqID_138230
atggagatgttaatggttattacaaagttaattattgagggttttaaggggtttaaagaccgattctgcatcgagttcaatgagtcagtgaacattatcgtaggcgataatgaagcgggaaaaaggaaacctgtcaagaacaacatcagccaatatctctttaatgaccaattggtgaaggaatatttagccagtctcgcaaccgcagttagattgccaccgccagcgctattcgttgagctccacttccaaaaaacgcctgacactgtttttctggagggggatggtaactgcctgaagtcatcctcagtgggagttgtattcaaaatcaagtttaacgaggactataaggctgcctatgaagcactcttgaaagtaggtgatatcagaacgttgcctatagagtattacgatattgagtggaaaagcttaagcagggactcacttttatcacgtaacatccccctcaagtctgcatttatcgattcatcctcggccagaggcaacaatgggtcagatgtttacatcagcagaataatcaaggatttgctgacggatgatgaggtcattagcgtttctcagtcgcaccgtaagatgaaagaagccttcatatcagaccagtctatcgaaaccattaataagaaaattatcagtgcaagcaagatcaccagtaaaaaggtcactatctcagttgagctttcctctcaaaaagcatgggaatcaagcctgattacctgcctggatgatgttccgtttaactacattggaaagggcgagcaaagcattgtgaagacaaatttggcgctctcgcacaataaagccaaagagtcgaatgtcattctcattgaagagcctgaaaataacctatcgcacaccaagcttaatctgctcattaagaccatcaaagacaacttgtga

SEQ ID NO: 21453 - DNA, 1137 bp, Glycine max
  Peptide Sequence Number=SeqID_138231
atgggtaagactacccaagccatacctctttccagattcaacggcgaattgccagcaacattggcaggggttactataccccatacacgcttcactgatggggctactgagcttgttgcttcatgctcatcagctccccttttcaatcatgttgtaagaacatatttattcgcagcttctattggaaaaaaacttggtaaagcttttgatgaagaaatgctttatttaggttgtataatgcacgacctggggcttaccgaaaagttcatcaaagatgccagattcgaactggatggagctgatgcggcacggcagtacttagtcgataacaaattccctgaggaaaaagcagaagttatctgggatgcaatcgctttacatgcaacgatggaattgccggaacgaaaaaggccagagattgcgcttgtccatttaggggcttttatggatggggggatgaatgcaaatattttccccttgtcattctttgaagaagtatttgaggaactcccgcaaaatggaaacaaaacgcactttatcgaactcgttgctaatgttttgagaaaaaaacctcatactgcctatctttcatttgaaaaagacattggagtaaaaatggaggaattttatgcgcgattcactcagcactttcgaagtcacacagcagtatggccggggcatcagatcatgaacccgggcagctataccgccggcctgacgctgctctggcctcccatttttacgccgagggtcagggtaccgctttatgccgatccatgcgccgccggcttcccctcccctgcacaggactacgtcgagaaagaactcgatctgaacgagctgtgcatccgccggcgcgcctcaaccttcttcgtgcgcgccagcggcaacagcatgcgtgacctgggtctctgcgatggcgacgtcatggtggttgaccgggccgaggaagccgcgcacggcgatatcgtgattgccgaggtcaacggcgagtttacggtcaagcgcctgcagctgcagcccaggctcgcgctgttgcccatgaatccggcctacccggtgatctatccggaggagctgcagctgctcggcgtcgtgacctggttctttaacagcacccgtggccgccggaggtga

SEQ ID NO: 21454 - DNA, 1702 bp, Glycine max
  Peptide Sequence Number=SeqID_138232
atgaggggtggtgctgttacgtgtacagctggattctcaattgaatctcaaaaactctacccggagcaatccttcgatttactgttggttgtaggaggtcagggaggccggaatatctcaagagatagccaggaaggtagagcgctgaagaaagcctgcctatccagtaaaagttttggcagtatctgcacaggagcttttgtcctcgctgagttgggtcttctggatgggaaaaccgctactactcactggaaatataggcatatttttagtgatttataccctgatgtagtactatccactgatgctctgttcgtgaaagatggtggcgtttggacatcagcaggaatatccagcggtatcgatctcgcgcttgcgataattgaggataatcttggcactgcagtctcattaaaagttgctcaggaacttgttgtcgcgcagcgccgcacagggggacaatcgcaattttcacctgtgcccatgagcggtaagcgttatcccgaagagtttaaaatcgaagcagtcaaacaggttgttgatcgcggtcattctgtttccagcgttgcaacacgtctcgatatcaccacccacagtctttacgcctggataaagaagtacggcccggactcatccactaataaagaacagtcagatgctcaggccgagatccgccgactccagaaagagctgaagcggcagccacattcacagcgtcaccaggcagaccagatgctgaccgggcagatcaaacagttctggcttgcgtctggctgcgtctatggttatcgcaagatccatctggacctgcgggatagcgggcagcagtgcggagtgaaccgggtctggcggctgatgaagcgtgccggtataaaagctcaggttgggtaccgtagcccacgggcacgtaaaggcgaagccagcatcgtggtaccgaacaggctccagcggcagttcaatccggactcaccagatgagcgttgggtgacggacataacctacatccgaactcacgaaggctggctgtatctggccgtggtggttgacctgttctcccggaaagttgtcggctggtcaatgcaaccccgcatgacaaaagagattgtcctgaacgcattattaatggcggtgtggaggcgtaatcctcaaaaacaggtactggttcattctgatcagggcagtcaatacacgagccatgagtggcaatcgttcctgaaatcacacggtctggaaggcagcatgagtcgtcgcggtaactgtcacgacaacgcggttgcggaaagctttttccagctactgaaacgcgaacggattaagaaaaagatctacggaacacgggaagaagcccgcagtgatatttttgattacatcgaaatgttttataacagtaagcgtcggcatggctcgagcgatcagatgccaccaactgaatacgaaaacaaatattatcaacggctcgaaaccaaggcagctgatgtcgatgccattttttatgtcagaacctcagttaccgagaatcacttgagtcgtgaggaaatgcggcgaatcggggttaccgaaaacgtagtcgctgatttgatagagaaaagtcactgtgcatgggttgcgactgaaaacgaaaaaattattggtttctctatgattttacctgatgaagcctgcctttttgctgcctttgttctgccggagtacgaaggcaggg

SEQ ID NO: 21455 - DNA, 228 bp, Glycine max
  Peptide Sequence Number=SeqID_138233
atgaccatgaaaaacgtaaaaactctgaccatcgctgctgttgctgctctttctatgatctctttcggtagcttcgctgctgaaagcatctccgttcacggcagcacgctggatagcgctgaagcccaggttgccgctcaggctaaagcgagtggtgcggacagctacaaaatcaccagcgcccgcgcagacaacggcgtggacatgactgctgagctgtacaaataa

SEQ ID NO: 21456 - DNA, 1209 bp, Glycine max
  Peptide Sequence Number=SeqID_138234
ccggtgcgcgatcgcctcaccggcgctcaggagcagctgcagcaggcctggcgcgcagggcggcttaacagtgaagagagcattttgctcatcggcctgctggaacggttactcaattttgtccgtattgccgatgcttaccacagcgtcagcgagcgcgtcagtgactggacgccagcggtgaaaccgggcaaggcgtcacgcgcgcacaagcatgtcgataaagggctattactgctgtcgtgctttactgccttcatcgccacctttgccagctgcctgttctggatcggcagcggctggcgtgatggttcaaccgcgccgatgatggcggcggtgctgtgttcgttcttcgccgggctggatagccccatcgcgccaatgaagctgtttctgaagggcgtactgatctccatggcgatcagcctgatttacgtcacgctgctgatcccgcaggcggtgacgtttgaagcgctggtgatttgcctcgcgccgggattgtttgctttagggctggtgatcgccaatccgtccaccaacctgatcggtctcatcgtcgccacgcagatccccggtttgatcggcatgagccaccatttcaaacccgatttgcagcttatagtgaatgccatgatctcgacgctggtgggcattgccgttgcgctggtgctgacgctgctgattcgcaacaaacgcccggcgtggacggccacgcgtgcgctgcgtaaaggcattcgcgatctgctgcagtttattaccgcgctgcgcatgaacaccgcaacgctgacggcgcggcagcaatttgtcgcacgcacgctggacagggtaaacgtgattctgccgcgtaaacgcgtcgatccggcaccggagctggtggcgggcggtaatctgattgcggaggcctggctcggtgctaactgctatgactattacacccgtcatcggcacctgctgctggcgaatcagatagaaagcgcgaccatgtttcacgagctgagtcagtttcttaagcagcggctgaaaacgctgtacagcacgccatcgcctgcgctgctgcatgagcttgatgtgttactgctgcggctggaggcggcgacgcagcaggaaaatgcgctgtttgcgccgctgtttcatctgttcaatatccgtctgtcgctctttcctggcgcgcgctggccgcagccgctggcagagcaaaaccgcacatag

SEQ ID NO: 21457 - DNA, 545 bp, Glycine max
  Peptide Sequence Number=SeqID_138235
cttggaacagatacacggataacattctcggccggaatatccttccgaagagaaatgttcatatttatcatactgagtttgatgagttcaaagcggagttggagaggcgtaatctacacaaacacctcaccaacctccaagagggaagcattggtgtggcgattgtcaaagaattctatgccaacttgtacaaccctgaggatccgtcgcccaagcaagcaagagtaagaggacacttgatcaagattgatgcaaacaacctcaatgattttcttgagacaccagttgtgctagaggagggggagaccctacccacttactctagattttgtaggttgaggtctaatcctcaagagatagaggctaggccgtgtattccccgcaagggttttgtgttgaacgctgaaggccaaccatggaagctccttaggaaggacttgaccatattggcccagacgtggagtgtcctatcttactccaacctagctcccacatcccacacatcagatttaaacatgggtagagctaggctggtttatggcttg

SEQ ID NO: 21458 - DNA, 150 bp, Glycine max
  Peptide Sequence Number=SeqID_138236
atgaaaatgaaaatgtttccaccgggcattgcctctagagcaagtctctaccactacaaggaatgccaatacaaatcgttactcgcaatctacatcgccttgtgcaagaaagcgtgtctaaacaatgtatccgcaaaggctctcatttag

SEQ ID NO: 21459 - DNA, 426 bp, Glycine max
  Peptide Sequence Number=SeqID_138237
atgtgggtagtgccaatagcaacttccaaaatgcaatggcagatgacaatgcagtgtttgagagtgctgctaggtgcacccagcattattgctggtgcacccagcacttattgtgaaaagctcttcttcttctttctttccctcctcccgcgagactcttcttcttctttcttttctgcgagcatcttctccttccgcgagactcttccgtcggcggccctttcttcctccttcctcattcttccgcgaggtggttgtgcttctccaacacgagctactacttctccctccttcgagtgcgcttcttccattcttccacgagcttctgctcttctgttcttcatcgagcttacgcatcacttgatccgtacgcattttccggatcaacttgatccggaagatgcttacagatcaggtgatccgtaa

SEQ ID NO: 21460 - DNA, 354 bp, Glycine max
  Peptide Sequence Number=SeqID_138238
atggcagctgtcactatttcttcttcagaccatccttctattttttctgttgcaagatgtgagttgttggatattttcattatttccagtataagacttgatgtagctccatgtggagcttgtaagccttggatcttcttcatcaatggagtcctttgcttcttaaagtctgatggcagcggaatggagaaggagaaggatgattggagacgccaattcaaggagaagatgagtctagaagaagctcaccaccataagaagccatggataagagctcgaagcccactaatccaagatcaatttcaagattctccactaagtgtacttaggtgtcatgaggcatgtaaagcatga

SEQ ID NO: 21461 - DNA, 167 bp, Glycine max
  Peptide Sequence Number=SeqID_138239
gatgggagaaggctgaaaatgaagggacgggtttaaagaagcaagtccaggcactgactcttagaaattcaacacttgaagatagagtcacccatctagacagtgcacttaaggagtgtgttaggcagcttatcagtcacactaaaagaatagaacagcattgctag

SEQ ID NO: 21462 - DNA, 291 bp, Glycine max
  Peptide Sequence Number=SeqID_138240
atgggggaggagcttgccacccagctcgccctggcgagcaaggttgcttcctacataagcaacagccttctggaggaagaatctggaaggcccaactttagaagaagttacggaaactcacagattgcgcaacaacacctccttttggtttccgccacactacggaatttcacggatcgcataaccctgcttccttttgacttccggcgcgtctcgagacttacatattgtgcaacaaagggtgccaagtatcttgaaacgaccaatcaaaggttgcatgtcatcaagtaa

SEQ ID NO: 21463 - DNA, 513 bp, Glycine max
  Peptide Sequence Number=SeqID_138241
atggataaagttttgagaggtctatctaggaagtggagactacaggtaacggtgctgatagcggtaaagaatcttgagtccatgtctcttgaggaacttgttggcaccctcaaggttcatgaacataagctccagcaagatggagtcaatgattcatttgatgaggactcagatgaagatgagcttgccttcatctctcgcaaaatctgcaagatatggagaaacaaaaatcaagagaaaagtcaagataagaagaaattctttaagaccaaagaaaagaaggggattatgagcatgtgggaagacctagacgacacttcattagatgaagacgatgaagaaccaaacaaattcctgattgcagacacaacttctgaaggatccgaattagaccaggacaatgaggagttggaaaacaaatggaaagatcttcaaaaggatctgaaggagcttaatgaacttgacaatcatcaaaagaaagaaagatatgatctttggagaaagtgtgcataa

SEQ ID NO: 21464 - DNA, 177 bp, Glycine max
  Peptide Sequence Number=SeqID_138242
atggtgtcgctagatagtatgaccttcactcccaaaaccttggaggctatgagtcttcttgttgacaaactcagcacatcgccagaaggtccttatcagttatgggtagatggactgagcttcagtgacgagggtgtttgcaaaggccatctaagagggatgaaagctaaggtttga

SEQ ID NO: 21465 - DNA, 627 bp, Glycine max
  Peptide Sequence Number=SeqID_138243
atgaaacctttgatccaattcaagtgtgtgtgcaaggaatggaactccttgatttcagaaccctatttcatcaaattgcaccttagcaaatctgctgcaaaggacgatttggaacaccttcaattgataaaaaatgtctgcctcggatccatccctgaaatccacatggaatcgcgtgatcgaaataccagaaggatactgtgtttgtttctggaacaaggcgacaaggtgatatccagagaatcgcaaacgctgtctttttccccgggcattggtcgtagaacaatgtttgggtttggctatgatccgtcaagtgacaaatacaaggttgtagcaattgcgttgactatgctctcacttgacgtatctgaaaagactgagatgaaagtttatggcgagggtgacagtagttggagaaaccttaaaggttttcctgttctttggactttacctaaagttggtggagtgtatctgagtggaacccttaattgggttgttattatgggaaaagaaaccattcattctgaaatcgtaattatttctgttgacctagggaaggagacttgcatatcactgtttcttcccgatgatttttgcttttttgatacaaatatttggagtttttag

SEQ ID NO: 21466 - DNA, 909 bp, Glycine max
  misc_feature (6)..(6): n is a, c, g, or t
  Peptide Sequence Number=SeqID_138244
ggtgtncgggacatgctgtcatgggtaaggggccagtggattccttttgatgcagatgccctcagccagttcctgggatacccgctagtgttggaggagggccaggagtgggagtatagtcagagaaggaaccgggccgatggatttgacgaggaggccattgcccagctgctatgcataccaggtcaggattttgcccggaccgctgccgggagacaggtgcggatcatacgcaccaacatgactaccttgacccagacgtggatgacgttgctgctcagcaacatcctgcccagcgatcataactctgacctccctctgccgaagtgtcagctagtgtatgccatcctgacacggatgggcgtccatgtggctcagttgatcgctgatgccatttatttatttacaggtatgccgcctaccaggcaccctctagacccagataagtctaaccgggccctgggatttccagcgttgatcacgggcctctgccagtcattcggggttcccgtcgcacctagtaaggtgattcgaccgccgatcacccgggcctgcattgagaagtattgcacgcctagacaggcgcagggtgatgcaccgcaggccgcatatgcaccgccaccacctcaccaggctgatccaactgggtcatttggcatggagcggtatttacagcacttggttcgccagcaggcggccaaccacagggggcatgtgcagacccatgtgtatctctaccagctcagcctcagtcagcagagccagggtttcgctccttttgcgtgccctactccagatcagtttagggctgaggttgcatggcccggagattggcctgaggcccatgcaggggagcgcctgcagaggctcccggcgatccagaggacgcacgcatggatgaggagatga

SEQ ID NO: 21467 - DNA, 2859 bp, Glycine max
  Peptide Sequence Number=SeqID_138245
atgacggggtggatgcgtaaaaagtcatccacccgcgccggttacatcattttttgcggaaagtgcagaaccggtcgtaccgactcgcgtaacacggagcgtaccgatgaataccatatcctccttaaccggcagacgtttacactctttccgatgcagcagatggtaaccctcctgatcggtactgatcgtcactgtcgccgtgtggaaggcatagcagctcaggctgggccatttttagcgcgccacagcgcagacaatcaccggcgatgcagccacatatactgctcaggcgccagcagcaccgtctcttccaccactttattcatcacgatagcggcggcgtgccagaaacggcaccacgctcggattagccagacgaatcagcatatgcgtgccggtggtggtcgcggcttcctgaacggcaaagaacggggcgaatacactgctgcgcgggccgtagtcgtgatcgggcgcataccagatgatgtcgttgttcttcatggcgcggatcatgcctttcagatctttgcgatccagcatgcttttattggaacgcatgcgtccccaggtttgcagccagtccaggcgatacacgccaatgcccgggttgtacatgccaaatacgcgcgcacccaactccagcgtcaggaagtgcatgccaatcagcaggatgccgcgcttttgggccagcgcctcggtaacgtgctccaggccgctggtgctgacccatttacgaatacgccagtccggccagaaccacgccatgccggtctcaatcagccccattcccaccgattcgaaattgtgcttcaccatggcttcacgttcgctggtcggcatatccgggaagcacagcgccagattgcgttgcgcgacctgaacacgacgcttcataaaacgcatggcaaggcgtcccagcccgcagccagtcacgtacagcagcgggtagggcaacagcaccagtacatagaggaaaccgatgcccagccaggtcagccagtagcgtggatgaaggagttcgcgggtaaattgcggaagttgcgtcatggaaatatcaatgtcctgcgtcgtgtaccagagagtccggtgttcaccatgccagtgttacacaacctcgtttccaataaagagctgaaagaacgtatgctggccgaaaccgagccgcgtaccacagtctctttttataaatacttccagattgccgatccacaggcattccgcgaccgtctctatgttgccttaacccagctgaaggtgttcggccgcgtctacgtggcgcaggaagggattaacgcgcaaatcagcgtgccggccagtcgctatgaggcgatgaaggcgatgctctatgcctttgacccggcgctcgacaatctgcgcatgaacatcgcgctggatgacgacggcaaatcgttctgggtgctgcgcctgaaagtgcgcgatcgcatcgtggctgacggtattgaagacggtagcttcgacgccagtaacgtcggtaactatctcaaagcggccgaagtcaacgccatgctcgacgatccggatgcggtgtttgtggatatgcgtaaccactacgaatacgaagtgggccacttcgacaacgcgctggaagtgccagccgatacgttccgcgatcagctgccgatggcggtggatatgctgcaggctcagaaagacaaaaaaatcgtcatgtactgtaccggcggcatccgctgtgaaaaagccagtgcgtggatgaagcacaacggttttgatgatgtttaccacattgaagggggcatcatcgaatatacccgtcgcgcgcgcgagcagggtttaccggtgcgcttcaaaggcaaaaacttcgtgtttgacgagcgtatgggcgagcgtatctctgacgatattctctccagctgccaccagtgtggtgcgccgtgcgacagccacaccaactgcgttaatgacggctgccatctgctgtttattcagtgcccgagctgccggaccgagatctttgctgatgttgaactctttcagcacaatttcgccgctggcggcaaagccggcgcgataaccgccccacggatccttgccttcaccaatcagctgcgcatccagcgtgatcggcttcgttacgccgttgagcgtcaggttgcctgtgatcttataatccttgccctgttttttaacctcagtcgagctgaagctggcctgcgggaatttgccggtattgaggaaatccgcgctgcgcaaatgcttgtcgcgctcggcatggttggtatcgaggctgttagtattgatggtcacgttgaccttgtccgcggcgggattggcttcatcaaaggtaaagctgccatcaaaatctttaaagctgccgtacagccagctgtagccaagatgctgaatgcggaactggacaaacgcgtgctgaccctctttatcaaacttatactcagccgcgctggcactcaggctggtcgaaaagagggcagcggcgctgagcgccagcagggttttcctgatcatattacttttccttttcagaggttaaggggatgcggtaaccgagcatccgattcagcgtcatgtcgcgatcgacaaaatggtgtttcagcgcggccagggcgtgcagggcagacaacagcaccagagcccacgccagccataaatggacctcaccggcgacatcggcctgctcacccgtgccgcggtagagatcagatagccgctgatcagcaacaccagcagcaggccatacagcagccagtgcgcagcatgggcgacacggcgtacgtgcggcgagtaactgttgagcggtgccggcggcggcgatatcacgcgccagcacaggcgcagcagcagagcagcaaacagtaa

SEQ ID NO: 21468 - DNA, 315 bp, Glycine max
  Peptide Sequence Number=SeqID_138246
atgtcctattcttgcctcgtcgtgcttacaggaggtgtgttgcacatgactactgaaaaaccagaagaggcgatgacgtttggggaattactggccttcattgctgaacagcaacgccgtttgaccgtgctggaaaatgcctttgctacgctgaccttctgtctggatgatcgcgccagtcagctgctggctcacaatctgacgctcgaagcgcaaaaccagaatcatgacgctcagttacagcagcattttgcccggctggcggacgagatccaccggcgcaaagggcagctgcctgccgagtcgcagggataa

SEQ ID NO: 21469 - DNA, 513 bp, Glycine max
  Peptide Sequence Number=SeqID_138247
atgaataaaggtatctactactacgtgacgatcagtaccgatcaggagggttaccatctgctgcatcggaaagagtgtaaacgtctgccggttaaggaggatatggagttgcagatgagcctgtatagtacgttagaagaagccattgaagccgcacgcgaagagtttctcgccagccagcctgaactggagcaggatgacgccagtgtcagccagtttgccctgcagaagtacgtgatgcaggatggcgacattatgtggcaggcggagtttttcgctgatgaagacggccagggcgaatgcctgccaatttgcagcggtgaagcggcgcaggcggtgttcgacggtaatttcgatgaaattgagctgcgccaggagtggcagtcggaaaataccctgcacgaatgggacgaaggcgaatttcagctggagccgccgcgcgacctggaagaaggcgaagcagcggccgaagagtgggaagacgacgacagtccgtcagacaactgggcgtaa

SEQ ID NO: 21470 - DNA, 246 bp, Glycine max
  Peptide Sequence Number=SeqID_138248
atgcgtgttgaaattaccgtagcaaagactcagccccttcccgccggtgcactggatgcactgagcgctgaactcactcgccgtatctcccgcgattttcccgacgacaatcatcacgtcaaagtgcgctatgccggtggtaaccagctcagcgtgtttggcggctgtaaagaatcacgcgaccgcatcagcgatattttgcaggaaacctgggaaagcgctgacgactggtttattaccgattaa

SEQ ID NO: 21471 - DNA, 772 bp, Glycine max
  Peptide Sequence Number=SeqID_138249
ttggtaaaatggaggtttaaagaagaggatgtcgaaagactcatgggggttgttaggaagaggaaagtagtattatacgctagggtatcatcaaacacacagaaagacgacttaataaaccaagttaagtacctggaggagaacgttaaggactacgaccaagtaataacagacattggttctgggttgaacatgaagagaaaaggattcctcaagctattgagaatgatactaaacaacgaagtatcgaaagttgtcatagcctacccagacagactagacaaaacaccagagcaggaactaatcgaagatttgatctctatactggtatcatttagcggaaagttgtatggtatgaggagccataaatatgagaaggaggaatacgtttacctaacttactccctgaagaataataagaaggtgaagagcaagatattactagagaactataaacacctactacagaaggctttagactggttatgggagaggactaagatagagaggaaggaggtcaagaagggcaagaaaattttcgctaaggttaaagtaaccttgccaaagaaaaaggaagtttacaaggtgttgagggatgagttagagaaggttaacaatctagcttcacattacgttgacaaagcaataaatgatgcttactcaatcttgaatagttggaggaggagggctgaaaaaggacaagcgtcattaaggaaacctagattgaagaaggtttacgttagggtaaagtcgacacttagaaaggttgagg

SEQ ID NO: 21472 - DNA, 441 bp, Glycine max
  Peptide Sequence Number=SeqID_138250
atggtcattcccaagttcaaggtgccggactttggcaagtacaaggggactactcgctccaaggaccatctaaagatgtactgtcggaagatgggggcatacgcaaaagatgagaaaactgctgatacatttttcctgagaaagaaccttcttgagtccattcttggaaaggacctaatggttgccttcattaggcagtgtcaatacaattctgatatggctccggataggatgcaactacaaaaagtgtgcaaaaagggggcacggatcattcaaagaacacgcccaaaaggtggagggatctggcggcccaggtgggtacccccaataatggaaagggagacgataatcgtgatggtagacacattatcggtactctactatgaaaagatggtgggctgcgcaccctcaaagctttgcagatttggtcttcgccagtga

SEQ ID NO: 21473 - DNA, 294 bp, Glycine max
  Peptide Sequence Number=SeqID_138251
atggtgatctggaactacacaggtcagactttggagaggttaggtttcataacatttgcgggtcaagatttagttggcctaacaagttggtcaagagagagtaaggattggggacaacctagtttctctcatttgagacgtagattagaaatcccattgaagcatgagatgcacagggtagccaaaggatttaatcaaaggagggcaagtctagaaggtagggtgagcgaccttagaaaaggagacaaagatactaagtgcgacaacatcgacaaggttgttaaggaggcatag

SEQ ID NO: 21474 - DNA, 162 bp, Glycine max
  Peptide Sequence Number=SeqID_138252
atgcctacatctctggaaagggcgcagatgacccatatcggccctctgcttatcaatcacactcgaggtgcggataaccgtaaagtgtggtcgacaaaagcgaggctcttggctcctacgtatcctccaatgaggaactcagacctacgtagttctggataa

SEQ ID NO: 21475 - DNA, 574 bp, Glycine max
  Peptide Sequence Number=SeqID_138253
ggaaagattcgcacaagcttggagcgctatccgcagactcaacagaagtcagttggggaagaaatcagaccatgtgcatgaatcttacacccagtgggttattgataggaccaagagctttggcctaccctaccacttacctagatacctatcgtccaccatcccaccatcatccttgcctatcccctttgacactaaggaagagtttcatgaacaattaaccaaagaaaggcaagaaaaagaaacttggaagaggagatgccaggagctcgagcgagagaatgagactttgaaggggaagatagcccaacagagccgtgagctttttatccagaaccagagggtgattgagaaggacgacttgcttcgccggaaagacgctttgctccaccaagatgctagaaggaagaggaggtttatggatttgttctcccgtgcacattcagattccgaggatccatctactccgggagagggtcaatcagccgccgcccaaggaaagtggcccggcgaattctccacaaaccaactcgcatttacaacaccagggccaatcggaagaggatggatttag

SEQ ID NO: 21476 - DNA, 741 bp, Glycine max
  Peptide Sequence Number=SeqID_138254
atggctcgtctctcgatcgtcgccatcgtcgccgccgtgctcctcctggccctctccgccacccccgcgacggcgcgtccctgcaggagcttcataatctcctcctactccttccgcaaccctaactccaacacgttcgccaccatcaccgagatccgatccttcacccctctctacatcaccgacaaacccccctcctatgcccttttcttcccccacgcgactcagctccctcagcatgagagcgtgcgcccacgcgcccctctagggttcgcctccgcctacgatttctcttccctccgcgaccgcaccaaggacatcctcagcgtcgccctagccctcctcttcggcgtcggctgcggcgccctcaccgccgccaccatgtacctcgtctggtccgtcttctccacgcgccaccgcgcctcctccttcgacgacttctcctccgacgacgaagacgagatcgagagccccaagaagcttggctacgtcaagattccggccattgagaccactaccgccgtcgcccccgcagctccggctccagccaagggttcgaggctcttcgctatgcgaaggtatgggggagggatattgtacgcagccttacccttgcatatgcaaagaggctgtttccggattcgaacccatgaccaacaagtcaccaaggcacaactttaccgctgcatcaaggctcgccctcactttaccgctgcattttgcaaaattgtttttgattag

SEQ ID NO: 21477 - DNA, 594 bp, Glycine max
  Peptide Sequence Number=SeqID_138255
atggtgatccacttcactagaggatcaagccaagaaactgaaacaagaacaatgttgggtggtttttatctaagttcaccccaccatgcttctcgtgacactccatgcccaaaatgtggttaccaaacaaagactgaaggtgtcactcaaacctgcttggattgttttctttatggtggctatctatacttatttgagtatggtgtgtcacctgcattttttctagccaaagctagaggaggcacttgcaccattgcatcttctgattcaaccgaagccatccttcgccgtgctttctttcttctcaagaaaggatttggtggctaccatttattcaagaacaactgtgaggactttgcaatgtactgcaaaacaggcttgcttctagtcagaacaagcatcatgagtgtagggcaaagtggacaagcaacatctctcttggctgctgctggtgctatagtttcttcatcacttgtgtttatgatcactagcttgtgtggtttggctttggttggatgtgccatgtattgtgttagcagatatgtttctgatattggagtacgttgtgatgtgaccaaagtttcagtgaagaag

SEQ ID NO: 21478 - DNA, 753 bp, Glycine max
  Peptide Sequence Number=SeqID_138256
atgcaagacgaagacccagctgcagcccttcgactcctgctgaacaccagtcaagccaacacttcgagtgaaaagattcctggtgcttcgtcctcatctgatgctgacatcacctcttcagtacgccaagattgcctgcttttgaagttatcaatggaatacgcacgggcagacgtacttaaatccattgaagagaacccctctgctgcttttgggcacctgaactttttgaagaaattgcacaaccctcttacctctgatgaaattctaggcaaagtcatccaaatcgagtccattatcgatcaatttgcaagtactgtgcagaaaaaacgcgaaaatggcgccagactggatgcccagaaacaggcacatatccttctgctcgaaaaagcccaagctgctcaacatgaagtcgagcgtctcaacaaagaggcgaaagaaggatcttctgagatcaaagcctgtgatgataacatctcctcctgggaggccactattacggacttgctgtctcaggtcgatgatctaaggcaaaaaattgtgacagagcaggccaaacgcaaggaactccaggagaaggccgctaactcgattcagaaactgattgctgaaaaagggagggaaggcctgaaggcctttagcgcatctcaggctgtagcagatgaggcaagagttatggagagtgctgaccaggtcttaaccaaagagatggccaccttgaagaagctatatgaggacttggtcatgcattag

SEQ ID NO: 21479 - DNA, 558 bp, Glycine max
  Peptide Sequence Number=SeqID_138257
atggcggagcaaaagatgctcaactacgtcggtaaactggtggtgctggtcgacagcagcaaagtcggccaacgcgccggcatgctgttcagccgcaccgagcaaatcgccatggtgatcaccggccgcgctgccaatccggcgatcgttgagcaactgcgtcaacagggcgttgaagtgctgctgttggttacaatagcggcgtcccccaattacgaggcagtcagcagtatggaacagttcgaagcgatcaacgttgagcaagcgtacgcccgctggaaagagggcagcgccgccctggtcgacatccgcgatccgcaaagttttgaagccgggcatacgccgggcgcctttcacctcaccaacgccaccctgtcggcctttatgcagcaaaacgacttcgagcggccggtaatggtgatgtgctaccacggcaacagcagccgcagcgcggcgcagtacctgctgcaccaggggttcgacgcggtctacagcatcgacggcggcttcgaggcctgggcccgccagtatccgcaagacgtggaaacctctgcctga

SEQ ID NO: 21480 - DNA, 417 bp, Glycine max
  Peptide Sequence Number=SeqID_138258
atggagttcaaatattgtgattgtcaaaaccaaagaacatcatcaccaacaccacgcccttttcccacattgacatacaagaattcagatatctccaaaggctcgtcacaagatatgccaagcattacaccgagaatcagagaaaatgcagatacagcgggagttggagaaagaagggatcggagagagataatcgccaatgagatgatatggcggcgagggctgaaggagaaagtgttgggaatctcgatgcaaggactggggatgttctcgtttggtgaaccaatttcgatgtctttcaatccaagaatgaactcgattaatcacgtcaacaatgctgacaaggataccagacaattttctacactgactaacaaagataaaataatcatactggataagccagatgctaattaa

SEQ ID NO: 21481 - DNA, 261 bp, Glycine max
  Peptide Sequence Number=SeqID_138259
atgggtgccaagtacctcgaagtggtaaaacgagggtcgcatcccaacaacagatggtccccggacgaaattaaggtgtgcggaatgacaaagggcgcagaatttgtctctgcacgtttaccacccaacttgcaaaatctgaatgataaagggcacataatctgtttctacgcgtttacccactcagcttgtttgttcctgaatgataaagggcgcagaatctgtatctacgcgtttacccactcagcttgttgttcctga

SEQ ID NO: 21482 - DNA, 441 bp, Glycine max
  Peptide Sequence Number=SeqID_138260
atggaagaacacgcaaaggaagagttgaagctgcttgaagctcaatatcccaaccaacatgaacatctaaagaatgagcttaggtcattcatctttcaactccagaccaatcaccaggattctgaacagcttccagaaaacaataacttcagcactcaccttgctttctttgatacagaagaatccaccagcttaggggagcaacggaagaggagtgactatgatttggaacttgctttggcagacagattagtgatagagaagattggtggaagttctgagcttgaaactcctaagagtgttgtggtgaagcatttctcaagcaggaagaacaacaagaggaaagatagggtcgatttggttcttgagagggcacaagtttgtctcaaaaaaattaaacacttgaagacattcttattgtctccacctcctgaaatttga

SEQ ID NO: 21483 - DNA, 1086 bp, Glycine max
  Peptide Sequence Number=SeqID_138261
atggacaactacaagaaccttgtcaaagtcattgccgttcaagacctcatccttgcaaacccaaagaatccatcagtctccattgatttcctctccaagctctcccagaagctccacctgaaccgtggcgccactgccttcctccgcaagtttcctcacatcttccacatttactatgacccttccaagttgaagcccttttgcaggttaactgatgctgctcttgatgtttcacggcaggaagcagtggccatcaatgcttctttgcctgatgttgttggaagacttgttcggatactgtcaatgtctgcatccagaatggtgcctcttagagctgtttttaaggtttggaaggagcttgggctgcctgatgacttcgaggactcggttatatctgctaattctggtgtttttcagctgtttgaggcgcatgaaccaaatactcatttgttgaagctggttgatggtgcttgcaacaatggttttagggcagctgttgaggattggagggttgttgagtgctgcaaggaggactgcagtgttgataggatggaaatgcagttcaatttcaaacaagggtaccctccggggatgaggttgaccaagaatttcaaggccaaggtgaaggaatggcaaaggttgccgtatgtggggccttatgaagtggtgggtgagaagaagaagtctaaggctggaatgatggctttggagaagcgagcagtgtcgattgttcacgagttcctgagtttgacggtggagaagatggtggaagttgagaaaatcagccagtttagaaattggtttgggattgatttaaatataagggatctattcctggaccacccagggatcttctatttgtctactaagggtaaaaggcatactgtttttttgagggaagcttatgaacgagggtgtttgatcgaaccaaatcccatctatgatgcaagaagaaggctacttgatcttgttgttttaggacgtcggggtctgccagctgttaattcaaagttccaggatacaagcggctgcaatgagactggacaagaggaaaaccagcaaagccacgattctttaccatcttga

SEQ ID NO: 21484 - DNA, 624 bp, Glycine max
  Peptide Sequence Number=SeqID_138262
tggtgatcagcacctttctcgctacccatccggcgcagctgaaaaccagcatgaagctgacgctgctggcggcgctgttgcagggcacggtggcgattggtctggtgacgctgatgctggtggtgctgcaaacctcctcgcgccagctgcatctcaccagttactggctggagaaaggcagctatttgctggtgatagcgctcggcgtctgggtgggctggcgcgcgctgcaggggttacgccgcgcgttccgtccggcgaccgggctccagattcgcgcgctggccggtgcggtgagcggcagaacccaggcgctggtggtgctgtcgatggggctgcggccctgttccggtgccatcatgatgctgttgtttgccaaagtgattggcgtgtatggctggggcgtggcctcggcgctgaccatggcgctgggcaccgcgctcaccgtgtcgctgctgggtttgctggtgcagcgctcgcgcgtgcttgcggtgcgtctcggcagggtcagcagcagaggggcagcgcaatggttgttgccggccgtgatgctggctggcagcctgctgttgctgctggccggctttattttatggcacagtgctacgcccggcttcggtggcg

SEQ ID NO: 21485 - DNA, 1185 bp, Glycine max
  Peptide Sequence Number=SeqID_138263
atgcttgacgcacaaaccatcgccaccgtgaaatctaccctgcccgcgattgctcaactcggcccgcagctgaccggtcacttttatcagcggatgctgacgcggcatcccgagctgaagaacgtgtttaacatgaacaaccagcgcagcggcaatcagcgtgaagcgctgtttaacgcgatctgcgcgtacggcagcaacctggaaaatcttgaggtgctgctgccggcggtggagaaaattgcgcagaagcatgccagcctgaatattcagccggcgcagtacgcgattgtcggggaaaacctgctggcgacgattaaagagctgctcaatccaggcgatgaagtactggcggcgtggggcaaagcctatggcgtgctggctgaggtgtttatccagcgtgaagcagcgatttaccgtgcgtcggaagaaaaggtcggcggctggcgcggcgcgcgcgattttcgcatccgtgcgattaccgcgcagagctcggtaattaaaagcattgagctggtgccgaatgatggagagacggtggcggacttcctgcccggccagtatctgaccctcagtctgcgcccggcggacagcgactacattcagcaccgccagtattcgctgacgcatctgccggatggcaaagcctatcgcattgcagtgaagcacgaagcgcagggcagcgtctccggctggctgcatcagcatgcgaaggttggcgatatcgtgcagtgcgccgcgccggccggggatttcttcctgcaggcagcagcgcagacgccggtgacgctgatctcagccggcgtcgggcaaacgccgctgttagccatgctggccagcctggcggagcagcagcatccggccgcagtatgctggctgcacgccgccgaaaacggcgcgcagcacgcgtttgctgatgaggtcgcggcgctgggtgcgcaactgccgcactttagccgccacgtctggtatcgccagccgcaagctgatgacgcgggacgttacgacgcgcagggtctgatggatttagccaccgtctcaaccgccctgacccagtccgatggtcagttctggatttgcggcccgctggcattcatgcagtttgttgcgcgccagctgaccgacgccggcatcagcgccgagcgcattcactacgaggtgttcggtccgcacaaagtgctgtaa

SEQ ID NO: 21486 - DNA, 724 bp, Glycine max
  Peptide Sequence Number=SeqID_138264
actgcctcctgagcctgaggttggtccttcagctacttgtgccagcactaaagagagttgtgttgatcccttagggaatgatccagacacaggtgacttagacaaatgtaggttgtacatcgaagaaaatcctccctgcctggttgccctaggaagagtttatgagggatccacaatcgttcacaacattcctttgttgcatgatcaagtcaaggttggtgttgaggaggttagagatgcagatgcttccattcccgtacccactgaagaggttaagttagtggggcagacacttaacaccttttttgctttgccgacacatcttgtcaagggtttatcagaacagggagttgtgggaccgacaaaacctgcagataggccacatcatgatgtcgatgatcccctatatctgatgacattgaccatccttcagctatttctgaagccattgcaggttatgtgggatgctatcatgttcggggtgtttaatgaagacttccccttgtacataaagtatgaagatctgtctgaaatagcacatggtggtcaatgtctaagcatctcttttatacaattgtggattctgcatatgaatgagacaagtatacgagcggggaatgccgatgtgtatggattcctcaagccacagtccatccagagatccgggcaattgaaatttgaatcagaaagttacattaagaactggatgcagaattcaaaatag

SEQ ID NO: 21487 - DNA, 387 bp, Glycine max
  Peptide Sequence Number=SeqID_138265
atgtcttgtggatcagttcaagtggagggtacatccacttggttgttcaaagagaacaagggagggtacatcccttgtggatctttgcttgtaaaggattttacaaggttattggaaatctcaagaaccggtggttggtttggaactggatttgatcaagacactactttaagtctcatcgtgcttacacacttgagggtggagaactatgtatcgcaccattcgttagccgattggaacactactttaagcctcattgtgtttacgcgcccaagactggaagactgtaccgtatcgatcgccaaccgaccgggacactactttaagcccccattggagcttgtaggccttggatcttcttcatcaatggagtccattgcttcttga

SEQ ID NO: 21488 - DNA, 682 bp, Glycine max
  Peptide Sequence Number=SeqID_138266
agggctgcatgtcctcgcctccagagggcttcacatcctctcctttagagggctgtacgtgctcatcttcggagggctacacatcctcacctttagagggctgcacgtactcgccttcagagggctgcatgtcctcgccttcagagggttgtccgtcctcgccttcagagggctgcacatccttacctttagagggttgcacgtcctcgcctttagagggctgtacattctcgccttcagagggctacacgttctggcctttagaaaactcaagcgaccacgactccaatttccccctgccaaagtgtcagctggtttatgccatcatgacatagggatcgtgcccacaagacacccagtggacccgaagaagtccaacaaggtcctggggtttccagctctgattacgggcctctgtcagttctatggagtgcccgtcgccaccagcaaggtcatcaggccctctattaatagggctttcatcgaaaagtacagtgcccccaggcgggcgcagggcgaggtaccacagcagcttagggacggccaacagcaagcaacagatgcaccgccaccacctctagggtccacctcagctcatctacaaaggttggagtgttgcccacgacccatggctgaccggcaggcgaccaagtccaaagccaaatgtaagaaaaagtactag

SEQ ID NO: 21489 - DNA, 135 bp, Glycine max
  Peptide Sequence Number=SeqID_138267
atgaacggagcttcacaaagttttgtagaagggaattggaaaggaggattgatgtcataccttgaagaattcgagtcaagaagcaaggggtcaaccaccttaagagctattggactaagaagcactccaaattga

SEQ ID NO: 21490 - DNA, 805 bp, Glycine max
  Peptide Sequence Number=SeqID_138268
ggcttcccggtatcaacagggacaccaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagctggctggatttaccaatactaatggcagcattgttggttctaatagctctccatgagtttaagatcccaatcataacaccgagggatttggagttgctgctgactggaaatgttgaaaaatgggtttcgaataaagaccataaagcactcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21491 - DNA, 909 bp, Glycine max
  Peptide Sequence Number=SeqID_138269
atgcctaacccgggactggctaaagccagccccttaattcaaacgctagcaacaacagttcgtgtttgcttaaatgttgtagcagtgtttggtctcacaatgttcttattttttattgggtttagctttatgggatcatccatttccaatttgactattcgccctgtgaagccagacggtgatttaggtctaactcctcattcaagcgggacgcctaacggcgccccttacttcaatcagcaagaggaggcttttgcttgccagcatattgctaactcgttactgactggtgtacctgttggatttttttggcctgaagagtcacagcaaaaacatccagatgcttggtgtcaactttgtgaagatgcaagattagaggcggggggtgattggactcccgaggttgagaagctgctcagtgtaaagttgctatgcgcctcgagcaatgtgagttggattgtcagttctcgagactatcaaggcttccctctgcttactcgtcatcctgtaggtcttaatttcgacaaattacaagtgatttatcctatcagactcattgttgatcttactttcgcaaaagttcaagaaaacggattacctgaaaatcactacaacgaaactttagaaatattcgacaattttataaccgagtattttaaacatcgctccaatgggcaatgtgtacttgttgaaacttatggaggcaaaaggcatttttacttatatgtttcaaggtgggctgatacagaagcattcaagatagagattagtgagatatttccgcagcatcaagttgagttcgatgtaaggcctgacgaaaactggtcactgattagaaagtatagtcacgatatcttgagtgatatctcacgtgacgctaattctgctgaaagttacatagctccatag

SEQ ID NO: 21492 - DNA, 695 bp, Glycine max
  Peptide Sequence Number=SeqID_138270
gtaatgatgacgcatatactttgattgatgaaagccaggctcagattgatgcactaataggcaatgccaattatgatataggacatactttcagtaccggaggtggtggacttgccggattaggagtaatatgcagtacaggaaataaaggaagcggaattaccggatcttctaatcccgtaggagatccgtatgatatagactatgttgctcacgaagtaggacatcagtttggagggccacatacattcaatgcaacaacaggaagttgcgcgggtaatcgaagcgcttccaatgctgttgaaccaggaagtggtgttacgatcatggcttatgccggtatttgtggggcaaccaataatctggcacccaatagtattcctacttttcataccaaatcatttcaatcaattactacaaaagttcaatcgacaagctgtcaggtaacaactccggttaccaacacagcacctgttgtgaatgcagggaacgattacacaattcctaaaggaactccgtttaaattaacaggttctgctacagatgcgcagaataatgcgcttacttattcatgggaacaaaatgatgtaggaccggcaggaaactggaatgcaccaacaggtaatgctgctatattcagatcatttttaccggtaacagttccatacagatactttccaaaactacagacgtaa

SEQ ID NO: 21493 - DNA, 702 bp, Glycine max
  Peptide Sequence Number=SeqID_138271
atggagtgtgtgatgcagaggtttgttcaaaggccaacttctctagcagccctcttgaccttcctatggttgccaattggcatcatactctccatcttatgggtctaccttaacatccctttgcctgaaagaattgcttggtataactataagctattaggaatcagagttattgtgaagggtacccctccaccacccccaaagaaggttgtggcactctcaagggaaagagagaaagatgctgccaatattaagagactacttgaggaaggggacttggtgatttgccctgaaggcacaactcgtagagagcctttcctcttgaggttcagtgtactatttgctgaactcactgataggattgtcccagttgctattaacacaaagcaaagtgtgttctatgaaaccacggtttgtggacacaagttgttggagccctactttgtattcatgtatccaatgacaacatatgagatcactttcttgaaccagcttcccaaggagctcacatgcagtggggggaaatcagctattgaagttgcaaactacattcaaagggttcttgcagggactttgggatttgagtgcacaaatttgactaggaagagcaaatatgccatgcttgcagggactttgctttcaattattttcagctatataattttcaattattatcacagacacttgtgcacttctatataa

SEQ ID NO: 21494 - DNA, 162 bp, Glycine max
  Peptide Sequence Number=SeqID_138272
atgttggggattggatcgacttttggtcgtcctcctgatcttggttatctggctagtcctactgggattgaacgggttctaaccgaaaaagaccttctggctgactcgtattcaaacctagaggcttctatccttgatgagaaggaatttctcctattgaag

SEQ ID NO: 21495 - DNA, 333 bp, Glycine max
  misc_feature (26)..(26): n is a, c, g, or t
  Peptide Sequence Number=SeqID_138273
atgccattggagggcaagcagtttgntggtatacccatgccaaacactttggagggccctcagttttgcccacaaccacaacccttgcattttgcggtgggaagagcccctcctgctatggctgaaaagggaaagttggatcatatagaggaaaggctcaaggacattgaaggaggcgaagattgtgcctttgctaatctagaagagttattcctagtacctaaacatggtcattcccaagggactacttgctccaagaaccatctaaagatgtattgtcggaagatgggggcatacgcaaaagatgagaaactgcagatacatttttcctaa

SEQ ID NO: 21496 - DNA, 224 bp, Glycine max
  Peptide Sequence Number=SeqID_138274
aggaaacactgggtccaacaaagataggagaaaatcactcaaagtgtatcaatctcacgcagtgcgtggcgagaaagtcgctagtgcacaggattttgtcggcaatcaaagggagaggaccactttagggcgaggattgacattctcaccctgggtcaaggtttatgataagttgggattttggctcaaggcttgtagaacggctggtcatgatatatgtcagg

SEQ ID NO: 21497 - DNA, 100 bp, Glycine max
  Peptide Sequence Number=SeqID_138275
gattctcatcagtttgtccatctgtttaaggatgacaagtggtagagaaaatgagttttgtgcccagtttggtccacaaggtcttccaaaattggcttag

SEQ ID NO: 21498 - DNA, 636 bp, Glycine max
  Peptide Sequence Number=SeqID_138276
gaacatcctgatttgaagttggtgtcacatgggaggaaggtgacactgattgggaggccagtgcctgagattgaaggactggttgctgccacaggattaagtccactgatcgattgtttagttattactggcgatcctggactgatatccgcattcgtggagaggtggcacggtgagaccagcatcttccaccttccgattggagagttgacgatcacattggatgatgtgtcgtcactccttgatttgtccatcactggcgcattgcacagttttcatgcgctttctacaaaggaggcgagatttttgctgacagagttgcttgaggtgtctgccgaggaggctagagccgagacaacactgacacgtggggcatatttagatgaggcttctaggaccaccacacgacagcttgcgaggtacttgacgctattacagtgctggatctatgagtacttccctagtttgcaccagtgcgtgacagatgatacataccaggagacgtccccacgtgcttctcggtggttgacgtcgatggcgcacatgaagggaatcacaggagcaccttacagggcacattgtgatgctttgaccgtcacagatgtgtcctggttgccgtacaaggagcatcggggg

SEQ ID NO: 21499 - DNA, 270 bp, Glycine max
  Peptide Sequence Number=SeqID_138277
atggagggtctaaggcgtatctcccgatggtcgactgaaggcttattaccgattagcctttttgctactaaagagacttctggaactccggctgacttgtttgctttgctctacgctgggaagacgacgtggagcttcgggaaagatgggcactcgtcatgtgctgcaactcgatttgtcgcaacaagaggagaagaagatacctcgatgaaacccaatcaggatgtgaacaaaggccactgctcaaactcttcgatatgcgctagctag

SEQ ID NO: 21500 - DNA, 377 bp, Glycine max
  Peptide Sequence Number=SeqID_138278
tcaccctcttccttcaacactttaacatccctcttgattctgaaccctatgttccaatcaagagatcctttctaataggtgcttcagtcattgcatcctttggttatcaaaaagagcatgatggctcttgggtgaaaaagggtgctcgacatgttggtgaagaaggacatgatggagaagattcatctcttctttcaaagattttggataggttcgatggtcttcaaacctttgttggtgaaaggtttgatacattggagttacaagtggacatgagctttaatgagatggagtcaagaatcaccaaggtcaaagaagatgtctcttatattcgttcaagctttgatctaccaccaccgccgtcaccatcgtcttag

SEQ ID NO: 21501 - DNA, 345 bp, Glycine max
  Peptide Sequence Number=SeqID_138279
atggagcattttcttgagcaagtagcctggcctgaagctcaacttccattggtgagacccaacgaggttgctccgcctgagcccacacctgtgcaggtcaattcagagccagctaacccacaatctccagtggtgaatccaccttcttcgcctgagcttgaagcagttcccccatctcctcctctgattgtcatttatgatgcatcatcagatgaagcaactgctcttcttgattcaccaactgtagaaacagctgacccccctgtttccccaattggaggaatcgctaatctttctgattcgtcatctggagaagttgttgctctcaccgattccccagtttaa

SEQ ID NO: 21502 - DNA, 189 bp, Glycine max
  Peptide Sequence Number=SeqID_138280
atgtcgtcacgcacgcgttgtatgttgctctcgtcttttgtcatgggaagccggaaggtctatatcaccttcttaactacacacatggggcactgcgtccccgaatgcgcaaagtatttttcggagctggattgcttctggcctgggcgagctgggcagcaacatcctccccctttttcctataaatag

SEQ ID NO: 21503 - DNA, 171 bp, Glycine max
  Peptide Sequence Number=SeqID_138281
atggagtggatattacccacgcctacaccatatcgtctagtggagccagtccaagtgatcgaggtgacgtcatctaaggaagaccctgaggaagacccagaggagctacctcctgagcccgctgtggatgctcttgactttctagagggtgatgaggacccactccctgag

SEQ ID NO: 21504 - DNA, 395 bp, Glycine max
  Peptide Sequence Number=SeqID_138282
ctaagccaccttactacctcagtcattttgatttaccgttcctgcgtagcttctggcatttatattccgtctgcttgtgggataaggcctctctcttgggtttaactagcggagcagctagaatgcctgaagcgggaggagcgaacgaagtgagaactagatcgagagtccagttttcagtgacttcaaggagcaaagccataggaaataaggcaactctcttgacagaggggcatagcgggtactctaaccataaggagaaggaaggtgagaaggtagctcattttaccagttccgtgggggaaagacgagcaaagcgttcgaggagccctacttttaagaagaaggcgttcaccaagggaactagccgggtgtacgaagtgaaggctcgttga

SEQ ID NO: 21505 - DNA, 309 bp, Glycine max
  Peptide Sequence Number=SeqID_138283
atgtttgcacattcgattaaaggctgccgtccccttggggcggacgtgtggggtgctaataccttccccgtgcgtaaatacaactcccgaacctttcacgtaaaagttcgtagatcgcgtcttttccagtttttccgacgttttcctcaaataaacgttggtggcgactccgcgcgtattcctttcgtggaacacgcatcccgcgagtctcgcgtcgccctcccgccgaaggggccctatacccgggttcatgggagcataaggagtggaggtgaatctgtgatcatgctaggtctccgacttgcttga

SEQ ID NO: 21506 - DNA, 166 bp, Glycine max
  Peptide Sequence Number=SeqID_138284
gcttagcatgatggattcaaactcaccgtttctgcctcattgcaattctgatacaaaaaatgcatttcgcaagccttctggtgatgcagctaataggaattatcggcgtcggtcacctgttgaaggatcaccctcacctgatggttgggatcttttaagctgttga

SEQ ID NO: 21507 - DNA, 669 bp, Glycine max
  Peptide Sequence Number=SeqID_138285
atgaggatattgagatgtgtgaaaggcactttgggctataagttgttttcaaaccatggcagaaatgtgactgaaaaagtacagcagggtatgtgttggagctcttggtggtgttctaaggaggagtcaatggtggcattgtcctcatgtgaggctggatacattgtaacttcaatgggagcttgtcaaggcttgtggtttgaggatttgatgtcaaaatcgaagattagaagaggagactatgaagatgctaatagacaacaattacaacgtttcgtcgtcaatcccatcgttccacctctctatctcacgaaggacgatcgaatttctgatcatgtgaaccctgactatgaaacttgggaggttcaagatcaaacgccccttgtttggcttcaatctacactttcaaaatccgtactattgtgcgctcttggctctaatcattcctatcaagtttgggagaagattcatgagtactttagcctccatacaaagtctcgtgctcgacaactttgcactgcgatgcgcgcagttacacttgacggaaaatcgattgatgagtacttgcgcaaaatcaaaggatatgttaatgaacttgcaggcgtcagagtgcctgttcgtcacgaggagtatgttgatgcgcttcttgaaggactgtcgtcagattag

SEQ ID NO: 21508 - DNA, 1239 bp, Glycine max
  Peptide Sequence Number=SeqID_138286
atggacaagttggacgattccaattactctacatgggcttccgacattctcctttggattagtgaagctgaacgtgctaagtggcaaaagattgacgcccaattgtgcagtcatcaaatccaccattcaccattctatcaaactgatttttcaccctcatgctatgtgagaattgatttgttaagaagcaagagctctctctacactaatgacactcagcacctctatgcattgtgccaagagttcatgacccttttgctccacaatggtttaatggcccgatgtgcacctatcttggcaaactccatgactataatgaacctttccttcctaatgctacgaaacctgaagaagccaagaagaaacttgaaaaccacagtaccttcttcacaacatttaccaagaagggagatggtttgttgtgacaaaaaacaatatctagggggattttcaagtcttctcctcaatgacaatggggcttctttagggcaccttgttagaaaagcaagggaatttgacagttcaagtcggcaacgtgaagatttaaggactttcaacagatctttcgaaggccaagagatcattgataccaattcccagctttttgcattgaggacaaggcagctcctcagaagggtggtattgataagtaccgaagcccaagtaacccaatacaaagatggagttgttgacctggtagttactaagctgtataaagttgtcttagctgtagacttttcctcgtgtttcctttgtaagctactttcacattataaaagagacagctgggtgttgagggttaacacaactctatttcagatattttctatctcaaacccttcacaatgtagctccttaaatttttccaaggttgatatcagagcaggtcaatcccgctctgcttgtggttcgctgccagctgccgtgctaggcttcagtcagtgtctgctgccgaccactgtcattggcgctgctgtcctagtcttcgacaacttttctggcgaatttcagatctggctagccctcttatgtttatcttttctcgaagatgtttatggccgacgatcccaccatcatatgcgcctctcacctatctcccccggtcatctccttccttttttgtcagatctacttctctccgatgagattcagcagacccactgccaccattgtgctcatcttcttctggcgagcctgaccatgttgtcagccaccactgccggagttgtcactgtttaa

SEQ ID NO: 21509 - DNA, 1301 bp, Glycine max
  Peptide Sequence Number=SeqID_138287
ctagtcctaggcatggacatagctcaagtccaaatctagtgagagaaaattctgcaagagtctctcaccattctaggaagtatgatgacagggaacaagaccaacagtatggaagaaatcactatggcagaagcagtgactctcttagacattctgatagacagtcattcaagagttcctatggtcactctcggcatgataagtatgcaaatgaagacagatatcgtgagaagctattgtctcgttctggacatgagacaagggatgatcatatgagagatgagagtgatagcaggtcaaaaaactaccagcgcagtgtggaaaagtattcacatgacaaatatgacaggtctgatcatagaagcaaagaaaaacgtagagaaacatacttggagcatcagaaatataaagatatggattcttcatatgataaatctgcatctagcaagaggcatgcactgtatgatgaggtggagagggaggggcattcaagggactgggatggtcgaaatgaaagaagagattcccgcagaagttcaggggactacagaagtgaccaggcagtctgttattcagagtcaaggaaccaaagagatgaatcaggtccccaaagagactgtggtaaatctagtttaaaagaaggttataagagtgaacagaaggagtcaaatgatcaaaaccttccatgggaagagaaaagaaaacatgatgatactgagactgggaagggtaaagactggaaaactagacaagcaagcgagcagtgtggtattgaagacaaagaatcttctggaaagaaactaaagttgtttgatcttgacaaggatgacaattatagaaaagatgatgaaagtaagacttcaagttcaaagctttctcacgagagcaaggcagatgtaagggctgccaagaccagtggctttgatggtgacaatgacctagatgctgcgaaagttgcagccatgagagctgctgaattggttaataggaacttagttggggctggttgcttgactactgaccaaaagaagaaactgttgtggggtggcaaaaggagtacacctactgaagaggctataggatttcttgggccttcgggaatataccaacacgggcttgtgcgtactagtcctaaccttagtaactaccaggtcaacaactccatctttgtattgggttacttgggcttcggtacttatcaataccacccttctgaggagctgccttgtcctcaatgcaaaaagctgggaattggtatcaatgatctagatgcgacaaatgttgtggctgagaaggactaa

SEQ ID NO: 21510 - DNA, 276 bp, Glycine max
  Peptide Sequence Number=SeqID_138288
atgtatctttggtcgaggttgcatgtaataagtggaagagtagtgtctggccatcgttgggatacagctatgttttctgatcgtgagaggcaagaaaaattcaacaaactcatgggtatgagaggcgaaacaaaagtggagcagaatttcaacaaccaaagtagtaatgacagtctccgtgctgagaaggagaaggaacttcagatggacctagagaaacaatacactgcaggccttcgacgaagagatggccgtacagttggcttagggctttaa

SEQ ID NO: 21511 - DNA, 213 bp, Glycine max
  Peptide Sequence Number=SeqID_138289
atggggggacggatctttgaggtggagcagggggccaagatgggtatctccttcctcatcgtcttgcccgggatagtcttcataaggcccagattcaaggcgggctgcagcaccggctccgcttccctaactgtactggaggcggttgccgtggctttatcctctatggttttctggagttttaacatgacctccgagatggaagccatttga

SEQ ID NO: 21512 - DNA, 1056 bp, Glycine max
  Peptide Sequence Number=SeqID_138290
gattcgtttgaggagcaggccacactcggatcgttcgtcccccatggacgtcaggatgttctcgccgctgctattggacgtccagagcaccctggacgtgtccgtgctgttggagccggtgtcaccatcaagcaatactttggatcggctccacggacgtcccgtaacgcttcctccgtgcctcctgacgaattacagcaactgacccagcagatcagggacccgctagaggagtccatcacaatgaaagtgacgaggcaggtcatggcatccttcagccagcttcagtcgcagatgcaatctcagggacttgcagtgcctcttaagcctctggttggtccctccggtcctcaagtgagcacaaaggggagttgtgttgatccctcaagaaacgatcctgagacgggtgactctgacaggtgcgacttgtacatagaagcagatcctgaccgcctggttgccatggggagagtttatgagggatccactgttgttcatagcactcctttgttgcctggccaagtaaaggtgagtgtggaggaggttacagattcagatgctccagttcctgtacccactgatgaggtttccttagtggggcaagcacttcacaccttccttgcttggccgacacatctgctccaagtctttatcacagcagctgtgtctccagcaaaaccacctccgaagcccgatccagaggttgatgatccgctttatccgatgacattgaccatcccagagcttttcttgaggccttatcaggttagatgggatgccaccgtgttcggggtcgttaatccagatttccccctctacataaagcacaaaaacctctccgaaatcgcatacggtggtgaatgtcttagcatatcagtgttacagttgtcgattctgcatctcactgaaacatgtatacgagtggggaattctgatatctatggattcctcgagccacggtccattcagaggtctaggcaatcgcagtttgagtctgaaagttccactgcagtggacactggcagatggtggtcatcctgcccaaggaacacctag

SEQ ID NO: 21513 - DNA, 798 bp, Glycine max
  Peptide Sequence Number=SeqID_138291
atgaagatcacattaatcccgttgctccttctttctgtgttgggaataaaatcactgcttgaaggagcttatgattcacctcaccaagttgttgacacatctggcaatatactaagggtaggtgccaactactacatcattcccaaccctactaccaaatgttcaattttttccaaatacaaaggtaacaacgggcttgtgctagcaaaagtagcagctaacaagaccttccctcttgatgttttggttgtggagggacagcaattaggccagccactaacttttacaccgattcatgaccaaaagaaaggtgcaccggttcgtgtctctactgacctcaacatcgagttctccatgcaaacaagttgttcacaatcaaatgtgtggaaaattgatcactttgatagggcaacgaggaagtggtttgttacaactggtggtgttgtggggcacccaagttggagaactatcagcaactggtttaagattgagaaatatgatggtgactataagctggtttcgtgcccaactttttgtgcatattgcaaggttcaatgtagggatattggtgtatacgaggatcaaaatgggaacaagcgtctagccctcactgatgcgccttacaaaggaatcgtaccttttgccgagcctgaggtagctccttctactgcccgtgtcagcacaaagggaagctatatcgatccctcggggcaggacctagatatgactacatcagacaggcatgggttgtatattgatgacaatccttcctgcttagttttgttaactcgttggcaa

SEQ ID NO: 21514 - DNA, 216 bp, Glycine max
  Peptide Sequence Number=SeqID_138292
atgggaggggcaaatagctatttccaaattttgaattgggccttccagaataattttttgaagctggattgcttctggaattgtttccgtgaagaaaatccaagccaaggtgcttctgtaacacttccgagatgtttccgtaagcaaatccgtgaaggttttcctccgttattcaccgttcttcatccgttcttcgttcttcaacggttaaaatga

SEQ ID NO: 21515 - DNA, 411 bp, Glycine max
  Peptide Sequence Number=SeqID_138293
atgcaaaccatcacaaaatgtggaaagtacgaatgcttgaatgctgaaggccttccacttgccagcattggtgaatcatgccctcttgatgttgtggttgtgcaaagatcttttggcttgccgttgtcattttcacccgttaaccctgatgaaggtgttgttattcctatgtccactgatttgaacttcattttctctattggtcgtactatttgtgctgagtattcgccagtgtggaaattggatcactttcatgccattggctacccgggatggaaaaccatacacaactgcgtgtacctttatttcaagcatttctgcaaagatgttggtgtgtttgtggatgagaatggctgtaggcgtttggctcttagcgatgttccatacaaagtcatgttccagcgagcctga

SEQ ID NO: 21516 - DNA, 258 bp, Glycine max
  Peptide Sequence Number=SeqID_138294
atgatgctctcctacaacctaagaaaaggtagatggagattacaattcaacaggctcaggaaaataaatgatagtcctgtcatcactcatcctgcgctagtatctgatcatcctaaggtgaagaaggggcatcctgatgcaatcctccctaggaagggaccagtcactagagccatgagcaagaggctccaagaggattgggctagagctgctgaagaaggccctagggttctcatgaaccttagggtagatttctga

SEQ ID NO: 21517 - DNA, 186 bp, Glycine max
  Peptide Sequence Number=SeqID_138295
atggggaaaaggtggttacggtggcgccttccagaagatccgtttcgggttcttctgaaactttcggaagaatgtgctctggaagatttccggaagaactgggttctttcggatgacctttcagtgcttccggaagcactttccggaagaaccccttcttccggaaaattgttagttgttttttaa

SEQ ID NO: 21518 - DNA, 462 bp, Glycine max
  Peptide Sequence Number=SeqID_138296
atggttgccttcattaggcagtatcagtacaattttgatatggctctgaatagaatgcaactacaaaacatatgtaagaaagagcatgaatcgttcaaagaatacgcccaaaagtggagggacctgacagctcaagtagcacccccagtgatggagagggagatgataacaatgacagtagacacgttaccgctgttctattatgagaagatggtgggatacatgccttcaagcttcgccgatttagttttcgccggcaaaaggatagaagtgggtatgagaagaggcaaatttgaatatcctgctttgatgaataggatgactggggcaaatgaagagaataagaaggagggaggaacttatgttgtgactgctgttcccacattgtcaaatttcccaccagctcaacaatatcaatactcagccaatatcagcccttctcattacccaccaccttattag

SEQ ID NO: 21519 - DNA, 372 bp, Glycine max
  Peptide Sequence Number=SeqID_138297
atgaagttgtctatagcgaaattaaaagagcttgaagctcgggaaacggatggtgggctcgacaggcttccaaagaaagaggcggccctatgcaagaagcaaaaggaacggctcgagaagtatctgggtggcgttaaagacatgatgaggctgcccgatgttgtggtgattgttgggcaaccggaagaaatgaacgcagtgcgggaatgccgcaagctcggcatacggagcattaccgttttagacacaaactgtgaccctactgtggcagatctctttattcctgctaatgatgactcagtcacttcattgcgcttccttttacaaatcttttcagatgccattttaaagggacagaatcttgtgcgctaa

SEQ ID NO: 21520 - DNA, 1894 bp, Glycine max
  Peptide Sequence Number=SeqID_138298
atgtttcggcacggagatggggaacaggggagcctattctggtattacctggtaacaaactcctattcaatgaaactggcggcgaagccgtttcaagcaggcctcacaggcctcacaggcctcacaggggcaggcctcacaggcctcacaggcctcacaggcctcacaggggcaggcctcacaggcctcacaggggcagggcgttccgtcggacgggttcagccaaacgaccttgccttacaggcctcacaggcctcacaggggcaggggcccacgcccaagggcgttccgttggacgggttccgcgtttcgctgaacaagaccgggcccctgcctcctcattggcctggctctgatgcgcaagggcatcaagcacgggtggccttccaacccctgaaaggcaaatcactttcgctgaagggtgtggtagacccatcagcgggacctaccaggcaatgtcccccaaattcgcaagctgatttgccatcggctgcgttctctcgagactatcacttgcaaaggtatcaccgctctaaccaagaaacctgcctaacccagacctctgctgtttcggaaggtgattgggtgcagagcggagacctattggcagattgttccgcgagcaggtttggtgaactcgccctcggcaaaaacatcctcattgcgtacttgccatgggaagggtacaactttgaagatgctgtcgtgataagtgagcggctcatttctgacgatgtctacacgtcaatccatgtgcaaaaatatgacatcgagacacgagaaactcgctttggcgttgagaaaataacgcgccaaatcccagggataaccgatagagagaaggaacatttggattggcgaggcattgccaagattgggagttgggtcaaggaaggagacatcctcgttggcaaggtcagcccaaaaagctctcaacctctctcaccctacgaacgccttgcatacgacattgccaatgttgaagcagcaaccacagaagacacatcactacgtgtgccaaagagcgttgaagggagagttatcaactgccagtttttcgaggggccaggcgttaccatcgaaaagcaggggccaagcactgggcgtgtccgcatctatctagcagagaagagaaagctgcaggttggcgacaaggtggctggacggcatggtaacaagggaattgtttctacggtgttgccacgtcaagatatgccctatcttccagatgggactatagttgatatggtgctcaatcccctggggataccctcccgaatgaatgtggggcaagtgtttgaatgtctccttgggctggcaggcgttcaacttggacaacaattcaagatcacaccctttgatgagatctatggggcggaagcttctcgcagccttgtttacttgaaactctatcaagctagattgcggaccaatcaagattggttgttcaattcacgattcccaggcaagacaccccttcttgatggcagaactgggcggctgttcgaccaatggataacagtgggctatgcatacatgctcaagcttgtccatttggtagatgagaagattcatgcgcgctccactggcccatactcattggtaacgaagcaaccattaggcggacgatcgaaacacggtggccaacggctaggggagatggaagtctgggcactagaggggtttggcgccgcgtacacgcttcaggagatgcttacaagcaaatcggatgatgttgttggccgcgagcaggtggtcgaagctatactgttcaagggaaggatgtccctcgggaatccagaggcattcaaggtgttagttcgtgaattgcaatctttatgccttgatgtgggagtctatgttatatcacccggccgactgcagcgcgaaagct

SEQ ID NO: 21521 - DNA, 375 bp, Glycine max
  Peptide Sequence Number=SeqID_138299
atggtttacgtttaccgccggcctgctctaaagaaggagttgtcggctcttgcttgggttgagggaaatcagttcacaggaaaccgtatcgacaggatagggggccgttcagcaaaacaccgaacccgtccctgcattcctatgggatgcacgggacgccgaaaacgttcagcgaaacgcccttgcctcacaggcctcacacgcctcacagaggcaggggcccacgcccaaaggcgttccgtcggacggggttgcattgcttcgcaatgcacgcccacgcctaagggcgtttcgttgaacgggcaggcctcacaggcccttgtgaggcctatgaggtcattggggcatcatgggaccctctttaacgatcagtga

SEQ ID NO: 21522 - DNA, 1627 bp, Glycine max
  Peptide Sequence Number=SeqID_138300
gacttactggcctcccaggcctcccaggcctgggaggcaagggcgttccgtcggacgagttcgacgccccctgcattgcttgcaatgcaaggacttgcatcccgtagggatgcacgttcagcgtttcgctaaatcgaccttgccgaaaggtcttttcgctgaacagttcgccgttccatgggaggattccaacgcccgagttaaaaacccttgcagggcggaattcctccatcctacacttgtgaagaggtcagaggaggcagatgagcgccatccaataagagagagagaaggggaaaagagggtggttgtcacatggtcacgtgcctcgatgattgttcctattatgattggccataccatagctgttcacaatggtagggaacacatcccagttttcattacggaacagatggtgggccacaaattgggtgagttctcgccaaccagaacgttccggggccatgtaaagagcgacaagaggtcaagaagagtgacacaagcccgcgatggacctgtgaggcttccttggaacgagttcgagaacaacccgaacacgaaagagtggtcgaccgacgaaaacaacgaaacaacgttttattacattcttatgggacaaaaagtgcatcctttgggatttcgtttaggcattacacagcagcatcgttcacaatggtttgcaaaacccaagcaatattcgttcttggtggttgaagaccatttccttcggcaaacaatttcggcaaagttccctgaagcgggaatcgtttcagtagggatacagcgcaaagtcgaccaaataaggattgacatctgtgctgcacgtccacgtgccattgtagcgtttggtggtcaagatcttgacaatttgcgtcgatacctgtcgcagagtttgcggggtcatcgggaagacacgcttggcaaagcaagagcattcaacccccctacgccaggcattgcgaagccaatgccccaaattgcaatttacatcaccaagctttcaaacccaaacgtttcagctggtttcctttccgatttcctcgtggagcaattagagaaacgaatcccttttcgtcgtgctatgaaatcagctgttcaacgcgcgcaacgtgcacagatcaagggcataaagattcaagtagctggccgtttgaatggtgctgagatcgctcgaagcgaatggattcgtaagggacaagtgccactgcaaacgttgcgtgccaacgtggattacagctatcgaactgcaagcaccatttacgggttgctcggaataaagaacaaggatgcaattgcgtgtacatccgcccgacggaacgcccttgggcttgcattgctttgcaatgcgtgcatccctacgggatgcaaggcccgttcaacgaaacgcccttgggcgtgggcccctgcccgtccgacggaacgcccttgggcgtgggcccctgccccggtgaggcctcgtggtcgaatgaaaggaaaggccctgagaggtaacaaggtgtcgtttggggattttgctctgcaagcattagaaccgtgctggattacctctcggcaaattgaagcggggcgacgcgctatgacgcggtatgcccgacgtggtggcaagttgtggagtgggatcctctag

SEQ ID NO: 21523 - DNA, 435 bp, Glycine max
  Peptide Sequence Number=SeqID_138301
atggctttggtggccttgttccacgatatgatacaccgagaaatcgaggtctatgtggacgacatgatcgccaagtctaaaactgaggaggaacaccttgtcaacttgcggaagttgttcgaaaggcttaggaagtatcgattgaggttaaaccccactaagtgtaccttcggggtcaagttagggaaattgctgggtttcattgtaagccagaaagggatagaggtggaccccgaaaaggattgtcaagaggcatttggaaggatcaaacagtgtctcatgaaccctcctatgatgatgtcgccagtgcccagaagacctctcatcttgtatatgacgattttggacgagtcgatgggatgtatgctagggcaacatgatgagtctgggaaaagagaatgtgttatgctttggtctgggcgtcccaccgtctaa

SEQ ID NO: 21524 - DNA, 546 bp, Glycine max
  Peptide Sequence Number=SeqID_138302
gtaagtgcatatcccaacacgatgcatccaaagaattcaactacatggctaatccatatcatcaagggttccatcaaggaggacctcttcgatacaatcagggagaaactttttcttaaggccaaggttggagatcccatcctgggaataatttcaataaagatagacaatccatccatttcaccttccaaccaagggcctaatctttatgagaggaccaccaagctagaagacactctgactcaatttatgcaagtttccttgtcaaatcacaagagcacggagttagctatcaagaaattggaggatgtgagtaataaggaaggaaagaataaagagagagaagaggatgatgaaaagaaagatgtgagcaaggagaaaagtgataatgttttacccattaagaccaagatgcagttagctagggaggctaggagagagataattgtagccctagtgaaggacatcccttaccctttgatgccgtcaaagaaagcgagggagcattactttgctcgtttcatggatatatttaaaaatttgtaa

SEQ ID NO: 21525 - DNA, 268 bp, Glycine max
  Peptide Sequence Number=SeqID_138303
atggacttgaaagaaaattgtacttatgtcatgcacaattttaaagtgctaaaaaacaatggtcagtacagagtctgtgatcaccaatttaaattggtgtttattggggttactgttataagggagtgtgttctagaggacatcccttttagaaaatacatgtttgctggatttgcggatgttgtggctggccagtttgaacctgggctattggttgatgttattggtgttgtggaggaggttgtctttcgccaagtttcaggaaaag

SEQ ID NO: 21526 - DNA, 471 bp, Glycine max
  Peptide Sequence Number=SeqID_138304
atggcttctaggggagggaactcatattttgaaaagtcggttcagttagtgttaaaggaaccaatgaatgatatggaccacgctgatggctttagtggagaacctatggatggcaggatagaggatgatgcacttcatgatttgtttagtgcaaaaaggaagatgcggttcatttctgaattagagcttaaagttcaaacacttcagacagagacaaccacattgtctactcagtttaccaaattacagggaacggtgaaaaccttggccgcaaaaccatggctgaagaagattcagcaagcaagacctctcatttccatggttaacaaggttgcctctctatctacccccatggcagcacccaacgtcgatgtcagaaatcttgatctggacctggcgttagaaagggtttcaactgtgggaagatgtcgctttattgccaaatccccaaactcaaaggaattgcagaag

SEQ ID NO: 21527 - DNA, 282 bp, Glycine max
  Peptide Sequence Number=SeqID_138305
atgaacataaatttggagtttgaacttccctttgatgttccctctagattgtttctattgggtttgaagaagtatgggaaagaagacaccaatagatccacttcaccacatgtgctctcacaaaaacaacaaccaaattctactcctacaacaccaagaactcattttcagtggagtaatcagtctaacataggagtagctatgactctcaaccctgctcatgaaaaagtcttcatctctcattatagtgctaactcctttggtgttaaaattgagggatag

SEQ ID NO: 21528 - DNA, 183 bp, Glycine max
  Peptide Sequence Number=SeqID_138306
atgagtacgccaagatatcagcagaaagggaagcaagggaaagggagtcaagaacttccccgattgctagccaaggccaaagcaatggcggacacctactccgcccccaagaagatccacggacttctcagctattgtcaacatatgatagacttaatggaccatatgattagaaaccgctag

SEQ ID NO: 21529 - DNA, 492 bp, Glycine max
  Peptide Sequence Number=SeqID_138307
atgtggggaaaccctagaagaggatcagttacagatgcccgcgcccagcgtgccacaagctcgctcaacgagtcgtttgtcccttctcgtgcccagcttgctaacaagggtatcacatctaagctagatacctgcttgactacacttctagaggtaaaagacatcaaagaagttagtggtggtggggcattggcaaatttgcccaagagactaacttcaattccctcaaggaatagaagtgagagtttggaaggaataacgactgagatgttcacggaaaataccaagttatggataaagaaagtggcatactacaagaaactagaccatcagctagcagagcgggggagatatagaaatctggttgatatgaatgcttacttgggaggctttgcagctgcacttcttgacaatcttgtgtgggttatgaaaattgttcttgttgaggctgaaaaatcaacactattggtgttgtatatgagtgtggattga

SEQ ID NO: 21530 - DNA, 377 bp, Glycine max
  Peptide Sequence Number=SeqID_138308
gtacatcacgtgcgtcaaagctttgccaagagcttcgtgtcattgaggtcacctttgatgatgaagacgtcgtgcttgtcgagtccgacaacgtcgtctccacacatgctgccttgacggtggatctaggagaaggtgtgtacctgcttttcccattggatctcggtctaggacgtggaggggtagacactgccgaaatcaatgaaacattggaagttgagattaaagccgaggaacttgaaggagaggactttggcagtgatggcgaagcaaaagaaggaggtgaggatgagagtgggagagaggctttggaggaaaaactaggagaaggtgttatccctaatgttggagggggaaaagtgttggagaggatctag

SEQ ID NO: 21531 - DNA, 168 bp, Glycine max
  Peptide Sequence Number=SeqID_138309
atggatcgagcctgcctgatctacgaactcatcatgaaggtggacatgttgtcttgccaggagtctaaccctattttgtacaggggtgatgcctctggcacgggtaatgatgatgctgcagagattggagctgatgatgattacatcatattaaagaataaacaatag

SEQ ID NO: 21532 - DNA, 741 bp, Glycine max
  Peptide Sequence Number=SeqID_138310
atggatgccaagataactttaatattgcgccatggaggaagattcactccacgtgccaatgatggaaaggttgaatatataggcagagaatttgacgtttgggaggatatatctgcaaattacatgaacacatttatcctatgtgatctgttgcaagcatgtaagaagtatagcaggataggagattgtttttggttgattgataaggacttagattttaatcatgggttaaggagttgtacaacaaatggagatatattatacttaatgaaggatgctttggaaaatgagaatgagataaacgtttattttcatcataaagtatatccaattccagaagaagtcccactgatgttggacttgaaatgtcatccaattccaaaagctagtaatgaggatgatttagatgatgtacctgttgcaggccataaggaaggtaaatttttaatcaatctctattgtgcaaagaatgaacacagagactattttcaaatcaagtcatttaagcatgagcataaatgcttaagagaaatcaagaacaaacaagcaaatagagagtgggtggttagcaaacttgaggccaaactcagaatccagccaagccttaaatgtgttgaagttttggattatttcaagcaagagtttggagttcacattgaagttacaaagatgtggagagccatgaaagaagcaaagcaactagtagaaaggagtgatgataagaatgaccaagggttatga

SEQ ID NO: 21533 - DNA, 1008 bp, Glycine max
  Peptide Sequence Number=SeqID_138311
atggtgttgtttgtagatggttctttcagagtgacattattgcttccaactgaatgtaatacatacgcagatattgatgctgcatataaatgcctaaaagagcaatacggggtggaagatgagcaattgatattgtatggtcaatctgttgggagtggtccgacacttgatcttgcttcacggatagcagaactgagaggtgttatcttgcatagtccaattttgtcaggacttagagtactataccccgtaaaacggacatactggtttgatatttacaagaatattgataaagttggtgcagtcaaatgtcctgttttggttatacatgatctccaacacaccatcctcacaccaaggaatggacatcttgagcatgaagtttacaagactaaacatctgtgggtggggactgcagatgaagttgtggatgtgtcccatgggaagcagctctgggagctttgcaaggtaaagtacgaacccttgtgggtaagtggtggtggacattgtaatcttgagctttaccctgaattcattaaacatctaaagaaatttgtacagacaattggaaaatctaaagcaactgcaaatggttctaaaaaggacactgtagaatctgataatcaaggcaaagctagcaaagaatctgaaagtggaacttccgttacttctgaattgagtacagaaatccctgaagtttctagaaacagtttagatagccgtctcgagaagtctaaaaaaccagacaaaccggaaaaatctcgtatgagcacagaccatgttgataggtttaggagaagaaagggtgtcttatgttttgctctgtgtttcaatccttgtcttccttcattcacccaagtaaaatatggatggaaagaatttaaggctgccagagcagcagatattatctacaaccaccaagggataacttggcagcacaatcaagaaatgttgaagtctcactttgttaaatacaagaatgttccaatgatctatactatctcttga

SEQ ID NO: 21534 - DNA, 168 bp, Glycine max
  Peptide Sequence Number=SeqID_138312
atgcagatagtggaagcaataggccagtctcaagtgagcacatgtgctgcagagcaagcaacaaaggtgcattggattgcaatggccatgtcatttgggtggctgaccaatcttgagatgatcgagaagataatggtggtggtggtggcgattgaaaaagtccactga

SEQ ID NO: 21535 - DNA, 294 bp, Glycine max
  Peptide Sequence Number=SeqID_138313
atgctaggggcaccatatccactgcaactttcagcctctgacacacaatgcctaatccactgtggtgatcatatgacaattctcagaagattcagagctccattgcaatggaatgtagttgtgctcgacaaaggcattggtgataagtatgtcactctgctttggtataaattccttcaagaaggtgattttagcaatggagacgagctctcattctactataggcatgctaagaagatctgggaagttgtcatcaggcgtgcaattgatagggatgatagtgatatagattag

SEQ ID NO: 21536 - DNA, 469 bp, Glycine max
  Peptide Sequence Number=SeqID_138314
atggaatcacatgaagacaatacaagtggagacttcaatttcttctccgtctctctaacgtttgggaactctatcagagcagttggaggaaaaactgaaggagaaggaatcattcattctgaaatcgtaattatttctgttcacctggagaaggagacttgcagatcactatttcatcccgacgatttttgcttttttgatacaaatattggagtttttagagactcgctgtgcgtttggcaagatagcaacacccatcttggcttgtggcagatgaggaagtttcgagatgacaagtcttggattcaattaataaattttagttatttacatcttaatattcatccttatgaagaaaaatccatgattttaccattgtgcatgtctaacaatggagacttcttcatgctgaaattcactagaaatgctgatgatgaataccaaacaattctgtataaccagagggatg

SEQ ID NO: 21537 - DNA, 334 bp, Glycine max
  Peptide Sequence Number=SeqID_138315
gataaatgtaccaagttacttgcttcagggaatagaagagaagactgccaacttgaaaggaagtgagaaggctctagttgcacggcatgaagctagcaatgctgtagtaggtactgcagtagcaaaccttcttgctggacagccacatgttgagaaaaacgacaatctgggacttattcacagttggatcgtcgtgaaatttgataaccacgttcgaaaccaaattctgaacattctcaccgttgggaattgcaaaagcatgtcgaagctaagagaatacccttcgcaccgtacctttctcttttcccgcagaaacccagaacggtctcagtaa

SEQ ID NO: 21538 - DNA, 390 bp, Glycine max
  Peptide Sequence Number=SeqID_138316
atgcctgagctgcgttcccggccacgcagaaaccgccttgtagataacgcaaacgccgatgaaatcgtgagcgttcgtggaaccagagcgaggaagctgaaagacgatcaaggagtgaaggagaatattaataagaagaaggtttctggtagggttttggaagtggaaggcatgaatgagtacgatagtggtggccgcagtgctgataaggctcccgaagctgaagacgaaggcaccacacctcctattccagagaaggttcaagttggtggttccccattgtacagagttgagagaaaacttgggaaaggaggatttgggcaggtttatgttggtcggcggctaggagctgcgaattctaatgacggagctggtgccggtgctgttgag

SEQ ID NO: 21539 - DNA, 306 bp, Glycine max
  Peptide Sequence Number=SeqID_138317
atggcagaggaatctaagcttcaatgggaaggcaaagccggtgttccaggtcaaccgggcctaatccgctactactgtgcttccaccgtcgaagaaggaaccatcatgtgggccaaagagaagctgcttgcagtcgatcccgtccaatgttgtttgtcatatgaaattgttgacaacaacgtcggatttaagtcaaatgtggcaacactcaaagtgctgccaatgaatggagatggatccatgatagagtgggggtttatctgtgatccagttgaagggtggagtttacaagatttgaagttatga

SEQ ID NO: 21540 - DNA, 348 bp, Glycine max
  misc_feature (334)..(334): n is a, c, g, or t
  Peptide Sequence Number=SeqID_138318
ggcatctccgcatgtcatcggactcgccgtctctggatgacaaaggtgcagatgatgacgttagtctcggcgtgtcaatcggctcgcttgcctctggtgcagaagacgacgttagtctctgcgtgtcaacgggctcgcttgcccctggtgcggataaccactcgggtatcttcgcctgccacctgagttcacgggtcaggattaacagaaatcatctttgtacggataaccactcgggtatctccgcctgccacctgacttcacgggtcaggattaacagaaatcgtctttgtacggataaccactcggactcgccgtctctggatgacaaagngtgcagaagacgac

SEQ ID NO: 21541 - DNA, 525 bp, Glycine max
  Peptide Sequence Number=SeqID_138319
atgggcacccaattacccacacgaagttcggttcaaatacaatggagcaacctacccaatacggatggactctcagaggtcagggcagatttaaaaatctacgagtctattatcatcaacttctttgcctgcgatgataataccgtctttgatctacattttacgcctcccctcaatcaacagacatgcggtagaccaatacttcattcccgtgtacatgcctggagaactgaaattacccaatgtatactgggtgctccccaaccactggaaatcccatcacatgcaaggaaatatctgaaacaatgtgagaatcacttgacaattttaaggaagactgcacctcctctgcaatgggacgtcgttacacttgaccgcgacattaaagataaaagtatcgttcggccatggtacaagtttctcagggaaaacgatttccatcacgaagacgaggtatcattctattaccggccacatgaaagaatttgggaaatagtcatcagaagagaaaggaagtggctataa

SEQ ID NO: 21542 - DNA, 1800 bp, Glycine max
  Peptide Sequence Number=SeqID_138320
atgctgaattttcttaatttttctcttctattgacgctgttgtttcttctgtggaagcctgcgataagcaaaaacgggtgcacggataagtgtggacgcgttcgcattcaatttccattctacctcagaaataatagcaaattgaatcacaccaccaccgcctattcttctgggttcgatctgctatgtacggatgcagatgagactgtgctggagctgccttctgttccaataaaactgtttgtcaaaagcatagattacaagttgcagcaaatccaaatctacgaccctcaaaattgccttcccagggaactcataaaactcggcaattcctctgttgctccatttaaattccaatcatttggtgggaataatgtttccttcttccgctgcaactcaatgtcatcatcatgcccaattttgcaacttggatatgatgaaggtgactttattgatcctgaaataatatcttgcaccaaggtgagtgatgttttctccgtccagtggcaagtgaataattacttggggaacgcggtggttatggaatggtccaagcctgactgcagtacctgtgaagcacaagggcataaatgtaaatacaagaatggtactcaaggtgaaactgaatgtttcatttgcccaacaaacaggatttcaacatcaagtgttgttcttattgctgcagggggaatagttggaatgattcttttgctggtggtggtcaaggcgttgttgcatttgtatgaccattatatgacgaaaggagaagaccgggctcgaatggagaaattcttggaggattatagggcaatgaagcctactagattcacttatgctgatattaagagaatcacaaatgggtttagggaaagtttaggggaaggagctcatggagcagtcttcaaaggaatgctctcccgagaaattctcgttgccgtgaagatactcaatgacacagtgggagatggaaaggatttcataaacgaagtgggaaccatgggcaaaattcatcatgttaacgttgttcgcttgcttggattctgtgcagatggattccaccgcgctctcgtctatgatttcttccctaacggatcactgcagagattcttggctccaccggacaacaaggatgttttccttggttgggagaagttgcaacaaattgctcttggtgttgccaaaggggttgagtatctccaccttggctgtgatcaaagaataattcactttgacatcaatcctcacaatattttaatagatgaccattttgttccaaaaatcactgattttggacttgccaagttgtgtcccaaaaatcaaagtacagtttctataactgctgctaggggaaccttaggctacattgctcctgaagttttctcaagaaactttggtaatgtttcttataagtctgacatttatagttatggaatgttgctcttagagatggtgggaggaagaaagaatacaaatatgtcagcagaggaaagtttccaagttttgtaccctgaatggatccataatttgctcaaaagcagagacgtgcaagttactattgaggatgagggagatgttagaattgccaagaaacttgccattgtaggactttggtgcattgagtggaacccaatagaccgtccatccatgaaaactgtgatacaaatgcttgaaggagatggagacaagttaattgcaccacctactccttttgacaagaccagctcttctagaacaagtgtagttgctccaacaagacgccagaattttgagttggaaattattaatgaaatagaagaataa

SEQ ID NO: 21543 - DNA, 288 bp, Glycine max
  Peptide Sequence Number=SeqID_138321
atgttctctttttgtaaaaagacacttgctagcattgccacacctcttgggcttgagtttattcctcaagtaaagaagttgttggatgagggtttggttcgcaagagcttaaatccttgtgctttgttggttcccaaaataggtattattaggcaccaagtccctaaaataggtggtatgatgaatgttttgagtggtgcaaccctcttttgtaaaatcactcgtacacctaacatcttcatggtgtcgagggaaggagcccaaagtatgaagaaccttgggatttga

SEQ ID NO: 21544 - DNA, 672 bp, Glycine max
  Peptide Sequence Number=SeqID_138322
atgcattggatgtggttcatagtcagcgacggtttgaagaatgaatggaacaagtggttttgtgatggaacagcgttagacaatgaagccatgacatcactacgcaagaaatgggcagcatattttctacaacttaaaaacatggaagtcattgttatccgcattatggtagtcctattgacagtgcatctaacaagaagaaaaatcagttacagagatgaggtgttcaatgaatctatatggcatgttttgttgaaatggggcctcctttatcagcatggccttgggagaactttggaacatacaagggacaatttgttgattctgcatgcactagttgcctccatggcatatatggtatatgtttccctttctttagcatctttctctctggaatgtaaaagatatcaccacgtactcaactctgataaggacactaatttgtgcctcttcatgcctttgtttgatgcacttggcaataccctcaacaatattcatggaaatcacacaaaaggcaaacttcaccaaacgtggcttatacctagatgtggttttcagtatttcttgccatttgcgactgagggaatcaagaatcaaattgagcaagctatccacagggctgataaaattggggttaaagtcatcagccttggtgcattgaataaggtctga

SEQ ID NO: 21545 - DNA, 1380 bp, Glycine max
  Peptide Sequence Number=SeqID_138323
atggccgcagaaaataacgcggcaaagaatacaaaggatgttgaggacactattaccgtggtggctgacggccgccagcagaacgccaccagcggttatcagccgctgagttcgtccacggcgacattgacctcaatgccgctgctggatattccgcaggtggtgaataccgttagcgaccgggtgctggaagatcagcatgctacctcgctggatgaagcattgtataatgtcgctaacgtggtgcagaccaataccctcggcggtacccaggatgcctttacccgccgcggcttcggcgccaatcgcgacggttctatcatgaccaacggcctgcgtaccgttttgccgcgcagctttaacgccgctaccgagcgggttgaagtcctgaaaggcccggcctcaacgctgtatgggattctcgaccccggcgggctgattaacgtggtcaccaaacgccccgagcaccagttctctggttcggtttccgccacctccagcagttttggcggcggcacgggtagcttcgacgtgaccggtccgatagaagggactcgtctggcctatcgtctgatcggcgaatatcaaaatgaagattactggcgcaatttcggcaagaacaaaagcagctttatcgccccttccctgagctggtttggcgatagcgcgaccattaccgcttcgtattcacatcgcgattacagcgccccctttgaccgcggcaccattttcgacctcgataccggccacgcggtcaacgtcgatcgtaaaacccgtttcgatgaagcctttaatatcaccgatggttattccgatattgcccaactgaatgccgagtaccgtcttaacagcgcctggaccgcgcgctttgattacagttacagccaggatcactacaacgataaccaggccagggtaatggcctatgattctgcgaccggcaacctgacccgccgggtcgacggcacgcacggctcgacgcaaaagatgcattccacccgcgccgatctacaaggcaatgtggtcatcggcggcttttataatgaactgctgaccggcgtcgcctatgagaattacgatttgctgcgtaccgatatgctgcgttgtaagaacgtgaaaggctttaatatttatcatccggtttacggcactctcgatacctgtaataccgtttccgctgccgatagcgatcagcgcatcaagcaggagagctatgcgacctatctgcaggacgccctgtatctgaccgacaactggattgccgtggccggcgtacgctaccagtattacacccagtacgccggtaaaggccgtccgtttaacgtcaataccgatagccgcgatgagaaatggacgccgaaggctgggctggtttacaag

SEQ ID NO: 21546 - DNA, 351 bp, Glycine max
  Peptide Sequence Number=SeqID_138324
atgaagagagatgtgcacaattccaaattagccattaggaatgttgttagatttattttatatgaggccactagggtcttctctgcatcattgaatgcgagcttacacattccatttcatcaattagatcctattcatattgcacttgacaagacaattttaaatctaaatactattttggcccctacggggtgtgacatgaggcaaaagtatgataagtattggggtaatgtagataacatcaattacttaatgtattttggtgttattcttgaccctcattatttgttagagcttgtcacttggaattttgcagcaatgtataaatgtgatcctctcaaagttgtttga

SEQ ID NO: 21547 - DNA, 246 bp, Glycine max
  Peptide Sequence Number=SeqID_138325
atgacatcagtgttactactaaattcccctgcagtgtctaatgattataatcatcaggaaactctgcagtcaaagctatctctctgcttctcaacaaagtcaccacaaggaataaatgcagtttgtgagagatttccaatgattaaacttgtgacatcagagattgatgcatcactgaatgagaaatctcatgtgatccctggcctagggcagtttggtgatcgttactttgcgactgatgattag

SEQ ID NO: 21548 - DNA, 169 bp, Glycine max
  Peptide Sequence Number=SeqID_138326
tgcgatgaacacgatgctcgaccttagacaaaatgatggtcagatggagaacatacagcttcaaggtatggtggcgaaggagaagaagcagagacttgtgacaatgctcgagtgcgacgaacacgatgctcagatgcagacagggacggtttcgctaaacggagattag

SEQ ID NO: 21549 - DNA, 600 bp, Glycine max
  Peptide Sequence Number=SeqID_138327
atggagatgaacaattttgaaaaagaggctacaccattgaacctcaacattgaggacaagcatacgctccaatccaatggcttcaaagctccatcatccccaaaacaacccttttttattggtgttgctggtggaactgcatctggaaaaacaactgtatgtaacatgataaatactcaacttcacgatcaacgcgttgtcctcattacccaagactcgttttatcactcattgagcgacaagatgttgcagaaagttaatgagtataattttgatcatcctgatgcctttgatacaaagcttttgctttcaacattggagaaattaaaatgtggacaacctgttactataccaaattatgatttcaattcccataagagaattgaagctggacgtcaggttcaacctgcaaatataatagttttagaagggatattagttcttcatgattctggtgttcgtaatcttttgaacatgaagatctttgttgatgaagattctgatgtgcgccttacacgaaggatgcaacgccttgctattgagcgtgggaggaatattgagaatgttttggatcaagttagtaagcttactccttattag

SEQ ID NO: 21550 - DNA, 352 bp, Glycine max
  Peptide Sequence Number=SeqID_138328
atgattgttcagtattccagatttgtaaagccaagttttgaagattttgtattgccaactaaaaagtatgctgatattatcatcccgagtggaggagataatgatgttgccattgacttaatagtacaaaacatacgcatgaagcttggccaacatgatttgtgtaaaatatatcccaatatttttgttatatgttcaacatttcagataaagggaatgcacactcttatccgagatgttaagacaacaaagcatgactttgtcttctattcagatcgtcttattagactggttgtcgagcacggattgggtcatcttcctttttctgaaaaacaggtgataacaccaacag

SEQ ID NO: 21551 - DNA, 507 bp, Glycine max
  Peptide Sequence Number=SeqID_138329
atggcttctcataaaaggaaggcaccagcttcagtgtcccaggcacgatatgacagatcaaaattcacatcacaaaatgcctgggacagatatgcagacaatattcttggctggaaaatctttccggaaatgaatgtgaagctgttctatgctgaatttgatgaatttagaagggaagttgagaggcggaactggcataaggagctcactaacttctcagagggaagtattgatgttgctattgttaaagaattttattctaacctcgatggccctgaagacaaattgcctaagcaggtaagggtgcgagggcacctaattaaatttgatgctgacaccctcaacaccttcttgaagacaccagtggtcatagaggaagaggagagcttgcccgcctactccagacgggctgcctctgaagatcttgaggaagaatctgactactctggcccagacctggagtgttctatccttttcaaacttagccccgacatcccacacttctaa

SEQ ID NO: 21552 - DNA, 495 bp, Glycine max
  Peptide Sequence Number=SeqID_138330
atgcagattaagttctacaacaactcactctccggggagttacccaagggaatgtccaacctcacttcgctgagactcattgattggcgagttaccgctgagtattgtagacttgccaacctctatgagctgaggttgttcaggaacaagcacgtttggaaattgctgaagaatttggggaagaatgcttcgttgaagtggcttgatgtttccaccaattggttctccgattggattccggggagtctcagtaagcatgacaagttggaggagttgctgatgctagagaacgagttctctggggagattccaactagtttgggcagctatcagagcttgttgcgtgtgagattgggtaccaatcgattattcgtcaaggttttggctgttggaggaggagctctagagagcaccagaaacgccactattgctaatggggaacgcttgaacgactacatcgaggtaagggacgagttactcatgcttgaggattag

SEQ ID NO: 21553 - DNA, 231 bp, Glycine max
  Peptide Sequence Number=SeqID_138331
atgtccttccgcgaagaccatttctggaagaaccttcttacggaatcattccggaagacacttcttccggaaaatttccggaagacccttctttcgaaagaagatttcgtgattccggaaaaaatcaggaacactttccggaagaacttcatccggaatgtttctggaagaaggttcttccggaagataaccttcttcttccggaaggagggtcttctgaaatttttttaa

SEQ ID NO: 21554 - DNA, 207 bp, Glycine max
  Peptide Sequence Number=SeqID_138332
atgaggcgagagaagtccaagacacgaaggttaacaaggttcccgagggggtccgggatggggctcacgaggttgcagcccttgagccagagtttctgggttggtgaggttgttgagagagtaagggatgagagaagggagaaaagggttgaagaagaagttaagtgtttaaagagtagtgatgttgaagggggaaggcggaactaa

SEQ ID NO: 21555 - DNA, 411 bp, Glycine max
  Peptide Sequence Number=SeqID_138333
atggatcaattattcacaatgatactggcgtttacttccaaacttcaactctgcctaaaaaccaaaatacgcaatacccttcagctatccgacaaacaatttttggatgaaattcactaccggaagccattcaccgatacagatggaataataaacttacttgaacgcactatggcccgtactcatgacgtgatcctgtattacaacgagaaatggaacatgccaccgcagaacaaatttgttggatgcgcgttcacaggaaaaaatcctaagaaattccgaattccttcaacatgtaccatcgatgaactgaagaatttaataaagcaagttgcacctaaagagattccccctcttggaattcacgaatcacaaacggtgttatttgatgaaaccggggaacgggaataa

SEQ ID NO: 21556 - DNA, 597 bp, Glycine max
  Peptide Sequence Number=SeqID_138334
atggatcaattattcacaatgatactggcgtttacttccaaacttcaactctgcctaaaaaccaaaatacgcaatacccttcagctatccgacaaacaatttttggatgaaattcactaccggaagccattcaccgatacagatggaataataaacttacttgaacgcactatgacccgtactcatgacgtgatcctgtattacaacgagaaatggaacatgccaccgcagaacaaatttgttggatgcgcgttcacaggaaaaaatcctaagaaattccgaattccttcaacatgtaccatcgatgaactgaagaatttaataaagcaagttgcacctaaagagattccccctcttggaattcacgaatcacaaacggtaagacgattgtttttctgccaaccagctcgctttgagtattcagatatgcttataaaatatgaaataaatgagctgaggaccaacgaagaactgctgaaggtgttagtacaatctaactactggaaaaaatatggaccaatagaaattttagttgtctttactaaatatgttgtgaaaatcgaagacgaggtcactgggacatcgctaaacaactga

SEQ ID NO: 21557 - DNA, 456 bp, Glycine max
  Peptide Sequence Number=SeqID_138335
atggcgaaagctaggggatcttccgaaagtaataaacgtattccggaagaagacgtcttccagaaagctcccggaacacctcttccggaatgtttctggaagaactacttcttccggaaacattccagaagaagagttcttccggatgacctttcagtagttctggaagcactttccggaagaccccttcttctggaatgtttccggaagaactacttcttccggaaaacacgaggtttaggtcgtgccataggtagagttgtaggcagagatagacctggtgatgaggatgctgctaatgttcccgagagacgaaggcctactgcctcagcccgtaggctacgcgttcatcagatgacaacggagggacgcgatatggctaaggacgtcgctgacatgactgacgatgtccctgagcaggctgcggaggcacctgagatgcgtgcggacgcatag

SEQ ID NO: 21558 - DNA, 483 bp, Glycine max
  Peptide Sequence Number=SeqID_138336
atgggaaagttgatgagtgcacttggcttagtccgccacctgcggcactctctcttgcctaaaacaaactcccatgcttggtttggaagactcaattcactcacttggcatttcccaagactcaacacctggggagacaagtttccaaattctgaccctgactgggacctgatcattgcaagtgatatcctattatatgtgaaacagtatgcaaatttgattcagaccatttcctttcttctcaattgttacaagccgcaagagagaagagcagtttctccaactggaaatgatgagaatgatggagatgtagtgttgccgcggccagcctttttaatgagctggagacgcagaatcgggaaggaagatgaattgcttttcttcaatggttgtgagaaagctggtctaaaagtgaagcatattggatcccgtgtatattgcatcaattccatagagaatgagatatcagaaacaaaaggttga

SEQ ID NO: 21559 - DNA, 206 bp, Glycine max
  Peptide Sequence Number=SeqID_138337
atggatatagctatcttctctccatcatccctcttctctgaagatgacattcctactcgcgaggaagatgcagactctcaagaaagctatgttgagaggaagcaccagtttcctgggatgtcttggtgctggagcagctgtgagctttgtaatggtgctgaggtagtgttgtctcatgggaatgctgtgtggtttgtgatggaaag

SEQ ID NO: 21560 - DNA, 189 bp, Glycine max
  Peptide Sequence Number=SeqID_138338
atggtgaagatcaaacattccaatcacgaaaagcacttagtcttaggaaaaaggtgtctagtaatcgattacttggagagtcaagtagacattcgattcggagagatggattctaggatcacgaagattgaaggcgacattactttcatcaaagattgcttcaaccttccaccgccaccatccacttag

SEQ ID NO: 21561 - DNA, 237 bp, Glycine max
  Peptide Sequence Number=SeqID_138339
atggaagacgcacccgtgagccctcgcgtcgccctcccgctgaagggagaagttattgggcttagtgcgaaggtacgtgctgggcgagttctgcaactctcgcttagcgggccaaagccgtgcttagtgaataaaatgatcgttgaatgcaatagtggcccatgcttagcgtgttcgtctcgcttagcgctattccaaatagagaaggaattgggcttagcgagagcattcacttag

SEQ ID NO: 21562 - DNA, 162 bp, Glycine max
  Peptide Sequence Number=SeqID_138340
atggctgctgtggaattcagtgccctggccgttctgtacaaagtgtgctctgaaatcgcgacactccgcttagtgccaccttcgcgcttagtgcgagtaagtggaattgggcttagcgccagtctcgcacttagcctggttgaaggcacctgttgcgcttag

SEQ ID NO: 21563 - DNA, 195 bp, Glycine max
  Peptide Sequence Number=SeqID_138341
atggctcacaatgttgcccaggatgatgcctccaccatagctagtatagaaggtacatcagagacattgaaggaagcatatgatgggggagtgagcaaaatagaatcaagtccaccaagttgtgagcacaagtgggttgtgttccatgtgaagccatccaagttcaaagcacgagcacaaggcgcagccatttag

SEQ ID NO: 21564 - DNA, 234 bp, Glycine max
  Peptide Sequence Number=SeqID_138342
atgtggactgttgaagtcactcaatccatgcttgctgccccctatccactgaaacttcctacttctgtcgcgccgcatgttgatgcctgcggccaacatatgacaattctaagaagatttggctctcctctgcaatggaatgtcatagtcctcgacactggcattggtgacaaatatattgttcaaccttggtaccaatttctcgcgaacaacgattttgagccatggagatga

SEQ ID NO: 21565 - DNA, 158 bp, Glycine max
  Peptide Sequence Number=SeqID_138343
atgaggaagaaggggcagtcgagcatgatggaagaggtcctagttggcgaccaagaggatgttggagcaggaaagttcgatggtgatcttggcatgaacaatgaggttaaaggtgtcgtcagggagggaaagacttgcaccgtcaaggagatcgacac

SEQ ID NO: 21566 - DNA, 252 bp, Glycine max
  Peptide Sequence Number=SeqID_138344
atgccacgtattacaggaaaggctaatttggagaagtcagatttggagccagctttgaaagctccaaaggacaggctcatgaccaagaatgtggctgaggaaatagttgagaaactatatgagcttgtggcaacaagtcttaaaggcaaaaagctagcttcatttacaaggatatcttcaacaatgcatgtttgttcatatccttatatttatgcttccataacattcatactgatatggttcaaaaattga

SEQ ID NO: 21567 - DNA, 396 bp, Glycine max
  Peptide Sequence Number=SeqID_138345
atgggggttttcagagcttgtgttgctaaagttggtggtattactaccatggtgggtttgcatttggatgctattactaggtggaatttcacctttcttatgcttgagagtgcacttttgtaccattgtgcttttagtagtcttgaatttgaagataaaagctatgtgaattgtcctactaatgaagagtgggatagagaagcaacttgcaatgttgcttcaagtcaaacttcatcacaagggacttcatctgttactacttttactagtaaaaactcatcattgcagtggaatattgtgaatgagtttattcagtatgagaatgaaagtttgtcaggaaaagaagataacatcatagaaattgggaaggatgatcaagctacatcaaacatttag

SEQ ID NO: 21568 - DNA, 489 bp, Glycine max
  Peptide Sequence Number=SeqID_138346
atgtgcaaggagaggttacacgagatagtgaaggaagaggttcacaaagcgaaggacaatttggaatgggaatcaacgacgaagaagtgctttgtaggcatgggcgaagaggttttaaggtggagtcataacaaggacactccaagttgcaggtgtgagcttcagaccccacattgtgacatcgtgggctccactgtggtggtcatcatcattatgccagagaaaatcattgctgcaaactgcggcaactcacgcgccgtgctttgccacaacaacgtagccgtcccactctccgacaatcacaaggctttacaaagaactttagagtttgagggtgaattggctgagaaatttgagggaggcactcaaaatagagagattgggaatgagattgaagaaatagttaaagggaataattctaatgaatacaagctccaacctatgaagccactttgcatcattatctacctttcatcaccatcaacctaa

SEQ ID NO: 21569 - DNA, 273 bp, Glycine max
  Peptide Sequence Number=SeqID_138347
atgattcaacgatttgcgagagcggcaaaaacacttatgtgtgagcgcaaaggtggtgtgagtgcaactagagagaggactatgcatgagcacgacggtggcacgactagatttggaggtgtggcacgaccgcataggtggactggtgtgggtgctaccagggagtggacaatgtacaagcacgagtgcatgacggccagagaatgtcatggtggtgcaactagtgtagggcaaaagaggtttggaggtgtgacacgaggaataagggtttga

SEQ ID NO: 21570 - DNA, 597 bp, Glycine max
  Peptide Sequence Number=SeqID_138348
atgtcattgctggccgcttctaacctggcttgttggttggtggtcttccgccatgtttcatcaagaagatcctatccaccctcagtcaataattctttgaaggcctcaaaattacttattaatcaaccggtggttgaaattcaagaattcaatcagagccttcctgaattagggattgaggtctggctttcagaattaggcattgaggttcgatcagttttgacacctcatggtcaagggagttcacagctttcaagttctagtcaattatcatcaaaggatgtctttctttcaaaggctgaggcaaagagcatttcagagattaacaacatttctgaggaaattgtttgtgttactattggcacaattaccaaaattgttatggataatcattcttggtatagacttgaggtgatggtcaaccaaaaggacgaaagcacaaaatttctactatgggacagtgaatgtactgagttgattgggcaatcagttgatgaagttaataggctgaaaatagcagatggtgatgtcgatttaaatgcttctcccgaagcacttgataagttgttgggctatgtccttgcctttaaagtcaag

SEQ ID NO: 21571 - DNA, 252 bp, Glycine max
  Peptide Sequence Number=SeqID_138349
atggctgatgctctagggaatgagaattttttgagagatgcgatgattggtgcgttcacgacattcaatttcttcctttgggttcttcaaaggagatccggagcttgcaagaacatttcaacaattgcaagaaaaaatacgggagttgattacattgatgatcaaagattatcagcgtatcaatggagaaggaggaattgtgaagacatgctcaatgcaagcaaggaaatgacatttattccttctctgtaa

SEQ ID NO: 21572 - DNA, 168 bp, Glycine max
  Peptide Sequence Number=SeqID_138350
atgaaatcagaggtagtgctggtgcaggaccggactatatctaacattgaagaagaacacattactagagcaagcttaagccgtctaacgcccaatcacagtagtgctccaccatggtccattccacctgaaatatcattcttcgataacaaaaatggatatatgtag

SEQ ID NO: 21573 - DNA, 874 bp, Glycine max
  Peptide Sequence Number=SeqID_138351
atggctacaaatgtgaagacatttatgcccaaaatagataatgcaagggaattcatgaaattggtcaaggattactcaaaatctgatattactaacaagtcaattatggaaaatttatcaagtgagcttacaaacaaaaagtatgattggtctcaatcaattcatgatcacgtgacagaaatgactaatctggcaacaaagttgaatgtcatggggatggaagaggaaggtagattaaagaaaatgaaggataagtcaattcatctcatgactcatgatggagccaatattggccagagtaagccaaggagtggtcacttcaagaaggactggccgaaaagaatgaaatggtttgaaaagaaagaagtaaatgtgtataattcgcataaaaagaagtttgatgcaagaaccattattggtttcttcattagtgggagtgagaaatcacgaaagctgaatattgtagagactcgtggtgaatcttcttcacctatagtttttcatgaagatgttccttcggttgtattacggtcaaacaacacccagagacaatgtaataacgttaataacccacaagatgaacacataggtaatgaaccagtagacaatgtgcaagtcacaaatgaacaagtgatagaaaaggcgcaagaaacaacaccaaggaggtctaaaaggaaaaagaggccagctatttcaagcgattatgttgtgcattcacttgagcatgaatgtgaattaagcattaatgattatccaatctcatttagacaagccatggaaagtggctattctaaaaagtggctcaatgtgatgaaagaagagttgaaatcaatggatgacaataaagtatgggatctagttgaattgcttaaag

SEQ ID NO: 21574 - DNA, 348 bp, Glycine max
  Peptide Sequence Number=SeqID_138352
atggatttgtggaaggccgttgagaaggcaaagaagctcagaggcttcatcgctgagaagagatcactgttatttacgattgagtttatggattatcgttttgacgcattttggtgtgtttcgtgtgcagatggcactctgctggaacctttgacaagggcacaaacactggtggacccttcggacatcgctattaggcttttggagccactcaaggcggagttccctattttgagctacgccgatttctacccgttggctggcgttgttgccgttgaggtcacgggtggacctgaagttccattccaccctggaagagagagttttacgggattatctacgaggtaa

SEQ ID NO: 21575 - DNA, 414 bp, Glycine max
  Peptide Sequence Number=SeqID_138353
atgtgggttttcttaaccggtcgtcaaattgactgggcccatcttatgagatatcgcatgcataaggcatcgcgatcaaatgctccactcccatatccccatctgattaccttgtttctacaacattttaatgtccctcttgactctgagccctttgtcaaagtcaagagatccttctctatcggtgcaaatgtagtctcttccttcggataccgcaaagagagggatggctcttgggtgaagaaggatgctccagtacaggccgctggagaccgttctccatcaccacattctcagagagatgactcttcatctcttatgcacaacattcttgacagactggatggactccacacctttgttggagagtgctttgactcgctggacagccgtattgatgccatggatgcatga

SEQ ID NO: 21576 - DNA, 117 bp, Glycine max
  Peptide Sequence Number=SeqID_138354
atggcgctaagcgtgacgccgaggtggaggacacatcctccccactgtgtatcagtgaattgctctcaaaccccttcttctacttgtaaaaggtgcttccttgtgatggaaggctaa

SEQ ID NO: 21577 - DNA, 594 bp, Glycine max
  Peptide Sequence Number=SeqID_138355
atggtaggaccagtgaggcctcaatttgtgttgtttggttcgtccatagttgagttcagttatagtgatgaaggttggggagctattcttgccaacttgtatgctcgaaaggatgccactgatcaaccatcactgataattgtgtactttggtggtaatgattctatgcatccacatccatctggccttagccctcatgtacctctccaagaatacattgaaaatatgaagaagattgctatccatctcaagctatgccacgagatgaatgtgaaagccattgatctctggtctgcactccggcaaaggcatgactggttagatgtttgctttacggatggaattcatttgtcaaatgagggaagcaagatagtggcaaaagagatattgaaagtcctcagagaagcagactgggaacctagtctggactggaagtcaatgccagttgagtttgcagaagattcaccatatgaaccaattggtgcggatgaaaacactcatatagatgtctctaactggaacaacatccagggaaagtctcaactggaaatgagtaattgcgcattgaccaagggatttagctcagttgattaa

SEQ ID NO: 21578 - DNA, 495 bp, Glycine max
  Peptide Sequence Number=SeqID_138356
atggaggcttccttggcaaaggatacttcccctaatgatgtgaaaaatggtcaagggttcaaaggccatagcatgcttgctcctttcacggctgggtggcagactactgatttgcatcctctggtcatagaaaagtcagagggaagctatgtatatgacattaacgggaagaaatatcttgatgcacttgctggtctatgggccacttctttagttgataatatacaattttttgtaagcatgtacacagttgacattattggacacgcaggtggtcatgatcttactgaaattggtgaaagaggggtaaacatcagcggtggccaaaagcagagagtatccatggctagagctgtctactccaattctcatgtgtacatctttgatgatcccctaggtgctctcgatgcgcatgtggctagacaggttacctttatgccaactaacttctctatagcttctgttatctctatattagcactcaatgagatataa

SEQ ID NO: 21579 - DNA, 477 bp, Glycine max
  Peptide Sequence Number=SeqID_138357
atgcttcgggcggcgagaatacaatgggatctccgtaaagtggataattatgagtgttacgaagaattgattgggaagtcaatggcaaaaagaaggagatccttagctcgttatttagttcgaattggctttggaaggaatcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggttttccctggagatggaaaattcgtccgccaggttttatcaatttgcaaattcttcctcaattagttaaaagaatgaaattggccgatattatgacaatactaggtagcatagatattattatgggagaagttgatcgttga

SEQ ID NO: 21580 - DNA, 759 bp, Glycine max
  Peptide Sequence Number=SeqID_138358
atgtcctcctttcgcgatttggagcagaaatgggcaccaaaggttgaagctttgttgggcaataatggtggaggaagaaaagaagaagaaggctgcgatgtcacagtcaggatgaaaggcaaagcctgtggtaaccaaatgcatctcctcttcagaatcagaaatgtcaggcaaggaaccgatagtagcaacaaagagcttgagggagtttttgggattcacgataaagcatccgtgaccatgttggtattagcaccatttctttaccgccgtggtgatagcgaaaaagtccctaacataggtggaagctcgaagtacttaagggctgaaaggagaccagtcaaaggaatcttttgtcatcggcctgctcaaaggtgtcgtgatggacgcgtacccgtaaataaactgatgataaaattcggtgaggccctagaagattacggtatgggtgacaactggatagcttggactttcaccaaaacgggttcaactcctttaacagagactaagtggccaagatactcgacttgtgacctttctacaacatcgattcaacctaggcttcaatttcatgtttctgaaaatgcgggtaaagatatgggtgaacatttacaggctcagagttgggaagaagatgaatatggtgattgggtagtttgggttgaaaggagttatgtgggaataatgcaaatatggaagaattcactagcaccagccttgtggactagacgacgaagttatggtggagtgatgaagtga

SEQ ID NO: 21581 - DNA, 141 bp, Glycine max
  Peptide Sequence Number=SeqID_138359
gtgaagtggtgcttaactgtgatggtgtcgtggctgaaggtggaacgaaatcagtttgtggtggcgctttgagggatcatgcagtcttgatagctgagttaacagctatccttattggtttaaggatggcttggcataaag

SEQ ID NO: 21582 - DNA, 1275 bp, Glycine max
  Peptide Sequence Number=SeqID_138360
atggacttgcccccgcgcgtgaattcagagatgtcatggagcaccacaaaaggcattcttccagaaaatgctttgccaatgttacagatgcagatgtgtcttatctttcttgcaacctttttcttgcacacatttctgggtcgtctaggagtccccagattcacttccatgagcgtcgttggcctaatctttgcaactaccttctcagaaaaatgggctcagaaatgtagggacttgttcatttttgactctcaggcaaatctggggttgctttcagtatttggctacatgcttttcctcttctacactggtgtcaaaacagacatgagtgtggtccacaggtctagaagaaatgccaccaacatagggtccattgccataatggcaccctttctatgtagcatggctgttgtgcattttcactcaataaaatacttagacattggtcaggcaacaaaacttggagtcatctctggcttgttctccatgacccctttctcaaccatttgcacagttttaagtgatctcaagatcctcaattcggagttggggagattagcccaatcctcaactttagttactgaggtgttcaacttgttcttgataacaatcctaactttctctaaaattgtgttccaagagccatcaagagcttggttttccctcgcagccgcagttttctttgtgctattggttgtattcatcattcgccctgcaatgttttggatcataaaacagaccccagagggttccccagttagtgatcactatgtctattgcatactcatattggttttgttatcatcatatgccacacatcgaatagggttttttgctctctttgggccttgtgtgttgggcttggctaccccagaggggcctccattgggcactgccatcacaaaaaagattgacacttttgttaattgggttttggtgcctgcttttgtgaccacttgtgctatgagggtggacctaagagacttcatgaattggacagaaaaggtgaatggaggtgttgacgagttcatggtgcaaaccctgattattattgtagtgactagcgttgtcaaagttgttgcatgcactttgcctcctttgtacagcaacatgcccttgaatgactctgtgtccctcgctttgattatgaattgcaaaggcgtagttgaaatggctggatactctatggtcagagatgtcatggtaagcattctatttcatagctctcataagtccaatgctcattcaattcttggacataagtcttccatataa

SEQ ID NO: 21583 - DNA, 392 bp, Glycine max
  Peptide Sequence Number=SeqID_138361
atgggtcaagactccactgtggaaaagagcagagttgcttcacaaggccgctgcaatactgaaggagcacaaagtgccttgttcaggagattgcaaagccagctaaggatgctgtcactgaaatcaggggatttggtgtcatattgtgctgaggaaggggtgggaattcttggggaaggagaatttctcatctctgatagttttcggggcaatgaaagaaccaaatactgtctaacttccaaggactatccaaaccttatgatgcaagctccattggagcttgtaggcctaggatcttcttcatcaatggattcctttgcttcttcgaagataaatggcagcggaatggagaaggaagagagagaggagacgccacttcaaggagaagataa

SEQ ID NO: 21584 - DNA, 507 bp, Glycine max
  Peptide Sequence Number=SeqID_138362
atgtggcaatggggtgtaattccacttggagttgttttagccattccaccttttaactatcctgttaatctggctgtttcaaaggttgctccagcactcattgctggaaactcaattgtgcttaaacccccaacccagggttctgccgctgcactacatatggtgcattgctttcatttggttggtttccctgaaggtcttattagttgtgtgacaggaaagggttctgagattggtgactttcttacaatgcatcgggggatttgtggtcaaagatgcacaactataaaggttgctttggtcatggaatcggttgcaaacactcttgttatgaaaatcaatgatagaattgcaaagttaactgttggacttcctaagattgacactgatgtcacaccagttgtcaccaaatcctctgctaacttcattaaagggttggtaatggatgctaaggagaaaggagcaacattatgccaggaatacatatgggagggaaacctcatttga

SEQ ID NO: 21585 - DNA, 468 bp, Glycine max
  Peptide Sequence Number=SeqID_138363
atgaagcacttagacacacgtttggagcttgaagacatcacaaaccgcatcatggtcctgcggtgtgtcgataatcgaaaacagaaaatcttgagaactattcgaaactcagaagaattacgggaaggggccattgaacagctggaaaaagcccaagcccgcttaaggaaagtcgaaacggaagcagatcgttttcgggtgaatggctattctgagatcgaacgagaaaaattgaatttaattaattcaatttatacgactttggaacaattagaaaattacaaaaacgaagccattcattttgaacaacaaagagtgattaatcaagtccaacaacgggttttacaacaagccttacagggagctctaggaactctaaagagttgcttgaacaacgagttacatttacgtactgtcagtgctaatattggcatgtttgggacgatgaaagaaaaaataactgattag

SEQ ID NO: 21586 - DNA, 690 bp, Glycine max
  Peptide Sequence Number=SeqID_138364
atggataaagacaaagtgcaagctgtaattgattggccagttcctcagaatccaaaacaattaagtgcttcttgggacttactggcaattgctatggctcctgtattagctttgcctaattttgcgaagcctttcattttggaaactgatgcatcaggaaatggcattggagctgtcctaaggaaagagaatatccctattgatgcactatccaggtcatttttcatgacttggtcagctactgattccagaccagtgatccaaccagtttccatattgcaaacaagaaccattatcaggggaaatcaacaggcttttccagattttaaccttgaggacaaggttaattttgatggagggggaattgtaacaagtgctagcagcaaggataaagatgaaggggcaaaagaggaaaataatttggcacaaaatgagttagttacatgtttgggaaggtgggcccccaacaaaaggaaaaacacacgtgtgaagaggtattggggttatgaaaatccccgagaagcaaccggtcgtattgtctgtgccaattgccatttagctaataagccagtggatattgaggttccacaagcggtacttcctgatactgtatttgaagcagttgttcgaattccttatgatatgcaagtgaaacaagttcttgctaatgataaaaagggagctttgaat

SEQ ID NO: 21587 - DNA, 2925 bp, Glycine max
  Peptide Sequence Number=SeqID_138365
atggatgctgcatgggtgaaattgctacaagcaatatcagacaaggtagagaacctgaattggaaagttacacaacgttcttgcaacggggatagaggatttgataacaggaacatttcaagggataataagtctcaaatcataaggaatgtcacgtgtgattgctctttcaacaataacactacttgccatgtgacagcaattgcgctcaagggtctcaatatatctggacctatacccgatgaatttggaaatttaactcgactagaaatacttgatctcacttggaataatttcaatggctcaattccaaaaagccttggacgcctctcatcagttgtcaatctgtcacttttgggaaatcgacttactggttcaattccctcagaaattggtgacatggctagtctgcaagaactgaatttggaagataatcaacttgagggacctcttccccagagccttggaaaaatgagcaacttgctgagattacttctttctgcaaataatttcacagggataataccagatacatatggaaatctaaagaatctcactcagtttaggatagatgggagcagtttatctgggaaaatacccagttttattgggaactggaccaaacttgatagattggatttgcagggcacatccttggacggcccaattccttctgtcatatcttacttgacaaatttgacagaattgaggatatctgatttgaagggaccaactatgacatttcctaatctgaagaatttgaaacttttgctaagactggaattgaggaattgcttaataactggtcccattccaaactacattggagaaataaaaagtttgaaaaccatagatctgagctccaacatgttaacaggttcaatcccagattcatttcaggatttgggaaatctaaattacttgtttctgactaacaattctctaagtggaccaattcctgattggatactgagcataaaccagcaaattgatttatctttgaacaatttcacaaagacttcagcaaataattgccaaaggccggatctgaacttagcttcaagcctctctcgcacagcaagcacttcaatactttgtttgaagatgggccaaccttgttcaggaaaacccctgtttcattcactgttcataaactgtggaggacctgaaacaaagtttgagggcaatgaatatgaagctgacctcagtccatttggcatttcaaactatgttcctggtaatagtggcaaatgggcttatagcagcactggagtatatctaggaaatgcaaaagctgattatatagcaacaaatcagctatctttggatattaatggccctgattactaccacacagcccgcatagctcctctgtatcttaattactatggcctttgtatgctgaacggcaattataaagtgaaacttcattttgctgagatagcattctctgatgaccaatcatattgcaaccatggaaagcgtgtattcgatgtatcaattcaaggttttaaatatctgaaagattttaacattgcgaaagaagctggtggagttggtaagggaatcactagggagtttaatgttaatgttacagaaagcaccttggaaatccacttatcctgggcaggaaaaggaactaatgccattcctataataggtgtatatggacctctcatatctgctatcactgtgaccccaaactttaaagtttatgcacatgggttctctactggaacaattgttggaattgttgctggggcatgtgtgattgtcatattgatgctctttgctctttggaagatgggtttcctttgtcagaaagatcaaacagaccaagaacttctaggtctgaaaacaggttatttcagtttaagacaaattaaagctgctactaataactttgacccagcaaataagataggtgaaggaggctttggaccagtattcaagggtgtactatcagatggtgctgtgattgctgttaagcagctctcctccaaatcaaagcaagggaatcgtgaattcatcaatgaaataggcatgatatctgctttgcagcatccaaaccttgtgaaactttatggctgctgcattgaaggaaaccagctgctgctagtatatcagtacatggagaacaatagtcttgctcgtgcactttttggtaaagaacatgagaggatgcaattggactggcccagaagaatgcaaatttgtctgggtatagcaaagggcttagcttatcttcatgaggaatcaaggttgaaaatagtgcacagggatattaaggcaaccaatgtcttacttgataaacatctgcatgccaagatctctgactttggtttagccaaacttgatgaagaagagaatactcatatcagcacaagaatagctgggacaattggttacatggctcctgagtatgctatgaggggttacttgactgacaaagcagatgtctatagctttggaattgtagctttagagattgttagtggaaagagcaacacaaattataggccaaaggaggagtttgtatatcttttagattgggcctatgttctccaagagcaaggaaaccttctggagctggtggatccaagtcttggttcaaagtactcctcagaagaggccatgagaatgctgctgttagcactcttgtgcaccaacccttctcccactcttagaccatgtatgtcatcagtagtgagcatgcttgagggaaaaactccaattcaagcaccaataattaaacgcggtgacagtgcagaagatgtaagatttaaagcctttgagatgctatcacaagacagtcaaactcatgtctcttctgcattctcagaagaaagtatagagcaaagaagcaaatcaatggggggaccatggcttgactcctccatatcacttccaagtagaattgattag

SEQ ID NO: 21588 - DNA, 306 bp, Glycine max
  Peptide Sequence Number=SeqID_138366
atggccaaggacacaaaggagaggatgacagaaacctacatcaatgtgttgtgtgtcgcacctcctctgatgatggcaaacctctcagatctctcaaacccatgtctaaatccagatctaaagttagaagcagtaatggaggttgcaagagaggaggaactacagggactcatcgaaggtagggccattgtcggccaatcaaacgacgaggttgctgtcaatgatggcatgtgtgaagttggagctgtagtcgaagatttggctgtcgtgggcgatctagattgggaactggagagaaaggaataa

SEQ ID NO: 21589 - DNA, 669 bp, Glycine max
  Peptide Sequence Number=SeqID_138367
atgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggagtagcggagatgaggatgttgcggtggatgtgtggtaagactcgacaggataaaattagaaacgaagctattagagagagggttggagtagcgcctattgtagagaaaatggtggaaaatagacttaggtggtttgggcatgtagagagaagaccggtagactctgtagtgaggagagtataccagatggagagaaggcaaacaattcgaggcagaggaagacccaaaaagactataagagaggttataaaaaaggatctcgaacttaatgatttggatagaagtatgggatgtgtcttcacaagagacattaacaaagcaatgttgatcagtgatgcaacggagacaggaacaattcaaattaattcagcaccagcccgtggacctgatcactttccttttcatggtctgaaggatagtggaattggttctcaaggaatcaccaacagtattaacatgatgacaaaggttaagactacagtaatcaacttgccagcaccttcttatactatgggatga

SEQ ID NO: 21590 - DNA, 285 bp, Glycine max
  Peptide Sequence Number=SeqID_138368
atgctccctctttccttcattttcgtttttctctcttctcctcccaaagccctctctttttctcgcagaccaccaaacctatctcagaaaaatgacgatctcggatgcattcaccgttggatcgttgtgcaatttaagcaccagataatattcctggagagagaaaaggaatcacacaaagaaagttcatatgaaggcttcaatcctttctccatctctctgacgtttgagaactctatcggagtagtcggaggaaaaattggaggaatctcagggaaccgctag

SEQ ID NO: 21591 - DNA, 1611 bp, Glycine max
  Peptide Sequence Number=SeqID_138369
atggcggcggttacaggcgtgtttggttccacattccagataccccagacgtggtttttcgcgtcagctaagaagctgagaattgagttgatggggggtaacaattctaaggaggataataacaattggaggcagaattcatctgtgcgttcaagttcctctgcgtcttcttggggttcatatcctgacccccaatcaggttatggtcacgggggttacgcgtatgagccacaacagccttcttatcctacacagcagccgtattatgcccaaccgccgccgccgccgccaaactatggcaatgaacctcagcctcatgctagcggcagagtggccggccacagaaatgagaagcggttagacaggaaatactcgagaatcacagataactacaactccatagatgaggtgactgaggctcttgcacgtgcaggccttgagtcttcaaatcttattcttggtattgatttcactaagagcaatgagtggacaggaaagcattcatttaacagaaaaagtttgcatcacattgggaatggtccaaacccctatgaacaagcaatatcaattattgggaagaccttggctgcatttgatgaggataacttgattccttgttttggatttggggatgcatcaacacatgatcaagatgtctttagtttctatccagatgaacgaatttgcaatggatttgaagaagtgttgagtcggtatagggaaattgttcctattattcgacttgcagagctaattttgactgatggttttatcccaggtcctacttcatttgcaccaatcgttgaaatggccatgacaatagttgagcagactggaggccagtaccatgttttggtgatagttgcggacggccaggtaacaagaagtattgacactgagcatgggagactaagtccacaggagcagagcactgtggatgccattgttgaggccagtaaatttcctctttcaatcatattggttggtgttggagatggtccttgggacatgatgaaggagtttgatgacaatatcccagcccgggtctttgataattttcagtttgtgaatttcacagaaattatgtcaaagaatattcctccttctcgaaaagaggcagcatttgcgcttgcagcactgatggaaattccttctcagtataaggcaacaatagagcttaatctcttgggtggtcgaaatgcaaatgctcctcagagagttgctctcccaacaccatcatatggttcagcatctatgggcatttcaaaaccttatggttcagcatcttttggcgcttcaaaaccctatggttcagcatcctttgatgccccaaaaccttatggttcagcatcttttagcagttcaaaaccttctcatgctgctagctttgagcagagtgccccttcttattatgacaacacggaccctgttggcacagctcctcctgccccaagttcctcatatgacaatcagctttgccccatatgtctgaccaattcaaaagacatggccttcggatgtggacatcagacatgttgtgaatgtggacaagatcttcagtcgtgtcccatctgtagaagccccattaacaccagaattaagctttactag

SEQ ID NO: 21592 - DNA, 300 bp, Glycine max
  Peptide Sequence Number=SeqID_138370
atgtaccctcattattttaagctaaacaacattattgcttctaactctaatcattcccctacccatcttcttcttgatgcaaattgtcgagaccttacaagaaacaatttcgctttgagagctcatggctattggaaccaactattgtcaacgagggttgggcgagtgaagggagacaaaaaactcagagaagccaatgatgaagcctcgaccatccagtatgaaaaagaaacaacctcaacaatctgcttactcaataagaggtctattggagacaaatggccgagatttattgactaa

SEQ ID NO: 21593 - DNA, 228 bp, Glycine max
  Peptide Sequence Number=SeqID_138371
atggttagccaaggctctatcaagcttttcttcgatggcattatgttttcatttgcttctagaccatgtaaatttgtacccatccattggaagatcatgaaggccgttgtcagaaatagcatctctaaatccatgaaggagccaatttgggtgatctttgctaccaattttttcatcactagacaagagatcgttaaaatctccaaatatgcaccaggggaggggtga

SEQ ID NO: 21594 - DNA, 340 bp, Glycine max
  Peptide Sequence Number=SeqID_138372
ggcagcggtcatctggtacaccaatttggaggcttctcgtatccgctcatggacggatttgattactaccttcattaggaagtaccaatacaatactgacatgactcctgacagaactcagctgcaaaatatgagcaaacgggagcaagagtcatttaaggagatcgaagtaggcctgaaaagagggaagtttgattatgtcgctcctgccgacacgagcaataggagatttgaggcaagtagggcaaagaaaaaggaaggagacatccacgccgtgacctcagctcctacttggccaaaaccccaacaaacccctcacaacacttaccaatatgcctaa

SEQ ID NO: 21595 - DNA, 285 bp, Glycine max
  Peptide Sequence Number=SeqID_138373
atggtggcaagtctgtgtatgacattgggatgggagcgaatccgaaagttctttaccggaaaatcattcccggattggtgtttatgcttggattggagttgccgatggggcgaggtgccctttgctggatgggcgttggattggaagggtttccgacgcgggccaaaaagcttggttgatgttaggcatattggagctgaggtcacggcgtggatgtctccttcctttttctttgccctacttgcctcaaatctcctattgctcgtgtcggcaggagcgacataa

SEQ ID NO: 21596 - DNA, 201 bp, Glycine max
  Peptide Sequence Number=SeqID_138374
atgactaagctatctgttgcgcaatcagaagaattaagaattgatattgagtttcagcaacaaggtaatttaggtgttgctatgaatatgactcaaacattagaacacaagccaagggggttaccaccaactttcaaaagaagatatgctacattcacccatacaaataagccaactagaattagcatgcccactttttga

SEQ ID NO: 21597 - DNA, 456 bp, Glycine max
  Peptide Sequence Number=SeqID_138375
atgagagctcatgttgtgaagattgtcaggaggggtgcgtggaatccgaaatgcaccactttggttgcaagggagcatcccccgggtctcctagatgatagtcttgaggtgcccggtctttttgctattggccagcttggagagcaagtatgctttggtgttgctcttcctggggcttgctctagaatgacattgtcaggaacttcgaggataattcttgcctcgcttccctttatgctggatgcaccatcaacgtataggctcaaccgggttgagctaacggcttcgtcaactattgagagatataggaggaggggtacccctggcctaggtccactcaggactggtgttgtagccatggtcatcttgaaggcttgttcgcagaatgccttcgccttttttgtgagcttggggaggaacctggacagggatgctagtctaccattcagcttctag

SEQ ID NO: 21598 - DNA, 348 bp, Glycine max
  Peptide Sequence Number=SeqID_138376
atgaaacaataccaagagtttacaaacattccacgcacccctcctgacaatcttcacaacatgagctctcattggcccttcgacatgtgggaaatgaacatactaggaccgctgccaaaagcctcaggagtagtcaaatgcatactagtcgttatcgactacttcaccaagtggatcaaggcaagaccattcacctggaaacaccttatatgcaactatggcctcccttacgccattgtcactgacaatgacaccgaattcaaagctcaggcttatgaagacttcctaacgaggttaggcgtcaagcaccttgttacctctatcgaacatcctcagaccaatggttag

SEQ ID NO: 21599 - DNA, 1929 bp, Glycine max
  Peptide Sequence Number=SeqID_138377
atggtgagggcctttgaggaccatttcttcaaggtcctgactactgacatagtggctaatggcttgtcactgatgtttaaccaggacagagagccccgcttcccattcttctggcagtttgaccataccaggttgacgtcgtttgacgaggatctgttgacccttgtggagagggtcaataaagcgatattggagcaactgtcggccttgctggatgcgcggaccattttttctcttccttcaatggacgatccttttgttgccttagatggttggacttgctggtggggctgtgcaccgtatgctgccatccctcctattggagaagggggtcaacctgttgttggtgttactgaggtctcccccggcgttgcttcctctgttttggctaagaggagcgagatgatggcactgcggtgtcatgccgcttcaaggttgacactcgattcgggtatcctttcgagtttgcaagatctacctccggctccatcaatcttcatggcttctactcctgctattgttgttgttgtcgctcctactgttgaagttagtgcgctagccgcttcggctggttctgttatgtctccttcatccaccgtcgctccacctttgttgagtgctggtgtagtgacaatgagtgctcttgtgatgccgcctcctccttcttcagcttcaccggttcctccttctgctgtgttggtgtcggtgtcaacttctacctcttctcacccccgtgtttctttggaccacatctacacctccagcggtcttcctccaatgaagtttggcaatcttggaagagaatgggcaaaggcactaagaggcgctaaggtcaatgcttgtacagtctggagaacggagcaccctaaggtagttaatgccattgtcaccttcaatgaagctgtgaagtcaaaccaacaactgtcttccaaggttggcagtgcccttgccaaggtggagaacactgcggcgaagaaggatgagcttgccaaggtggtggtggacctcgaggtccgattgaaggaatcagagtccaggctagaggagtccatgctatgggtatccaaggagagagaggtcaacaaggagcttgaagaggagctgttgatgtacaagaaagaggccatggagcaacatgaaaaggattttcacaaagccattagtgttctgcttgatgaggaagatattgttgctgaggaggaggctggcgaggagcaggaggttgaggagcaaggaaatgatgccaatttcccaaggggtgaacttaccaagggcatgccttgggtttttataggagtgcgcaccaacggtgcaccttgggcttttgtaccaagggcggaccttgggtttctttaccaagggaggaccttgggctcaccaagggcggaccttgggattaaggagctttggactagggacgcgttcatcttgggttttggcgaggctcaccaacgatggaccttagactcaccaagggagaaccttgggtttgatgagcctttggagaagaaagactcaccaagggcaaaccttagggcggacaatgggtttgatgagcctatggaaaaaagccatactcaccaagggcaaaccttcgatttaacgagcctttggagaagcgagactcaccaaggatggatctttgatttacgagcctttggagaagcgagactcaccaagggtggaccttgggtttggcaagtctttggagaaggagactcaccaagggcgtaccttgggtttgaagagcctttggagaagcgagactcaccaagggtagactttgggtttgatgagcctttggagaagcgagactcagcaagggtggaccttgggtttgatgagcctttggagaagcaagactcaccaaaggcagaccttgggttcgacgagtctgtggagttgggaccagggatgcgcctgtcctag

SEQ ID NO: 21600 - DNA, 405 bp, Glycine max
  Peptide Sequence Number=SeqID_138378
atgacggtgtcatacaaagattggcatgagatgttgccttttgccctgcgtggatatcgaacctcggtacgaacttctacaagggcaacaccgtattccttggtttatgggatggaagcggtactcccatttgaggtagaggtcccttcccagaagatactagcggaatcaagcttagaagaatcggagtgggctcaaacacgctatgaccaattcaaccttattgaaggtaagcatttgacagccatgagtcatgggcgcctgtatcaacaaaggataaagaacgcgttcgacaagaagggacagacacaaattgaggctagggtcacgaccgatagatcgtcgtcctttccctgctctggacaagcggaaaacgccgctgcaaggcagcctagtatcctttaa

SEQ ID NO: 21601 - DNA, 255 bp, Glycine max
  Peptide Sequence Number=SeqID_138379
atggcttctctaaattctatcaagagtcgatatcccaacatctcaagtttatgtgaatttttcattgccaaataccaagaaaattctccaagttttaaacttgcccaggtactcctgtctgggatgtactataaggaacttcgttcaaagtgtggttggatattccctggtttgctaccttttgcaggtgatactgccctagcaagtcctttcgataagtatgtcaagaggaatttggagagaggggatatttga

SEQ ID NO: 21602 - DNA, 279 bp, Glycine max
  Peptide Sequence Number=SeqID_138380
atggcactagtgttcttcctagcaatatttttcaaggaaaggcagcagagatatgtagagcagagggtagattgcatgatgcatgagggattactcaatgaagactatgacatttataacttgaatgcagtttatactagagatggactacataaacacttccacctaaattttattggtggaagcaaggcattagaaatagttgtgcaacagaccaagtcctctagggttgctataccagtttctaggcaaaagggagaaacaaccagagagtcatag

SEQ ID NO: 21603 - DNA, 212 bp, Glycine max
  Peptide Sequence Number=SeqID_138381
gctgcaccttcaaaacccaaggaagataaaggtaagaccatagagaaacccacccttaagactagttcccaagcaaggactagcaacattaaatgcttcaaatgtcttgggaaagtggaagtaaagatgaagcaacggggtgaagagtatagtgaggaagtctacccccatgaagaagatggtcttctaatggttagaaaggctcctaggag

SEQ ID NO: 21604 - DNA, 492 bp, Glycine max
  Peptide Sequence Number=SeqID_138382
atggttagaaccagaggattgcgttgggctttaggtcgagttttaggaagagccttaggtagacaaattgttgatgatgagaaaaaagcccctcagcgtcagaggccgacaacatcaacatgtagacaacaggcaactgtggctgttgtggagtatgttgagcatgtggatcatgttgctggcgacgttcatgaggagcttcaggaaccagttacggatcatgtaggtgctaatacagaggattttccaggcgggtcccatgatacatcagtgttggcgttatatgctaatcatgtggcagccagagtttgggcaagagagaaacgcactgagttgaagttggcctctcataagaggaaggtagagaaattcggaacgcctacacctaagattaaaggcatagtggctgctataggattaagttctctgattacatgttcattggagaaaggtactatctatgagaaataccaaattacaggcattggttaa

SEQ ID NO: 21605 - DNA, 1320 bp, Glycine max
  Peptide Sequence Number=SeqID_138383
atgttgccaagaaacccttcatacacaaacccagaaccctgccagcaccttgctgagtacaagctcaagcatggcttcaatggctacaaagccatccaaaagctcctcgtgacctctccaattgggaaaaccagtgtgaagaaacccaacacaaaggtacccagatgcggtttctgtaatgggtgtgaagggaggttctatctatgcctgatttgttcttcattttcatgtttggatcacacccttttgcaccctcaatctgaatctggtcatgctgtatttgtagacattgaaaggactgaactttattgtggagtgtgccgtgatcaattgtatgaccctgattttgaccaagttgtgatgtctaagcactcaatgggggtggcaggtggtgccactgggaatgaaagcattggccagagattgatcaagaggaggagattggtttctgggattgttggattggatttgcagaaatctaagtgcagagtttccaccaaagatctgaggggaaaatcgtgttatcctttggggttgagggggttgaacaatcttggtagcacgtgctacatgaattctgtgttgcaagtgttgctacatgcacctcctttcagagactatttcctgagtggtggacaacgtttggaagcttgtcatcatagaagagccacggatctgatgtgttgtttgctttgtgatgtcaatgctattttttcggcagtgtattcgggggatcgaagtccgtatagtcctgctcagtttctctacagctggtggcagcattcagcaaatttagcatgttatgagcagcaggatgctcacgagtttttcatttcgatgttagatgctatccatgagaaagagggcaaaacaaggaatggaagcaaaggtaatggagactgtcaatgcattgctcataaggtgttctatgggttattgagatcagatgttacctgtatggcctgtggattcacctcaacaacctatgacccttgtgtggacatttcacttaacttggataccgatgtctcttcaactgaaaagggtaaaaaacttaccaaacaaaatgaggatggcagtatgtctacactttcgggttgtttagatttgttcacaagaccagagaagttggggtcagaccagaaactttactgccagaattgtcgggaaaggcaggactcgttgaagcaaatgtcaattaggaagctcccattagtacttagtttgcataaaaatagatcgctacctacacttcccattttccttagacatgactccatatctgtcctcctcaatcctcagagccagatatgggaatag

SEQ ID NO: 21606 - DNA, 291 bp, Glycine max
  Peptide Sequence Number=SeqID_138384
atggagttacttaacatcggttttataaaaactgatgttaactacttaataaaaccctacactgctcttggaacagtcgtgggtgctcaaagctcaaagctttctacgctgccagttaacaagctgattatgctttgcgtggttttcaagcttgacgagagttacacgccgagcaaagtttccatccgtgtcggtgatggttttcacaacttgaaggagattaagaccgtggaactcgtgaagccaactgggtgggtttatctatccttgtttggagctgatcctaggtaa

SEQ ID NO: 21607 - DNA, 276 bp, Glycine max
  Peptide Sequence Number=SeqID_138385
atggctgagtgtcctgtagtcaagaatggtcaaacatatgagaggcaatccatccaaaagtggcttgatcatgggttgaatgtttgtccaaaaactcatcagagacttactcttacaaatgtcattcctaattacactgtcaaatctcatgttattagattgattgaagaccttcacaggtggaacttggagatgtcaagtatgttagagggatctatacagatcatgtcaaaggccgagaccgggactaccatgtttttagtatgggtgagttag

SEQ ID NO: 21608 - DNA, 291 bp, Glycine max
  Peptide Sequence Number=SeqID_138386
ttggttgtggctttaccactggttgctgctactactgtcgtggctcgtcatcacggtgcgtctgtgctgccacagtcactcaacgatgcctctcgttcgcatcatccccttcatgggggatcacatccagcaatgtatgatgtctacttcgtgcaagagagaacaaaggaggaggaagggtttttggaaaagggtcttgtgttttggggaagggaagagtttttgaatagaaggagaatgaaaaatggtttctgtgttctgggggagaaaggaggtgggggacacaaatag

SEQ ID NO: 21609 - DNA, 1675 bp, Glycine max
  Peptide Sequence Number=SeqID_138387
gttcttgctaagttgtgtacattgcttgggtttgggtccaagctacagcttgatgagttcttcaataggcttcgggcctctatcagaagtgtcatcgtatggatctacatcgaataatcatccaagcttgcttggtagacgaccagttctcaaactagagaccctttgtccacgctcattacttgagtattgccacccactgtggggtgaggcttggcaagctccctggtgggaggataaggtggggaacttcatccttagatgtggtgtgaagacaatgattcctagctcgttgagcgttttcctaccaatgaaagcaaagaaagaggttgacatcgcctctagtctctactatttctcttgcgaagccaatgagtggatcggcgtgagtttggatgatgtcagtggagctaccctcgttgatgaggaccttggacaccatgaagttagccattacgatggagacaacgataaggttgtcctagttgatagggttgatacctttgaagtctctatcattgatgtcgatgttccggatggcatggaggttacacttatgggactggctggactgcccttcgtaagagaatccccctgcaatggtgttgattacacctctgatttgttgggcgggcttgttttcccattcttacggaggttgtcgctcacatctttgatggtggtgtctttgtcttccttgatcttctgctttgtctcttctttttctgccatcgcggtttttatggtgatcctcttggtgtccttcgggtctcactcctattgcatgacttatttggtcctttttaaccctggccttggtagaagcggcaaaggtagttttattggtacctccgcattgaaagcctcctcgaggattgtagtgcgattgattgtcagggtcggtcttgttacctccttctctcttgtcgtgcttttgtcccgcttgtcggaccttgttcttgagcctggacatctcttccatctggatgtagcctttggctcattcgtgcaactcgtccatgctactagggcgcctgatgtcatacaatgtgactgggtggttgcatattatgcattgaagcgctcgacaagagtgtcaaagctgtcgatggaccttggaggaagtccaccataccaggttaatgtcgcccctttgagggatgttgggaagacacgacacaggattgcatcgtcattgggtgtcaacttccatgatgcaatcgacaaaggggtgtcgacgagtaggccaccctgcaggacagtgtatgtgagagagacttggatcatcttaagtgttaactatgtgttggggctttttgagctcttcctcatagcgtcactccatctccgcaatgtagttttagagttgttggagagtatcaatatccatcatggttacgagaggaggattggagccttcgaaagggatctcgagtctaaggccaaactgagtgctaaccatggagtgggcactaaatgtacttaccgaaatccaaagttgtcccacgtcaaggtggacgtgaacaaggagagtatgagtgagtatgaaaagagtgagatggaacctggtacttatagagcggagaggaagttgcgggcccttgtttataggggttgttatggtgacataatagcccttgcaaataattatcggcttgtagataatagccggtaa

SEQ ID NO: 21610 - DNA, 558 bp, Glycine max
  Peptide Sequence Number=SeqID_138388
atgacaacgactacaagggcggtggcaacaatctcgatggctggcagtggaattgatttggggtgtcaacttggaagcaatggacacatagttggtttctcagaagaagcgaggggccaagaaaagatcggtacaaatttcaaagaatctgattccgatgaactggatgattcttttgcaccccctacaaagaaaccccgtctaatgtggcgacaagaattgcatcaacaatttgtcgaggatgttatgcaaattggacttgataaggcaaagccaaaaaggattgttgaagctatgaatatccctggtttgacaagagagcaagtagctagtcatttgcagaaacatagacatgagttgttgttgaatacatctaaaggagtgacattgcaacagaatgagaagacattgtcaaacaacatagaatccaagagaagggaaggtgcatatggaaggtttgacttaacagcttttggtgataccagccatctttcttatgctgcccttcatcctgaggaacgaatggaagaccaatggccttactattcccttgcataa

SEQ ID NO: 21611 - DNA, 744 bp, Glycine max
  Peptide Sequence Number=SeqID_138389
atggtgaatccaccactatcatgttcggaagtgacgctatggccttgggtcatgggtacatcctttgtggtacaagtagagggtacatctacttgggttgttgtaactgagaacaagagagggtacatctcttgtggatcagttcaagtggagggattttacaaggttgataagaaatctcaaggaccgcaggtcgcttggggactgaatgtaggcacggcgcctcccaacctagatgactgcatttgttctcaaagaccaagaaatgaagacgttggtcaggctattgatgaaaacatgttggactctgactacgatgattcattagatgaatcttctagctcatcaagtaatggtgatgacaatgaagatttaaataacaatggctatcccttaaagaacaaatctggaaaagttgctagttctaacattgaacaaggaaagatcaataagaaaaggaaattggataaaaagttgtttagtcccaaggcatctaactttgagaatgtcccaatttcaaagactttcctggaaaaagaaaaggatgttgtaggctgcgaaaagaaatctcgatttgacgttcctcttccgtccaagaagaccagaaatggtggtgcccctggagaccatgtaaaagcatctcctatctctatgttgatgggcaccgataacatcttcaccaacctcaaagctatgttggaagccacaattgggagtccatcaacaaagattcccattttgtga

SEQ ID NO: 21612 - DNA, 297 bp, Glycine max
  Peptide Sequence Number=SeqID_138390
atgtaccctctcttgttctcagttacaacaacccaagtagatgtaccctctacttgtaccacaaaggatgtaccctccaatgtgttaagacaaagttctcaggcgaacaaagtttggaaaccagaaaactcagaaatctttttggcaaaggaagaagaagaagaagttcaagaagatgttcaaagagattcaaaggttgtaaaagaatatatgaaaaagttattgaaatgcaagtcaaggtcttgcttttatagactcttcatgtctggtcaagaaaaaccattggaagagttataa

SEQ ID NO: 21613 - DNA, 312 bp, Glycine max
  Peptide Sequence Number=SeqID_138391
atgggtgagattaactttgttgggggagaaaacaattcttacaatcaataccctaacaatttcaatcaaggacaaggcttcaggcaaagtcaagggatgtataggccccaaaccatgcaaaatcagaggcctagacaagaggagagacaacctactcttcaagagaccatgcttcaatatatggccaagaatgatcagagaatgaagctggatgattctttcccaaaatttgcaaataatgtccttactaagaaggatcatgcatctaggaaagttaaggttcctattgatgggaccaatcacccagggtaa

SEQ ID NO: 21614 - DNA, 489 bp, Glycine max
  Peptide Sequence Number=SeqID_138392
atgagtcttagggcggttgctggttgcggcggatttgggttcttaggttttgttatggcgaaacgatttggctttaggtgggtggcggctcttcgcatggagctgtggcatactctgatgtctcacttgcagtgcttctcggacatgtgcgcaagtttttgctccggatcccaaaaatgtcggagacggcactgctcacttgaagagtatgttcgggagaaaacacattgcattgatgtgatactcattgaagttcacatgccatatgtcgatagccttcaattccttcagcatgtcactaacgaaactaatgttccagttatcatgatgtctcttgatgatgctcagagtactgtgatgaaggctattagaaatggagcttgcaattattggcttaagcctttgcaagagagcctaatcaaggttatgtggatggaatatgctaggaaactcgagtcaaaatatgctaccaagaaaagaagattctga

SEQ ID NO: 21615 - DNA, 882 bp, Glycine max
  Peptide Sequence Number=SeqID_138393
atgggtcgtgcaagaataaccttgaaacatatctcaaatgagagatctcgcaagacggtgtccaagcagagaaagaaagggctaattgagaaagtctctaaattttccaccatgtttggagatgaagcatgtttgattgtgtatgatgatgaaaatggtgatgttggacctgtgacttggcctcaacaccccacactgatacacgccatcattcaaaagtattatgagattcaatcaaagaatgagaggcctcaagagacttttgttattcaagatttttttgcaaataggaaaaagatggttgaggctgatatttctaaagtgcaaaaacagattgccagcatcaagtatccaacttgggatcaaagtatcagaaacatcaaagaggagaaattgaggggcctcattgctcatgtggattctaagattagaggttatgatcatagaattaacatgttgaaaaacaagcatcagagtgaagccaagttcagtttcgtgcaaaacatggctcaagcaagtggtttctccaaccatccaagtcaaatcctccttaatgatgacaataggagggtgaattttacaaattcaatggatcagtttgatggagcttgtaattatggaattaataatatgatgagaaacatgcaacaaggtgatgcttgttttagttttgtgccaaacatggctcaggaaagttctaatgctacctcctcacatgtctcacatccaagccaactcaattgcttgcaaaacatttctcaaagccaacctgtgcttgaagctttaaagcctcttagtgataagaatgagatagtagattctagtaatcaagttgatgtgcctctgtattcaactaatcaacttggtgagtctatagactag

SEQ ID NO: 21616 - DNA, 378 bp, Glycine max
  Peptide Sequence Number=SeqID_138394
atgaatcttactcatggaaactcttcacaattcatgactggtgaagattctagcaccaatttttcctctaataccaatatgacatacgcaaaccaatactcctttgattctagggtttctggtggttgtatcaatcgaggtggaggtggcttcaaccacagtggtggtggtagctcagttaagtgtcaagtgtgttttgagtataatcacacttctctcacatgttacaatcactttaatcctcagtatcaagcctccaacaatggaaacaatggcaatgattctagagctttgtttcatgtgaccaacaattctcagaatattcggcaaaactcaccttttgagggtccagaccaaatctttattggtaacagatga

SEQ ID NO: 21617 - DNA, 405 bp, Glycine max
  Peptide Sequence Number=SeqID_138395
atgggcacgaaaagaaaagcagaagtcaagaatcagagatttttacacataattccagagcacaccacagtgcctattttgggaaaagagctctggaggcaacaagatgagcaacttttgcagagatacctaggtcttgtaattagagagagattagaagtttatgtagacgacatgatcgtaaagagtaagcaagtggatgaacacctagccaacttgttggagttgttaatgcaactaaggaaatacaatatgagactcaaccctagaaagtgtactttcggggtacaagtaggaaagtttttgggatacatgttaaccgaaagaggaattaaggtaaatcccgacaagtgtaaagccacattggagatgaggagtcctaagatgctgaagaagatccaatag

SEQ ID NO: 21618 - DNA, 447 bp, Glycine max
  Peptide Sequence Number=SeqID_138396
atgatatgtgttgatgggtcttctcataagaaaggaagtggtgaaagatttctcttgaaatcctcagatggactaattatggagcaagcactaacttttgccttcccaaaaaccaacaaccaagcagagtatgaagattgcattgtaggaatgaggctagcaaaggagttaggagcaaaaaagataaaggcatgtagaacaacttcgcattctacaactggagaatctccattcagattaacatatggtatggaagctatgattcctattgagataggagaacattcatggagagtgctcaactatgataaagaaaacatcgaagataacattaggtctgaattggacttagctgaggagagaaaggaagtagcatgcataagagaagccttattgaaaagaaggttagatgcccaatacaataggcattatctttgtcaaggatag

SEQ ID NO: 21619 - DNA, 168 bp, Glycine max
  Peptide Sequence Number=SeqID_138397
atggagctagatgagtccaatggtggcattgtggaacctgcaaacactctaatgttcaagttgacgcatcttttgctttcgcactatgcaaacttttggaatggatcaatagatggcttttgtcccttcagctttctggacaatgcgttgagtttagtcaacagctaa

SEQ ID NO: 21620 - DNA, 210 bp, Glycine max
  misc_feature (133)..(133): n is a, c, g, or t
  Peptide Sequence Number=SeqID_138398
atggaggaggaaaatcaggaagatccatgtagtgaatctatggaggaagatgaatccaaaagggggggacttggtggagctcttgctgaagttgggactaagtattacatgaaagatgttcagaaggtgcagncatctgaggcacagatttataaaggaaatcacatccattccttggattgtgaagcctctttggggtcttctcactga

SEQ ID NO: 21621 - DNA, 339 bp, Glycine max
  Peptide Sequence Number=SeqID_138399
atggaaaaacaacatcgcaggatggagaaacaactttgtgtgccaaagcaattgcaacaactcccgatgatggaaatctatgacgaatcttcagatcctaatgatcatttttcaagatttaagtctgccttgtcccatcgtggtgcaaatggcttacaaatgtgcaaagcatttctgttatcactcaaacaagtagcattgaagtggtttcaatggctctcgagaagctccataagctcatggagtgatctgcgtgtgaaggttcactatgcctttgcgactagcaaggaaagaccaaaaacacaggcagatatgaagaaaattaaacaaggagtatag

SEQ ID NO: 21622 - DNA, 696 bp, Glycine max
  Peptide Sequence Number=SeqID_138400
atgacaaggaaggagatacaagagggaaggatgatggaaaagatcctggaatcctccaaaatggaagatatgctcaccctccttgagaaggggttcgttgctggtggaccaataagtaatgcccaaaaaaggtatgctagagagatttcgagagataaagatttggatggattctcgagtcatgccataactccctttggttatctgaagttaagagttactttcagaaaatatcctttggcaaaggctatcatggtttgtttcctagttgtgagcacaatgtcacttttcaatgtgttaatcgagagaccaacacttaatgctttaggagttgttatctcaactccacaccttaccatgaagttttttaatgatgatttgaaggtggtagtgtcacgagaggtaccttcacccgagaagttggtcccaatacctgggaaaaaagagatattggtggcagtactagactatggagtggaggaacatgataataaatttgacagaccaattctagaaggagagctcatccaagtgaaaaacaggctggaggaaataaaggttgtcaaagtaggatttaagttgccaacacctattcttgacaagttatcctgttttggggcagataatgcatgcatttttgcgtggacccctgcatatattgtagaagcaagcttcatgatgatgaatcaagtataa

SEQ ID NO: 21623 - DNA, 285 bp, Glycine max
  Peptide Sequence Number=SeqID_138401
atgatgcctacaagtttcataggagtgattgccatgcttttgttatctttgcatgaaaacctgcatcttgtgttggcccttttggcattaacagctgggagtgctgggggggcaatagcagatgtgaccattgatgcctgtgtggcacagaacagtatctctcaaccctcacttgctgctgacatgcaaagtttatgtgccttcagtttatctgttggatcactaattggttacttcattagtggtatctttgttcactttctaggccctatggttagcctttga

SEQ ID NO: 21624 - DNA, 180 bp, Glycine max
  Peptide Sequence Number=SeqID_138402
atgaagacctcaatttttgagacgtcaggcagcgacttggcaaaggttgtagttggtggcatggggttggaagcatcggcattactgacagacattgacctaaaaggtttatccgcggtgtcctacacaaacctcccaggatacaacaggaacgtcttaacggagaactcacaaagataa

SEQ ID NO: 21625 - DNA, 186 bp, Glycine max
  Peptide Sequence Number=SeqID_138403
atgacaccattgccgccaccgctaacaataagaaatggagcattatattccaatttgaatggcgaggagcacatgacagaacaagtggaggcagaagaagaggaagatcgagcagccgatgaaggcgaaagagaacaaactggatcttgccaaccttctagaatccctttcactattctcagctag

SEQ ID NO: 21626 - DNA, 387 bp, Glycine max
  Peptide Sequence Number=SeqID_138404
atggagggcttatttcttgatgcaatagcaagggtccaagaaaagatcagttcaaatttcaaagaatctaattctgatgaattggatgattcttttgcacccccaacaaagaaacctcgtctagtgtggaaacaagaattgcatcaacaatttgtcgaggctgttatgcaaattgcacttgataaggcaaagtcaaaaaggattattgaagctatgaatatccttggtttgacaagagagcaagtagctagtcatttgcagaatgagaagacattgtcaaacaacatagaatccaagagaagggaaggtgcatatggaaggtttgacttaacagcttttggtgataccaaccatcttctctatgttgcccttcatcttgaggaatga

SEQ ID NO: 21627 - DNA, 254 bp, Glycine max
  Peptide Sequence Number=SeqID_138405
atgacaagggccatgttatgccgcatggatctttacggtgttggtggtttgacaacggtggggtgcacgaatctcgctgccacaatcttaggtttggatgtcggtgttggtggacaacaaaagggggacgaggtggccagtgtgacgcaaatcgataatgccaatgcttggaattcaacattatgcatgcagtctggaggggttggcatgggggaggggtggcccgacggttctagatttgggctggggttggg

SEQ ID NO: 21628 - DNA, 380 bp, Glycine max
  Peptide Sequence Number=SeqID_138406
ctcaatcccgttatgcagcgcgtgccgggtcactgaatcgggtctcggggctccgattcttctccgtttccacggaagagtattccaagagaaactatgcaaacaacgttgccgagtacaacactgttttgggttctctcactgcacaaagaaggaatttcttgctgagggatgtgtacgatgatatgatgcttgatggggtgaagcctacgcgtgacactttccattcccttgctgttggaaccatgaaagcagctagaatgcaagatgctttctacttcgcggaccaaatgaaaatcatgggtttgcttcctgatttagcttgtataactttctgttgtggggatgtttggaatgatgctagtgataaagatcattga

SEQ ID NO: 21629 - DNA, 468 bp, Glycine max
  Peptide Sequence Number=SeqID_138407
atggaatatctcaaaaaggaagacatgtgctattgtcatgcaggagatattgagcgtggtcttcaaaattttgagaaccacctaaggcaggacaggtctgttcctgcagaactttttgtgactcttgcagaaggggcaatggttgggtacactgaaaaaggaatgcaaatggctcaagatattctggtaaggatgaacgagagaaacatttttttgaataacaaattgggaagtgagctcctatttacagctgcgggagaaaagactgggggatatatcactgctaactacatatgggacttgatgcaagctcgtggaattaccccttcgtttcctgcagtagaagcatattaccaaggcttaaaagatcgagagatacctgaagatgatcctagacttgtattggtttctagaatacacaaaaaccttagcgtgagattcgggaacaggacgaacataaatttatag

SEQ ID NO: 21630 - DNA, 564 bp, Glycine max
  Peptide Sequence Number=SeqID_138408
atgggatttgagaacttacttcaaggcccaaggacaaagcatatgattggtgtgaagtgggtttatagaaccaagttacatccaaatggttttgttcacaaacataaagttagactagttgtgaagggatattcccaaatgactagagttgattatggtgatacatttgcgcttgttgctaagcatgaaacaaatagattaattgttgttttatccactcaatgtggatggagaatctttcacctagatgtcaaattagcttttctaaatggagttttggaggaagaaatttatgttaaacagtctattggttttattgttgaaagtcatgaagacaaagtttataggcttcacaaagtcttgtataggctgaaacaagctccaagagcttggtacaacataattgtaagtggtgtgttcacatggaattctaagaagcaagatgtagttgttcaatcctcagctgaagtagagcatattgttgcagcagttgcctcaaatcaagctatctggattagaaagatattggcttacttggtttgtgtgcaagaagaatctactgtg

SEQ ID NO: 21631 - DNA, 300 bp, Glycine max
  Peptide Sequence Number=SeqID_138409
atggcgaaacaccctatttcgccaagaccagcagcggtacaaagggttccgccagcaccaccagcgacacagcactgtgtcagcttgggcgaaacacactcatgcagagtgccaccaacccacttggcgaaacgtccatgcattcatgccttccttcccatgcatggatgcatgtcatgcatcacatgggtgccgccagcctggctggcaaaacgcgtgcaatgggttctgccaaccccattggcgaaacacgaaaaattagacacatactcgaaaaactccaaaggaggcaatttctag

SEQ ID NO: 21632 - DNA, 195 bp, Glycine max
  Peptide Sequence Number=SeqID_138410
atgatccgatttacagttaataaatggaaggccacgccatgggaagtaaaaggtgaaggaacttctgctgactttacgggtagggtgggggcaccattcattcaaaagccatttgatttcagatctcggactattcccgagggtgatcttaccaatatatcaccaattatccctttcgcagttgtaatggggtaa

SEQ ID NO: 21633 - DNA, 651 bp, Glycine max
  Peptide Sequence Number=SeqID_138411
gtatgacaaagatgattacgatcgaatgtggtatccgtataacttacctgattctacaccactcaatacttccttcaccgtcgactccttgaaccatactgcatatcacttgccatcggcagtaatgaaaactgctgtgaggccgacaaatgaaaatgattccctggaatttgaatttgacactggacaacctacttcagagtcttatgtttacatgcactttgctgaaatcgaagtgcttaatgaaaatgaaagcagggcatttgacattacattgaatggaaaattatgggctgaatatgtaactcccacgtatttgcagtcaaatacaatagatggtaatcagtccattaggggaattaaggctatcatcgacatcaaatcgcattacaagttgacatcatcggtgggtaaatcctggcaaggagatccttgcgcaccatcgaaatactcttggaatggactcaactgcagcaataatggatataatccacccacaataactgcattatatctggcctccagtggattaggtggcacaataattgcatcatttttggagctcaaattcttagaatccttggatttatcaaacaatagcttaacaggacctatacctgatttttcacaactgcaacacttaaaggctct

SEQ ID NO: 21634 - DNA, 277 bp, Glycine max
  Peptide Sequence Number=SeqID_138412
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagga

SEQ ID NO: 21635 - DNA, 348 bp, Glycine max
  Peptide Sequence Number=SeqID_138413
atgatgatttggaaacaacgtgcaaaattagtcatggccatagccaggagggcactcaagcatcccatttacggcattgtgatactacggtcaggaatttacacaaacagacccatcgtttcccaattatgttctttcatcagttcaatgaattcatccattcttatctcggacgacgttcctaaatggaaaactccacacgactctggaatttcgaaaaacactattgacaacaatgaaacaagtactaatgtaacaactcaaacgatatgtatgtacaaaacaaaagtcaatcaaaacgaaacaaatgttagtccctcagttaaacaaaagatagcatacaaatga

SEQ ID NO: 21636 - DNA, 429 bp, Glycine max
  Peptide Sequence Number=SeqID_138414
atgattatgaggggacaagacatttatagtagccaagatgaggctactacttcaccttcctctagtgaaagtgaagaagcaaaaggagaagaatctagtgaagaaatctacccccaagaagaaggacaacctttaatggttaaggaagagtgtaaggaggtaagtgtctcctacaagaggttagctaagaaggaaagtcattttgaaataaagacaaatattaaagaaacttcccctcttagacaacctccacatcttctcctttgtaaaaagacacttgttagcactgccacacctcttgggcttgaggttattcctcaagtaaaggagttgttggatgagggtttggttcgtaagagcttaaatccttgtgctttattggtgcctgaaatagtgatcaaggggttcccacagaccctaagagaataa

SEQ ID NO: 21637 - DNA, 204 bp, Glycine max
  Peptide Sequence Number=SeqID_138415
atgaatttccggaagtacttcttccggaatttgaatcatcaacttccggaagaagtacttccggaaattcataattctcattccagaactacttcctcctttaaagttcttctgggaatagctttttactgttcatcttctctaaccatctacccagaaaacgcaaaagaaaaaatcgataaatgcgtacctccgacgaaatag

SEQ ID NO: 21638 - DNA, 162 bp, Glycine max
  Peptide Sequence Number=SeqID_138416
atgggatgccccaggagcagaatcatcttaggcgatggtcaaatatcgggccaaatccaaagacagagacaaatcgaggtaaatggtaacgcggccacagtttgctgcacaatgtcgtttcttgctttcaggtacttagggacggacgtgagtagaggctag

SEQ ID NO: 21639 - DNA, 858 bp, Glycine max
  Peptide Sequence Number=SeqID_138417
gtgaaacaaaattttattgatgctggcaaggctatgtggactacattgaggagtgaagatgtatgggggccttgtttatacatgtatttatcccttgcattgagtttggatattcgtgaaggaatgttttattggtatacagactcaaagggtggaccatctttctctcaggtatttatacacaagtcacttatatcaaatagcataacagaaactattgagttaaccactctaacaactagtgttaaccacttatcggagagtgttggttttatattttcaattagttctgtgggggctcttttaggtgcaatactataccagtatgctctaaaggattatgcattcaggaacttgctattctggactcagttgatttatggcttgtcagggatgcttgatctgattctggtctcgagattgaaccttaagtttggcataccagattatttctttgttgtgattgttgaaagcatagctaaaatgactaataggctcaagtggatgcctatgcttgtgcttagctcaaagctttgtccctcaggtattgaaggcactttttttgctctcctaatgtcaattgataatgttggacttctctcagcatcatggggtggtggctttgttctccacatgctcaggatcacaagaacaaagtttgataacatttggttggcgattttgatccgcaacattttaaggattgctccactttggctcctgtttttggtgcctagagctgaccgcagctcttcaattcttccatgtaaaagcatgaattcagaggtggctatcgacccttcagacaccaaaaatgttgaattggtgtcccttgtacacagtgttgatggtaaatag

SEQ ID NO: 21640 - DNA, 162 bp, Glycine max
  Peptide Sequence Number=SeqID_138418
atggccagtgctcgtgtaaagactgctggtgaaacactagttcatccaactggtcaccatcattcatgtcatgatttcattgatattggtcgtgttgcctccattgagaataaccatctacctgttgattatgcaaggaaggggcagaaagtagccattaag

SEQ ID NO: 21641 - DNA, 285 bp, Glycine max
  Peptide Sequence Number=SeqID_138419
atggtcactacaagtagagactacattacaaaaggaaacaaggcagtcacatcttctcaaacaagaaaaaggacaatcacatcatcgaataacacaagcttaacctacctaagtaaggttggaggtcgcagctgcttgtcgttgtccacggttggactcccccaacttacgaatgatgaaatcaacccgactgatggaaccctcccgacgttggatcgaaagccctgcgaaagccttgctgggaaggttgaagtcgtcagaaggaacgaagaggttgtggaatag

SEQ ID NO: 21642 - DNA, 501 bp, Glycine max
  Peptide Sequence Number=SeqID_138420
atggttgttgatctgtacagcgagggtaagatagatgaagctgataaagtcatcattgaaatgcaagtcagaggctttaaaccaacacattctatctttgaggcaaaagtagctgcattgtgcaaggttagtaaagtggatgaagcaatcaaggtaattgaggaggacatggtgaaagtcaattgtctacccactgctaaaatgtacaatattctcttgaaaaacctatgcaatgttggaaattccacaaccatactcgagagcttgaacaagatgtctagcaaggtcggttgcacaggcgacagagatactcacagcattttgctggaaatgctttgtggtgagagaaggcaatatgaagcagttatgtggttggagaacatgataagtcaggggaagcttcttgaaatttctgtctggaattcattggcatctttattttgtaactcagaaaagataaaagtgtcctctgagacatttagtcgcctaagaagtttgtga

SEQ ID NO: 21643 - DNA, 318 bp, Glycine max
  Peptide Sequence Number=SeqID_138421
atgatgcaatcctaccccccaagagtattggatagaagactccaagaggattgggctagagctgctaaagaaagccctggggttctcatgaacctcaggctaagctctagcttctctaggaatcttttcaaggaagcttatcaaggaagtttctcaaggaagcttctcaaggagaatcctctccaaggttcttatccaagacacattcttgatggtgaagctccttcttccaaggcttattccctagtggttggcgcctcctctaacttcttctcctttgtctttcactgcacctccatggtggaaaatcaccattga

SEQ ID NO: 21644 - DNA, 366 bp, Glycine max
  Peptide Sequence Number=SeqID_138422
atggtggaggtggttggaaccagatgcgaggcaatggccacttgcaagcacaccgacacccaagtgagtgttgggagcaatagagtaacattatctagtgaaagttacatagctggggggtgcctacttcctgtgtatatatatatgagagaagtaggaatgattaggttccttatccagagtgttagccctctttcaccttcgagggctatatctccaccttcaagaagatgcaaaagtaaatatcacccaaagtcaatcaactttatgtcactgagagatgatggctctcaaggacatagaaatggttcaagccaagctgctacacgacagatagacatggagaagcctgtcttttttatgtga

SEQ ID NO: 21645 - DNA, 723 bp, Glycine max
  Peptide Sequence Number=SeqID_138423
atgaattgcgttttcgttcctgtgtcctccaccttcgagtttggagctatgcgtaatgattgcttagtgcaattctccattctcaaccttttttggagccccatgaattgcgttttagttcatgtgtcctccaccttcgagtttggagctatgcgtagtgattgcttagtgcaattatccattctcaacctttttcggagccccatgaattgcgttttcgttcatgtgtcctccatcttcgagtttgcagctatgcgtagtgattgcttagtgcaattctccattctcaacctttttcggagccccatgaattgcgttttcgttcatgtgtcctccaccttcgagttcggagctatgcgtagtgattgcttagtgaaattctccattctcaacctttttcggagccccatgaattgcgttttcgttcatgtgtcctccaccttcgagtttggagctttgcgtagtgattgcttagtgcaattctccattctcaacctttttcggatccccatgaattgcgttttcggtcaagtgtcctccaccttcgagtttggagctatgcgtaatgattgcttagtgcaaatctccattctcaacctttgtcagagccccatgacttgtgtatacgttcatgtgtcctccaccttcgactttggagctatgattagtgattgcttaatgcaatatctccattctcacccttttttggatccccatgaatag

SEQ ID NO: 21646 - DNA, 189 bp, Glycine max
  Peptide Sequence Number=SeqID_138424
atggcgcttgggatttctgaagaaagacagaagactcatgtttgtattaacggtgaacttgcggtagcacgatgtccaatgctacttcaccccaaaagtatcaaaggtcatgcttctgaaaatattggttggaaacttggaattgtcctaacggtaatcaaacatgagctaagtaatattgatgtttga

SEQ ID NO: 21647 - DNA, 927 bp, Glycine max
  Peptide Sequence Number=SeqID_138425
atggatgatgatattgtaggactcggttttcgtccaacagaagaagaacttgtggacttttacctcaaacacatgttgctcggcaatgatccccgtgcccacgtcatccctgtcattgatctttgcgatgtggaaccttgggatgtaccagtgatgttagcaaaatcatcatcagctatacgatttggtgacccatattggtttttcttcagccctgttgatttcaagtattcaagaagtaaaaggtttaacaggacaaccaagtgtggcttctggaaagccactgggaaagaccgtgacattaggacaggggacactaacaccgtcattgggactaagaagactcttgtttactatcaaggccgtgtttcctgtggtgtcaagtccaactgggttattcacgaatatcatgctgttacctttcatgaaagccagaggacttttgttttatgttgcttgatcaagaaacctgggaaagcaactgaaggtggaactgatgcactgatctgcgatgaaggggagcccagtagaagcatggtttctgactttgaaaatcaggcaacagcagaaggaattccatctgaaggtacttttaccggaatggaaacaatctttcaggcaaccccttgggcagagaattgcttctctccaatacaacagtctccgactagtattgagcaggaaggagcatcctttccaaactatgcatttaacaatgcctattttagaaatgaagacaatgttatgcggaatccatttgaaactacaaaggaagatgaattcctgaattcaatcttagccggtgaaagtatagttatcaatgaagaaaataagcataattttgtccatagctccacccaatcagagtcattgaagacaatattattgaagactagacaacttcgtatgatgggaactaaaatctaa

SEQ ID NO: 21648 - DNA, 624 bp, Glycine max
  Peptide Sequence Number=SeqID_138426
atgtcgtacgactacctcttcaagtacatcatcatcggtgacacaggtgtagggaaatcgtgcctgctcctgcagttcaccgataagaggttccaaccggttcatgatctcaccattggtgtcgagtttggtgctcgcatggtcaccatcgattctcgacccattaagcttcagatatgggatacagctgggcaagagtcttttagatccatcactaggtcttactacagaggagcagcaggagcacttctagtttatgacattacaaggagagacacatttaatcatttagcaagttggctggaagatgcccggcagcatgccaatcctaacatgaccatcatgctcatagggaacaagtgtgatctgtctcatcgacgcgcagtgagcaaagaggagggagagcaatttgcaaaggaaaatggacttctgttcttggaggcttctgctaggacagctcaaaatgtagaagaggcttttataagaactgctggcaagattcttcagaatatccaggaaggtgtgtttgatgtgtccaatgagttggctatggacgtccccaaggtcaaccaggtgccagagatggaactgtttcagccagaggtgggtgttgcagctgattga

SEQ ID NO: 21649 - DNA, 165 bp, Glycine max
  Peptide Sequence Number=SeqID_138427
atgaaacatcatcgtaaagaagagacaggcatggatcgaatggaagagacaagagcagaggctgttacctttgcgagaaacgaagaaggtcgctcgttcggaatcctcagccgcaaacacagagacagaaacagagcgaggcagcagagtgatgatgaaaactag

SEQ ID NO: 21650 - DNA, 777 bp, Glycine max
  Peptide Sequence Number=SeqID_138428
atgaatgcttcagactcagagaaagaagacgcagaaattgaagcaacagaaactgcacccgatgaagagaatgcgaaattgaagaagaaagagaagaaaaagaagaagaaagcttcgtcgaaggatgcagagaagaagcgcggcgtgtgctatatgagtcgaatcccccctcacatggaccacgtcaagcttcgccacattctctctcagttcggcgatattcaacgaatttttctcgctcctcaagattcttctgtccaagtgtctgccaagaggtcacgtggatcccgagaccaagcatattcagaaggatgggttgaattcggtaataaaagtgttgctaagagggttgccaatatgttaaatggtgaacaaatagggggtaagaagaggtcatcattctactatgatctttggaatattaagtacttaagtaagttcaagtgggatgatctgactgaagaactagccttaaagaaagctattcgggagcaaaagctggctgtagaactttctgctgccaagagagagagggatttctatctttccaaagttgatcaatcacgtgctttgagtgctatagagggccgactaaagaagaagcagaagattcaacaagactcaggactagtggaaaaagtgattcgccatttccctcaaacaaagcctatagctgctgacaccaaaaaaaataaacctgagctctctgatgatatattggatgctgtaaataaggcacttgacccatacgacagtttaaaaggtataccagcttaa

SEQ ID NO: 21651 - DNA, 606 bp, Glycine max
  Peptide Sequence Number=SeqID_138429
atgtctagcagtccaagaacaaccttgtcctcaaggttgagtaaaaaggttaggtccaagaaggaatatgaggaagggttattagtgttggtggagactgtggaggatgcattggaagtaacaacggttggctttgtcggttggtggtggaccaaaataaggccacaaaagagagacgtggaagatattgtgaatgttagagttggccagaagctcaagttcatacacaacattgctaatgcggcgagtaactcaataaggttcaaagaaatggcaagcaagctatttggaacgacattgagtgagggattgttggcaatgatttttcaaatgcaaaagaaccaaatcattgacaacaaagctaagctaacaccagttgtcattgttatagggactcatggaaggatccaagagtggcacaacctgcgatatagtctgaaatggaaggggtgtcaagaagtgggtgtatttctagagtctatcgagatgacccaaattactgttagtccaaacaaagttggaagatgggtcacaaagtccatggcaagttttgatgaaaagtttggtgtcacggcgaatactaggccaatagaaggatgttgctag

SEQ ID NO: 21652 - DNA, 372 bp, Glycine max
  Peptide Sequence Number=SeqID_138430
atggcaagttttgtctcaggcaaggaaatgacattgcactgtggaagtcagatacagaagaagtcaacgtggtcctccaagtcttgccctgtctgcaacaccttcggatccagtttatgtcccacaatcatgcttccactctgcgcgaaggtcgcgccggcgagaacaatttcttcttcgtctggcgacagtgttgaagaagtcagggacatgcgtgttcgcatcgtcggacttgcggtggaggcatgcgccgaggtgcacaggcgacttcgcggcgaggatactgtcagtggctccggttctgacgccgtcagtgatagcttctggacattagagatgtgggcattgccgccatttctgcaatttgagtga

SEQ ID NO: 21653 - DNA, 1659 bp, Glycine max
  Peptide Sequence Number=SeqID_138431
atggaggagatgtcctttattgttgtggtgccattaagagtagttccccacatggatgtatccagatttaagctgatggcggacacggggttgttatctaattctgtaactaaggttttcaccgagacagttgcaagtttggatgattgtcatgatagtggcaatttggaggatgaagttggtattgctgaagtcataccaccaaaacaggatagggagggagagagtcctatgttggatacaatatcccaaaatagaagcactttggctgctggcgatgaagagttaaccacggaaattgaggaggattcattgtcgttggaaggtgaccagtttgttgatagctcgtgttctctttcagtagtcagtgagaacagtagtgtgtgtggagaggagtccttctgttttgatgctacttcggatgttgggacaccgtgttccgcagacgtagagaagagcatcagtgctgtcaatattgtagctgaggctgttgacttgggggagtcaaatattgacccagatattatgactgatcctcttgctgtggcagtgagccttgaagaagagactggagttagatctggcccaaagtcttctgctgttgatcttcatcagttgcctcaggaaaaaggggtgagtggaacagttggtcggagtgtttttgaattggattataccccactttatggattcatatctatgtgtggaagaagacctgagatggaagatgcagttgcaactgtacctcagtttctgaaaattcctattcacatgctaattggtgatcgggttattgatggaataaacaagtgttttaatcagcagatgacccatttctttggagtctatgatggtcatggtggctctcaggttgcaaactattgtcgtgatcgtatccatttggccttgactgaggaaatagaatttgtaaaggaagttatgatcagtggaagtatgaaggatggttgtcaagatcagtgggaaaaatctttcaccaattgtttcttaaaggtcaatgctgaagttggagggcaatttaataatgaacctgttgccccggaaactgttggctccactgctgttgttgctgttatttgtgcatctcatatcatagttgcaaattgtggtgattcacgagcggttctatgtcgtggcaaagaacccatggcattatcagtggaccataaacctaaccgagacgatgaatatgcaagaattgaggcagctggaggaaaggtgattcaatggaatggccatcgtgtatttggtgttcttgcaatgtcaaggtctattgttgcaataacaaaaaggcttatgtctggcgatagatatttgaagccatggattattccagaaccagaagttacgtttgttccccgtacaaaagatgacgagtgtctcattctggccagcgatggtctgtgggatgttatgacgaatgaggaggtgtgtgaccttgctcggaaacgaataattctctggtacaagaaaaatggcttggaacaaccctcatcaaaaaggggagagggaattgatcctgctgcacaagcagcagcagaatacctatcaaaccgtgcccttcagaaaggaagcaaagataacatcactgtgattgtggttgatttgaaaccctatagaaaatataagagcaagacatga

SEQ ID NO: 21654 - DNA, 1005 bp, Glycine max
  Peptide Sequence Number=SeqID_138432
cttccaccattgtctccaattgatgtatccaagtacaaacctcttggctctacatggaggaatgcttggagaccatggataaagccctcagaagaagcaatagctcgcaaaaagtttcatgttgtattctttaacaagaataaacaaaactactgcaagaagagtgaaattattcatcgtccactccaagaacttgtccagagagaacatatcatagtagagcctacaccacagacaaggtatgactacatccacaccccctttgatgcttacaaggccctttcaacagatgctattgtgccattggaaatccctacttggacaagaccagtgtaccccaacttggctctgatcataagcctggatccattctctaagacatccaagtactctccgcttgcagaaccactcagaattgacccatcaaaaaagaattcaaattctctagtccaagaatgtcgacatctagtgccctcgcacaagttgtatgtagctgatcaagcaacaacctactcgcctagtctccacatcagtaagtccacttatatagaattggtaccaaacaggagctaccctaggttgcctatatgcgatgaaggcaaaaagaagaacttcaagctctacttcaacatggaaatgcctagcaaaaaacaaaatgcaagtcttgcagccgaggaaaaatccaaaaagaaggatagtgctaagaggaaagatgaagcagatgttgctcaggatcaatccaacaaagttgttcctgagcaatctgttgccactaaaaccacacaggaagtggatgcatccattcctactttgattgatgaagcactagtaaacaaagttggtgaggatatgactaaacccaagcagccagaaacctcacatgaagctacgtccaaagatactgctaatgtcatagttgataccactacctctaggcccactcccattaactatgcacctcaaaaagttgaagagaaagagaacaagagagaaacacaattttga

SEQ ID NO: 21655 - DNA, 305 bp, Glycine max
  Peptide Sequence Number=SeqID_138433
atggtggttccaaagtcagaaaagatgcaaagacaagctaaaaataacaaggaacaaacatggaatcatggttacctcaaaggaaatgaaagggttcctctcagtatggggttgcaacggagaacaacgatggtttgcggtggcgaatggtggctgtgggtgatggagaaagtgcttgggacacatcttcttaaagatcccaacggtcagatggtgtacaagtgtcttgtgaagctacagaccaagtttcaggaagatccaacggttaacgaaggctgggaaacgtttttaccgaagaagctcat

SEQ ID NO: 21656 - DNA, 456 bp, Glycine max
  Peptide Sequence Number=SeqID_138434
atgtcaaaggatagtattatatttcttcttgagaacttcctattgacatatcaagaggtggctggacaatatggaacacccttggagttttgtgatcctcgactcttggcaattgcagaggcagaacgtcagttcttggatgttgaatatgatgagtatgctgcttccaacgttagaggagttgcatttttccgttcaactactttaattcttttcttgcttcacgctgctagatttctattaccttgctacatcatggcttgggcaatcagtattctgcagcatcggcaacaaagacaagcttctaaagtactcatgctcttaaggatatattatttttattattactattatggacttaataaggatcaagaaccagaggcaccaccagaagcccaagcaagaaggcccaaaaggaacactaagcgtcctgggcatttggatgattatgtctag

SEQ ID NO: 21657 - DNA, 204 bp, Glycine max
  Peptide Sequence Number=SeqID_138435
atggagcttggagaggtagtggttagggttgggaacaatgttgaagcaagaagtggtgtttgggtgcaacatagtattgggtggaggttgagtgtggtcatgaagggagttattaggaacaaaatgtgggttctattggcaaaagtggaaagtagcttgaaggccaatgaagcggttaacaaaatgttagccatgatctcctag

SEQ ID NO: 21658 - DNA, 606 bp, Glycine max
  Peptide Sequence Number=SeqID_138436
atggctccccgaagcagtgcaaagtctgcgagaagctcatcaatttcgacgctgaaattcctggaagattcttcgaaaggacctaaccacccttgcgcagacgtcgagtgtcttgttatatttcaacctacctcccccacctctgatctgaacgtggactgtgcccgactgatttattggctggttatgaagatggacatggacctgggtagcatgatctcttctcaaattactcagatcgcccaatccatctcttcaaggttgggcttccctaccttaatcgcatccctttgcgacgccaagggggtcatttctaacactctaacgttggagtcgctgagccctgtgattaacttggcctatattaggaagaattaccggaatccaatagatccttccattgtcttcccaaggccacaaagggctagggctcgggccactctagatgctttgccattcttccctccatctgtagttcctccgccagcagttcctcctctactttctgccccgccttctcttttctctactcatcccgaccaactcctccccatgttgcagagtctccatcagggacaataccttatcatgaagagtccccattag

SEQ ID NO: 21659 - DNA, 471 bp, Glycine max
  Peptide Sequence Number=SeqID_138437
atgaaacgctccgaatttgagtttcccgcaactgatttttccagcgccatccccagcgacgtcgttttgtttggtaaagtcataacacgccgaaccgaacccggtccagataaaagagaaaaccgggttctgtcgaaatctgagtcttcttcgggtcgctccaatgggttcatgtcctggctccggtcgccgtccgggaagaaaaaccggtgccggagaagtgagagtggccggagccgttataagacggtattgaagtttccgttgcaaatggaactgagtgacattaagaagaggcaggaccggagggaatcgcttccgccgccgccgccgccgccgctcccgatatttacggcgaaggacgacagcgacagcgacggcggagagagttgctgggaactggtccggccgtcgaggcgtcagggaacacttaagaacgccttctttggatgctttcttcccattatttag

SEQ ID NO: 21660 - DNA, 450 bp, Glycine max
  Peptide Sequence Number=SeqID_138438
atgaaacgctctgaatttgagttccccgcaactgattattccagtgcggtccccaacgacgtcgttttatttggcaaagtcataacgcgccgaaccgaacccggtccagacaaaagggaaaaccgggttctgacgaaatccgagtcttcttcgggtcgctccaatgggttcatgtcgtggctccggtcgccgtccgggaaggaaatccggtgccggagaagtgagagtggccggagccgttataagacggtattgaagtttccgttgcaaatggaactgagtgacattaagaagaggcaggaccggagggagccgcttccgccgctgccgagggttacggcggagtgcgacggcgacggcggagagagttgctgggaactggtccggccgttgaggcgtcaaggaacgcttaagaatgccttctttggatgctttcttcccattgtttag

SEQ ID NO: 21661 - DNA, 288 bp, Glycine max
  Peptide Sequence Number=SeqID_138439
atgttgctcctagagttggaggaaatgaggctcaatgcctatgagtcctctaagatttataagcagaagatgaaggcttaccatgatcgaaaattgatgaaaaggaatttccagcccggacagcaggtgctgctgttcgattcccgactaaagctttttcctggaaaactcaagtccaagtggtctggccctttcgcaatcaaagatgtgaagccctacggagcgatcgaacgaatggacccttcctctactgacccagatggcgctaagcgcaaacagtcgcgctaa

SEQ ID NO: 21662 - DNA, 408 bp, Glycine max
  Peptide Sequence Number=SeqID_138440
atggcagttttcgaactgcctacagttatggcctttgcacttagcgcgagcatcgcgcttagcgtggctcgcttcgcctgtgatgtcgcgcttagcgaattaactaatggaagtttcaaaggtgcacaatggcttagtgtgtcagtggcacttagtgtgctgcgtttgagaggagaagggattggagcctctagttcactgtttgcgtgtgatgagaatttcttccttcaaaaatactattttgcaaatcctaacggtaagaatgtgctaaagtgggtttcaaagttggtttccaaatttcacgactatccaacggctaacgagtccaggatcatagttttactggcacaggtttgggtgtatgcgggaaaagagaaaactcccaacggtggatgtgttcggatataa

SEQ ID NO: 21663 - DNA, 690 bp, Glycine max
  Peptide Sequence Number=SeqID_138441
atgaccatcatcattgctaccaccatgatctctgtcactctcattgtaaccaccaccgtcaatggagatcatgttaatgataatgatcatagtcatggcgacaatcacaatgatactggtggtggtggtgaaaacagccatgataatgaaggcgttcttaagcgttccctgacgcctcaacggccggaccagttcccagcaactctctccgccgtcgctgtcgccttcgtccttcgccgtaattatcggcagcggaggcggcggaagcggctccctccggtcctgcctcttcttaatgtcactcagttccatttgcaacggaaacttcagtaccgtcttataacttctccggccactctcacttctccggcatcgtccttctctcccggacggcgaccggagccacgacacgaacccgttggtccgacccgaagaagacctggatttcgacagaacccggttttcgctttccgacgctggaccggccggttcgtttttgggagcaatggcggcatggagatgagtattgttgtggccactgttgcggaaaatgaagtatgggaattaatgggtatgatgggaaacttgatgatggtagtggttgtggtgttcaaggtaacaaacaaggatgatgattgtggtgaggactgtcatagtgtggtctatgagagacggatatcaaaccattga

SEQ ID NO: 21664 - DNA, 192 bp, Glycine max
  Peptide Sequence Number=SeqID_138442
atggcaacaagttcagatctggagcagcgacacaaatttgtaccaatggctatgtcaatgagcgaatttggttggggtggcaagacgtcagggaacacaaggatgcaatggtgcaccaaaaaatggatctcgtcaatgatgtggtggtcgtggtggtggaggaggttgagaatcagattgaaccctaattga

SEQ ID NO: 21665 - DNA, 162 bp, Glycine max
  Peptide Sequence Number=SeqID_138443
atgaaaattgcaacattcttttatgattttgagttgttgaagaaagtgaacggaagaggggtgaggtcggaaagcgtaattgaacatgaggtctcggtcgaagaagcaaatgacgacgtcatcaaatccgatgacggcaaggtgccacaaagtgcaaattaa

SEQ ID NO: 21666 - DNA, 1107 bp, Glycine max
  Peptide Sequence Number=SeqID_138444
gtcatttccatcggtagctcctcggaggaggacacctaccacgatgcttttgacaccgaatcctcttcctctaagaggttaagggttttgtgttgtgctgggggatgcacttctcgtctccgcaaaagggcacaaccttccattgcttccctagtcagggagcctgtcccggttgctatgattctcgccccttctatttctgggggagcaaggaggagtggtggcagagacattaaggcatcccctctaatgcgacatagccatagtgactacgttttgaagtataggtccttcatcacttctgcggtgagcatcgctgcactacaacaccaagtgaaattggaaaaccctgaggactcctgcaagatagtcgtccaggcttgcgggagcaaccctgaggactcctgcaagatagtcgttggccttgttgctggtgttgttgagtcaagggcccctttgaaccttcgtgcactgaggcaagctgtagggttgacgcatggttcgggtcacccttcgagttttcaggatctgcctctagctccatcgattgttgagactcatgttgttgttgttgttgttgttgttactcatgctcctccaccccctcttgctatactggttcaagaggttgctcctgctgttgaagttgatgcgccagccgtttcaactggtcttgtcgtggctccgccatccactgtcattgcacccttgctgagtgcactgactttgcttcaggtgtcgttgtatgccgacaacgattacgacggtccttccatacccgtccttgctaagaagcccttttgtgataccaaaggttcagataatgacttgaatgatcaaggcagtgagcatccattacttcctggtagattggaaaattcttcactaaagatagcaagcacaggaaatggaaatttgaaagaaagaatgggacagctcaggtctaaaagttcagcctctgaaactgagggtcttgcaagggatctcaagagacagaagaatctggactttaaacctggaaaggaacctggtgcaccattgcccaaaattgactcgtgtccaaccggaaggatctgttcattttgccaatcctctaaaatctcatag

SEQ ID NO: 21667 - DNA, 225 bp, Glycine max
  Peptide Sequence Number=SeqID_138445
atggaatctcttatggatgatgatgagaatattactcgtttcttggtgcttgcaagggagcctataattccaggaactaacaggccccataagactagcattgttttcagtctagaagaaggtccagggtctataattcaacgacagtcaaagatagacccgtcgttatccaatgacgtggccaatacaacgacaatcacccatacacccgtcgttatcctatga

SEQ ID NO: 21668 - DNA, 324 bp, Glycine max
  Peptide Sequence Number=SeqID_138446
atggacacccgtctccgtgtaattggtgatcccatgaatggagttcaacggagtaagagcattggtgttcataaggtttggggatcctttcgctgcacacgatcggaaccaacgggttgtcgtatcttgggagaggagcgcaatcagaatttcttacccgtacagtggaggcgttttctctctaaggatagcgtttacgcgcttcaacctaggctatatcttttttctcctaatttttttttccttgtgcttattgcaagagtgaccctagcaccatcactgcagaagttatatatgaccttgtggaccccactggtaatttaa

SEQ ID NO: 21669 - DNA, 357 bp, Glycine max
  Peptide Sequence Number=SeqID_138447
atgtccaatatggactatattggcagtggggactattttcaaaacatttgcaagtattgtggaagtaatgacccggatctgaaggaggagatggagaagcagtttgtggaccttctcagtgaggagttgaagttgcaagagtctgttactgaagcaaacacccggcacatgaacataactttggctgaagcaaaaagagtggcttctcagtaccagagagaggcagataaatgcattgctgcaactgaaacatgcgagcaggcaagagaacgtgctcaggccatacttaccaaggagaaaaagatgactttggtgtgggagaaacgagctcgtcaaatgggttgggaaggagaataa

SEQ ID NO: 21670 - DNA, 363 bp, Glycine max
  Peptide Sequence Number=SeqID_138448
atgggggagacacatgaagcacctcgagaccacaatctagtcaacttcaagcctcacctcggatgtgccattgaggggcaagcatttggtggaatacccctaccaaacactttggggggacctcaactgcctcctaccgtagtggaaaaggagaaatttgatcacatagaggaaaggctaagggctattgaaggaggcagagattatgcctttactgacatggaagaactatgcctagtgcccgacgtcgttatccctctgaagttcaaggtgccagatttcgataaatacaaggggactgcttgctccaagaatcatctgaaaaatgtacagcaggaaaatgggggcatacttaaaaaatga

SEQ ID NO: 21671 - DNA, 510 bp, Glycine max
  Peptide Sequence Number=SeqID_138449
atgttcattctaaccccaattgcgataaactcatcccttacctctaagcgggctcacgtgtcttctgacagcgatagcggtgtctctagcaagttcctgagattcctcaaagtttctcctcatattgctctgatagggttcccaaacgttagagagaacgagaagggattgaagcctttatcttcgtgcgattccattatctccctccatgagtactatctcataaatcccattggtgaagaccattttgggtttttgcgggaaaggaaaaggctacgatgcgaaaggtatttctctcatataaagaatgatatcaaaattcccaacggtgagaattctcgtaattgggttaccaacctggtgtttaaatttcacaacgatccaacggtgaatgattctgagatcgtcgtttttctgagacaaatttggtgggctgtgggaaaaatagagggttttgagaggagtaaagagaaaaacaaaaatgaggcgaagaggaggcacctgacttaa

SEQ ID NO: 21672 - DNA, 273 bp, Glycine max
  Peptide Sequence Number=SeqID_138450
atggctttgcttggcagaggcacagttgcaacaatacgtcgtagcgctttaattttcacctccaactctaataacagcttattccgtagccacccattttccgcacccatttctctcaatgtttcaaactccaacacgattcatcggcacttcagttccaccaagaagccattcatcggcacttttatacggtacctgagcaagatttgtggaacggggaagcaaaactcgacaaataatataatgcataatgcgacattcaaaggtgaatga

SEQ ID NO: 21673 - DNA, 1134 bp, Glycine max
  Peptide Sequence Number=SeqID_138451
atggaagaaccatcaaagaagagaaatggatcatcctccacaaccaccgctgcaagacaacgccgccacaacacatccgatgacccaccagcaccacctaatctttctttttcttctccacggtcattaactctattttcttcagatgaacaacatcaaaggtactattccttattctcaaatcgtgtcattctcgatgctaaatatctagacatagaattctttgatggggaaaactttgattgttatcaggtgcataaaatacccattgttgttgatcaatctttgttttattctttgacaaaactgagtagtcagggtgttccttttgagggcactttggttaatgattggaagcatatctattctagtcatgatgcacgtaaaatggtctgtaatgaccatgctgatatgaccggtagattgcctggctcattcacctttgaatgtcgcattatgcattatattatttgtcgagttttgcttccccgttccacaaatcttgctcaggtaccgtataaaagtgccgatgaatggcttcttggtggaactgaagtgccgatgaatcgtgttggacgctacgacgtattgttgcaactgtgcctctgccaagcaaagccattctcttctattctattctcagagacttgtgcaagaaaaaagtctcacttgatcactcactttactcgtgttggaaagccttctagaatatttggatggcaaattggcttgcataacgaagatttaattctgctatgggctcttcaaaccggtcgccaaattgactgggcccatcttgtcaggtaccgtatgcataaagtattacgggccaatgcacctcttccttatcctcatcttgtcactctatttcttcagcattttaatgttcctttagaggatgaaccatttgttaaggtcaaacaccttccacctccaattcctgataaacgcacaccctccctaccaccacaacgggattcctcctcttccttactaaatgacgttgtcactgagcttagggatcttcgagctttcattggcgatcatttcgatgctatggactcatgcatcacgcgtcttgaagacgacatgaacttcattcgtcgttgccttgatcctcctgcggatccatag

SEQ ID NO: 21674 - DNA, 537 bp, Glycine max
  Peptide Sequence Number=SeqID_138452
atggtattaaaaattgtaaatgataataaactcccctcacctatcgtgagctcttcgtcagttcctctttgcgtcgttcagaggtctctctcgttcatgctcgagaaaggcttagaagtcaagattacctcagagaagctacaaaatgaaggatttggggggaattttctccatcgaaaacttgaggaggattttgaggatttctctgattacaacgttcttcttggtgtggaggttcgacgacaagcaacgacgactcatggtggccactggtggtcatgggttgtagagaacaaggtgttagggtttgggtgggcgtttggagaggaggagagggggaaaaatcatgtttttcacgttgaagaacgtatttataatctgtatatctttcttagcaagctcgtctcgctaagcgggagtctaatttttgcacttagcatgacaattcacgctgagcgcaactccttccgcactaattctcgctcagcgcaattcccgctcgggttggaattgtgcttagcgccccctcgcgcttag

SEQ ID NO: 21675 - DNA, 804 bp, Glycine max
  Peptide Sequence Number=SeqID_138453
atgggcccgaaattcgccctaaggctcatgagaaccctaagaccttctcttgcatctctgacccaatcttcttggagtcttctatccaattccctttgggggttcttgcaagagaaaggtaaggtggttgcattcattggaacaaggttgattactagttatatttcaattctaaaggtagctgatgtggggatagttcttgattctgtgagcaggatagtggacagagatagttctgacataactatcaaacgtttcaatgcattggaaccaattctgatggctggcagaagtaaataccacaatattcaaaacttcattcaacttcatctgacatttaccatatcagggttagtcataacattgattacaacaatatgtactggagatttcccccttgcacaattccagttgatttgggtgaatgttttggtgtgcattctgggtggtctaatgatggtaatgaagttaacccacgaggaacagcttgccaagcaacaatctgctcataggaaccatccaattataaccacagaaatttggaaaagcattgttattcaggttttatatcaggcttctgtgtcgatgatacttgagtttgggggacatgtcacagctgacagattgtgcctgcttttcaatctgctcaacatcatgcagttgttgaaaaaggaagttttgaaggtggttgttcagagcttctgtttcttgggggctttaggtggttgttttcttatgcaagtgctgctgattgagtatgctaaaggccgagcagattgcatgcggctgaatgctacgagatag

SEQ ID NO: 21676 - DNA, 738 bp, Glycine max
  Peptide Sequence Number=SeqID_138454
atggggaatggtaatcttgagatgagtgtcgaagaccaaaaagtgaccttcaatctcttcaaggcaatgaagcatccaagtgatgaaagaaattgctttaatgtgaaggctattgaacatgaagtagaaaatgttatgcagcaattcactgatgataaaaaattagtagtcattagcaatgctttatctccaaaggaagaagccaaattggtggaattgctcaagaagcataaagaggaaattgaatgtcatatcttcgaccttaaggggattaatccatcatattgcatgcacaagatcatgatggaggaggattatagactggtgaggcaacctcaaaggagacttaacccgactatgaagcaagaagtgcgagaagaagttctcaagtttcttgaagttggaaggatgccatttgggttgtgtaatgcccctgccacctttcaaagatgcatgctagccatttttgctaatcttgcagaaaaatgcattgaggtcttcatggatgattttttggtgtttggttcatccttcaagcattgcttgtccaatcttgaattggtgttgacatggtgtgtagaaaccaaccttgtgttaaattgggaaaaatgtcatttcatggtccaagaggggattggcttgggtcataagatctcatcaagatggattgaagttgataagaccaaaattgatgtcattgagaaattacctccttctatcaacgtgaagggcatctaa

SEQ ID NO: 21677 - DNA, 231 bp, Glycine max
  Peptide Sequence Number=SeqID_138455
atggcgcctcctctccctttttctcctttatcttctgctacaactctatgggcggtgtttgtagggaaagctcttattgatttaggggcaagtatcaatttgatgcctatttcgatatgtcggagaattggaaacttagaaatcatgccaacaccgatgactttgcaactagcagatcactctatcacaataccctatagtgttgttgaagatgttcttctaaaagtctga

SEQ ID NO: 21678 - DNA, 228 bp, Glycine max
  Peptide Sequence Number=SeqID_138456
atgagtttcttgaacacaagggaaagggattccttgggtgttcagaaattactgactgttgggatcttgaaaataataaattttggtctctcgctaagcgagtatggcgcgctaagcgcaactccaaccaaggggaattacgctgagcggccaaaagctgcgctaagcccaactccaaccgagggaaattgcactgagtggccaaaaggtgcgctaagtgagccctag

SEQ ID NO: 21679 - DNA, 699 bp, Glycine max
  Peptide Sequence Number=SeqID_138457
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 21680 - DNA, 445 bp, Glycine max
  Peptide Sequence Number=SeqID_138458
cgcatttgcatcatttgcatcaaatcatcatgatcatcatcaaaacatcaaagtcatttgcttctacacagttttgacgcctattggacaagggagttcacaggtttcagggtcatctcaattatcatcaaaagatgtgtttctgtcaaaggctaaagcaaaaaatatctctcagattaatgccatttctgagattacaactatagtgatggacaaccattcatggtgtcatccggcttgcagtcaatgtcacaaaaaagctgacatagaaactatgtcattcacatgtccatgtggcaaagacaacgaccaacctatattaaggtatagagttgaagtaatggttaatcacaagggcgaacaaaccaaatttttgctctgggaccgtgaatgtgcagagttaattggtccatcggcagatgaagtcaacaggctcaaaatagac

SEQ ID NO: 21681 - DNA, 294 bp, Glycine max
  Peptide Sequence Number=SeqID_138459
atgactatgcaaaacatgcagtttcatcaagagaccagagcctctattcagagcttaactaatcagatgggacaattggctacacagttaaatcaacaacagtcccagaattctgacagattaccttctgaatctgtccaaaatcccaaaaatgtgagtgccattacattgagatcgggaaagcagtgtcaagaacctcaactagcaaatgaacctgcccaacctcactctactccagaaaaagatgttggatcgagtggcctcagaataattaagaagggggggttgaattaa

SEQ ID NO: 21682 - DNA, 1866 bp, Glycine max
  Peptide Sequence Number=SeqID_138460
atgaggattttcctgagctttgacaagtttcttccccaacatgctccattcattagtcgagaggttggcccggcctggttcactgactatttccctactgtcgatccggacaatgaagaagaggtgaacgaaatatggtcattttacttgaacccacagatcctgtcttgtcgtacaggtgttcaatcgaactatttaggcctggttgggtaccagcctaatctggtttcaagacaatttggcctctcgcaaattcgtcctaaaagcttgttcgaagatcctcaagacttcataagaggggccaatctttcggaaaagaccttcaagaagtatttgaaaatttctcttgatgaaaactatgacttgcatccttttgagttcaaccattcccacttctgcaccatggggtttgttacctggtgggaaaaatattattcgacccgttcgattggagacactactgccatgatctccaggcttgagagtggctttgcgcaaccaacggtcgagaatattcgctcaagccttcaagctcgaggcaaagcacccatgacgaagaggagtgctgaaacgtctcgagctgacgtgagacccaagaaacccactggggtgaaaatccaggaaggaaaacaagaggagaaggaagaagaggagagacctcttataagaaaaagaaagttacctacgacttcgaccaaatctgctgatcaaacagaggcaggcaattcccaggctcaaacgcctaagaagaaaaagaaggcgaagcaagttgagcctgagccttctgtggctgtcgagggtggtgagccagccaagaagaaaaagaaaaagaccaagtctttaaaagaacaaggtgacaatcaacctgttgacatccaaccaccttcaaccgatattggcggcactgaggtagaggctgctccttctgttgctgagatgggcaaccctgtcgagaatccggacttaccacaagagcaacctgccatcgaggtgcaacaaaatgttactgcagaagaaatgccctcatgggcgcgaacatctcccgctcctgaggcgaatgcagtaaatgctgaggaatggggtgaaggtcaaggcatcggatccagtagtcctcatggctgggcagaggttgatggtcaatatgagccaaaccagtcagataataccattcctcatgaatcgagtcagaaaagttcatccgaaggaaactttttcgatgaagacgccataaaagaggctgaagctggaggctcagacattcacccggtgtcctcaacatctaaactttccgctagcatagggatcgcagaagatacattcattcaaatgcaaaatgaagaccctgctgcagcccttcgactcctgctgaacacaagtcaagccaacacctcaagtgacaagattcctggtgcttcgaccccatctgatgctgaaataaactcttcagtacgccaagattctctgctcttgaagttatcaacggaatacgcactgaaagatgtgcttaaatccattgaagagaacccctctactgcctttgggcacctgaactttttgaagaaattgcacaacccccttacctatgatgaaactctaggcaaagttatccaaatcgaggccatcattgaccagtttgcaagtgctgtgcagaaaaaacgcgaaaatggcacaagactagatgcccagaaacaggcacatacccttctgctcgagaaagcccgagctgctcaacatgaagtcgaacgtctcaccaaagaggcgaaagaagggtcttctgagatcaaagactgtgatgataacatctcctcctgggaggcaactattacggatctgctgtttcatgtcgatgatctaaggcagaaaatt

SEQ ID NO: 21683 - DNA, 534 bp, Glycine max
  Peptide Sequence Number=SeqID_138461
atgaatttgtccaagtatgattaccatgtgatatatgagtgtcataccctaatttcgtccggggacctttgcttgatgacatgcgacctttctttggtccttgtgaggtgcttggcacccatcattaggcaatttgtgaaattccaggacatgccggaaaaccaaaaaatattgatgcacaatccaaaaatcgagtcgaagtgcttctgtaacgcttccgtaagcgattctgtggaaattcttcatcgttcttcgtcgttcttcaccgttcttcatccgttcttcgttcgttcttcgttcttcaacgggctgccgtcccttggggcggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgtgagtcacgcgtcgccctcccgccgaagggtaggttgcgacaatga

SEQ ID NO: 21684 - DNA, 510 bp, Glycine max
  Peptide Sequence Number=SeqID_138462
atgtcttggggtaccctgacactggtggacaggttgagtggcatggttaaaattgttgattctataatccaggttgtttacatcttggatcaagttcgtgtctcagagaatgagatgctcaaccgcatcaagaaacatggccttgatatcacccttcgtattctcattgatgttgcccttgaacttgccaaggagttgcaagccaacccagatctgaaaacagaccacaacaagccaatcatcttcactatggcaagacttgaccgtgtgaagaacatcacaggacttgtcatgtggtatggcaagaatgcgcgcctctgcgagttggtaaacctcgtcgtggtggtcggagacaagaggaaggaatccaaagacttggaagagaaggccgagatgaataatatgtatggcctcatcgagacctacaagttaaaagaccaattccgatggatctcctctcaaatgtatgcaaggaataactatggatttaacaccatttcttggatatga

SEQ ID NO: 21685 - DNA, 168 bp, Glycine max
  Peptide Sequence Number=SeqID_138463
atgccgatctccccctgcggaagtatcggttgggatcgtgcccacaagacacccagcggacctggaagagcccaacagggccctggggtttccagctctggttacgggcctctgtcagtcctacagggtgctcgttccccccggcaaggtcacgccatcatgacatag

SEQ ID NO: 21686 - DNA, 357 bp, Glycine max
  Peptide Sequence Number=SeqID_138464
atggcaacatatcttctcaacattttaccaaataaagttattgtttgtctccatgtgttatttgaggaaaatgaatttcccttctcgaagttgcatacttcttattcctccacctatgattttcctgacaatggcttatcgccttatgtgataaaccatttacaaaatcagtccactccttacattcaagtgcaaaaccacccttctctagccccagcccagtcacttggccaaccctgctcccctaatcatgcaaatccctcttctccacaattggcccaaccaacttcctcacccccacagttggcccaatccacctctaccaacccagagtcatcatcctccactttgggctag

SEQ ID NO: 21687 - DNA, 477 bp, Glycine max
  Peptide Sequence Number=SeqID_138465
atgtctttaaaatttccttattatcctgaacttgtcaaagtcttttactgcaatttaaaaattcaagatggcattatttcttctgaggtgcatggtatttccatgatcattgatcaatcattgttcttttctttgactaaattacccagtcaaggtgcaccttttgagggcaccattgttgatgattggaaatttgattattctagtcatgatgctcgccgtatggtttgtaatgaccaggctgaaatgaccggtagattgctggccagatcattgacatttgataatcacatcatgcactatattattgtaagaattttgcttccccggtcttcaaatttggctcaagcctctgaggaggacttgatcttgatgtgggctttccttatcggttgtcagatcgactgggctcacttggttcgataccgaatgcataaggcattacgggccgatgcacctctcccttaccacttaatt

SEQ ID NO: 21688 - DNA, 2004 bp, Glycine max
  Peptide Sequence Number=SeqID_138466
atggatactgtgtttggtggcttgtatatcttgaccttaccttcaaattccaattcaaaatttgggttttttttttttgcaagatttgcaaattcttacttcttcaaagttactacaactaatcaggcagttgaagcgctgaaaatgttgagggaaaacagaaataagtttgaccttgttatcagcgatgtgaatatgcctgacattgatggatttaagctccttgagttggtgggacttgaaatggacctacctgtcatcatgttgtcagcacatggtgatacaaagctggtgatgaagggtgtcacacatggtgcatgtgactatttgctgaaacctgttcgaattgaagagctgaagaacatatggcaacatgtagttcgaagaaagaattttgacagcagggatcagaacaaggcttccaatgaggagaaggctcccaatattgctggggaaggtagtcaaggcctacgatcagaaaacagtgctgaccagaataaaaggcttggtaaaaaaaggaaggaccaaagtgaggaggaagaagaagatggggaagagaatggagatgatgaggacccctcagcacagaagaaacctcgtgtagtttggtctgttgagctgcatagaaaatttgttgctgcagttaatcaactgggcctagataaggctgttcctaagaaaatacttgacctgatgaatgttgaagggcttacaagggaaaatgttgcaagccatctacagaaatatagactctatctgaaaaaggcagcccagcaagctaacatggttgctgcattgggtggtagtgattcttacctacgtatgggttcaatagatggatatggagatttttgcacctcgtctgggtctggaaggatcacaaacactacttcaccatcatatgcatctacgggaattttcagtaggctgaattctccagctgccttgaacatgagagcaattagttcttctgcgcttatccggcctgttcagtctcaaaacatcaactgctccttaaacacacttggaaacattcagccatctgtttttcctgcaaatcatagctcaagtttattacagggaattccgacatcaattgagcttaaccaatctaagcaaagcaactgtacaactggaatatcacagttaagtcaagttgattcaagtggatttgcagtggcctctgggttcccagacagtagggctactgttaatggtccaaacaattctctaccgtgtgtctcaaataatcatataatgttacaaggaaatccacaacaaatgcatggcccaggagcatttagaaatcagtcttctgttagagcggcttctttgtgtgcagaatcttttgacgcgggcttatgtagttcttctaatttgttagattataatcggtgcaatgaaaactggcagaatgccgctcaattgtctaaatttcctgcccactccttgccactttgtgaggctttcagcaatgaccaactgcctcccactagaattaatgtttccaactcaagaactcatattgtcaacagtccagttgatttttcttctagaatgggaatttctgttcctttggaggacaccagaaatgagctggcatgccaagagggcttgattgggaatattgtaaagccttcaagttacacaccacaacaaaggtgggaagaacataaactggattataaccaaaacgtgggtcattcctttaatcctgtaaattcacatgcttcttccagtggagtgaaaagttctatggggcatggtttaaaccaaaataatacaatttgtagcaatagagttgatgcatctttggttggccaactaaatggagcatccccatcaatcagcaggtgcactgaagttgagaaattctcttcagacattcgactgaagccaaatgaagcctacattttggagcaaatgaagtcccaagatggatttatgcagaatacttttgggaccttggatgacataatgggtgcaatggtcaaaagggtatga

SEQ ID NO: 21689 - DNA, 435 bp, Glycine max
  Peptide Sequence Number=SeqID_138467
atgactggaagcaagagggttgaagaggattctaataagaataagggttcctctctaaaagctacaaatgatgtcctcactgaagatgaccaagcacctaagaagattgagattcctactggggaaaaccaggttcacgacaaagaaggaaatattgacatctccttagaagaagaactactaagtgtggatgctctaacagtgataattcttgagcttccagttgaggaaactctgcatacttctgataaacctaaacctttggaacttaaatctaagaaagtcttcaaattcagtgacctagtggttgatgagctttgtaaagaaatggaatcattcctcaatgttttcaataatgccttcgaggctcataaactttgtgaccaatacgcttttgacattgctgaaattgagtcttcgacggaacaagattga

SEQ ID NO: 21690 - DNA, 489 bp, Glycine max
  Peptide Sequence Number=SeqID_138468
atggcaaaggaatctgcccaaactctaatggattacctcacttttactttggggaaatccaataccatcatactccttgatttgtctgaagaagtcaattttgacttcaagcatgggttctcacagatgctggagaacaacacatttagtggtacccatgaagctcctatccagaacttgaagaagttcctcaaaatttctaacacagtgagacaaaattgtgtattggcagaatatgtcaacctctacgccttcattttctctcttaatgggagggataggagaaacataaagaagggcgtccaccaaatagagaaagatgaatcccaaactgagttgggaacacaaattcaaactttaacattgaagattgggtcactcatgagagcccaagctcaaatgcccatcaatacacctcatttccaaacctctgagaaatgtgggattgtacatgggccgggagaatgcgttgtgtgggtgatgcattag

SEQ ID NO: 21691 - DNA, 306 bp, Glycine max
  Peptide Sequence Number=SeqID_138469
atgccttcgaggctcataaactttgtgaccaatacgcttttgacattgctgaaattgagtcttcgacggaacaagattgaaacaaacttgttcaaactcaagaaggattctagaaagctaaggaaaatatcatgctatgatacaaggacaaatagagatattatggaagaattgaaagttctactcgagaaacaaaggcaacttaagtatgctaagaaagagttcatgaatgcactatctacatggattaaggccttcaatgacaagaagaagaaccactacgttaaatatgctaaatccttgtaa

SEQ ID NO: 21692 - DNA, 234 bp, Glycine max
  Peptide Sequence Number=SeqID_138470
atgaagaatttccacagaatcgcttacggaagcgttacggaagcacttcggctcgatttttcttcacgaaaatgtatagggaaaaagggaggtgcttaccaagggggcgaaggcgaggccaacctcgacggcatcatgcaaggacctcaacggtggaacatgacaacacatcacaattttggtgtaggcatgtggcatgacgacccaacatgtggcacgatctcagtggcataa

SEQ ID NO: 21693 - DNA, 447 bp, Glycine max
  Peptide Sequence Number=SeqID_138471
atggacgtgtctttggcgtgccagataagcaggggagtgcggcacacgcatagtacttttgcaaacgtgtcacacatggagtgggcacgtactggagtaacggtcatgctgattttgtgggatcgagaggttatctcgataggcggttccccgtctaaagatactcgtcgaggtgcctctgatagcgagtcctcctcctcaaagagggtgagggcctcgcatcgaactggttggggcgcggccttccactactatcggggagcctatcccgattattgtgaacctccccccatttgctttagggggtgcacggggagccctgcttcccattctactagcagtctgatcccaccatgtttgaagtcgtataatgaggatctgttgacccttgtggaaagggtcgacaaagcgattttcaagcagttgctggcctcgctggaagcgtag

SEQ ID NO: 21694 - DNA, 336 bp, Glycine max
  Peptide Sequence Number=SeqID_138472
atgattaggctcaagggcttgacaagccacttcaacctgcaactctcacattcgtcaaggctaccaaacttgacatcagacaacactcgtccatatttgggggttaacaaacttgttaccctctgcttgttaagattattacccaaaacatttgacagactccctcgacgcaggacaatctactttgacatcgacaacctcttttggccgcaactaagagcttgggggcttatgtattgtccaggacccacaaaatctatgtggcatctcacgtggcactcggagacacgtatccaccctccatgtcagccctgctacaagagcatatacgcctga

SEQ ID NO: 21695 - DNA, 408 bp, Glycine max
  Peptide Sequence Number=SeqID_138473
atgacaagccaaaagaaccaggttagcgccactgacgacatgtcactatcagcgaggaggaagtttagcgcgatctgtcgcagcgcggtagcacttagtgatttttttggcatcgtcacacttctttatgaaggagaggagtgtggtgttggagggggagtaaggcgcaggggagcagatctagatgacgctagattgggagtcgcgggtgaggttcatggagtcgaagttgtcaatggcgcagccagtggtttgaaggagcatggtgatgagcttgccggaggaggggagggtgcagaggttggactaagagaggaactggaggaggacaatgaagagagaggcgcagttcgagagatccgcgatgaagggtatagcggagttaaggagggagatgaattgggatag

SEQ ID NO: 21696 - DNA, 156 bp, Glycine max
  Peptide Sequence Number=SeqID_138474
atgacgattacttccactcacagcggcgatcggtggcgctggacgaaggagttttaccaacaaaatcttttggtgccccgagatgagaagcttgacatatattgtggtagtggacataatggcgagattttgcagaataaggtaccggctgggtag

SEQ ID NO: 21697 - DNA, 201 bp, Glycine max
  Peptide Sequence Number=SeqID_138475
atggaagaaaaaaacgaatccaaatggaagaattcttccaaaaaggtgtttatggagaggaatgatgaagacaaaagctctataatatgctacgaatacaataagcctgagcactttaagcctgaatgtctagaattggagaagttccacgacaaggagtattacaagtcgaaagaaaagaaaggcctcatgagcacctag

SEQ ID NO: 21698 - DNA, 330 bp, Glycine max
  Peptide Sequence Number=SeqID_138476
atggtaaaaatgcgccaacaacacttcaagtccaacgggctcttgtgtgaggtgtttagagatgtaactaaaccattaatgtacttagagccatcaaaacgggttcaaacccacgtgccaacccagcccacctcaggatcagggcaggacgggctgaaaaaatgtgggttggtggtgggccaggccaggccatttctccaagactcaaccttaagtgagttggattgggttgacccttacagggtgggtttggcccaatggatcggatcaatccgttttgacaactataaatgtaccaacatccaaaacttaagcttttggggtagctag

SEQ ID NO: 21699 - DNA, 198 bp, Glycine max
  Peptide Sequence Number=SeqID_138477
atggctaattcattggcagccagggatgaaaggaaggctctcccaggctttaaagcacacctttacaattttttgaagggtgagaaggagctgattgagaagttgttacaaactgaaataaatatattccgctcaatcagagatggaagtgctctgatgcagcatatggaggatttctattacatcacgttactagag

SEQ ID NO: 21700 - DNA, 165 bp, Glycine max
  Peptide Sequence Number=SeqID_138478
atgatccaacaaaggtttgctcttaccaggctggccagcaacagtcttacatggccaactaaaaccaggaaaatgtcagcaatgcagtatgcccagtatagtttgcaaatggaactgataaggcatgatgagttgctagagactgcaaggagaaaaacctactga

SEQ ID NO: 21701 - DNA, 216 bp, Glycine max
  Peptide Sequence Number=SeqID_138479
atgaagaagaaaggggttttagttgatatcagagtcatcgaaatcgtcttggaaattgttgaagaaatcggcgtcggcgagtttgttgtcggcggcgatgacgccctcggcgaagatctcgagagggtcgacgtcgtccacgtccattgccatcgacgatacctgctcgtccatctctccgaacaaggacagaaagcaagaaaggagaagaaataa

SEQ ID NO: 21702 - DNA, 285 bp, Glycine max
  Peptide Sequence Number=SeqID_138480
atgaggcgggcgttgaggtcgggtgacgggaggaagtggaagaaagttaggcaggagagaggggggggagggtggggtcggagaggacacggggttgttgaggagggtaaggattatggtgtgggcgagttggaggtgttgtggggttggaggagggaaggaggtgaatttgctgaggattctcgagagggtcttccggggatgggaacacattggttttctttctctttacagaagagaaaaggtggtggaaaaataatgggaaaaagggttcaagaattttag

SEQ ID NO: 21703 - DNA, 1263 bp, Glycine max
  Peptide Sequence Number=SeqID_138481
atgacaaccagagtcaaagctggtgtctttaaaccgaaaacttatgcttcttacaaggaaggaagctatgatcacactgttgagccacatattgtaaaggaagcaatggccaagcctgaatggctcaaagctatgaaagaggaacatgatgcacttatccgaaatgatacatggtccttagtggatccacctcctggttgtaagcctataggctgcaaatgggtgtttaaaagcaattttaatgttgacggaagttttcaaaggcacaaggccaggctggtagcaaaagggtatcatcaaagagagggctttgattttaaagaaacctttagtccaatgattaagccaacaactattagaactattctgtcacttgtggtttttctggcctattcatcaagtggatatcaacaatacctttttgcatggagaccttcaagaaattgtatatatgactcaaccaccaggctttgtttcatccaacaaacacagagtatgcaaattgctcaaagctctttatggcttgaaacaggcccccaagtcttggtttcacaaactcaatttgactttgaggttaagcattattctgatggtggtattctattgtctcaatcaaaatgcataagagatctacttcataaaaccaatctgttagactctaaatctcagccaactcccatggtttttggtttaaagcttactgttgatggttctttttcacttcaggatcctactcactatcgaagcattgtcagagctcttcaatacatcactgtgacaaggcctgaaatttcattctctgttaataagaccttgatgatagaaagtctaccacaggttactgtatgtatcttggaccaaatcttgtatcatggtcttctaggaagcaagttgttgtttctcgaagtagcactaaggctgagtatagaggacttgctgctgtcgctacagatattttatggctgtagaatttgctcagagagttgtgttccagttgcattgccaagaatttattgtgataatttaggtgttgtccaccttgctacgaatcctgtcatgcattctcgcacaaagcagtttgagtcggatttgcattttgttcacaataaagtcttgtcgcacgagcttgttgttgttcatctgcctgctgaatttcaggttgctaatattctcactaaagctgtttcaaatcctcaatttacaatatttagatccaaactcaaggtttcatcggcttccaccatgagtttgaagggggtgtaa

SEQ ID NO: 21704 - DNA, 489 bp, Glycine max
  Peptide Sequence Number=SeqID_138482
atggcagattttcgtcctccgtattcgatatcaaatcttcctccagatgcaataccagaacttgcatgttacaattcaacagtggatctttccgacaatatctggaagcgtggtaatgtcattggagaagctgttcctcttttgtctattcaaattgcctacattgtcctgctttctagtatttttcatcgcatcttcaagccatttcacctgcctcttatggtttcccagatacttaatgacatcgttctaagatcaagcaagaaggctataaccattgctcttgtttgcattctcattccaatgttggcgggtgctagttttcttgctctagagcatagagtatcaggaggttcaccaaaccctactgtttccactaagggtatttcttttgttgtgcaattcttgctgtcacggggtttccagtccttgctaggctcctatcagggctcaagatcctctacagaaggcttggcaaagatgccttaa

SEQ ID NO: 21705 - DNA, 1350 bp, Glycine max
  Peptide Sequence Number=SeqID_138483
atgtctaacgttttagcatgttaccaactcctagaactcaatgtcatatccgcacaagacttagctccggtgggtcgttccatgcggacttatgcaattgcatggattgacccagatcgcaaactctccacccgggttgattctcagggtggaaccaacccaacatggaatgacaagtttgtctttcgagttgatgaagattttttatacgatgaggagtcagtaattacaattgacatctatgctcttcattggtttcgagacatccatgtgggcagcgctcaggtgctctcgggtgaccttttcccaccaccaacacaaccccaaaaaaatacctacaaatccacaggtatgcaatttatggggctccaagtccaaaggccctcgggtcgccccaaagggattttgaacatcggggcggctataattgacagctccatgcggagcatgcctctctacacacagaactccccagccgttggatacagtcatgacgatctcaataagccaagccatcaagccaagtcagagcttcggcgcacaaagagtgactccagctcaatgctcggctcggaagccatagctcctgagcaccaagccaaggctagaaagggaaaagcaagctcccaaattaccccttccgaagtaagcaccaagagtaaaaacaagaccagctccacattgagtgactcaaatgtgaaggcaaccccaaagaggggtaaattgggtagaaagaagacgaaaataacatctcatgactcacaaaacaacctcaatgcaaggctatatgttgattaccaagtaaagtccacgccaaagcgagagtttcaaaacactccctcgaggacttacaacaataacaacaataattataaaggtaacctgagagccactccattgcatgcatttgcggtgacaaacgcggcattagaatatggcaccccatatcggtcaaacttgggtcgtcgtccctttatgacggactctgaactgggtccgtcagcttcggaggttgcagcagtggtggcgagactaccgatcgaggagggagagaattctacggtgggagggtggagcttggatgatagtgtggaggggttgcaacctaaagtggagaggtggcaaacagagctgccgccggtgtatgacggcagcgagaggtcaaacatgacaacgtcaagcaagaaagggaagcattcacgtaggcaaacagatggtggaaatggcttgttctcttgctttagtgttatatgtggtgttgagtgctctattgtttgtggtggcggtgacaacaacaagaagaaccggcgccgccgggttcagtcagtggacaatgaaagctttctataa

SEQ ID NO: 21706 - DNA, 471 bp, Glycine max
  Peptide Sequence Number=SeqID_138484
atgactgataaggtttttcaagagcgtaatgattttttaaattgggatcaacgaacgggaaaggagtacgagtttgtagttttcattcataagtcagaagttattgtcagtaatagggatcttgctttcatgaatgcattgaagaccgtgtttccttcttcaccaaacttattatgtactgatagttctgcttgtgactgtgcacttagagttactcatggtttactgcgtgcttgtgagctcaatgaatttatcaacacatatggctacattcccttgaagagcattcatgtgactcttgggggggacttaagtctgacacacaaggttgatgcattgtgtaagagattttcagaactagatgtgtttggtaaaatcaccttgaagactaaattatgtgaacttgaatttctggataccacttcaatgtgttcccctgcaatgaacataaaaacaaagggtgcaccataa

SEQ ID NO: 21707 - DNA, 213 bp, Glycine max
  Peptide Sequence Number=SeqID_138485
atgtggaccaccacggctttcgaagaagttacggaaactcacggattgcgcaaaaacacctcttttcgacttccgccacattacggaatttcacggatcgcgcaagcctgcttccttttgatttccaagacgtctcgggacttcatttattgtgcaaccaaggacaccaagtacctcaaagcggctaaccaaaggttgcatgtcatcaagtaa

SEQ ID NO: 21708 - DNA, 285 bp, Glycine max
  Peptide Sequence Number=SeqID_138486
atggttgatgaacaaaggatcgtgatcaaaaaccagactttggggcatttcatggagctttccgacaatatccataaagagaacgacgacagtgtgggaagtatgaatggtgatgtgtccatgaaaggtcggcaaactgacgatgaagtcgagggaaagatcttcctatggccagaaaggaatcgacaagggacagagcaacccaacgacctttctagtcttatactttgtatgttgacaatccatgcatatgactgccaatgggtgatgagtggtactccatga

SEQ ID NO: 21709 - DNA, 180 bp, Glycine max
  Peptide Sequence Number=SeqID_138487
atggttcaagttggtgaccggctcaaacaagtatgcaagtaccgcaggtggccagaatggctagcggcacagcgtgccccgcagtgtggtgtcaggtctccttatgtggtgactcgtggtccacaggtgtaccccttgaatctccccaacactattcccttaaatatttacccacgctaa

SEQ ID NO: 21710 - DNA, 567 bp, Glycine max
  Peptide Sequence Number=SeqID_138488
atgagttccgtgtatcacccacaaactgacaggcaaatcaaagtgctcaatcgggtcattgaacaatgccttcgtgcttttgttcacaagaagccatcatcatgggggaaggcttctccatatgagatcactttcggcaaaaagcctttcaattttccccaataccttgctggcaccactaacttggatggagtggatgacctcctgactaatagggagtctgttttcactaaattcaaaaagaagctcttgaaggcccaagcaattatgaagcaaatcacagatactaagtacaaggatgtcaacttcaatgaaggcgatcgggtaatggttaaactgctccctcactgccaatccattgtttctagaaatcatgcttcttattctaagttagctaaaagatattatgggccataccagattctagaatgcattggtaaagctgcacatatacttaacctacctgaggtggttgtattcaccatgtatttcattgttccctactcaagccatttcatcattccacctggaacaccatccctcctctgccattaccagccactttga

SEQ ID NO: 21711 - DNA, 339 bp, Glycine max
  Peptide Sequence Number=SeqID_138489
atgaccgatggcaatcatattttggactttatggaaagagagcatggtcagagccctaactttgatatcttaaactggtggaagctgatttcaactaaatttccaatcctaggaaacattgcgagagaggtgttggctatgtctacctctactgtgccatttgaatctaccttgggtactagaggatgggtgcttgaccagtatctcaattacttatcacctaaaatagtggaagcacttgtgtgcttagaagattggttgaaaggatcacctacaacatttccatcaaaagaggatcttgaagagattgaaaaaattgagcaaggtgatataaaatga

SEQ ID NO: 21712 - DNA, 696 bp, Glycine max
  Peptide Sequence Number=SeqID_138490
atgtcgttccccttcaaccactctcaccgcagggacgacgacgacgacgacgacgacaaacgacccgccgtttaccctcctccgggtaacaccttcaacaaccctccaccacccttctacggcgtccatcagccagaaacccacgtgtcccatgtcttcaacaacagcaactactccgctcccccgcctccaccaccttcccataaccaccaccatgactccttcactcacggaggcggcagcaccgtgcaccacacccctcacaacaacgcgccacccaccacctctgttcatcacttgagccaccaggttaacaccggtgttctctcgagcaaacccactgtgagagttttcaccaaagccaatcccaatttctctctcaccattcgtggcggccaagtcattctcgctccctccgatcccaccaatgagtaccagcattggtataaggatgagaagtacagcactagggtgaaggatgaagaggggtgccctgctttctctttgatcaacaaggccactggtgaagccttgaagcactccatcggtgccactcatcctggaatctgtgttttgaattggtatgtgatgtctgttacagcaattggatgccaatctgtaatcttgatgttctgttacaaacatgatggctttgttagcttttctgtttcaaataatgtcgagaaaaatggctaa

SEQ ID NO: 21713 - DNA, 666 bp, Glycine max
  Peptide Sequence Number=SeqID_138491
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttgctaagtctgtgcctcggtggtggatcatcatgtcatacatggcagacacaaggtcacacgcacacacacacacacacactcacgcaggcacaagggggaggagggcttggtcggtttgttggtgatttggaggggagggacgaatcaaagcgacaagggctgaatctcagtggatcgtggcagcaaggccactctgccacttacaataccccgtcgcggctaatccgcctcacgagggtcaccaacggcacgtgcctttggggggccgaggccccctactgctggtcggcaaacggacggcggggcgcacgcgtcgcttctagcccggattctgacttagaggcgttcagtcataatccaacgcacggtatcttcgcgccactggcttttcaaccaagcgcgatgaccaattgtgcgaatcaacggttcctctcgtactag

SEQ ID NO: 21714 - DNA, 279 bp, Glycine max
  Peptide Sequence Number=SeqID_138492
atgtgggcttatatccatttttttctgcagaatacttaccaacaatatttggctgcaaaggagttaaagaagcagtcttggagataccaccgaaagtataacacatggtttcagcggcatgaagagcccaaagttgcaaccgatgaatatgagcagggaacttatgtgtactttgatttccatattgcaaatgatgacatgcaacatggatggtgtcaaagaatcaagactgaattcacttttgagtataattatcttgaagatgatcttcttgtatag

SEQ ID NO: 21715 - DNA, 466 bp, Glycine max
  Peptide Sequence Number=SeqID_138493
atggagaaaaactgggttttgagatggatttttgtggtggggttgatgtgtttgagtgtggaagggattggtgtgaattggggaactcaagcaacccacaagttgccaccagacacagtggttcagatgttgaaggataatgggattaagaaagtgaagctttttgattcagatgactccaccatgagtgctttggctgggactgggattgaagtcatggtggctatccctaataatcagcttgctgagatgaatgactatggcagggccaaacaatgggtcaagaaaaatgtcacacgttacaacttcaatggaggagttaatgtcaaggaagctctatggattgggcgattccctagaattagatccttttttttggtagtgatgcctgataagtcctttgtaactttgtatgtggctgaagagaaggatatttgttccaagaataattttgccgttttaggag

SEQ ID NO: 21716 - DNA, 846 bp, Glycine max
  Peptide Sequence Number=SeqID_138494
atgggatgttacaacaacgagatcttctctccagtagttagacgcacttcaacatgtgtcttattggatcttgtaacaactctggacatggagttagagcacctcgatgtcaaaacagtctttctccatggaagattggaggaagacattttgatgcaacaacttgaaggtttcaaggtgaaagggaaggaaaattttgtctatacgttgaagaggtctttctatgggctgaataaggtggtggatggttcctacatctatctgaaggaatacattcagaaagtgttgaatccttttgagagttgtagaaaactagtttgtactcctttgacagcattcattcgtctcactaaacctaatgccactcagtcaaaatcagaaagggaatacatgtctcgtaatccttatgcaagtgttgtaggtagtctcacatatgcaatgatgagcacaaaattggacctagcaaaagcagttaggtgcataggtgacatatcttgtgtccctgctggatatttagattctgactacgctgcaaattttgatgcaagaagatctgtgacaaggtatgcattcataattggcaattcacttgtcagcttgaaggctacacttcaactcatgattgtcttgtacactacaaaagcaaagtacatggttctggtagaagaaacaaaggaaggtatttggctgaaaggtcttattagtaacctcatgtttccacaagataaagctatcatttattgtgacagtctaagtgcaacttgtttagctaaagatcaagcccatcatgggagatctaaacatattgaccacttcatccatactaagaagcatattgcaatctag

SEQ ID NO: 21717 - DNA, 840 bp, Glycine max
  Peptide Sequence Number=SeqID_138495
atggcttctacaaacaattttcaacctccttctccccctccaccactgttttcttcaactctggtggctgattctattcctcaaccgattctggtttctcaaccgatgattttgactccggtcgctgcggcatccttgtctttacaatcccatccttctaccttattctcacatgcgatctatgcaaaattgaccaataggaactactggttgtggtgtcagcaagtagaaccagtgttgaaaggagtaacaatctctttggatgaacatcttgatgttgttcttgagggcctaccaagggagtatgtgtctacaatgtctttgatttgcagagcttcaacctctaataactctgcatatgttcaacctattcaagtggttcaaaattttcaaagttcctctaatggcagttctactactcagaactttgatgctcaagccaatattactcaagggaattataataattccaataacactaataatggtaacatattttttaacttcgaccaagttggttgtggctatggtggtcgaaatggaggaagaagtaatgttggtagaggtgatggtcgtggtcgtggaagtgattctcaacctattcccacccctctcactattttacccactattcctatttttgttggtgcacaatcctcccaactatccactgcatctatacaacaccaacactcttcctatcatcctacaccagaacctagtatttcccctccaaccacttttgcttttgcttctgtttccgaacctaaacctatccttgaacctgttaatccctctcccattattaccttttctcgcctttcacctgaagttacttaa

SEQ ID NO: 21718 - DNA, 813 bp, Glycine max
  Peptide Sequence Number=SeqID_138496
atggagagttccatggcataccagggacttcctattactattggtaggtccaaaactcaagttttccaatctgttcgagaaaagagctctgctggccaacaattaatactggagatcggcaacatgcaacaactcactcatgaccagagttttaaaagcaaaacattttctccattcgagagctatggaggcagatcgtggaccttggccgagttttacatgggcaagtattcatttagtctaggatatcctagaggaagaacatgggatgaacaaaagattcggaggttgttcccacaaaatattgctgctaatattctggatattcctcttaggatcaactcatctgtggaccaactcacctggaaacacacaaatgatggcttctacccggtgaaatctggttataatcaggttttccaaaaaaattacaggtgcaaagcttcttctatttctaacactggaacactctggcagaaaaaatatggaaggttcaagtggaaccaaaatgccaaagccttatttggagaatatgcaaaaatagtgtttgtgaggggaaaccttcaaacaaagatggacatagatcatgtgtgcccttgttgtggagaggaatatgagtctttggaatatgcactcttgttacgtaaggaagtacaaccaatctggtttgctagcccagtgagtggaagaatgagaaatgcccaccaaagctcctctaatcagtggcttgtggattgtttgcagctgcaagatgaagagttcatgaagcaaatttttggtattatttggtctatcttgttaagaaatgaatga

SEQ ID NO: 21719 - DNA, 225 bp, Glycine max
  Peptide Sequence Number=SeqID_138497
atgcaaaccctgctttcatcacacttgcagccagctgtgcctatgttagcccatgatatgcctccaatcttttttcctgatgtagttcttcacaccagcttgtttcctactggaaaaataaccttacttgagccagcaactttggaggaatggcgaaagaggaagatggagagggccagacaaagagaattggagaaaaatggaacaacttcttctcaagcttga

SEQ ID NO: 21720 - DNA, 454 bp, Glycine max
  Peptide Sequence Number=SeqID_138498
gtataggcttgaggtgatgatcaaccacggagatgaaagcacaaaattcctgctttgggaccgtgaatgtagtgaattaattggtcaatcagctaatgcagttaataagcttaaaattgaagatggtgatgttgatttaactgcttcaccccaagcacttgataagctgctgggttatgaacttgcttttaagataaaggtgcaacccaagttcaggaattctgctgttttgaaatgttcaactgactcaagcttaataaatgttgtgatggatatgctagctgatgctgagcaatctatgtctgtgacagcagaccatgatcaactgcttgggctcccattgacacctacaaagcggcagacatttcaagattgtgatgatgaagcagggagctctcaaatttcacctgcacaactttcatccaacaaattaaaaaaacatggcacaatttag

SEQ ID NO: 21721 - DNA, 339 bp, Glycine max
  Peptide Sequence Number=SeqID_138499
atgggttcgaccaagtatgagggtctggtgaaggatcttgaaggagaggtcaagcttgagaaattgatgtttgagaaagataagaaagcaatgctagaaaagcctcataatgcaattatcttgagtcttggtgataaggttctcatacaagtcttcaaagagaagactattgtaggagtatgggcaaagtttgataggttgtacatgaccaaatccctaatgatgaggatcaagctttgttatttactaaaaacacatgtacacttcaaagaaactttgttgtttggtagagagtctttaacccttgatgatgttcagccttctttgaattctaaataa

SEQ ID NO: 21722 - DNA, 375 bp, Glycine max
  Peptide Sequence Number=SeqID_138500
atgttaagacagttaatcccccctcacaggatgacagtcaggctcagggataacagtaactgcgacattctaataactgtttgggaggactatgctattcagctacatgatgctattgacaaaaaccttctgcttcaggaaccattggttgttatgttgaccctaggtaaaatcaaggatgctacagacaagtatcccctaagcgtgcagaatatcaaatttggatctaaattgtatgtcaacgctgatattacagagatacacgaatttcgtcaaagtttgtctgccccattttattttggtgggataatcaatgataaagatggttctcagtcccaatctagccagagtaatgtggtggaaaattttctgtag

SEQ ID NO: 21723 - DNA, 267 bp, Glycine max
  Peptide Sequence Number=SeqID_138501
atgggactacaagagccaacatatgagttcccccaccctttggaacgtgttcctcaaagtgccagttattggctgtcctatataattgtggatctactaatatggtggggaatgcgaagaattatcaataaattcaggaaaacaacactgaagcttgctcctattgcatacttcagtatgtatcgtggatcaatatctcatttaccgactagctacatgtggagtcctcatgttgttccaaaaccaagtggtatggacaaggattaa

SEQ ID NO: 21724 - DNA, 292 bp, Glycine max
  Peptide Sequence Number=SeqID_138502
tgctttgaaaggacttgatgatactccacaacctaaatccaaggctggtgctaggtggattgttattaagtgtaatagacaaaaaggaagcactgagtgtggctattacgtcatgtactggatgtccatgataatcttaggaattttcaagaataattgggaagcgtattttaacgatgttagaccattggaagcatcgagattgaaggaaattatcaaggcttttgacacttttggcttagggaaaagtttaaccaacgaaggtttttgtaagaatgaactgaagctctag

SEQ ID NO: 21725 - DNA, 537 bp, Glycine max
  Peptide Sequence Number=SeqID_138503
atgctgcgtagaaacatccgtttgaggagagagtatttgtaccgaaagagcttagaaggcaaagaacgtttgctctacgaaaagaagcgcaaaatcagagaagctcttcaagaagggaagcccatacccactgaactcagaaacgaggaagctgctcttcgccgcgcaatcgacctcgaagatgaaaacaccgctgttccgagaacgcacattgacgatgagtatgcttatgctgcggaaaaggatcctaaaatcttgctgactacttccagggatccgagtgctcctcttcaacagtttgttaaggagttgagttttgtgtttcccaatgcacagagaatgaatcggggtggtcaggttacaaggcatgaaattaaagacaagaaagccattggaacaatgcctgaggcttatccacatctgattctcaataatttctcaactaaggtctttgaaataagaaattgtataactgagattctgataggaatagacctattaggagggtttatgggaggaggtgcaaggcagctgtag

SEQ ID NO: 21726 - DNA, 237 bp, Glycine max
  Peptide Sequence Number=SeqID_138504
atgtttgtttgtgtgtgttgcaaggagttggtttgtggaactcgtggtcgctgcaaggatttggttcgtggaagtcgtgtgaatggtgacactgccttcttgattataaagttagtgatgcaatcctaccccgcaaggccattggatagaaaactcgaagtagattgggccagagatacaagagaaggccctaggattcttatgagccttacggtagatttcgggcccatgggctaa

SEQ ID NO: 21727 - DNA, 381 bp, Glycine max
  Peptide Sequence Number=SeqID_138505
atggtgatcttgccttttaagtattgttcttcgcatgagaatttgaccattgatcatgttatgcccactgcactaggtggagaatggacatgggaaaatctaaattggagaattagaaatgtaattggcataggctttgaatcacaaggactactatctttcaaccttcattatctaccacaggtgactgcttgtgccaaatgcaactgcaaaaagggtagaaaaactttagaggaagcaaaaatgaagttgattaagcccccaaaggtcccaaaggactatgacattctcgccatacctctaactgccgcagctctaagaatgctgacattaagaaagggaacacctgaagaatggcgtcagtatctaaggtctccttga

SEQ ID NO: 21728 - DNA, 348 bp, Glycine max
  Peptide Sequence Number=SeqID_138506
atggttcctcaattacttcaggttgttaaaagaagaatagtcaagaacaatcttagccgaaaaaatatactatttcgggacaattacacctgtcacacaataaacagaaactccttttttcctagcccatccaaatccagggttaaggaggagggttgtgttaggccctgggcagccaacataaaactcaatatatcgaacacgttagtaggccagatgaattgggagaggattcagggaaatgaatttagacagaacccaacaagggcttgctcaattatgaaaagggaaactaatggaggagagatctttctccttgttctgttcgctttcactcaagcaatataa

SEQ ID NO: 21729 - DNA, 387 bp, Glycine max
  Peptide Sequence Number=SeqID_138507
atgccactaggtcaaaatctagtgttcagtaatctcaaggtgtttgtttatccttgccaacagtcagagcaaaggttcaatcccaaagtggttaagtcgacgcaagaagctgcagatgctggatctgtcatggaatcatctcagtgtgtccccatatcttatattttagatattagtcgtgtcaaaatgtccgtatttgtgtcatgttcgatgtttgtgcttcatagacttttccatctacaagctttgaagggaacaggggtctctactaccattatggcacttcagcatgatcaccagaagttggagatcattggttttccatttggatttgatgctgttgctggttttcttataaccatcgccatttgtttcacttctggatga

SEQ ID NO: 21730 - DNA, 987 bp, Glycine max
  Peptide Sequence Number=SeqID_138508
atggcttctagttcagaatctcaatctcagtctaaaccgctccaagaccgagttgcaatcgtcaccggctcgtcccgcggaatcggccgagaaatcgcgcttcacctcgcctcactcggcgcgcgactcgtcgtcaactacacctccaactcggcccaagccgactcagtcgcggcgcagatcaacgccggttccgccaccacgacaccgcgcgccgtcgtggtccaagccgacgtgtccgatccggctcaggtgaagtcgctcttcgactcggccgagcgcgccttcgactcgccgatccacatccttgtcaactcggcgggcgtgatcgacggcacgtatccctccgtcgccgacaccaccgtggagtccttcgaccgcactttcgcggtgaacgcgcgtggcgccttcgcgtgcgccagggaggccgcgaaccgcctcaagcgcggcggcggagggcggatcattctactgacgacatcgcaggtggtggcgctgaggccggggtacggggcgtacgcggcgtcgaaggcggcggtggaggcaatggtgaagatcctggcgaaggaactgaaagggacgcagataacggcgaattgcgttgcgccgggaccgattgcgacggagatgttcttcgagggtaagacggaggaggtggtgaatcggatcgtgcaagagagtcccttggggaggctcggtgagaccaaagacgtggcacccgttgtgggattcttggccactgatgcttctgaatgggtcaacggtcaaattgttcgtgtcaacgagagggccagcaaaccgtggtggtggaattatcatattattgtccacatcattgatggttgctttgaggccaagactcatacaccggtaaaagagcaaggaacaaaaattactgctaagtgtgttgctcctacaggtccaattgcaactgacatgtactttgatgagcaagtgaaaggcaattgcagagtctgcactaggtag

SEQ ID NO: 21731 - DNA, 119 bp, Glycine max
  Peptide Sequence Number=SeqID_138509
atgtctgaggtgtttgtaatgagatcaatgagacttaccttctcttctggtgttatatgtcttataatggtcgtagctatcaagttggtaaatcccgagcaatcacccactacgaacat

SEQ ID NO: 21732 - DNA, 273 bp, Glycine max
  Peptide Sequence Number=SeqID_138510
gttcggctgataccttacaagcccgactatcttgatgagtctattctatggactgaaagccgtgacttaggagatggccacagagctataaggatggtcaacaatgttcatcttaatgtggatgcttttcacggtgacaagaattctggaggtgttcgtgatggcactacaatagtcctctgggactggaacaaaggtgataaccagcagtggaagatcttaccttactgtaagttttcttctatccttcttcctttttgtggttccttctaa

SEQ ID NO: 21733 - DNA, 774 bp, Glycine max
  Peptide Sequence Number=SeqID_138511
atgggaggttccttcaaaaactacgacaaccagagtcatgaggttagtgaagaagaatctgagaattacccttatcaccaccatgcaccacttgttatgcatgtaaatgtgaacaacaattctcattccaacattgcaactactacttctgctctttctaacaaacgttccactgtgagaattctgtgcaaagcagcaccaaatttttctctttccattcgggacggcaaggtcattcttgcacctgcggatccaagcgacgcgtaccagcattggtataaggacgagaggtacagctctatggtgaaggatgaagaggggtaccgtgctttttgtctagtgaacaaagcaaccaatgaggtcatgaagcattccattgctgactctcacccagttcggttggtgccatacaatccagagtatttggatgagtctattatgtggactgaggccagtgacctgggtaatggctacagagccattaggatggcaaataatattcatttgaatatggatgctttaaaaggtataaaagaacttggaggggtccaagacggcacaattgttgcgctgtggaaatggaatgatggcgacaaccagaaatggaaggttgtaccatatggtgatgaggactctgctattgatgctgaccacagtctaatgcggaggctggatcgcttggagttgaacatgcaggcgatgttcgatgctcagcaaaagtaccttgagggcttgtctaaacgttttggtaatgaaaaattatctggttattaa

SEQ ID NO: 21734 - DNA, 1467 bp, Glycine max
  Peptide Sequence Number=SeqID_138512
atgagaaccatagtaaagactttggcttcaagtgcagggtccttccctctccaacaggcttgctcaaaggtggttcctgcagttgcaagatatggaattgacccctcaaccccagaagacaaaaggaggcacataatttggtccctttgcacgcctctttccaattctctctcgagttctcaggagagccttacttcgggtgctgccctttgcttgaaggctctggtggattctgataattggaggtttgcttcagatgaattggtcaatcgggtttgccagaatgttgctgcggcattagatggaaagtctggtcaaaccaactcccatcttggtctggttatgtcgttggccaggcgcaatgcgttgatcattgaagcgtatgcaaggttgctcatacaatctggaataagaatactgaatgctggccttgtggaggggaattctcagaaaaggctttcatcaattcagatgatcaactacttgatgagaagtttggactccagaagcatattctcagagattgaattgataattgaggagatggacaagtgccaatctgataaaatggcatttgtgcaaggtgcagcacttgaggctttgcaaactgccaagagaattgcaagtgataaaaagccaagatatgcaaaaagtccggcttcagtgacaggatcaaattttagtaggagagaggaagactatatggagggagagaatacttcttctggtgatggagaacatactccttcttctcttacacctgaatcgcggacatttgactttttccctggatatgaatatgttgattctcctatttcaagcaactttggacgaagaagtgtgactaggaagctttggagaaaagaaagtgctttgttagagcattcattgattccagagttttctgatggagagggagactatacagaggagtttgctggtttcatgggcagaaataccagccatggagtgtccaaaagtaccaccacaagtccactaaggtcacgcactcaggcaactgttgacagcataaaaatctttgagacccctaggaagctcatccactctcttcaagattcaagtgatctgtctttgggttgctctaagaaggagcagaatggaaggtataggagtctatcctcagacgacaacatggagtggagtccatcttgtaagtataaccaaaacggtttctcagatgacatgaacaagtgtgatagcgaagtaatcgaaggttgtgctgaggttgagtttcaaggtggctcagagtcagtctcatcaacaaatgacaacaacattcttgtagatgtcgaaaagcagatgcataccaaagtggttcctgaaaatagaaatgccaagactaaatacaaattggtttgtggtctttcatgcgttctacttgcagtggctactccattgctttggatcaataatcaagatgaaggccattatcttgtcccaacataa

SEQ ID NO: 21735 - DNA, 2004 bp, Glycine max
  Peptide Sequence Number=SeqID_138513
atgccagagttgagaagtggagctagaaggtcgaaacggcttggagatcttcagcctggtccactgcctgttgatcaaggagagaattggcaacaacctgctgctccgaatcgaactaggaggagagttggaggtggtagaggaagaggtggtaatgccacagctgtaggcaaagggccatcaccagctgtacccacaaggcgaactgcagctggtagaggccgcggagcaagattgattgatctggaccctgaaccttgcgaagtcttgccagaacctgttgctttaggggctccggaaccagtttacaataacgtagaggtagtggccaataataatattgtgatggagggtggaagtggagataaggtggcgggagctgaagaagaaccaagcacaactcctgtccctgagaggggtggttttggtcaagtttatgttggccggaggttaagtggtggctctgatcgaacaggtcctgatgcggttgaggttgcacttaagtttgagcacagaaacagcaaaggttgcaactatgggcctccttatgagtggcaagtatacagaatgtcaccaaatatggttgcgtgcattgcagtagaggcaatatcaattcttgagaagctccacttgaaagggtttgtgcatggagatgtgaaacctgaaaactttttgcttggtcaacctggatcagctgaagataagaagttatatcttattgatcttggtctggcttctagatggaaggatgcatcatctggtctacatgttgattatgatcagagacctgatatattcaggggaacaataaggtatgctagtgtacatgcacatttaggtaggactggaagtcgaagggatgaccttgagtcactggcatacacactagtatttctcataaaagggagattaccttggcagggttatcagggtgacaataaaagttttcttgtttgtaagaagaaaatggccacttccccggagttgatgtgctgctttgttcctgctccatttaagcagtttcttgaagctgttactaatatgagatttgatgaggagcccaattatgccaagcttatatcactttttgaaagcttgattgaaccatgcactccgttgagacctattagaatagatggagctttaaaggttgctatggttggccaaaagcgaggaaggatgcttataaatctggaagaagatgagcaacctaagaagaaagtgcgattggggagtcctgctactcagtggatatcagtgtataatgctcgccgtcccatgaagcagagcttgttaaacagttcaattgatattaaaaacatgagaatggagggtgatgttcacacttcatacactaggctacggcagcatgtagacaagggtattgaggatgggttgtatataagctgtgtggcctctgcagcaaatctgtgggctctaatcatggatgcaggaacaggtttttcttcacaagtttatgagttatccccggccttcctgcacaaggactggattatggagcagtgggagaaaaattactatatcagttcaatagctggcgcagttaatggaagttccttggttgtcatgtccaaaggaactccttacacgcagcagtcctacaaagtgagtgaatcatttcctttcaaatggataaacaagaagtggaaagaaggattccatgttacctcaatgactactgctggcagtcgctggggtgttgttatgtccaggaatgctgggtattctgatcaggttgtggagcttgactttttgtatcccagtgaaggaatccatcgtcgatgggagaatggttaccggattacttctatggctgctactagtgatcaggcagccttcatactgagcataccaaaacgcaaattacttgatgaaactcaggagacactgcgtacatctgctttccctagcacccatgttaaggaaaaatgggccaagaatctctacattgcctctatatgttatgggcgaactgtttgctag

SEQ ID NO: 21736 - DNA, 255 bp, Glycine max
  Peptide Sequence Number=SeqID_138514
atggatgctccaagcaacctgttaatcttcgtggagcttcctcatcgtccccgaaaccggcgtctcatgcaatctctaccgtccaatttcacccccaaaaactcgtggtcacggtgctggttctggcatgggcagtggtcatatgttgcaactatgaggtggggggcgaggaaggggaaaccgtataaggtgcataatgagaagtcgtggtatgaggtagggagccataggttgtatataagatcaatgcagtaa

SEQ ID NO: 21737 - DNA, 117 bp, Glycine max
  Peptide Sequence Number=SeqID_138515
gggggtctgtttttgaaggggactcgccagtggggttggcgagttggacacgtggcagcgcctgggggactcgccagtggggttggcgagttgctgcctttcgtgagaactacgtag

SEQ ID NO: 21738 - DNA, 645 bp, Glycine max
  Peptide Sequence Number=SeqID_138516
atggctgaaaatatgaaagcaaaatttgacaaatatttggacatcgatggcgggaatataaattatcctgtggttgtggctgtttttcttgacccgcgatacaagtggaattatatcgagttctattttaattcgatgtatacaaaagaaaggactgtagattacgtggaatggcatcctgttcctattgatactcatgatgttagtagttcagagaaaaaagttactcaaagtttgaggggtggaggtggaagggctaatatcatggatgagtataaactttgggtaaggaagttacaaggtaagctccaaaagaatgagttggagaggtatatggaagataggcccaagtttgattatcctgggtttgatattcttaattggtggagaataatgactacaaggtatcatgctttttctcgtgtggctagggatatattagccattccagtgtctacagtatcatttgattctgtatctagcacaggaggttgtgttcttgacccataccatagtttattgagtcctaacactgcagaggctttgatttgtccacaaaattggttgaatccttttactaatgatagtggtcttgatccacaactagtaaatgtgacacctctaccccatacatatatgtattaa

SEQ ID NO: 21739 - DNA, 969 bp, Glycine max
  Peptide Sequence Number=SeqID_138517
atggcttgggaatggaattccttgaaggaaattaacaataaaaaggttgtcacacgtgatttttgtggcaagacctcaactggtggaataactagagctgagagacaacaaatccttggcagtcggatggggaaatggggtaaagatggagaagtggttgaagatgaaccagtctttggtgatgatagcttgacttggggaattgtaggtgatgcaattggggttggtgatccagctagactcactagacagcatactagactcactacagttgcacctattgaagaggaaaaggaggaagaacatatctttaatgatggggaacaagagatgaggaagaaattggaagtggagatagtgattctatttaaggaatcactttatcatcctgatgttagcaaggatccacaggctgctgaattattcaagagcatccatgatgcatataaagtactatctaatgaagcagcaagagttcagtatgaccaagaacttcaattcggtcacaagccttacagagaaaaatggagttacggccctgaatttgaagatcaggctagattctatagtgaaacagatgaggaagaagacgaagtagtagatttagatgaagagaggggttctttagttgaagtgcttagatcagcattcgtgtcattatttttgcttcagacacctggatcccgcttctcactcacattcagcagtctgacagcattgtttgataagaagttagacaccggctataaaatgggctatataataacatggattttgggtgggaggggtggcatattgctaacactgtgcttgttagttgcaagttgggtttgcgggaaaaccgttgttgcatttgttgtggtggccatatgggttggctcctacctcgcaaggtatgcaccacttccccaaggtgctttattggctcttctctacatgtccattaagctacaatctgacctaatataa

SEQ ID NO: 21740 - DNA, 308 bp, Glycine max
  Peptide Sequence Number=SeqID_138518
atggctacctcgaatccttctccttctgcgcctcaatcttttcccaacttaatcgctgaaaaacttgatgactctaattatctacattggaaacaacaaattgaacctgtcatcaaatcacataaacttcagcgatttgtcgttaacccttcaattcctcaacgatatctcactgatgaagatcgcattgcgaacaaagtgaatcccgcgtatgaggcttgggaagtccaagaccaaacactcctcacatggcttcaatcaacattgtcgaagtcgattctctctcgagtcattggctcgattcactc

SEQ ID NO: 21741 - DNA, 657 bp, Glycine max
  Peptide Sequence Number=SeqID_138519
atggcaactctgagcaattcaactaatatcttttggcaagattgtcaagtaggaaggcttgaaaggcagaagctacttaaccaaaagggatgtgttgtatggattactggactcagcggatcaggaaaaagcacattggcatgttccctaagcagagaactgcactcaaagggaaagttatcttatgtccttgatggagataaccttcgacatggactaaacaaggatcttggtttcaaagccgaagatcgcgctgaaaatattcgcagaactggtggtgtttgcaaaaggaagtataggcaaattgttcatacaaagtgggagcatattaccatgccacgtccaaaactgatatttgttttcatgaacatgcctctagaattgtgtgaggcacgagatccaaaaggcctctataagcttgctcgtgcggggaaaatcaaaggttttaccggcattgatgatccttatgaaccacccataaactgtgaggtatgtgttcatggagctactaaagttgtttacacgtttcttttgccgtgtatggtgtgttacgtacatattgaaataaagcaggaaaatggggattgtccaacacccactttgatggctggacaagtagttacttacttggagaataaaggatttcttgaatcctag

SEQ ID NO: 21742 - DNA, 456 bp, Glycine max
  Peptide Sequence Number=SeqID_138520
atgcaaacgaaacagcgtcaaatcaaatgtataacaagaataaagaatggtacatacagagagaggggggatatgaatgggaattggaatttcaatcggagtgtggatgacgataggcaagaagaggaggcgcaaaacgacgtcgctgctcaacctctcgggattgcaagcaatgaattggcaaagatgcgccgatgcgtgcgccactctcggcaccacgttgctgttcagcaccatccttgccttgttcttgatctattctactgcgctacttggtcgttttcttctccctttaccctgtccttgatccttgatccgtattcacatcaaagtcaaactctattttcagactcgcctctgtttattggaactgatgctcttctaggttgcttagttattgtactatttggatttggactatgccattttacctttttattgtttaaatttatataa

SEQ ID NO: 21743 - DNA, 414 bp, Glycine max
  Peptide Sequence Number=SeqID_138521
gtacctgaaaatgaaagagaagccgttcgagctgcatatttggcgaggcatcccaatgcattttgggttgactttggagacttccgattcttgcgcattgaaccaaaagttgtacgatttgtgtcaggtgttgccacggctttgttaggatcaggagagtttagtggagatgagtataaatctgcaaaagttgaccccatagctcagttttccaagccagtggcgtctcatatgaacaaagatcatgctgaagataacaaagtgattgtgcagcattggacctcagttccagctggttaccagggtgatactttcaagcttcgtgtacctttccctcgacgtgctgaagatagaaaggatgtgaagactctcattgttgagatgcttcaagctgctaggcctaaagttgattga

SEQ ID NO: 21744 - DNA, 1224 bp, Glycine max
  Peptide Sequence Number=SeqID_138522
atggaagagcctattgtggtgaacaaaggtgaggagcctttagatttgcctccaggtttcaggttccaccctaccgatgaagagataatcacttattatctcactgagaaggtgaagaatagcattttcagtgcaattgctattggagaggctgatttgaacaagtgtgaaccttgggatttaccaaagaaagccaagataggggagaaagagtggtacttcttctgtcaaaaggataggaagtacccaactgggatgagaaccaatagagcaacagaatctgggtactggaaggccacaggaaaagataaggagatttacaaagggaaagggaaccttgtggggatgaagaagaccctcgtgttctataaagggagagctccaaagggtgagaagagcaattgggtcatgcatgaattcagattggaaggcaaatttgctagttacaatcttcctaaggcagcaaaggatgaatgggttgtctcaagggtttttcacaagaacacagatgtcaaaaagtcctcaattcctggccttttgaggataaactctattggggatgatcttcttgattattcttcactcccatctctcatggatcctccttatggcaacaacaccaacaccaccaacaacaacaacaacaatgctaacccactttcatcaactaaattatcacaatcagagggctattatcttcccagtttctccatcaacaacaaccaccaccagcttctcatcaagccagaagaccaccacaaccacagaatctatgaatttcccacaattaacttcacctccaaccaaaccaatctcagcagcaacaacgttaacccaatggggaacaacaacacactctcatcacagcccttaaacatgttctcagctgattactatgtacaccaaaacaggatcaaaagctccatcatgccaagtgttgcaggctcaggttttgttagcgacaacaataaccatgatgaagctatcctaagagcatttgcagccaagaacaacgagcacatacagtgcaagatggagcaattttcttctaaccactcacaagacacgggcttgagcaacgacagaaacacaactgacacatcctcggtggtttcgatgggaagaaataataataatagggcactgtacgaggatcttgaaggcccttcttcagttgcacctctctcagatttggaatgcctgcagtgggatgatgactactga

SEQ ID NO: 21745 - DNA, 564 bp, Glycine max
  Peptide Sequence Number=SeqID_138523
atgatgcgtgttaggcctcccgatgttgcacctacaccatctccacctccaactgaagctagaccatcttcatctcatgttaatgcacatggaccatctctggtatctgcatccacaccatctccatcctccgttgatgcacgtggaccatccctagtacctacatccacaccttccccatctccgtctgtggacaatttgcctatagatgaagatgatgtaaatttggcaatagaagacccccctcttaataatcgtcctatggttatgttaattaatggagcgtttcatccatctaaggttgcggcaaaggctgtcactttatccattaggcaacaatttggtcagccttggcctacatgggaagcgattccaaaagaatatcaagaactttttttccagcgttttaagatgaggtctttcaacaaactcatttacaaaaggatactagtcaatttatcgatgatagatctagacggacacatgaagaatttgaggctagactatctcaagctaggtttgatgctgcatcaagtgttggtgaatcccaactcactcccttaa

SEQ ID NO: 21746 - DNA, 709 bp, Glycine max
  Peptide Sequence Number=SeqID_138524
atgagccaatattctggaattcagagccatattgtttcaggtttaagtcacatgctcaatcaacacaattctcatgctaaaagttttagaatggccagggatagattggcaggtgatcaagccaataatatcaaattgcaactgatagctgctcgaggaaaagatgggcgtgtatataatatgcctaatgttccagaaattgttgcacttattgttggcgattttcatctaggctcaaaaagagatattattgttgaaactcaaaatggagaattacaaagaatccatgaacttcatgctagctatctaccactacaataccctatactctttccttatggagaagacggatatagagctgacatacttcaccgttctacttcatccagcaaaaaaagaaagcgaaaccgtctgacaatgagagagtggttatcttatagacttcagtccaggtcaaatgaagcacagactttattccattctcgaaaattatttcaacaattcattgttgaaggttataccatggtcaaatctgaaagacttagctacatcagaaacaaccaaaagaagcttagagttgataagtattctagcttacaaagttcattggacactggaacagctaaaagcttaaccaagggaaaaagagtcatcttaccttcaacgtttgttgggagcccacgttatatgaatcaactttactttgatg

SEQ ID NO: 21747 - DNA, 324 bp, Glycine max
  Peptide Sequence Number=SeqID_138525
atgtcgatggtgctcttggctccggcacgtgagggatatctgtctttggggtctaagggacgactcggggctgcggagcatgaccatttggcagaggatctgatgcctggcctggcccccaccgcaggagaccagaatagcatgaaatcatatggaagtcccggactggttgatgctccccatatgggatccaacaaacatccggaatctggagtcggtccaggcactccctgtacaccggtgtatgtatgctcttcacggtcttcttcgtggcaatccacctacaggcacgcggtgaatcctcatcgtagtcctaatcagtag

SEQ ID NO: 21748 - DNA, 264 bp, Glycine max
  Peptide Sequence Number=SeqID_138526
atggcagtggaatggagatggaagaaagatgattggagatgccacaatagagtcttttatccaatgcccttgcggggagatctcaacattaatcacttagacaaactagaggtgatcaagaatgaatttaagaacactatggagcaagatccttttgcgattgacatggatgacattctaattgatgaacgtgtagtgttttcatcgcctcagaaaatcgattttgacaagagaggaaaaggaacagacagacatattacttga

SEQ ID NO: 21749 - DNA, 564 bp, Glycine max
  Peptide Sequence Number=SeqID_138527
atgagaggggcgccaaccgaagaaagtctctcgcctttccttgtgagggatctaggcgcgcaaggtctcaaggttatacaaagagtccacaaggcgtggaggagtccgttgaggaaagacaaggagcttagaggcatccgaaacggcgtcatcggaggttatcatggatggctaagaattcacacgcggggcttagattggctctccaaattgaaagttatcgatgaggagaacttcgaagctccggaggaagatgaagaagtccgagctctaaaattagagctagggaaggcgagactcgccaaggagaagttcaaatcagctgctacacacatccggaaggagtgcaccgagttacaagaggaaaacgcggccactgccagagcccttgaacaagaaaccaaaagggcccgcaaggaggaatatggccgagagaaattccgaggagcattgtggggtagtaacaatgaactcaagctccgaagagaggagagagatcggtcacgggtgcatggcatgatattaaaagaagagttagttgcttgcgcgagcaaagcatgctag

SEQ ID NO: 21750 - DNA, 348 bp, Glycine max
  Peptide Sequence Number=SeqID_138528
atgaagaaacaaaacaataaaaaagaaaaacccaatttgggcttcgagattaggataataccaccaaagtgtgtgaaggattttgcctccaacctcaagatctgtgtctctctgaagagacaacaaccttttgtgaaaaaattgtcctgcgaggtgaaaaccagagatgatggggtcagaacaagggatgggaaactagagagaatcagggccgttgaatggagaagggaaaggaagataagagatggatgggggttgttatcagaacggacctgcccccaatccaacgggtatgggcttggtcctgggctttggtttgggcctggtcctcttttaggactgtgctga

SEQ ID NO: 21751 - DNA, 243 bp, Glycine max
  Peptide Sequence Number=SeqID_138529
atgaatggtgctagaagtggtggaaaggtgattgttgtggatggaattcttccatttgaaccagagacaacaggtgcattgaagagcatttcccaatttgatgtattgatgatgactacaaacccaggagggaaggagcgaagtgaagaggaattcatggctttggcaaaaggagctggatacagtggcattagattcacatgctttgtctctcacttatggcttatggagttcttcaagtaa

SEQ ID NO: 21752 - DNA, 384 bp, Glycine max
  Peptide Sequence Number=SeqID_138530
atggaatctagtgagccgaatggttctgtttgttgcactatatctttgagggtttatgagttgttttatgcttttgcaattattggatttggagggctaatgagaagcaaccaaggttgtggttgtcgcattgtgccacatggtaggaaggagaagctctgcgtcgtggagagtggtgcccttttgaatggtgttgccaatgtgacaaccgtggttgaagagcatgaggtggttgattttcgacttgagtatgagaagttgggaaaggtagtgagtagaatgaagattcatggttcaaagatgcaagtgatagtggtgagtggaagcacggtggtgagtttggtgtggtgtggaggtgttgggtgtgatagtggtggtgtttga

SEQ ID NO: 21753 - DNA, 474 bp, Glycine max
  Peptide Sequence Number=SeqID_138531
atgtcgcagaggagcaatgcatcatcatctcgaacaagagtttcatcacaagttgttcttttttgtggttgtggtagaagggttgttaggcgtgttgttggaacaaatattaacagaggaaaggcgtttttcacttgttcaattaataaggatgaagttggatattgtgggtactttatttgggttgatcaattgattgaagcacttggagttgatgattcacttgggacatttttcatggaacaaagaagacaatttggaagagaggaagataagacaatgtggaaggctcaagttaactcaaagcttgattgtgtttcacgcagaccacccaattggattccaccaccacccgatgaggatgttacaccacttatggtttcgtgtcccatgccaagtagtcagcttgtgatgatgacattcatgcaaactcctagacttcccccaagcggacatggtcagaatcaaggttga

SEQ ID NO: 21754 - DNA, 1398 bp, Glycine max
  Peptide Sequence Number=SeqID_138532
atggcttgcagtcagtttgcgtttcagggcacagagtcaaagccttgtgacgcggaatcagcagtgccggtgacccttttgattaagcacttgccagaagccattcctcacgacaccctttctcgaatctttgccaatttcggcgcttcctttgttcgcccttgctctagcgccaggttgagaaattgtgcttttgcggatttcaaaaatgagattgtggcatctcaagcacaacgacaactaaatgggttgagatttcttggtaaagtcttgtcagcagagagagctagtaacccaactgagaatggtgaaaaaagtagcggagaccagctgggaaaggaccctaaaacatcaatgctgatgaatgcaaatgtaaccaaacctattgatggagatacaaaatcaggaggcctccctattcctgaacctattgctgatagacttggtgtcaattatccatttcctccacatcttgagatgctaaagggatgccagcctgccaggtatgcttaccctccgcctgatggaaatatattgaccaatattgtgaatgctctaattgctgttccccgcttttacactcaggttctacacttgatgaacaaaatgaacatcccagctccatttcgtatggcactgcccacacctccattacctccagaggtaccagcactgccaccacctccacctgcaccaactgtaactgtgaatcctcggtctgcagatctgtctagtggcgaatcggagatggaatcttcagatgaggaggttgaagcaagaacaaaaaagtctggacaaaagcgtgccaggcgtgagaccattgttggccctgctattgataagggtgtggctcatgagtctgttggagtaaaaccagccaccttggttccaaaggaaatccctgtgataaaaaagaaccatgtcttaaagataaacattgttcccaaagcaacagtgaaagaacataaagatgatgacacaacacaagagttacaagagccagaaaaagatgttccagatcctaacaaattttttactccagatgaattagagagaggaaagcttcctcctgaggaaatcttatcccttccaatgtttaagaactatacagctggaaatcctgctcctgtgttgtatattaagaatttggcaaaagatgtgattgctgatgatttctattttatatttgggtccttgtttggaagtattgaggctgctaagtctggtcttcaagtcaaactgatgcaggaaggacgaatgaggggtcaagcgtttataacgtttccctcaattgagttggctcatcatgctttaaatctagtgaatggatatgtattaaaaggcaagccaatgatcatccagtttggtcgaaatcctgctgctgctaaggcaacctaa

SEQ ID NO: 21755 - DNA, 414 bp, Glycine max
  Peptide Sequence Number=SeqID_138533
atgtcgcagaggagcaatgcatcatcatctcgaacaagagtttcatcacaagttgttcttttttgtggttgtggtagaagggctgttaggcgtgttgctggaacaaatattaacagaggaaggatgtttttcacttgttcaattaataaggatgaagttggatattgtgggtactttatttgggttgatcaattgattgaagcacttggagttgatgattcacttgggacattttccatggaacaaagaagacaatttggaagagaggaagataagacaatgtggaaagctcaagttaactcaaagcttgattgtatggggattgaaatgaagatgtttagaacaattgtctatggaatgttcttaatccaattgttgtcaatggtggtgtttgtatgtattcacaagtactag

SEQ ID NO: 21756 - DNA, 1806 bp, Glycine max
  Peptide Sequence Number=SeqID_138534
atgggtgcgagtagaaaactccagggagagatagatcgcgttctcaagaaggttcaggaaggcgttgaagtcttcgatagcatctggaacaaggtttacgacactgacaatgctaaccagaaggagaaatttgaagcggacctcaagaaggagattaagaagctccagaggtacagagaccaaattaagacttggattcagtccagtgagatcaaagacaaaaaggttagtgcctcatatgagcaggctttggtggatgcacgcaagctaattgagcgggaaatggaaagatttaagatatgtgagaaggaaactaagaccaaagcattctccaaagaaggcttgggtcaacagcctaagactgatccaaaagagaaggctaaatcagagacaagggattggttaaacaatgtggttggagagttagaatcccaaattgatagctttgaagcagagcttgaagggctttctgttaagaaaggaaagaccaggccacccagattgacacatctagagacatcaattactcggcacaaggctcatataaaaaaatgtgaattcattttgaggctactagataatgatgaattaagtcctgaggaggttaatgatgtcaaagatttcttggatgactatgttgagcgtaatcaggatgattttgatgaatttgatgacgttgatgaactatacagttcattacctttagataaggtggagactctagaagatcttgttacaattccccctggtctttctaaggtggcacctagtcttagcttgaagaatactttgacagtatcagcatcacaatcagcatctgcatcgcaaacatcttttatttttttctgcttggatgctcctgttagatatttctgtgtaaatgaggttgattttactccccctccaattgtatttggatgggtaaggctgcgtacaatatccctcccccataatccctcccccataccttcgcatagcgaagagcctccgggcaatgggataaacgttattgttaattcccaatcctggagactgatttctaatcatcaggatacttctgtccaggagcaagctgatgacacagagtcccaggatagcaattctgacattgttgccaaaactccacctcctaaaagtgggggaattagttctgctacttcaactcctgttggcaaccatgcaactcctgtttccgtgaatatttctggtcataacttgtctggtgcacctgttgcagccctacctagttcaaattctgtgcggaatgtcttagagaatactaatgttaccaattcatcatctgtaaatcagtctacctctacaaaggaagaagatattaatagcttccctagccggagaccgtctccatcactttctgatgcaacacttttgagggacagaaacagcctatcaaatcaagcaacagccagcgttcctcttggttctggaaacatggtttctagcaatgtggcccttggatcagtctcttcagcctctgaaatagctaaaaggaacataatgggagctgatgatagacttggaagtagtgggatggtgcagcctcttgtatccccgctaagtaatagattgatcttgcctcaggctgcaaaggctaatgatggaattgtttcagttgactctagtactgttaatgaagccgcagccgggagagttttctccccttctggggttcctggcatgcaatggagacctggaagtccctttcagaatcagaatgatgcatttgttcctgcaatagcataccaatatatcaggttttggattaaaattaaagctgaaatctaa

SEQ ID NO: 21757 - DNA, 810 bp, Glycine max
  Peptide Sequence Number=SeqID_138535
ggccagcttcgtggaagaactgaaatagctcctgatcaaagggaaaagtttttgcagaagtatcagcaagtgcaacaagggcatagtacccttcttaatatgccttctcttgttgggggaaaccataagcagttttctgcccagcagcaaaatccccttttgcagcagtttaactctcatggctcatctgtttcttctcaatctggtattggacttggggtccagtccacaagtcttggtggtatttcttctgcttcactacagcagccacccaatcctgtccattccccctctagtcaacagccattgatgccaggtgtttctaaagatgcgtctatgttttgtgtctcatatactagttgtgttttgctgaagaacgatgttggcaattctaagattgaagaacagcagcagcatcagaatttccctgatgattcaacaatagaatctattgctagcactgggattggcaagaatctcataaatgaagatgattcaaaatcagcatatactgtagattctcctgcagcagtgtctgcctctcttccagaatctgctcaaacttccagggatattgatttgtctcctggccaaccattacaatctaatcaactaactggcaaccttggtgtcattggaagaagaaatggtgctgagcatggagccattggtgataattttagtgggtcgaatgttagttctggtggagtgcgtgatcaattatataatttgcaaatgcttgaggcagcccacttcaaaattccactacccaaagactcggaacgtcccaggacttacactcctgtatga

SEQ ID NO: 21758 - DNA, 939 bp, Glycine max
  Peptide Sequence Number=SeqID_138536
atggggacaaatcaaaatggcaaaaggttttatcaagtcaaggttaaaggtctagatgtcactagcctcaaggaattgggacgattgatgggacctctccaaaggcaagccttccgcaaagtgtacgggaagattctagatttggccgcagcggaggtatttacggaagctgtcgtatccctcacccaatactatgaccagccgttgaggtgtttcacgtttggggacttccaaatggtcccaactattgaagagtttgaggaaatattaggatgccctctaggggggaggaaaccgtatctcttctccggttttctaccttccttgagcaagattgcggctgtggttggggattcagcaaaggagttggatcgcacgaagcaaactcggaacgacgtagtgggcttgcctcggaaatacttggaaggaaaggcaagggatatggcgagccaagagaagtggggcccgtttgcagatattttagccctgctgatttttggggttgtcctcttcccaaacatcgacggtttggtagacttagccgccattgatactttcctcgcatatcaccatagcaaggaaagtccagtggtggctatcttggcagatttgtttgacacctttgaccggaggtgtgagaaaaacagcgcgcggattgtctgttgtttacccgctctctatgtatggttgatttcacacctattccgacaagacacgagacacccgtgtccgcttcaaagctatcgctcatgcgccgaaaaaggaagagtcgattgggaccaacatttggctgggatagggggcagcgcgatcaattggtttcctcgttggaaggaaggcaaggaaggagttcttttctcgtgtggggactaccctaatgttccactgatagggactaggggttgtattaattataatcccacactcgccataagatag

SEQ ID NO: 21759 - DNA, 282 bp, Glycine max
  Peptide Sequence Number=SeqID_138537
atgtgtttacaaggaaatgcccaattaattgatgatcaagaaactaataaatttgcaaagtggattctagatattggagatggagttattgggaatcaaaatgatggatatgctactgttgaaattcctgagtacctacttattactgaatataatgaccccattgatgctatagtcaaatcaacatttccaaatttatatcaacatcagagtaatcctgatttcttcaaatctagagcaatattagcttccaccaatgaaacagttgaaagaggtcaatga

SEQ ID NO: 21760 - DNA, 534 bp, Glycine max
  Peptide Sequence Number=SeqID_138538
gaggtgcaagagcagatgaaggccgacatggaggccatgaaagagcaaatggccacaatgatggagaccatgatgagcatgaagaagataatggaagccaatgcggttacaattgccgctgccagcactgttgctaaggtgaacccgatgcccccatctggccttaaccaaatgaatcatccaaccttagctatggtaggcaaagatttgggaagtacgaatggccccatgatgtgcaaattcaaaacgagcacgccttctcgccatatggcttgcctcccaacttacaccagccaatgtggcgcacataaaatgccccactacaatctagccgacttcgagccttgcctcggatatgccactgaagggcaagcagttggtgatatacccctacaaaacactttggagggccctcaatatcacccacaaccacacctcttgcattccacagtgggtaaaaaccctcatgctatggcggaaatgggaaagttggatcatctagaggaaaggctcagggccattaaaggaggctga

SEQ ID NO: 21761 - DNA, 558 bp, Glycine max
  Peptide Sequence Number=SeqID_138539
atgcaacaacagtgggctgacattattggaaacataaaggaacaagtaaggaatgaatatgaagaacaacacaagaggagtctggaggaatttaagaaggagttgtccagtcagatcttcattcaattgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatacgtgcaacgacaaaatactacagtgttggtggccttggggaaaatatgtgagggtggatcagccattcacaatgtcacttatgctgatgatgttgtgagggtgagtgttgacaaagttatagaaggtttttggatgagtggagctctactttgggtcatgcttccgtgtatggattccttgagccacaatcgatacacaatgcaaaggatcgacgtgctgaatgtgagcattacttacaagcatggctcaaggaatcgcaacgagaggtgtacctag

SEQ ID NO: 21762 - DNA, 801 bp, Glycine max
  Peptide Sequence Number=SeqID_138540
atgaagtcagcaaacacaaccgcagatggtacaaataatccagcaactcctaagtgggttgaagtcaagagccatgtacaaagcggagggtatgagtgtggctactacgtgatgcattggatgtggaacatcgtcggtgggggtttaaagaatgattggagcatgtggtttcttgatggaacggcgttagacaacgaaacaattacaacgattcgccagaaatgggcagcatattttcttaaagttcaaagcattcaatgcagaatagctggccctaggcaaacgactccaagaaattgcacaatgattgggttgatatggacatatgatacatcaactccagtgtctagaaatgcaaccatatattgcagcactgaaattttgtcacttgactgggaatgtaaatcagaccgcttgcttcttataggtacatccgatgggtgcattaaggcatggaatgtggatgcaaagagagttgtctgtgacctcaacacaaccgaagcatttccaagtgtattggacataaagtgcagtcctgtggaacctatttttgtgtctgcagcagcatctggaggggctggttctaactatattgacaacttgggttttgcttcacttactgtgtggaacatgaagacatggaaagccatgacagtccttcctcttggagaagatccaccagcaattacttctctatgctttaatcacaatggaaagattttggcagcttctgccgttgatggaatgattcacatgtttggtatccttaattttgttcatttgattgtttccttggtttga

SEQ ID NO: 21763 - DNA, 546 bp, Glycine max
  Peptide Sequence Number=SeqID_138541
atgtcaaaacgtcttgcagaagatgccaaggcttattttgatgagtgtgtctcgctatcaacttttgatagttctgacttttcatctccagaggatcccccagtcaatttcgttggtccacctactccatctggcagccctgaattgggcacacgaggacaatccatgaatatccattatgacatttcacaaccacctgccaacattgatactgtgggagcttttcacggtcaagtcagttcaatcactgacagcacagaaactggtagcaaaccctgcttctcctttgcacagaagccatccgaaacctctgcacttcaacaagacatccaacaatacataaaaaagttcgaaaaaaatgttttgaagtcttcagctatgagatcaaattattgtgaccctcatgagtatagttttcaatcttctgctgagagcttgctgaatgatagagtactactaaaaaggagaattgagtctggtagtttgatactctgtggtggtggtggtaataatttgttatctaaattttctgggatagggatttga

SEQ ID NO: 21764 - DNA, 138 bp, Glycine max
  Peptide Sequence Number=SeqID_138542
atggtggagggaaccgtcattgatgagaaatcaaaagagaagaggggatgtcatcaaggattgattaagaagaagagctcccacatggccacagattctaaactacttaccagacacccaatcccttggacatactga

SEQ ID NO: 21765 - DNA, 591 bp, Glycine max
  Peptide Sequence Number=SeqID_138543
atgaagaggtctccagcatcttcttgttcatcatccacttcctctgttgggtttgaagttcatcatcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtaaacaaggggcatatgatactgaagaatctgcagcacgtacctatgaccttgcagcccttaagtactggggaaaagatgccaccctgaatttcccgatagaaacttataccaaggacctcgaggaaatggacaaggtttcaagagaagaatatttagcttctttgcggcgccaaagcagtggcttttctagaggcatctctaagtaccgtggggttgctagtaaatcaagtattatgatattaattaatacatatcatatactttggataggcatcatcataatggtcgctgggaagctcgcattggaagagtatgtggaaacaaattaa

SEQ ID NO: 21766 - DNA, 879 bp, Glycine max
  Peptide Sequence Number=SeqID_138544
atgctcatatctaatagcattgagagaccaaatcatgtatgggctgaaacatgggagtgtctaattgacgatattgttcatcaacagagaaggataagaaacatgccagatgaattgagacatatctttaatttaatcatcaatgttgtcaatcaacaggctggtggaatgcttttcctatatggatatggaggtactgggaaaacctttatgcggaagacattaacttctccattatgttcaaaaggtgatattgttttgacagttgcctcaagtggtatagcctcattgttattacccaatggcagaactacacattcaaaatttgctattcatgtgcctatattggacaactccacatgtaatatccaccaagatgttggtgatgggagactaggcaaaggtgatgatgggctatataacatagaaattccatcagaattgttgattacaaacttcataaatcctattgaagcaattgtcatctatacatacccagacatccaacacaagtataaggatgcagaatttctcaaatccataactattctagcttcaacaaatgagattgtagaccaaaaaaatgactacatattaaacatcatcgcaggtgaagaaaaagagtatttcagttgtgatttaattgacatgagagatgttgcagcaagtgaattttatgaatctgttacaccagaatttctacattcgttgaagacatcaggtatacctaatcacaagataaggctaaaaacaaacacacctattatgttgattcgaaatttagaccaagcagaaggcctttgcaatggaacaagactaattgtctctagaatgaccaatcatgttattgaagcatggataatttcgggaaaaacatag

SEQ ID NO: 21767 - DNA, 147 bp, Glycine max
  Peptide Sequence Number=SeqID_138545
atgaagaaggagtcatgcttggaagatgaagatggtccatctcacgcacaacaacagtgccctcctccaccaatgccgctacttatcattgtcaatcggacacctaacacgtgtcgaagcaccgcacctactaagattgttgcgtaa

SEQ ID NO: 21768 - DNA, 639 bp, Glycine max
  Peptide Sequence Number=SeqID_138546
atggcagcaattgagtaccgtggagtcaatgcaaagaaaaatgaccaaaccctacaacaacaacaaacagaagtacaaacagaaacagttcctaactcctctgactctgaagaagcagaagtagaacaacaacacacaacaacaataactacaccacccccatctgaaaatctgcacatgctaccacaggaacaccaagttcaatacacccaccatgtcactccaagggatgaagaatcatcatcactggtcacaattatggagcatgtgcttgaacaggatctgccatggagcttcatgtacactggcttgtctcagtttcaagatccaaacttggctttaagcaaaggtgatgatgacttggcaggcatgtttgatggtgcagggtttgaggaagacattgattttctgttcagcacacaacctggtgatcatgagactgagagtgatgtcaacaacatgagtgcagttttggatagtgttgagtgtggagacacaaatggggctggtggaagaagcatggtgtatcatcatgtggataataataataagcagaagaagatgctttcatttgcttcttcttcttcaccatcatctacaacaactacagtttcttgtgactatgctctagatctatga

SEQ ID NO: 21769 - DNA, 372 bp, Glycine max
  Peptide Sequence Number=SeqID_138547
atggaaaatgttctagatattttcctaaaaaatggcaacatgaaattgttgttgaccaagagggctatcctgtttacaaaaggcataatgatggcatacctcaacatagaatggtgcaatcagtcagcgtccatcaaatatttattcaagtacattaataaaggttatgattgcataactgcaactcttgtacctgcccaaaatgacgatggaactactggacagactattggtgagattaagcactatcttgatgtaatatttaaggatgatgttgacattgatgctttactattcaagccaactattaaagaatctatgtttacttcttggctacaagctaacaacattttccaggaagaaaaagattag

SEQ ID NO: 21770 - DNA, 669 bp, Glycine max
  Peptide Sequence Number=SeqID_138548
atgagggctatacaaagatcgcctaagtctattgttgagctaattttagttgacaagaagaccagtatcacaagttgtcctttgtgggagtcattggctttggagtttaaggattgttttgataggcatgtttatggtcctatggtgttgttgctcagtctggctaaaatcaaagaagcaagagatcactttctgcataatgcccatgtgaaatgctttgatgaacttagccaattgaaaaaggagtgtatgtatgtcattgtggctactataagcaagctattggtagccaatgggtggatttatgatgggtgtcccaaatgtaacaaaaaagcttatggagagggttcgtcgtttgtttgtgttgggtgtggtaataagagtgcaagtatagttgcaaagtttcatgtggatgtcagagttggtcaacctcatgattctgctatttttacactatgggattgtgaatgttatgctctgataaaggagattgcaacagagattaagctgaaaatgttgatgagcaatgtttataagccagtgctgagtctgtccaacgctactgggatccatcatcggctaagcgcattttgccacagtctcatagtcaactgcatggaataccattcgaagatttatcgtccatacaactatcctcaactaggctag

SEQ ID NO: 21771 - DNA, 2163 bp, Glycine max
  Peptide Sequence Number=SeqID_138549
atgcttagagtagagagaaaagatggaaactggatagtgacaaaatttgttgaggaccataaccattcccttgcttcctctagaaaggtgcagaaccttcaacccggtaggcattttgtaggtgctgcaaggaatgttacaacagagacatttgatgcccgtaatgaatcctatgtttccgtgaatggaaatcatttagaaccaattggttcagttaggagctcctctctagcagaaaaatgtcatccaatgagaaacattgagtctcttacctatgcaagatcttctcgaaagaggacccttggaagagatgctcaaaatcttctgaattattttaagaagatgcagggagaaaaccctggcttctattatgcgatacagctagatgatgaaaatcgcatgaccaatgtattctgggctgatgcaaggtcaagaacagcgtataattactttggtgatgctgtaatttttgacaccatgtatagaccaaatcaataccaagtcccatttgctccatttacaggattcaatcaccacggccagatggttatatttggttgtgcattacttctagatgaatctgagtcctcctttacttggctattcaagacgtggctatctgctatgaatgatcgaccacctgtttccataaccacagaccaagatagagccatacaagcagctgttgctcatgtgtttccagaaactcgccactgtatttgtaagtggcacattttgagagaaggtcaagaaagattggctcatatttaccttgctcatccttcattctatggggatctatacagctgtatcaatttttctgagactaccgaggattttgaatcaacatggaagtctcttctggataaatatgatcttcagaaaaatgattggcttcaagcagtgtataatgctcgcaaacaatgggcccctgtttactttcatgatactttctttgctgcaattacttcaaaccatggggttagctccttttttgatggctatgtaaatcaacagacaaccatatctttattttttaggcagtatgaaagatctcttgaacattcattggaaaaagaaatagaagcagattatgagactgtttgtaacacacctgtactgaagactccatcaccaatggaacaacaggcagcaaatatgtacactaagaagatttttgcaaaatttcaggaggaactggtggaaacttttgcttatactgcaaataatgttgaggatgatggtgtgatcagtaaatacagggttgcaaaatatgaatatgatcacaaggcatacatggtcacattgaatatctctgaaatgaaggcaaattgcagctgccagatgtttgaatactcaggcattctttgtcgacatatattgactgtcttcactgttacaaatgttcttacccttccatcgcactacattttgaagcgatggacaacgaatgcaaaatctgatattagaacttatgaaaaaataacagatccacttgacattgaaaatcttactgtacgttttaatagtttatgtcgagaagccattaagcttgctgaagaaggggcaattgctgtagagacttataatgcaacaatgaatgctttaagagagggtgctaaaagggtaggtattatgaagaaaaatgttgcaaaagtcacacctccaaacactcatggtaatggaagctgcctggaagacaatagcaagaagagaccttcatcaatttctgatgtcatcccatcattatggccttggcaagattcagtgccacatcacttcaatcttaatgaccttgggcttcctgttactgatctgaatacccccagtatggctcctgtttctattcaccgagatggtggccctctagataacactgttgtccttacttgtttcaagtctatgacttggatgatcgaaaataagaattcgagctcatccagtaaaattgcagtcatcaacatgaagcttcaagattatggtaagggccctttaggagagacagaagtgcaatttagggtgacaagggtcactttggagcctatgttgaggtctatgacttacatcaatcaacagctaaatgcaccagtcaatagagttgcaatcatcaatctgagggtatgtaaacttggatcacgatcctgtactcttcctagatcctaa

SEQ ID NO: 21772 - DNA, 1164 bp, Glycine max
  Peptide Sequence Number=SeqID_138550
atggatatgattattatggtggttatgaacggggaatgggtggaagaggtggttatgcagatgagaagtcctatggcaggtatagaatccaatcgtggttacggagacatgccaagtggtggtgcacaaagagaggggttgatgtcttataagcagttcattcaggagcttgaggacgatatactaccagctgaagcggagcgtaggtatcaagaatacaaatcagagtatatctcgacccaaaaacgagcttattttaatgctcataaggatgaggaatggttgaaagataaatatcatccaacaaatttggttacagtcattgaaaggaggaatgaaaatgctcgacagctagcaaaggattttttgcttgatttacagagtggaacattagaactaaatcctggtttaaatgcctctataagtaaatcagggcaagctagtgaaccaaattcggaggaggaagcagacactggaggtaaacgaagaaggcagggtaggggatccaataaagaaaatgatttctcagctgctccaaaagctcatcctatcagtactgaaccaagacggatacaagcagatgttcaacaggctcaggcccttgttcgcaagcttgacacagaaaaggggattgaagataatattttatgcatcagtgatcacaatagaaatgatgataaggctcacagtgcatctgtggctcccatagtaattatacgaggcctaacatctgttaagggtttagaaggtgatgagcttctggatacactcgttacctatctttggcagattcatggtgtagattattatggcatgattgagactaatgaagctaagggctttaggcatgtgagaccggaagggacagcgcatgaagtagtagcaggtaaatcaggttctgaatgggaaaagaaacttgacttattttggcaaggaaggctgaatggtcaggatcccttggaagtaatgactgctaaggagaagatagatgctgcagcaatggaagtattggatccatatgttcgaaaaattagggatgaaaagtatggatggaagtatggttgtggagctatgggctgcacaaagctttttcatgctactgaatttgtgctcaaacatctgaagctcaaacacccagagcttgttgtggaacagacttccaaa

SEQ ID NO: 21773 - DNA, 264 bp, Glycine max
  Peptide Sequence Number=SeqID_138551
atgaagtcagctgacatgcagagttaccttatggttacctgcacctttcgtcaaccaggggcaaacaagcccattgacgcacgaagactaacattgtcttctgcaccttttgtcgtcctgacccgtgaagtcagtcaggtgacatgcggggttaccttatggtttcccggacctttcgtcaactacgggcaaacgagcgttgacgcgcagagacttacatcttcttctgcaccttttgtcgtcctgacccgtgaagtcaggtga

SEQ ID NO: 21774 - DNA, 225 bp, Glycine max
  Peptide Sequence Number=SeqID_138552
atggcattagcttggtggtttagtgatgaaacaccattggaattggagaagattacaacaaattgtaataaatgggcaacatattttaatgcatatgtaacaagtcaacataaggatcctttgtctgatattggagatctcatgactaggtctaagactaagaggatgaggtatgttttgcaaagacctaataatagagatcaagtatgctcaaaggtggattaa

SEQ ID NO: 21775 - DNA, 303 bp, Glycine max
  Peptide Sequence Number=SeqID_138553
atggagaaaaacaaagaaagtgtgctttgccagggttcgaagaagcctcctgatgaagggggtagtgatgatacacaaaagcagtactttaaggagagattaataaggaaaacctctatgcccacagagactaaagaaccactcaagaatggaatgacacacttggactatgaaggaggaagtcatctacttccaaattttatgctaactcccattgcttttgagcaattgtgtcttccttggaagcagtgtttgatcgtgaagttactagggaagaacattggatactttgttagatattaa

SEQ ID NO: 21776 - DNA, 555 bp, Glycine max
  Peptide Sequence Number=SeqID_138554
atgatttacacgaaagagatgaaggagaggttaagtggacaggacaaccgctatgcatttatgaaccttattttgaaggattctggtcttttccacatcaaaaatctctttatcgaggaattggcctggattgaacgtttacacaaaaatgcttggattggatttcagtcttggagagcaacaacaaggaagcttatggtggtcttgcacgtggccttcatgaaggtgcaaaagggatcgagaagcatgttgtgcaactatgttctagcagaagactgtgaccaacctgactatgttaaattggctaaggccctttgtgtagagcacaatgttagcctactgacaattctgggtgcaaagacccttggaaaatgggctggtttgtgcaagattgattcggaaggaaaagctaggaagctttttagcattctcctagtcctgatggtatattttggctcttctctcttcatagttgaaatatcacgagactggaaggaagaaagaatgcttgccacaagttggtcaatggaacatgatgaacaaggttacctttag

SEQ ID NO: 21777 - DNA, 306 bp, Glycine max
  Peptide Sequence Number=SeqID_138555
atgtggaagcctttaagacaacaactagcactaacaagtctatctcaacagacatatgctacttcgggtgaatctttgagagactttccgaaagaaaacttgggtagtgcctgcaaaggcctaaagaatattggagtaaagcttgaaaggctttttgaaaaaaaatacttaggtagagcctacataggcttagagaatacttgttgttggagcctctggaggctttcaagaaagaaagaataccttaaagtgattggtcttagtataaagcctacaggtgtagttactggacgtagcctaggttga

SEQ ID NO: 21778 - DNA, 384 bp, Glycine max
  Peptide Sequence Number=SeqID_138556
atggctcaagtagtttttggtattctgattggtttgagggccggttacagattcgtgaggtctttagggtggggaaatgacacttggagcaattattttctcccgttcctaatgatatatgctagaaaattcaagatgcatgtccatttgcatatgcatgataacgttctagacttgctaacttgggagccttgtctggctggtaattatactaccaaccctggttacagctcttccgatcctacttgcaagatgatctcagaccgccatatttcaatttcttccccctgccctaggtgtaatcatggtgaggaagcttcattgctcgaatgtgaggatgctccagcttctatgcgtttggttctggactctaatgacaaggat

SEQ ID NO: 21779 - DNA, 1140 bp, Glycine max
  Peptide Sequence Number=SeqID_138557
atgggatatgaaactagaaaactctcagatgagtatgaagtttcagatgtcttgggaagaggtggattttctgttgttagaaaaggcaccaaaaaagcaagcaatgacaccaaaactcatgtagccatcaaaaccctgagaagggtaggcactgcttcaaactccaacaaccattctggatttccaagaccaaaaggtggagagaagagcacagcagctatgatggggttccccacatggagacaagtctcagtctcagatgccttgctcaccaatgagattcttgtgatgaggagaatagtggaaaaagtttcaccacaccctaatgtgattgatctctatgatgtgcatgaggactcaaatggggtgcaccttgtgttggagctgtgttctggtggggaactgtttgataggattgtggcacaagataggtactcagagactgaagctgcaggtgtggttcggcagatagcttcaggattagaggctattcataaagctaacattgtccacagggacttgaagcctgagaattgcctcttcttggatgtgaggagggactctcctcttaagatcatggactttgggttgagttctgttgaggaattcactgacccaattgttggtttgtttggatccattgattatgtttcaccagaggctctttctcaagggaagataactactaagagtgacatgtggtctctgggagtgattctatatatcttgctctctgggtatccacctttcattgctcagaataatcgccagaaacaacaaatgataatgaatgggaatttcagtttctatgagaagacttggaagggcattaccaattctgcgaagcaactgatttcagatcttctcactgttgatcctagtagaagacctagtgctcaagatcttctgagtcatccatgggtggtaggtgacaaagccaaagatgatgcaatggaccctgagattgtctcaagattgcagagctttaacgctaggcgcaaactccgtgcagctgcaattgctagtgtttggagcaccgcaatctttctcagaactaaaaagctgaaatccttggtaggaacacatgatctcacagaagaggaaattgaaaatctcaggatgagttttaagaagatgtaa

SEQ ID NO: 21780 - DNA, 156 bp, Glycine max
  Peptide Sequence Number=SeqID_138558
atgcttgagcgactacatcgagaaagtcacaaagcaggaggcttggaagatggtttaagaactggagtagcacactcagtgcgacagcacccactcaacgcgagaagccaacttggaagccaattgtcacgtgcaagtacgctggaaccgacttag

SEQ ID NO: 21781 - DNA, 276 bp, Glycine max
  Peptide Sequence Number=SeqID_138559
atgacaaggaagtatctttgtgctgagtctggaagaggaacaatcctagttgccaattgcacagttgcttcgggttgggaaacatttagattgtggaggataaacaaggatactttcatattgagggtgtttaacaaacagtttcttggtttagataggattaacgatgttgttgtttccaatatttgcactcattctgagacatttcatatagttaaggaaagtgacaattcaagtcaaattcaaatcaaagcttctaatggatacttcttgcag

SEQ ID NO: 21782 - DNA, 1879 bp, Glycine max
  Peptide Sequence Number=SeqID_138560
gaatgtgataactcactccccgtgtgctatttgtgttgggatcctgtgatgatctcaaactttatgttcgtgggagcagatggtaaggtggatgactatgaagaacctcatgttggaaatggccagatcatggaaactgaaggatgggttaggcagttgacagtggatattcagggacaaaagttgtcggttcctgtatatttgctacctgtttcgagagcataccttattttgggatcaccttggttagccactctcggtccccaagttgttgattatgcagccttgacactcaaatttttctaccacgggaaatttcttacattgcagagagagggttctagtactcctactcaagctcaccttcaccgactccaacgattgcatgctactagtgccatttctgacaattttgttgttcacctaatgcaacatgatggtcttgatgccagtctcaccgagttaccagtggatattgctcatgagatagcaaccttgctacatacttatagcatggtggaatatcttggtcatatagtctcaagagctggagtaacaatggatgttgggaaggtgcaagcggtgttagattggccaaagcctgccaatgtcaaacaattaaagggtttccttaggttgactgaggcattatgttggaccaatgccaccgagcaggccttcatcaaattgaaacatgccattacatcaacccctgtattggcactgcctgactttactcagccttttgtgttagaaacagatgaatttgaaattggagtagaggctgtgttgagtcagaatggccacccaattgcatacttctccaagaaattgctccctagaatgcaaaaacaatttgcttacactagggagtttattcactgtaaggataatgtcgcagctgatgctctttcccgagtgttctttatggcttggtcaaaaccacagtttcaattgattgataaattgaatagagaagtgcttcatgatgaacagacacaagtcatcatgaacgattgccaaaatgctcagccaccgaactatccatataatgtcaaagatggaacagtggctagaatttcggtccaattttattggcctaaactcaaacaagatgtgaaggagtttgtccgaacttgcaccatttgtcagcaagccaagtctaagcatgtcttacctgctggtttattgcaaccattacccattcctaaccaggcatgggaggatatcgctatggattttatcactggattgcctaactctagtggatttactgttattatggtcgtgattgatagattgacaaagtatagtctttttgttgtaatgaagtctgattacaccagtaagactgtggatgaagcttttatgtgtcatatagttaagttacacggtgttcctaagtccatcgtctcagatagagataaggctttgtatggaagggaacctccggctttacttagatacaatgacagctctcaagatccgccaacagtgcgagaagtgttacataacagacaaatgctattgaacaggttgaaagggaatttgatcaaggcacaaacagctatgaaaatccaggcgaataagaagaggcttgatagaaagttccaagtgggagatgaagtgctaaaaattggcgaagtattcctcaagtactcattcaatggcaaggttgtagcacgacagaggcaactttggaggatgttacagaaattcaagccagttaccccacaattcaaccttgaggacaaggttccttttaaagggggaggcaatgtaatgaacctgtcaggtaatggaaagcctaagtcagcaaaagagagagaaaaggataagttagttacaaatggtccaagaaatgtgggtgtgaggaaag

SEQ ID NO: 21783 - DNA, 399 bp, Glycine max
  Peptide Sequence Number=SeqID_138561
atgtaccctcccttgttctctttgaacctagtggatgtacccttcactagaactgatccacaagagatgtaccctctcttgttctcagtcaaacccaaggaatgggaagaatcaaaagaattctcagactgtgtcgttttgaattctttgacaagggagaagggagacacaaaagaattcaggcggttagtccttcgttcttttggaaaagggagaagagagacacaaaaagaattcaggcggttagtccttggcgaattctttttggcaaagggagaagagaatgaaaagatgaataacacaagttttcaaggtttagaaaaccagaaaacttcagaaagcttttggtacaaagaagaagaagaagttcaaagacattcaaggcttgtaaaggattga

SEQ ID NO: 21784 - DNA, 282 bp, Glycine max
  Peptide Sequence Number=SeqID_138562
atgagcgtgggcattgtgaaagactttgagttgagcatgccatatatgacaaaactgagcaattacaagtggaacctatgcttgcccgtgcaagggttcgaagacatcctcttagggttctttaaagaaggtgaagatgttagagaggcaatttcagtgaccgtgtatgacaaaggttgccatgagtttgatatgatgctcaagaaaatgggtaaaggattccaaccattactatgtgccaaacctgagggtggttcattttctgcgaccaacagtgcttga

SEQ ID NO: 21785 - DNA, 393 bp, Glycine max
  Peptide Sequence Number=SeqID_138563
atgaagtgccccttgataaaggaatcaaaggattgtgtggtcctctctaaggcaactcaagctttgggagggagtgcatattctgctaatgatatcactccttccaactttattaaggcagtaacccaagttactaattatgaatatgaagatggcactttctgggtattgaggatttttggaactctagatggggcaagcacatacctcatcataaatgacctccacactggtgctaacgagatgtcagagagatgggaaaagcaaagcaagtgcgagcctcatcacaaatcacctctacgccaatgcaaaggatataacggagaagcggaagaggaggcatgcgtcacaaatgaccttcacactggtactatcgagatgtcggagagatga

SEQ ID NO: 21786 - DNA, 549 bp, Glycine max
  Peptide Sequence Number=SeqID_138564
atgggacattggtggggtgtgatgttagtggtggtaatgatgacaacgacattggtggtggtgggtgacagaggtggtattaacgatggtgatggcggtgacggtgacagaggtagtagtattagtgggatagtggtagcaatgtcaatggtgttggtggcgaccgtaatgacaatgatagtggtggtagcagtgttggtggtggtggtggttgtgatagtggtgacaaaagtgatattgttgatggtgctggtagcaatatcaatggtgatggtaatgtcggtggtgataatggtgacaatgacagtagtgttaatggtagcacgaagtggtgattgtgacaatactggtgttggttgtggtgacaatgacactaatggtggtagcaatattggtggtgatagtaatgttggtaaccattgtggtggtaataatggtatttggagaaatgagaagtgggaacggaagggagaagcggtggatgtgctactaaagaggaagggagaagcggtgaagggagaagggttgggagaaaatggaaaaaggtag

SEQ ID NO: 21787 - DNA, 300 bp, Glycine max
  Peptide Sequence Number=SeqID_138565
atgagcttatatctcattgtgggcaagaggaggagaggatgcagaaagacagatctgaaagtgttcaagatacgctgcataaagaaaggaggcattgctccttcgagctgcagttgccgcattagccctttagggaagtggatgagcacgccgatgagcaatgtttgtggcggaggcttcaagattcagaaactcgagtttggagacgacgattcagaggagtctttaggtgggtctcatggccttgaggacaaaaggggatttggggaaagaatggggagagaagagtggaggacatga

SEQ ID NO: 21788 - DNA, 273 bp, Glycine max
  Peptide Sequence Number=SeqID_138566
atgaaaacagagaaacaaggagaaaagacggaacagcaacacaaacatggagagagagatagagagagggggttaagggcagatcaggagaagagacccgtcttcgctgaggatgccgtgaggaaagttgcgaatgggagaagagagggtgtaattgtagagctttttcccgtcgagaaaagagaattggcaaggtgcagtggctgtgaccgaggaagagaaatgaaaagaagaggaacaaatggaaaacatcttgttggggaccactcttaa

SEQ ID NO: 21789 - DNA, 1221 bp, Glycine max
  Peptide Sequence Number=SeqID_138567
atggctatagttgaatcagtggggaagattcctttgcaagacccacctgaggaggagttttgtgctgctgacttgacttggaccaagtttggtaattctgagcaccatgatgaggttcccttcattccctatgacagagttgatgcttttataattggtgaatgctctaatgtcgagtgcacgacgaggtttcatatcgagagaggaaagaaaccgactattggaagcttgaaggactacaaggacgatgagtatctggagtacaggctgtactggtgctcgtttggccctgaaaattatggggaggaggcatattacctagtcgaagatgcaaaagtcagtagccttgcttctcagtatgtccacaagctagggatgattatcaaaaggatacttcagagtctgaccctttcatcttggggatccaaacagaatggcagctgcaaaaaaatgattcattttggccatcgaagtgttgttgccgcagactctacatttggtgtgaatagacttaaatatcccttgttcacactagttttttattcaagacaacatgcacttcctgtggcatgggtcattacacgtagctttgcaaagcctgtcggtggatttctaattgacgacactgcagctgaaattgatcttttgagatcttggcttaggaatattgttaagaaatgtagtaatattgagattcaatgggagatttttaagcgtcttgggacaatagtgtacagcatttggggagctattaatgcatcgcttgccttggaacaattcatgctggattttgttgaccaaacggctttcatggaatatttcaaagtcgcctggttgcccaatcttgcactgcaaagagtagattggttagtccccaagttaacaactgagttgcattcaagctgctggcttgactggtatgctgatgaaagtgattctttccagaatgtgaaggaaaaatatattgcttctacatcatggcatagagcacttcaaattccggactatgctgtttccttggatgataaagaccacctctttgccaaggttgtgagccagaaagatagtagcttaacacatatagtgtggaatccaggatctgaatttgcatcccgtggttatcagccatccatgtctttccagtcttttgaagaggttttgatggatctttggaaaaagccagtggatgattcttttgcgttggatctgtcattggcttga

SEQ ID NO: 21790 - DNA, 690 bp, Glycine max
  Peptide Sequence Number=SeqID_138568
atgccttcttctcttcactttgataggttcaatcctatcacccacgccgccaccactgtcgccatcgccaacggcgtaaactgtccgaagcagcctcaagcgccgccctcttccacggcggcgcgtcgcctcgtggttccctctctctcttccggcagaggaatcgcggcccccgacacggtggcgctccaccacgcgcacgtggtggaccccaaccagtgctgctccatcgtgacgcagcacatcaacgcccccgtctccgccgtttgggcggtggtgcggcgcttcgacaacccgcagggatacaagaacttcgtgaggagctgccacgtcatcaccggcgacggcattcgcgtcggcgccgtccgcgaggtgcgggtggtgtcggggctccccgccgagacgagcacggagcggctggagatcctcgacgatgagcgccacgtcatcagtttcagcatggtcggcggcgaccaccgcctcaggaactaccagtcggtgacgacgctccacgccaacgggaacgggacacttgtcatcgaatcatacgtcgttgacgtaccgcagggtaacactaaggaggaaacatgcgtgttcgtcgacacaatcgtacgttgtaacttgcagtcgctggctcagatcgctgagaacagaaccaataactgtgaacacactgcacaacactgttaa

SEQ ID NO: 21791 - DNA, 339 bp, Glycine max
  Peptide Sequence Number=SeqID_138569
atggtggcaaggcaaaagttgaaaacaaagggcaatatgaaggttacagagctaaagcacccatctggctgtgccatcattgtaaatgttcatggaggagggttggggtggtttggcaccttactgatcattgttttgtgtctttttgctgcatatctcttggctggtatagtttaccgatttttcttcctcgggattcgtggtatagatattatccctaacctggacttctgggttagcttgcctaggagaacacagagtctgtgtgcatctttggcgaggaagtttaagggaccgtctgaaggtcaccggagcacttattctcctgtgaacttctga

SEQ ID NO: 21792 - DNA, 1320 bp, Glycine max
  Peptide Sequence Number=SeqID_138570
atgatgaagccaccttcttcttcttccttcccctctcttctcagagtcaagcctcgtctctcttcttatctcttcaccctcttagctttcattctcttcgccgccatcctatatggccatgactttgtcttcatcttccgtccacgcctccactccaacgatcacaccacacaaacactcttctccacacccgtcgatgtgagatcttcaacaacaaagaaagaaaataccgaagaaaataagacggcggggacaaaatcgaaaagggaggaagaagaagagtgtgacgtgttcaacggaaggtgggtacgcgacgagttgactcggccactgtacaaggaatcggagtgtccgtacatacagccacaattaacatgtgaagaacacggtcggcctgataaggagtatcagcggtggcgatggcagcctcacggttgcgatcttcccacattcagtgccagattaatgttggaaaagcttcgtgggaagaggatgatgtttattggagactccctcaatcgaagtcaatatgcctctttgatatgccttctccatcaacttattcctgaacatgccaaatccgaggaaaccttggattcactcactgtcttttcagctaaggaatacaatgccacaattgagttctattgggcaccttttcttcttgaatcaaactccgataatgctgtcatccatagggtaactgataggattgtgagaaaaggttcaatcaatacgcatggtcgtcattggaaagacgctgatattgttgtatttaacacttacctttggtggataactggctctaagatgaagatcttgcttggatcttttaacgatgaagtaaaggagattattgagatgtcaacagaggacgcttatcgtatggctatcaaaagtatgcttagatgggtgaggctgaacatggactccaacaagacaagagtcttctttatcagcatgtcaccatctcatgcaaaaagcatagagtggggaggtgaagcaggagggaactgctacaatgaaacaacaccaattgatgatcccacatattggggttctgattctaagaaaagcataatgcaagtaattggggaagtgtttagaaaatccaaaatacctataacttttctcaacattacccaactatccaactatcgtaaagatgcacacacatcaatttacaagaagcaatggaatcggttgactccagagcaattagctaaccctgctagctatgctgattgtacgcattggtgtttgcctggacttccagatacttggaatgagcttttgtttgccaagttattttatccttga

SEQ ID NO: 21793 - DNA, 129 bp, Glycine max
  Peptide Sequence Number=SeqID_138571
atggccaacaaggactcctccaatgagaaagacaaggactcctccaatgagaaagacaactactccaacctcattaaccaaaaccacccgcaagcctatgtccgttcatcgccatcgcaatctcgtcaa

SEQ ID NO: 21794 - DNA, 141 bp, Glycine max
  Peptide Sequence Number=SeqID_138572
atggagaagaggcccacgaggatgaggagatggccaatttgctggattctggggagggagtggagatacgtgactgggagatccccagattcatattattgcgttagtgttgatgatgtttggaattctggaaccgtgtag

SEQ ID NO: 21795 - DNA, 510 bp, Glycine max
  Peptide Sequence Number=SeqID_138573
atgtgtcacctaactgcatatgtttgtgtttactacgacggccaaatttgcaatactaatgagggcaccaccttcattagtaacaacacaaaaactttcatggtcgacaaggttataacctttacacaattgcttgaacttgttcaccaaaaactaaacattgacccagaacaacatatccaacatctccattttcggtgccctatatttgagtcaggacaacgttatatgtacacatcttttattctgcgagatgatgctgatattcgacaaatgttcaacatttttgacaacaatccatcactaccatttgtggagttatttgccataatttgtcacaataatgacccaccaggcaaccaacatggctcaacctctaatcttgaggacttaggtgaatacgagacttgttggctcaaaaaccatgatagtgatacggactcctcttccgggcccgaaggaagtaacctgtctccatcccacgaacctatattcaaacgggatttgtaa

SEQ ID NO: 21796 - DNA, 297 bp, Glycine max
  Peptide Sequence Number=SeqID_138574
atggagatcatggtatgtcgcataaatcggctaaactatttcgtttcaagggtgcctcaaaactgggatgatatagtgaatttgtgtgctaaagatagagccactagtcatggagcaattgttatggatgttgataatgaagcaatgagtagagaaacaaatgaaggggaattcatgggtttaggtgctactactagtatagacttggaagaaccaaactctaatacagaaggaaaaagacaaggttcaacttattttgacacacattctcacaaaaagattggaaaaaagaagtaa

SEQ ID NO: 21797 - DNA, 177 bp, Glycine max
  Peptide Sequence Number=SeqID_138575
atgagcatcctgcaggtgctttcttgcaattggcttctccatctctgccttagccaccacaaccacactttcgaaaaggcaggaagagtagtgagcataaggatagtagggaagatctccccaaatgaacaaacaaacaaaaggggcagtgggaagattaccagagatcctttttag

SEQ ID NO: 21798 - DNA, 357 bp, Glycine max
  Peptide Sequence Number=SeqID_138576
atggagaggcgtaacttacacaaatgtctcgccaatctccaagatggaagcatagatgtagctatggtgaaggagttctatgctaacttatacaacctagaagaccagagccctaatcaagggagggtaagagggcatttaatcaagattgatgctaacagcctgaataccttcttagagaccctagtagttttcgaggagggtgagacactgcctacctattccagattcacaaggatgaggattgatcctcaagagtttgcttctcgtctctgcatccctggtaggggttttgttctgaatgcagagggccatccttggaagcttccaaggaaagatctcaccactcttgcatag

SEQ ID NO: 21799 - DNA, 483 bp, Glycine max
  Peptide Sequence Number=SeqID_138577
atgtatgttactgaaatcttaatctcttggtgtaagatagcaggaacatatgttggtgagggaatggtgatccacttcagcagaggagagggcaaagaatctggaacaggaacaatcttggatcgtcttcttataagttcatcaccacttcatgccaattttgacattccatgcccaagatgtgaatatggtgccactgcatcttctgatccaactgagtattttcttcaccgctctttgtttcttcttgagaatgaatttggtggctgccatgtgttcatgaataactgtgaggactttgctatttactgcaagacaagtttgcttgtagttactaacatctgcgtagggcagagtggacaagcagcatcttgcttggctgctgctagtgctgtagtttctttgctactgagatttatgacagccagcttcggagctaaagttccagtggagaagatatctgagatggccaaggaagattga

SEQ ID NO: 21800 - DNA, 1053 bp, Glycine max
  Peptide Sequence Number=SeqID_138578
atggcgatgttgagaagatatgttacagctagtgctattgcattatttgcacttttgctgttgttggttacttgcaaccttaacatggctttggcctcttctggaggcgtgatgggagggaatttcttcgattcggattcggagtcttcctcctcagaatcatacactagggattcagaatcatacagaatgaagcatcatcctcatcgttattatgatgccccttctcctgacaccgatgctgcaaagggaagtcacagtggactcgtgctttttctgatttttgcatcgggtatgtttttggttgcattctataaaggcagcactggaaattcagttactgtgatcaagcttcaggttgcaatgttcggtggtgggatggggagcccaatactaagggatctaactaggattgcagaaactgcagatacatcctctcgagatggtttgacctatctattggcagacacaatacagagtttggttcgacatcttcgttactgtattgctggatatacatttgaaattgtagctgttaagagattatctttaatgagcattctttggcagatgaatctaaagcggagtaaagaggatggggagaaatactataaccaactatcaaatgaagaaagggacaaatttgatgaagagacattagttaatttgaacaacacagaaaagagaagtaaaaaaacccagagtgatgtgtttagcaatgaatattcaatgtttgatcaaaaggggattaaagagggaacaaaaaaaattgaagaagagaaacttctcaacgagtttggtgacgagtacatagtgataacaatcttggtagctgctaaaggagcacataagcttcctaacatcaatggaacggaagatttgaaggaggccttacaaaagcttagaaccgttctctcaagcaaattattagctggcaaggtgttatggaccccacaaaatgaggatgacactctttcaaaacgaagactacttgaagactaccctcagttagcaaaaggcatggcaaactttctagttaagaaacgtgaatga

SEQ ID NO: 21801 - DNA, 252 bp, Glycine max
  Peptide Sequence Number=SeqID_138579
atggcttctttgcttccttgctcccttgttcctctacttgctttgtgcttaattggatcaagtggtcacgcattaaacacaggatgcatgcttagtgtgcttgctcatgacagctgtcttctaatgtggctttttgcgttaagtgaattacttaagttgaatgattttgactcactaagcgaggaggttgagttgagcatgacaattcagttcttcaatcctctttcatgcctctgctacaattttacataa

SEQ ID NO: 21802 - DNA, 351 bp, Glycine max
  Peptide Sequence Number=SeqID_138580
atggtaatcgattacatgctcatgctcgttgaggcctatgccgatcaaatcaaaattggttttgtcattagctcaaaaggaataagtatggatgaagaaaagggaaaagcaattagggaatggcatgtgcctaagaatgctaatgaggactataaatcagttacatactttagtgaaaaacttccaggagattgggtctggatttatatgaagaaggaaaggatgaatcctttcgaagacagagggaatgatgaaggtgcaaccaacccatctaatgatcctttacaggagatgggaggtcctatgacaaggtccaagactaagagcatgaagaagtattatgaggcctga

SEQ ID NO: 21803 - DNA, 135 bp, Glycine max
  Peptide Sequence Number=SeqID_138581
atgttaagaagtgaatttgagacgaaggatttgggtgcaacccagaagaatttgaccaagaattcggtttattatgaaatatgtcaaggtggagaattattgagaagtcttgagctcatgtacctgacgccttaa

SEQ ID NO: 21804 - DNA, 1434 bp, Glycine max
  Peptide Sequence Number=SeqID_138582
atgggcagaatgttcaaggaactgctgaatgtaaatattttgacacatactgaagaggtgactttcagttctcaacatcttaccaaaatagagatgttgaaacaaaaatacgttgctgattctgcagtgaagtgcaaatcaacattagaagaaaatatttcagtgcaggctaatgatttgtcagttcttaattggtcttcccttatccaaatgtcaaaaatggaaaatgttgggccctgcagaaagcatgctactgctaaaccaccaaatgatagcattcttgagaaaaatggcaaggctatggcttctgatagagaattaaattcttctacatctggagttgaagttctagtaggtgttaatgctccagtgttgcatgaaaatatcagcttaaattcttcaagtgctttaactgctaatcatgcggaaagtcttatgaaggaagatgagatggatcttagtaagtgtgatgttaacatggtggatgtggaagctaaggagaaatggagcagccctaaggatattaaagttggagatggtaaggaagattttatctcttcactttgtataataagaaatgatgaagtgcaggatgacattgttaatgaaataggagcaaaatcaggaatttcatttgaaattgaaaatggtgaaatgataaactctgaagaaaggaatgcaattattgagagggaaattgttgtcaaatcatcgcatgatttagatttgaagtcagaattaaatgccttgagtagcaagttacaaattggaaaaaaggattggaaggaggaaaatgtcgaggaagtgaaaaaatctaacactgtttcctctgttgtgcatacttcaatgaatgaggcgccacagcaggatgctggatatattagtcaacctgtggactctggaaatatggatagtggacaagaatttgccaagggaggtgctgtctgggatatttttcgtaggcaagatgtgcacaggcttgaggaataccttaagaagtattgtagggaattcaggcatctccattgttctcaagtggagaaggtttttcaccccattcatgatcaagttttttatctgacttcttatcataaaagtaagctcaaggaagaatttgaatttcaccatctttgtatttatgcatttgaggaaccttttacaggagttgaaccttggacttttatacaaaaccttggtgaggctgtttttatacctgccgggtgtccccatcaagttagaaacttaaagtcgtgcattaaggttgctctagattttgtctctcctgaaaatattcaagagtgtattcgtctgactgaggaatttcgttctcttcccaaaaaccataaagcaaaggaagacaaacttggggtgaagaaaatgtgtctctatgcattacgcaaggctgcagacgatttggagaagcttgaaggataa

SEQ ID NO: 21805 - DNA, 1527 bp, Glycine max
  Peptide Sequence Number=SeqID_138583
atgggtacttcagaaaggatcgacttggagcacggcggcgaggaggtggcggaagcggcggcgtcggtggagaaggcgtttgaggggaaggaggtgccgccatgggagaggcaggtgacggtgaggtcgatggtggtgagtttggtgttgggggcgtggacgaagctgctcgccaaatcggggatgcttatgcaaccgtatactcgtcaggagaatactgttattcaaacttgcgttgttgcctctagtggcattgctttcagcggaggttttggtagctacttgtttggaatgagttcagatattgctaaacaatctccagaagctactgcacaggatattaaggacccaggtttaggatggatgatagcatttgcatttgttgttagctttcttggcctcttttcattggttccactacgaaaggttttcatagcaatagcaatgattcttggtgacggtctatacaacttcatcaaggttcttggccgaacccttcttggtttgtataaccaattctacagaaaaagcttgggcacatcatcatcatccagtgatccaaattcacctccattactttcatacgatgatgaacgcagaattgacatgttcctcaaggaccaaatccccgtatggtttgctgtcattggctacgttgtgattgcagtagcctcaattgtgattgtcccccacattttcccacagctcaagtggtactacattgttgtgatctacatcattgcaccagcattagcattttgcaatgcatatgggtgtggactcacagattggtcccttgcatcaacctatggaaaattggccatcttcactattggtgcatgggctggtgcatctcagggtggtgtcattgctggtttggctgcatgtggagtcatgatgaacattgtgtccacagcatctgatctaacgcaagatttcaagacaggttacatgacattagcttcaccaaggtccatgtttttgagccaagttttaggaactgccatgggttgtgttatatctccttgtgttttttggcttttttacaaggcttttggcaacctagggattcctggctcagcatatcctgcaccttatgctcttgtttatcgcaacatggcgatacttggagtagatggcttctcagctttgccacaatattgtctcaccctttgttgtgtgttctttgtggcagcaataggtatcaatcttgttagagatttggttggagaaaaatgggccaagtttattcctgttcctatggctatggcaatacccttttatattggaagttactttgctattgatatgtgtgttggtagtttgatcttgtttatttggcagaggattgataaggttaatgctgacacatttggatcagctgtggcttctggtttgatttgtggggatggaatttggacacttcctagctcatttttggctctagcaggagtgaaaccacctatctgcatgaaatttttgtccagaggggtaaatacaaaggtggatggattcttagaatcttga

SEQ ID NO: 21806 - DNA, 219 bp, Glycine max
  Peptide Sequence Number=SeqID_138584
atgtgtgtgtgtgttaaggaacacggaaaccctaatagcttgatgggttaccacgaacctataacggtgaacaatcgagtgcagaccaagcacgaattcgatatcgcaatatgcaattggaaagaaaacccccaaatgatccacgaccacgccgacgagttgccgtggagaaagagaaagatatttttctttttgaatctagctcacttagacgtgtga

SEQ ID NO: 21807 - DNA, 3501 bp, Glycine max
  Peptide Sequence Number=SeqID_138585
atgaaactgcaggcacatattccgggggagatgtcaggacaggtacctaatcaagcagggtctcaattgtctggtctgacccaactgaatgggaatgcactacctcaccagatgccacctttagggggtgtaccgcgttcaacaattaatatggatccggattttcttagagctcgcacttttattcatgataagatctttgatatgttgttgcaacgacaacagcagccagttacagatgtacagagaaagaagcttaaggatcttgcaaaacgcttggaggagggcatgttaaaagctgctctctctaaggaggattatatgaacttggatacactggagagtcgtttatctaatttcctccgacgagcatctatgaataatcacaaccaacaatatccgcagcttgttaactcttccccaattggtacaatgataccaacccctggtatgtcacatgttccaaattcaaccatgatggttgcatcttctatggatgcctcaatgatttctgccagtgggtgtaatagcatagcatcaacatctttcaatagtgtaaacatgctaccagctggtggtatgcttggcagtaccttaaatagatttgatggtttgtctaatggttatcagcagtcttctaccagtttttctgttgcctcgggggggagcatttcatcaatggggttgcagagaattgctagccagatgattcccactcctggattcacagtcagcagtaatcactcacacatgaatatagattctaataatactaatggtggtgccttttccagtgtagagtctactatggtacccctgtctcagctacagcagcagaagcagcatgttggtggccaaaatagtcatatattgcagaaccttagcggccaaatgggtagtggaatgagatctggtttactacagaagccatttacaaactcaaatggtgctataaattgtgggtcaggcatgattggaaacaatatgcagcttgcaaatgaacctggcacttcttctgatagctatgcctcaacttatgctaattctcctaaacatttgcagcagcactttgatcaaaatcagaaaccagtagtgcagggtgatgggtatggaatgaataatgttgacaattttgcttctggaaacttttatgcatctgcgacatcctctgggtctatgatgaacaatcagaacactaattcagttaaattaccatcaatgcccaaaactagctcgttgataagtggctcgaatttgcacggtatgcagcaggctgctcatataaagtcccaaccaattaaccagctagaaaagtttaattttcagtcttcattgacttcaagagatggctttctgcattctcaacagcagtatcagcaaaggcctcaacaattgcaacagccagatcagtattcgcagcagcaatttcaatctatgcaaagtcaacagcctcagcatgtgatcaacagtgacacattcagtcagtctcagctatcttccaatatagaaaaccgagtgaagcctgaacctggaattgaacaccataaagtgcccaattctcatgtctctgaacagtttcacatatctgagatgcagagtcagttccagcagaactcatctgaagattgctctaggggtgctcaacatcttcaattcccatctggtcaccatgatttatcatcatcaacacctcaaaattcacaacaaatgttgcaccatcatcaattggttgcagagtctcaaaataatttcaacaaatctgtaattctaaaccaatggcctcaatcacaagattgtaaccacatacttgacagtatttcacatgatcaacatctccacatggattttcatcaaagaatatctgggcaagatgaagctcaatgcaataatttatcgtcagatggatctattattgatcgggctgttctttctagaggctcagctgagcagctggactgtggaattgctataaaaaaggcgcacaggaatcaacagaggtggcttttatttctacttcatgctcgacgttgttctgcccctgaaggacgatgcaaagaacggttttgttctagtgcacagaagttatgcaagcacatagagggatgcaccctgcgccattgtctatatcctcgttgccatcataccagggtgttgcttcatcattttatgaactgcaaggatccatgttgccctgtttgtgtttttgtgagaaagtatcgacgtgcatttcaactcaagcctcagattcggccagaagctgaatcaagcttgccaactgcagtgaatggatcctctaaaccttacaatattgtaggtgcatcgcctagattgatctcgaagcctcccttagttgttgaaacttcagaggacttgcacccatctataaagcgtataaagattgagcattgtgcccagcctattaatcctgaaaatgatcattctgcttcatcttttactgcaaattgtgaatctcttgtttccagggatgctcagtctcaacgccaagcttatcccaatgttgagaagtctatctcaatccaatctgagcttacagaagttaaggctgaagcttctgcacatgtggtacatgaaaaactcagtgagatgaaaatggataacagtaatgcagattataaaatgcctagtgccgaacctgtcaaatatgaggaacctcctaatttagctaggcctgaaaatatgaaaactgagaaagaaactggacaagacagacaagaaaatgttgtgcaggcatctgaaaatgcagctggaaccaaatctggcaagccaaaaataaaaggagtctcattaactgaattatttactccagagcaagtcagggaacatatcactggtctcaggcaatgggttggccagagcaagtcaaaagcagagaagaatcaagcaatggagcattcaatgagtgagaactcctgtcaattgtgtgctgttgagaagcttacctttgaaccaccgcctatttattgcacaacttgtggggttcgcattaaacgcaataatatgtattataccacgggcactggtgacacacgacattatttttgtcttccttgctataatgatgctcgtacagagaacatcattgttgatgggactcccattgccaagtcaagattggaaaagaagaagaatgatgaggaaactgaggaatggtgggttcaatgtgataagtgtgaagcatggcaacatcaaatttgtgccttatttaatggtagaagaaatgatggtggacaagctgaatatacttgccctaactgctatattctagaggtagaaagaggagagcgcaagcccttaccgcaaagtgctgttcttggagccaaggatttgccgagaactattcttagtgatcacatagaacagcgattatttaaacggctaaagcaagaaagactagaaagggcaaggcttcaaggaaaaagttatgatgaggatatgtacgtggaggtcatgtttagtgtgagaacacaaggtcggccttaa

SEQ ID NO: 21808 - DNA, 336 bp, Glycine max
  Peptide Sequence Number=SeqID_138586
atgcctcttgtgttgttttactcctttcctccaggttgggttggcacttggcagcgcagttgtggtggccagtcacagatggaagaacctggagggcagcgtgctctaatatttgatcaaggaaacagaatatcacagggcatcagctgtgctgatgtagctgatatatgtgtgaaggcactacatgatacaactgcaagaaacaaaagctttgatgtatgttacgagtatattgctgaggatggaagggagctttatgagctggttgcacacttgcccgacaaagcaaataactacttgacaccagcactctctgtcttagagaagaatacctga

SEQ ID NO: 21809 - DNA, 216 bp, Glycine max
  Peptide Sequence Number=SeqID_138587
atgacgttcaacaccataatgaggatggtgtcggggaagaggtaccatggtgaggattgtgatgtggagttagcaaggcaatttagagagatcattaacgagttgagactaaagaggctaagcaagagaactgatgcgttcttacatggactcattgaagaacattgtaatggaaagaataccgatcaaatcatcaaaggacttgctctctggtaa

SEQ ID NO: 21810 - DNA, 561 bp, Glycine max
  Peptide Sequence Number=SeqID_138588
atgtctagtgctagggaagccactggtagttatagcgtagctggttctatatctaggtattgcagttacgaagtgatcaagaatgctccgggaagtagaattgatgtggcagggaatcatggtgtttcaattgatggtaatcctagaaaaatcaagtgcaacgaatgtggtaaacttgaccctgcaagaaaggttaatgaaaaaattaaggggggaagaggagtggggactcaatacaccatcagtaacattttcaataatttgagggaggaagctagtcaagaaatttctctgttattttacaacaatgtcattcccttcaacgtgacaaagattgaagaatttgacaagaagttggaatttggttgttcaacatgggttagtgaagataacattgtcctagttgtcacagacaatgcagcaaattataaggcttctagagaaatcatgatggagaaaaggaagagattgcatatgacaccttttgcagctcattgtattgacttaatgttagaagatcttaagaagattccaattcacaaagagacagtagaaaggtag

SEQ ID NO: 21811 - DNA, 474 bp, Glycine max
  Peptide Sequence Number=SeqID_138589
atgatcccacattggtcctacaaggttgcaatcttacatgaacttgagctcagagatgcagaaaagataagacttaggcctgttgaaggaaatgcaacaatgaaacaggatttaagaagctttaagcttatattggaatatattaaagccttgcctgctaacgggtcaagccgaacttatataaaggccaggcccgggtctaaaaatagactcgtgacgggatttgagactgggcaagaaaccgattttgtattagtttcatgttctggactaggaattgagccttccaggcgggagcaggttcttaaagccaagagggctggtgaagattccttaagaagatctggccttggatacacaatagtccgtcctggtccattgcagggaatcccccgcctgatcttcctccagaggggagatgctgagagagttcccatcatcaccactgctaacttcactagcacaaaaggataa

SEQ ID NO: 21812 - DNA, 115 bp, Glycine max
  Peptide Sequence Number=SeqID_138590
atggttgggtcatcatcttcccattcactcacctctgaaacatcagcagtcacccgctcctgggtcttagaaaaactttgtaccccattgcccagaggctcttcgctatgcgaag

SEQ ID NO: 21813 - DNA, 219 bp, Glycine max
  Peptide Sequence Number=SeqID_138591
atggctatggcggatcatgtccacgtccaacatgatggtgacttgcctttcgagctgattttttggggaataggggtaccgataagggcatacattaatgaggggcagatgggtgggttcctggaaaatacctgcgtatcgttgaagaagacgatccagtgcagggtgggtgtgaatagtgggagtgggtgtgatgttggtagaggggggtgggggtag

SEQ ID NO: 21814 - DNA, 1521 bp, Glycine max
  Peptide Sequence Number=SeqID_138592
atgacataccaggagttgcttcttaaggtccaacaaagtcctgcggaccaccctggcttcactgttaatcagaattggttactattcaggggaaagatatggctccctgctggtcatgatctctccaaggtgctcctcgacgaatatcacctcaccctattaggcggtcacatgggtgtttcaaaaatgctccatcgtattcaacaacatttttggtggcccaacatgcgcaaagatatccgtcaatatatcgcggcgtgcattacttgccagcaaatcaagacggagacacgtaaacctgtaggccttttgcaaccattaccaactccttcatcactttggagtgacctatccatggactttatcacgggtttgtcggcttcgcaagggtacaccaccatcatggtcattgtcgaccgatactccgaaggcactcactttggaccattgccaacacactacactgcgcataaggttgctttaccattcatggatactatctgcaagcaccatggatttcccaacaacatcatttcagacagggatcccatcttcatcagtggattttggcgagagctttttcgtatcatcggaaccaagctacgtttcagtacaacataccatccgcaaacagacggccaaacggaagctattaactgtgttcttgaacagtatttacgtgcattcgtccatgatcatcctcagcaatggttcaagtttctgtcgctagctgaatggtcctataatacttccgtccacagtggtactggtttttcacccttcgagtatggaactccaccaccagctccgtctttctattctaccggaacttcaactgtggaagcagtaaacgctatacgcacttcgcgggatgtcattcaccaaaccctcacacacaggttacaaaagtaccaggcgtcaatgaaacacttagctgattcacacaggtgggatctcacctataacattggtgattgggtttacgtccgtttacacctttaccatcagacctcactccaaccagcctatactaagctctccaaaaggttctatggaccttataggattcaggcacgggtgggcaatgtcgcataccgcctggagctgccacccacttcgaagatccacccagtctttcatgtttcccttctaaaagcccatcatggtcccattccactgaacatacctactttgccaccatttagcactgctaatcatccaatagtacgcccactacaactgttggactggaaaatggatgagtccagtcggccacccactccacaggtcttggtccaatgggccaggttagcacttgaagatacctcctgggagtattggacacagcttaaagacatttatgaccttgaggacaaggtctgttttcagactgggggtattgatagcaattcaccactgcaacccattacgcaggagccacctatagataaataccaagggcccacacgcaaatctgcacacactcacacgaggcccacatacttgcataattacgagtga

SEQ ID NO: 21815 - DNA, 234 bp, Glycine max
  Peptide Sequence Number=SeqID_138593
atgacattgtggaggttcaccatggaagatacaaacataggattaaaaaagatcacaaccaacaacaagcacgaaaggctgaacctggaagagataagaagaatggtgagagactcaaagaggtacaaggcagaagatgaggtggcaaagaagaaggtaaaggtgaattacgcttatgaaatgagggagaaggcgaggaagattgaagaggcagtggaagaaacgatagagtga

SEQ ID NO: 21816 - DNA, 726 bp, Glycine max
  Peptide Sequence Number=SeqID_138594
atgtccataccacaagcagttgcgcttgccaagttgcaggaagaaaagattcaggaccgtcttcgccattcctgcacttcatataccccttctggtctactaccttcaccgccaccacccaccacggttccttccaccattaagcggctttccgcggaggaacttgttgtccgccgtgacaaggggttatgttatcattgtgatgagaagtggattctcagtcaccgttgccgccctcgcctccacttactcattgcagacgatgatgatgatgattgcacaaatcttccaccaactaacccacacttgcacaacgatgaccatggtgatcctctggaatcacttcagggtcctcagatcagcctcaacgctttggcgggaatgctgacacaggagacaatttgcctctatggaaccatagcacaccatcaggtaatcattctcatggatggcggcaacacccacaatttcatacagactcgcctcgcttccttcctccacccggctcaggttcccacggtggccatgcgagtcatgataggcaatggcagcaccattgattgcgacaccaagcatagtgctcggagttcagtggttgaaacagctaggtccggtcaccacggactattcctcgttgacaatgagcttcacgtacgagaaccaacccattacgctacgtgcagacgtacccatccatcccaacccagcttcgacctaacaggttaa

SEQ ID NO: 21817 - DNA, 801 bp, Glycine max
  Peptide Sequence Number=SeqID_138595
atgcctacgatagatgagctacttgatgagattggaacaacgtcgtggttctcgaagttggacctccatcaagggttccatcaaattcgaatgaatgaagaggacattcccaaaactgccttccgcacacaccatggtcattttgaattcaaggtgatgccatttggtttgacaaacgcgccctcgacatttcaggccaccatgaacgaccttctctggccgtttttgcgaaagttcgctgctatcttctttgatgacattctcgtctacagcccttcatttcatgcacaccttcaacacttgcaggccattttggatacgctcgcacagggctccttctatcttcgtcgttccaagtgtactttcgccgaacagcaactgaattatctcggccacatagtgtcctcacaaggtgttgctctagaccctgagaagattcacgcaatgaccgcttggcccacacctaccactccttcggacctcaggagttttctgggtctcacggggttctatcgtaagttcattcacaattatgtcagcactgctgctccgttaacgactttactctgtaaagacagcttcatgtggacgcctgaagctcacactgcattcccacatcggaaaactttaatgactcaggcccttattcttgcttcacctaacttcacggagccattcattttggaaaccgatgctttcagcaccgctatcggggcagtcctgctccagaagtcacgacctgttgcgttttttagcaagcaactgtgcccaaggatgcaacaggcttcgacttacgtctga

SEQ ID NO: 21818 - DNA, 309 bp, Glycine max
  Peptide Sequence Number=SeqID_138596
atgatgtgtaacacccttagaaccttaactattgtgttcactagagagggtgtaatggttgaagagatgtgtcttgactacatatttattgtaacagatagagtggcagccatagaaaatggtcttttctcacacaaagcaacacctctgtttgataagcttgcatttgagaagacacaacaagcactaggtggacatcttgaccatcactatcaccttgaggacaaggtgtttttcaatggcataggggatgttaggaagggaataatggctcaacaagatactacaagcaagcatagacacgaatga

SEQ ID NO: 21819 - DNA, 1464 bp, Glycine max
  Peptide Sequence Number=SeqID_138597
atgacgggggctgaaggcccaacctacacagtagatgatgctcttgtggctttgggttttggaaatttccaaattctcgtgcttgcttatgctggtgtaggttgggtttcagaagcaatggaaatgatgctactctcttttgtaggccctgcagttcaaactgcatggaatctttccgctcatgaagagagtttgataaccagtgtggtttttgctggcatgctaattggtgcatactcatggggcattgtttcagataaacatggaaggaggaaaggattccttatcacagcgacagttactgctttggctggttttcttagtgcatttgctcctaactatatatttttaattgtcctccgttctctggttgggattggtttgggaggtggccctgtattatcatcttggtttctagagtttgttcctgctcccaatagaggtacctggatggttgtcttttcagcattttggactcttggtacaatttttgaggcctcacttgcatggattgtgatgccaaaactgggttggagatggcttcttgcactgtcttctcttcccacgtctttccttcttctgttctacaaagtgactcctgagtcaccaagatacctatgtttgaaaggtagaacagctgatgcaattaatgttttggagaaaatagcaagagtaaatggaagagaacttccttccggtatccttgtttctgagcatgaaattgagttacacaaaattgataaccctacagaggacgcacgcttgctctcaccaagaacaaatgaagatgaacatcctaaaggaatagtttccaatttaggtgctatctcatcgttgttagtgcttctctcaccgaaattggcaaggtcaacccttctattatgggctgtgttctttggcaatgctttttcgtattatggccttgttttgttgaccactgagttaaacggacatagtaaatgcatgtcagataaattgcagacagagaagtcccaggatgttagatacaagagtgtttttattgctagttttgcagagctaccagggcttctcttgtcagctgcagcagtagataaactcggtcgtaaactctcaatgtcaatcatgttcttcatgtgctgtattttccttctcccattattattctatctgcctgaaggcctaacaacgagctttttatttctagctcgcatatgcatcacagcaaccttcacaattgtgtatatatatgcacccgagatgtacccaacatcagttagaacaactggtgtgggaattgcaagttcggtgggcagaattggtggaatgatatgtcctttggtagctgtgggtttagtacatggatgtcatcaaactgcagctgtccttctgtttgagatcgtatctcttgtttcaggaatatgtgtcatgttcttcccaattgaaaccatgggccaggaactgcgaaataatgtgcaagtctaa

SEQ ID NO: 21820 - DNA, 264 bp, Glycine max
  Peptide Sequence Number=SeqID_138598
atgaccaaggaggcaatagaaaaatcttgtccatattgtcaaggcaattgtaattgcaaatcatgtttacgtagaaaagatgtatatgtggattctggagatttaggagtgcctcaaaataaagatgaaaagattcgacatttgaagcatttggtgcgagcattgtatccttttctggaacaatttaatcatgagcagcagtcggaaatggagatggaagcaaaaactaaagcaagactggcatcagctgctattagtaattga

SEQ ID NO: 21821 - DNA, 465 bp, Glycine max
  Peptide Sequence Number=SeqID_138599
atggctcctgtcttgagagacctcattagcaatactcttaatattgtgcatgctcctagtcttgggaagtacctttgcctgaagttcattcatggacgttctaaaatagtggactttctccttgtggagcgcatccataacccttggcctcgtggaaggggaagcttcttaaccaagcaaagcatccagaaggcaattgtgtcctttcaagttgggtttggtgtgagattgggagatagtcaatctccactttggcatttagactaccttggtaggggtaacttagtctccaggttccttacattcatattcgtgactcgcgagctttggttgagagtgagtaatggtaatggtagtcttctatcccacacaaatttatttgcttggacccaggctgttctatctaataatgactgtgcttataaggttttggaggcttggtgggcgtggaagtggtgtaattag

SEQ ID NO: 21822 - DNA, 1082 bp, Glycine max
  Peptide Sequence Number=SeqID_138600
ttgtatcggtcttgagggttcaatttcctggcaagcatagcagatctgggttcttcaaggagtattgctgtcctgacacttggtgtgtagaagaagggctatcttcctttctaccttgccacatcatttcattcatgggggagtggattgttggagctttcatcaacctctttggtagtattgcaataaactttgggaccaatcttctcaaattagggcataatgagagagaaagacatttacttggaagtgatggggtaaatggaaagatgaatctgaagcctattatatacttccaaagttggagaattggcattgtatttttctttcttggaaattgccttaatttcatttcctttgggtatgctgctcagtcacttcttgcagcactaggatctgttcagtttgtatctaacattgccttcgcttactttgtcttgaacaaaatggtgacagtaaaggtactggttgcaacagctttcattgttcttgggaatgtttttctagtcgcttttggcaatcaccaatcacctggcggggagaacttctgtttgcagtatcaggacatgacctcagaccctattggagcatgctactgcccttttcatatgcttcagctacttcaacatgttgccatgcctcatgatacaatagccattgtgcctaatgtcaactttttggcagttctaacctattacgactggctatgtccaatggttatcagttgcacagctgataacatggactttcttctcaatctgtacaggatttatctattttcaagaatatcagaaacaccatggggcatgggttcaacatacaaaaccagacctagcctagataatcataaacaagcaaagaggacatttcagtttaagttcagcaacttcaaatcagaaacactgaaaaatagatgccagggagccagatacagaagagaattagagaacagagaacccagcagtcagcaaaagacagatgtaaaagagaaccacccagcaaactcagcaaacataagtgcagaagagaagaggaacaatgaaggagaagaagatagcatgcagcagtggtttcagctttag

SEQ ID NO: 21823 - DNA, 605 bp, Glycine max
  Peptide Sequence Number=SeqID_138601
atggaggcacattctccagttatagccaagaagctatggaatgtgttgaggatcactttcttcatgatcaggaagggtttggtgtcaaagaggaagctgattatggacatgaatttgatgatgaagaaagggaaattgctcagaaaatctatgagcaatttcatgtcatctcatcaccaccaccatcatcatcattcaaagagtttggcacgtggctatggcatgcaggaatatgaattctcatgcagcaacagcccaagtcctgtttttttccatgtgccaaagaagaagcaccatttcaacttcccttgcatgaataccacagaggttgttgaagagcctaggcccgtggttttggtgcctaatatgacacctgaatacactttcaaccataggtttgataatgcatctgattttgctcctggggagaggatctcacccttcactgtgaggatctccaactactcatctgaggatgaagaaaatgaacaagagggtggaaatggaaatgcccaagttgatgatcaggctgaggctttcatcagaaggttctatgaacagctgagaatgcaaagccgaatgcagttgctggagtaccaagagat

SEQ ID NO: 21824 - DNA, 261 bp, Glycine max
  Peptide Sequence Number=SeqID_138602
atggttcctcctgcatgcccctctcattttcaatttggtgaaaggtgtttagctcgtgcattaagaagggcagggttagggactgctatcgccactactcttttttgcatggagtctcgatgctacaattttgattttggagatcatatcatgcctaactcactaaatcctgcttgggaagctctttttttactaaccgcatgtatgatatctcgtgaaactgttgcacttctttgtgatcatcgaaagacgtccaaatga

SEQ ID NO: 21825 - DNA, 312 bp, Glycine max
  Peptide Sequence Number=SeqID_138603
atgggttctcctgcaccgaagggagactcctcatctacgccgccgcctaaaccaccaaatagactaccaaatgcgaattttatgaagccttccttcaaggaaaaagtggtgggacaaccgttggaacccaatgtggtccacaatcttgtagaagagacttttctaagactggaattaaaggaagaagcggacagagaaaaggttatgaacgatgcccttggatggtgtttgatcattacttcgcaagttcaaccctggtccccgaaattgtcagtagcggatgcaaccattgataaaacgcttgtatggtaa

SEQ ID NO: 21826 - DNA, 1075 bp, Glycine max
  Peptide Sequence Number=SeqID_138604
atggcgtcgtggtggtgctcctctccctccgccacactcaccgtcgccgccgccgctgccaccactgccacctgccactcctctctcattcctcacacttcccaatttcgcatccaaaccctcacattcccactttcttcctttcccctttccaccaccgcttcgtcttcgctccgatttaggcttccatgctccaacaaaaccgccttcgaaaccgagcttccggaggacggcgtggattgcgtgggaacaggccaagacgtggagtgcctcgttaataccgaagagaaacaatccgaaccaacatcatcatcatcatcatcatcgatgctgtgtctagcggaagcgttatgggaaggagcggtgttggtgtcgccgttcttcttctggggcacggccatggtggcgatgaaagaagttcttcccaaatgcggccctttcttcgtttccgcttttcgcctcattccggcgggctttcttctcgtcgcattcgccgcttccagaggtagatctctcccctctggcttcatcgcttggctttccatcaccctatttgctctcgtcgatgccacttgctttcagggttttcttgcggaagggttgcagaggacttcagctggtttgggcagcattataattgattcgcagcctttgactgtggctgtacttgcggctttgttatttggtgagtcaatcggagttgttggagcagctgggcttgtacttggtgtcataggacttgtactactcgagttaccagccctatcatttgatgaaagcaacttctcactatggggaagtggtgagtggtggatgcttcttgcagctcagagtatggcagttggcacggtcatggtccggtgggtctccaagtactctgatcctgtcatggcgactggatggcatatggttattggtggtctcccacttgtgctattcgcagttcttaacaatgaccctgcgttgagtttgagtcttaaagagtacagttcaactgatatattggcactcctctacacatccgtttttggaagcgcagtcagctatggtgtgttcttttatagtgcaactaaag

SEQ ID NO: 21827 - DNA, 114 bp, Glycine max
  Peptide Sequence Number=SeqID_138605
atggtgcaactagctggagttggtgccaattcaaccttggtcattgcatcaccaaatgcgaattttgactctttggtgctaaaagacagtggtaaagttcagatagcaccgtga

SEQ ID NO: 21828 - DNA, 2217 bp, Glycine max
  Peptide Sequence Number=SeqID_138606
atgggtgcatgcttgagtaagaagaaagggtcttctacagcaacaaccaaatcagctgcttcttccactgtgcctgagctgaagaataattctcctttttctgttagtggtgttgtcaatgtttccaaacccaatgtggaagaagtgaaactgaagaaggacaattcaaagaaagggaaagaagagaagaagcatgagacagtgccaccagaacctgaagggcatgtgaaaaaggagatattcatcatcaagcaccggaagaaccatgatgataataataatagagtcagaaacaattccaattccaagtccccacctttcactgaagaatcaacaatatgtgacaaaacagcacctacagcaaacatgggtggtggtggtggtggtgtaggagtgaggacttcaagctgtaccaaagaagaggtggatgcaattctcatccagtgtgggagacttagcagaagctcttcaggtaatgccattgctgctgaacataagagaaggtactcaggctcaaagagaagctacgattttgaccactgtgacaatgacactgtttccaatgatgatgactcaaagaaggtcaatgccaatgagagcaacagtgatctgtgtgaggaggagaggcaccagcaccagcaccggccacgccaccgccagtctccaagtccgaaccgaaggccctcttcttcttctcaggaaaggagaagaaggacaccaagcagggaaagagagcaacagcagcaaaggtcaagcagcagagaaaggagagttagtagatctcctggaagaagatcatcagagaacaccacaccttccaatgcaagaaacaacaatagcagcaacaacactagttctaggcctgggaagatggtttctgttcctgccactgtttcatcactggtgatggataagagtaataacaatggcagtggagaatctggagcaaccactggcatcaagaggatagcagtgaagagaaatgttggcgctgcctcgccgcgctcgcagtctcctgcaagagcaaatgggaatggagcaaatggtaataaagcattcagtgagaatcagcagcagccatcccttagccgcagcaattcaaggaaagcagaacaatctccttacaagagaaatccattgagtgagattgaacctaattcccttgcttttccacattcaacaaccaacaatagcagcagcagggtgcaaaacagacccaaaaaggaatttgaaacagaagctaatcagtgtttttccttacagcagaaaacaaatggcaacagaactgcatcagacaagggtgtgactataaattgcaagacaaaggttcaacaagaggaagatgtgaaagtgcagtcttcaattactgataatgttgttgtgaaaacaatggtacccccaggggttgacaacctaaaaccaccctatacattaacaagaagcagatcttcgaggcgatcgcaggagttagacatcaactgtgaagctctattgaatcctccaccacagtcctatgcttcactgctgcttgaagacatccagaacttccatcagaagaacacaccaccagtttctctcccggcttgtgtcaccaaagcttgctccatcctagaagccgttgctgatctcaactctaacgccggcttaaatttctgcagtggggaagacaggagaagtccactagcttttcaatgtagcaggaatgactacaatgttccattgactactaatgattatgggaagagggagccagatgccgaggaccctgttgtggaatcgatgttagtattcaatgatgatgatgtgatggaaccgaacttgcacaagtatgtgacagtgaatagaggtggttcacttggtggtgcggacatggatgaccaagagtcttcaggaagcaacagcttcactgtgagtagtggtcaacagcattggggtgtttcttcttcttcatgggaaccaagttcagttgaatcgaaagattgctggacttcgaggtcgaactactccaaagaggaatgtcagagaagtccattaggcttggaaggaacggtggcatctgaagtggcggggcgtgatgcgggtggagccaagaagaaattgaacagccaaaggagagagtgtgatcatcagcatggcagtggaatagggcgtggtaggcttggtgccaataaagttcttcacaacatacctgttgtcacagcagctgcatccacatag

SEQ ID NO: 21829 - DNA, 246 bp, Glycine max
  Peptide Sequence Number=SeqID_138607
atgcatgactgtcatagcagtcgaggaagacaagtgaggaacacaaaaatggttgctaaggagagcaaggaagttagggatttgaagaccaacaaagaaatcaacgacagtgatggtagatgcaaatctagcaaaacacttggcatcgaagctccatatcttgatctaaagaaggctggcccaaggtcaccgtgcaactcagacgtgatctacctgcttcctgatctcaaagcactcagagtttga

SEQ ID NO: 21830 - DNA, 1068 bp, Glycine max
  Peptide Sequence Number=SeqID_138608
atggagaagcttaacttggcactcgtttcttccccaaagcctttgatgttgggacatgttcctgcaagagacgttttcagaagaaaacacttctcttttgggagggtcttaattgctcctcaccgctgcagattccgtgtttctgcactctcttcctcccatcataaccccaaatctggtattcagtttttgaacttctttttattgttctgtttctatgaaaaaagattcattgaatcactggattctgatggagtcaatcaaatgaaatgtgtgtttttgaagttgaagagccatggatacacttggttgacaatttccaagggtttaagggagtgtttggataagcggttggtgaaaaaacgcactttttattacataaccctttttagggtcacctctcttctggattggtgttggtgttgggctttctgcactgttttcagtggtagcttcaagactgaaggactgggagcatggatcaagaggctgagattaagcctacaaagaaagtcttacaaatttattcataaatatgcaatgcaacaagctttcaagaccatgatgggtcagatgaattctcaaaataaccaatttggcaatgctgccttttctccgggatcaccttttccctttccaatgcctacagcagcagggcccactgcacctgctagttctgcaactactcaatctcgagcaccttcagcatctagtgcatctcaatccactatcacagtagatttacctgcagcaaaagtagaagctgctccaactactaatgttaaagatgaagtcgaactaaagaatgaacccaaaaaaattgcttttgtagatgtttctccagaagaaactgtgcgggagagtccttttgaaagttttaaagatgatgaatcaagttccgtcaaggaagcttgggttccagatgaagtttctcaaaatggagctccctctaacctaggttttggtgattttcctggttctcaatctacaaaaaaatcagccttgtcagtggatgctttggagaaaatgatggaggacccaacagtgcagaagatggtttatccgtaa

SEQ ID NO: 21831 - DNA, 228 bp, Glycine max
  Peptide Sequence Number=SeqID_138609
atgacaattcattcagatgtgcttcttaagttaaccatgtatattccggccacagtgactaaggccccaactagttgtaccggagagaaggaaataccaggggcaaaagttgtaaaaaggtcacttttcctccttaaggacttgaaattgcttgaaaatcctgagtctatcccattgtcaggcagccttacccaaaaattgaagcaaacattggggtcaaaaacgtaa

SEQ ID NO: 21832 - DNA, 765 bp, Glycine max
  Peptide Sequence Number=SeqID_138610
atgtcaacctccagtgtgcctcatgggaagctgatgaccctaatttttaggcactttggaatgcctctggatgatgaagctaagaatgataaggtgctgacttggggggagaaaaatgttacagctttgaagccttcatcccttccgattgatcttatcaaaagtgggaagaggttgaaggttagggttgggagatgccctcggtctaagtttgaggaggtaaaagaatcctcgaaaaaggaagaggaagaaaatgttattccttcttctgttgttgctgctaaagtttatgtcttagagaaggaggtctttaaacaaaatgaaaattttggtgatgaagaaaatgatctcaatatggagatcattactgatgtattaacagggctaaggactgtcgattctagcttggagaaggaagacactgagaaggaagaagacaaacaagaaaagtcttctaagaaagcaaacaaggttgaagttgcaacaaaaattgctcagattgtactagaagttgcagctggtgagagaactcctaatggatttgtgaaggattccttgttcaacattaacaatatgcaaaatcttttaagttctcccatctttgacacttatgttaaaattgcatgtggtcttggtcccttagatggtaaacccttaaccttttccattccctttccccaatttccttccgagtcaactactgttcaaccttctaaggttcaagaagaggttccatatgttcacgtttcctctcctccactatga

SEQ ID NO: 21833 - DNA, 168 bp, Glycine max
  Peptide Sequence Number=SeqID_138611
atgactgattctgacgccaatcacaatgacccatctctcgataccgatgctgaggcacccaatgaaccatttagaagagagggtaatacttcagggatggaattgaggtttggagtgcaaacaagcactgctttgcaggattgccaaatcgttgtctccaccacctaa

SEQ ID NO: 21834 - DNA, 520 bp, Glycine max
  Peptide Sequence Number=SeqID_138612
ctgtagtctcggtacttggacctcatctcctccatcagggcccagtagtgggcccggtagcaccgccccagctgcctcgttcgccgcagccgccgccggagcacctcctcccgcgtcagcacgcgcgacttcgccagcgccgtgtctccctcgccgccctcgatcgccaccggccgcggcggagaggacgcataaccccactcgtccatcggtgctgagtcgccaactcggaactgggtttctcgctggaactcggaagagttcgttacgattcaaaatattcgttcacataaacacaatgccccccggtcgttggaagatttggcataactatcgtcctagacatcatgacagtgaagtgaatcgaggggctggcgatgaagaagaagagttttttgaagatgaagaatgtaagggcatgatggttgctcttggtagtgatggaggctcttgttgcataagggaaacttcagggatcaaggcaagcttggtattgtcagagatagactcttcaagatga

SEQ ID NO: 21835 - DNA, 258 bp, Glycine max
  Peptide Sequence Number=SeqID_138613
atggctactccatcaaggtccaatagtggatctgcgagaaacccagttccgagttggcgactcagcaccgatggacgagtggggttatgcgtcctctccgccgcggccggtggcgatcgagggcggcgagggagacacggcgctggcgaagtcgcgcgtgctgacgcgggaggaggtgctccggcggcggctgcggcgaacgaggcagctggggcggtgctaccgggcccactactgggccctgatggaggagatgag

SEQ ID NO: 21836 - DNA, 1838 bp, Glycine max
  Peptide Sequence Number=SeqID_138614
gaaattttctaaactttatattgtgtatgccatcaaacaaggagaaagcagcactatggtcatgaaagtttcccttattttggtcctcctttcaattttctgtgtcactttcaaaccatacactgaagatgatgatcaaaattatcacaacaatgatccaactctcaccaacaaagaattttacaaaggagccaaaagttcagaatcaacaagattgaataaggaagaagatggagatgatgctacatcagcaaagcctgacaaaaggtcagcaaagttacaactaaggcgcaggccaatcaatcatgggaatgagcctaaaacacatgcactggactcagcaatcagggatttggtcagaattcagactcttcacagaaaaatcatagagaaaaaggacacaaaaagcatgtcaaggaagcaagaagtcaaagagagtatcaccatccagcaacagaacaacctagctaatgcttttgtagcatcattggaatcttccaaaggtgagttttcaggtaacatcatggcaaccttggaatctggggcctctcttggcacaggagagtatttcttagacatgtttgtaggtacccctcctaaacatgtttggttgatacttgacactggcagtgaccttagttggattcaatgtgatccttgttatgattgttttgaacaaaatggatctcactattatcccaaggactctagcacttatagaaacataagctgctacgatccccggtgtcaattggtttcttcgtcggaccctcttcagcattgcaaggctgaaaaccaaacatgtccttacttctatgactatgcagatggatcaaacacaacaggagattttgcatcagaaacatttactgtgaacctaacctggcctaatggaaaggaaaagttcaaacaggtggtagatgtgatgtttggttgtggtcattggaataaaggctttttttatggggcttctgggttgctaggacttgggagaggacctatctcctttccctcacagattcaatctatttatggtcactcattttcttattgtctcactgacctattcagcaacacaagtgttagcagcaaattgatctttggtgaggacaaggagctattgaacaaccacaacttgaacttcactacattgcttgcaggagaagaaaccccagatgaaacattttactatcttcagataaagtccattatggttggtggggaagtgcttgatatttctgaacaaacttggcattggtcatcagaaggtgctgctgctgatgctggtggtggcacaattattgattctggctctactttgactttttttcctgattcagcttatgatattatcaaagaagcctttgagaagaaaattaaactgcaacaaattgctgcagatgattttgttatgtctccatgttacaatgtgtcaggggcaatgatgcaagtggagcttcctgactttgggattcattttgcagatgggggtgtgtggaatttcccagcagagaactatttctaccaatatgaacctgatgaagttatttgtttggcaattatgaagactcctaatcattctcatctcacaattattggaaacttactacagcagaattttcacattctgtatgatgtaaaaaggtctaggctgggatattctcccaggaggtgtgctgagcgacttccttcaccactgtctccaatgagtagtgacgttcttcatcaccacttcaccaccgcattagtaccattgaagttattggcaggtttgcccatgtgcaataagagatggagccttaagtggaacaattggttaaggcctgatttcaagagag

SEQ ID NO: 21837 - DNA, 2373 bp, Glycine max
  Peptide Sequence Number=SeqID_138615
gatatgaagatcttcaaggataagaaatggcagccttggttcattataaatcaagcaaaaacaacatatgatattgctttctctcctccccccaatccaaaggctcaaaagcaaccgcttgcagtatctaggtcctcactagctgagaactcaatcaagttggacgtggatggcagttcgctaggcaacccagggaaggcgggtttcagcgaaatcctttgtgacaaccttggtcaatggctctcaagttttttgggtagttgtggttttgcaacctctcttaatgcagaattacatgtcttgtttcatggcctctctcttgcttggaactctggctacaagagtgtagaggaagccaacatttgtgcaaattggctttcgaagaagggttcatcctctacagaacctatgtctactttggttccttgtccaatttctttatcccctatgtcgttggttgatgctcttaggatattcatggcggcaacccaaccaccgcagggtccggatcgtaccaccgaagagataccggccgaaccagataacttgaaggagcagggtacaacaactataggtcattcaagggagaccacaagtcaatcaggatctttaggttcagttggagattgtcctctgtatcctcctaatgtgtatgctccccaagcccaggctttctactatagaggttttgacaatggcaatggtgaatgggatgaatattcttcatatgtcaattctgagggtttagacattggatctcctggtgtttacaatgaaaatccatctcttattttccattctgggtatggcttcaacccacaagtgccttatggaccatattccccagttaccacacctttgccttctgtaggtgtagacacacagttatactcccctcagcaatttccatacactgggccaccttattatcatcagctggttcctcctagcttaccatatcttaattcccctactccagtttcacagccagaactcaccaacctggtaggtattgaccaacaagttgataacatgttttttggaccaagagcgggctatccatcagtgggatcttttggtagaggcaactttcctgtagcgcctggttcctttggctttcatgaatcccaacaaggatttgaaggatcaagatctggtggaatctggtcagactgctcaaaaccatcagaaagacagagatctttgatgcccctatcgccatctgtttctccacagccaatgggctcacttgggtcatttgggcctagtgttggaatggcttctcatcaacagcaatcattgtatgggtttggatctggttcaaactcctatggtagaggatacctgcctaaccagggttctagctttggaggcacttccatttccaatcttaatgataggagttttgcttctcttgaaaatagcaggcggcaagggagaccaactgcttctctttgcaactgtaatggtactcttgatatccttagtgagcagaaccgaggaccaagggcctcgaagttgaaaaatcaaatttcaactgaaaataattctgtggatagtagtaaaaatagtgcatctactgccaagttccaaaatgaatcactcaatcggtcagattttgccacagattacaaggatgccaaattttttgtcatcaaatcttacagtgaagataatgttcacaagagcattaaatatggtgtctgggctagtacaccaaatggaaacagaaagttagatgatgcatatcgccaagcaatggagaagcaagatgcctgtcctatatttctctttttttcggtaaatgctagtgctcagttctgtggggtagctgaaatggttggacctgtcaattttgacaagagtgtggacttctggcagcaagataagtggagtgggcagtttcccttgaagtggcacataattaaagatgttccaaatagtcagtttcgtcacattattcttgaaaataatgataacaagcctgtgacaaacagtcgagatactcaggagggggttgaaatgttgaccatttttaaaaactatgaaactgatgtgtccatcctggatgattttgatttttatgaagaccggcagaaggctatgcaagaacggaaggcaaggcagcaaagcagcatggtggctactggattagttggagaaaatgagcatagaagttctgctaacactaccggtgatttcatgaagcagatgtcgaagagctttgctctagttgtccgcttagatgagaataacaaggaagttgttgcagatagagatagtttagtctctcatggtcatggccccattggtaatgtagttaaacctgatgatggtcaatcagtgactgcctcttcaactcaaaccagttag

SEQ ID NO: 21838 - DNA, 861 bp, Glycine max
  Peptide Sequence Number=SeqID_138616
atggcaggacaactccatcgcattcaacaaggggtggaattgattgtaggaaccccgggaaggctggttgatcttttaatgaagcatgagattgacttagatgatgtgatgacttttgttgtggatgaggtggactgtatgctgcaaaggggctttagagatcaggtcatgcagatatatagggctctgtcacaacctcaggtcttgatgtattctgcaacaatgtctaacgatttagagaaaatgattaacactctagcaaaaggtatggtggttatgtctattggagaacctaatacgccgaataaggctgtgaagcagctagctatttgggttgagtcaaagcaaaagaagcagaagctgtttgaaattttggcaagtaagaagcattttaagccacctgttgtagtatatgttggctccagacttggggcagatctcctggctaatgcaattacagttgccacaggaattaaagcagtttccattcatggggagaagtctatgaaggaaaggagagaaacaatgcagtcctttttggtgggtgaggtccccgtggttgtggctactggagttttgggtaggggggttgatctacttggtgtaagacaggtgattgtatttgacatgcctaataacattaaggagtatgtacatcagattggaagggcatctagaatgggggaggaaggtcaaggcatagtttttgtgaatgaggagaataagaatgtctttgcagaattaattgatgttctgaaatctggtggggcagctgtgcctcgggagcttgccaattcacggtatgccacaagagttttctctggtggcaagggttcaaagaagagaaagcatacaggatga

SEQ ID NO: 21839 - DNA, 1394 bp, Glycine max
  Peptide Sequence Number=SeqID_138617
gaggcaatgcgtcttttctagcgttgattcctaaagtaaatgacccacaaggcctcaatgattacagacctatctctttaataggctgtatctacaaaattgtggcaaagcttctgtctaacaggcttgagaaggtgctgcctggcatcattgatgaatgtcaatatgctttaaggagggcagccgaggggctagctagcttgatgagagaagcccaggaacagaagctctatgaaaggattaagatagggaaggatgaggtggacattagcttacttcaatatgctgatgatacaattttctttgggaaagcatccttggagaatgtaaaagcaatcaaggtcttgttgagaagctttgaattagtttccaggttgaggataacttttgctaaaagcaaattcagggcaattggcatgtcacatcattggattcaaaatgcggcaaattaccttagttgcaaagtgttggtcattcctttcttgtatttgggtatccctattggggcaaactcaaggtgtagcgtgatttgggaccctatagttgagagatgtgagagaaaactatcaaaatggaaccaaagacatctatcttttaggggaaggggtcccaaagaaggtggccatcaaattggtgaggctacagcgatggttcttaaggggtggaaattcagaccaaaggaaaattgcttgggaaaaatggaagacaattgtcttccaaaggagaaaggtgggttggagatgcgggatatagctaagttcaattgcgttcttcttaggaaatggcattggaaccttttccatcataagggagaattatgggcgagggttttggattccaaatacaggagctggagaagtctggatgaatcaagatcaaatacctctgattcaatctggtggtgggatttaagacatgtttgtaatgcttctggcgaggagggatggtttagaggcagtatagaatggaaaattggatgtggagcaaagtatatcttagcagcaacagaattcaattcagcagatggggatagcaacaatgggaggatgggaatggcacctagagtggagaggcgttttagggaagtggaggtggacacggttgcaaaattcatggaggatattcaggctgtgacaatgcaagttaatcagcaggatagttgggagtggaggttagattcttggggggtttacacagtggccagtgcttacaaagtttggaagctcaaaattccaagtaaggtgtctcatttcatttggagattaatccaggagagactaccaacaaaggttaatatgagaagaaggaatgtggagctgaatgatatcttgtgtcctttctgtagattgaatgaggaggaggagttggctcaaaaatttggaaaaaggatttga

SEQ ID NO: 21840 - DNA, 660 bp, Glycine max
  Peptide Sequence Number=SeqID_138618
atgacgatgagtgtattaaacatctatggctatggctatggtgttgtagctgttgttgtgttccttatattattgctttggcagcgtcacagatttttcttcgcttcatctccgtcgtctccatccacttcattactgctcttcgattctatcaattcaaactcaaactccagaagcagaacctcaaattttgtgacagatgcagatttgaaatttttaatggagattttggatgagaagctcggcagtgataaatgggaggatgttctagataaaagaaaccatcatctaagctacagtgtgaaatgctgcaggcctaagaatggtcccctgaaatatttgagcaagactgtgttcaatgacatttcatcagagatgctaagaaacttctacatggacaatgattacagaaagcagtgggataaaacactggttgagcataaacaactgcaggtagacaaatctgatggtactgaagttggtcatacaattaaaaagttccctcttttaaagcctagagaatatgtgctagcttggaagttgtgggaggggagtgataaaacattttactgttttatgaagaagctgttaaccattgcaaaacttggtttggtagaactttcgtatgccttgttgatattggcaaacagttcagcatga

SEQ ID NO: 21841 - DNA, 237 bp, Glycine max
  Peptide Sequence Number=SeqID_138619
atgcctctccactttatttttcttcctcattgtccttggagtttgttactgtttctcatttcactaagtttatgcatagaacaaggttatgttgaagaagccggttattgtcttttgaaagcaataaaagcagatcccaaagatgttacttttagaggtcatcttgcaaggcttttgataggtgttaagaaactaagctgctttcgagggtgccagtgccagtgcccccagagataa

SEQ ID NO: 21842 - DNA, 201 bp, Glycine max
  Peptide Sequence Number=SeqID_138620
atgacggttgccatcaaaattgttgttgaacattggagtacttttattgtggaaaatgattttaaattcatagccagtaatggattaaatgctaccagaattccaataggctggtggataacaagtgatccaaatccaccctggtcatatgttggaggttccttgcatgcactagacaatgccttcttgtgggcacagtaa

SEQ ID NO: 21843 - DNA, 345 bp, Glycine max
  Peptide Sequence Number=SeqID_138621
atgagcataagctgcgatagcagtgaaagattacctgactgtactgttgaactagatgaactaggattgcctatagaatgggttttctacaaagcttccaacagttctccttcatatgccaagtcttttttacctggtagcaatgcctgtgagatcacaatgtttcatcaagaagatgctggtttaaatacggagatggctaagctggcctttcgcaagggcatatggaactatgtatgtaagatggataacgcgcttagaagatactctgttataggctatcatttatcaagttcagttaccacttcaatcgatttaatgcagaaggggagtgtatcggattag

SEQ ID NO: 21844 - DNA, 717 bp, Glycine max
  Peptide Sequence Number=SeqID_138622
atgaaaaacaagccccaatcaaaagaggaggcagtcacggcgaaggtgagtgacagggacaacgacaaaggaaaaggcatagcaaaccagagaacaacaactactggaggcaggaattatgggacgaaaaaatggacaccgaagcctgcacatgcaaatagtataccatcttgttcgtctgtccaattaacgatacaattggataagaaaccatggctaaccaacacttgggtgggaagactgaagaacctagtaatgtttgataggctcaaagaagaatttatgtgggatagaggaatcgaaagcaacctatcaatgttccacacgctggagagatggagtccgtctttgagggctggtttcagactggcttgggtgatgtgctgggggattcctcttcatgcatgggatgcgaaaaatatcacaaagatcgagaacgggattggggaggtgatggacgttgatgaagatgaaggtcaggcggacggcaagtctccgatatcaaacactgtctcagatgctaagggagatgcaagggctgtgaactgtggaatgccccgttgggctgacactgcagaacagcaggagggggacatggaggatagcagacagcaaaatctggcagcagaaagtaaccatataggggaggcagatgcagtgctttcaaggagaggtgggaaccaattcaagagtgtgaaaaagacaaagcaggcttga

SEQ ID NO: 21845 - DNA, 555 bp, Glycine max
  Peptide Sequence Number=SeqID_138623
atggcaaaaaacataggagtcaatttcagcaaacaggatggaacaattataggaaaactgatcaacatggaagaaagggacaagggcataaatcaggggaagggaagcaatgagactaagaaggaagccattgacaaaactttatgtcaagctttgtggggagatgctgaaagtgatgcaactttcaaaatggaaaagaaggtgatgggcaatggtttcatatatttggaaggtacttgggttggtgatggtggaaaaaatgggggcagcataaaggaattcaatgactggattgttgacttagatgttgaggatgtacctagtgtgggcagaaaattcactttgtacagaccaaatgggacagcaaaaagcaaaattgatagggtccttgtctcagctgattggttttgcaaatggcaagacagtattcagattattttggatcgtaatttctctgatcattgtccaatcttgttacgatcctcttttgttgactggggacccaagccttttaggtttcttgactgttggctgcaagataaatctctcaggaag

SEQ ID NO: 21846 - DNA, 309 bp, Glycine max
  Peptide Sequence Number=SeqID_138624
atggttagggttgttcgtttgtggatggtatcaaatgttttaactaacaaacaaacatctaccatcgaaataccattatccatggagatggtgctggtggatccagtggaagataaagtgcatggttctgtcaagcggactctcatttataagtttgacaaaaccttgcaagaaagaaaagtgtactctattcaattttttgttgttgagaatggaggtattttgacaggtgttggaactgaaagagaaaatgaaagaaacggaaggagaacaaagatgaatgtaatccaaatagaagatgataggtaa

SEQ ID NO: 21847 - DNA, 348 bp, Glycine max
  Peptide Sequence Number=SeqID_138625
atgtccaaggtggtgctcattgtcttgtgggtgtcccgaaaatcttctctgcttcagaccagagcttcttcagaggaatcatcctcagtagatgccaatgagtgggatgctcttgaaaacaagtccacagtacttctttatggtggaggggctatagttgctatttggctatcgtcaattcttgtgagcgccatcaactcagttcccttgcttccaaagattatggagttggtagggcttggatacactggatggtttgtctaccgataccttctgtttaagtctagcaggaaggagctagctacagacattgaatcactgaagaagaaaattactggaactgaatag

SEQ ID NO: 21848 - DNA, 744 bp, Glycine max
  Peptide Sequence Number=SeqID_138626
atggtggcaagttacattgttaacattgtctttgtttttgtcatgtttggcatggaagtttcagttgttagattgcacagattctctttatggtcaagaggaatgaattatagtttcttcagtcttccgccgcggattctaccgcagcctaatgagaagagaataactattttgtttgaaaacttgggcaattggtcttctcattatttcaatgtgcctaactacacaatagtggctccagtttttggtgttatggcttacaattcttcagaaaaagtattggtagatgagaagattaactttaccacccatggtgaccccatcagaattcggtttccgcatgttggtcaacatgggaaaaatgacacaccaatttgtgccgagttcagtgctggtgagttggtgaaattcaaaaacatgactgagccatatgtctgtgaagtatatagccaagggcactacactcttgtagttccatcatttccttccccaaaagaacctaattcccggagccatagcaagagatttaccaaatggtgggtgttgggatttgtaataggttttgttgggttggtcatattggttttgatcttgctagctttagttaaggaggccaagaagagaagaataagaaaaatggagagaaattcagaagggggtgagctttttgatacattttggataggagaaactaaattgccatcagcttcaatgcttagaacccaaccaactcttgagaattaa

SEQ ID NO: 21849 - DNA, 327 bp, Glycine max
  Peptide Sequence Number=SeqID_138627
atgggtaccaccccaagccagaacatacaacaaatcaaaaaacgcaacccagattcaagacagatccaaataaaaaaggcaaacgcaagcctctgtcccttcctcttcgtgctccgcatctccgacgcgcccgaaatcgacgaggtagccattaaacgtgcagatctgcgagatctgaatggattcctctgttccaacgaatgtcatcagccgatgaaggccggcagtgccgtggtctatccggagtggagactggagacatggcgacggcaacgtggtatggttgcttacggtggagaggtgatggttcgcagtgatggcaaatag

SEQ ID NO: 21850 - DNA, 384 bp, Glycine max
  Peptide Sequence Number=SeqID_138628
atgtccaacaattctccgcgtcgccgccacaacaacctcctccaccttcgtcgcctccgtcagaggcatgaacaagcgggggttttggttgagaaaggtttgagttttgagcttaaggcgcatacgtttgtggcatttttcgaggtagcgcagaaggatgacatggcttggctcgttgaggacttctttgacaacgcgagcacattgcttataacgcttgttcttgatgcttttagcagtgatgaccggatcaagatgaatgttcacccagatgtccactttgaagaacttgcccggtccacagatgatttcaacagagcagatgcttctggaatggcagagtcactgaaagaacacaagttcccttctattgttgacccttga

SEQ ID NO: 21851 - DNA, 588 bp, Glycine max
  Peptide Sequence Number=SeqID_138629
atggcaaatagtagcctggacaagttcttatttggtgacaaaaaaggttccctcatctggaaacaaagagatattaagactgctaatatccttctagatgatgatcttcagcccaaaatagctgattttgggttggcaaggcttcttcctggagatcgttctcatgttagcacattgggatacacagcacctgagtatgcattgaatgtcctagaaatcatcagtggtcaaaagagaaccaatgtgactggcgatgaggatgatcgtgaataccttcttcaaagatcatggaaactgtatgagagaggctctcacttgcagctgttggaagaggacataaaccctaatgaatatgatgcagaagaagtgaagaaaatcatagaaattgctttactatgcactcaagcatcagctgcaatgaggccaacaatgtctgaagtagtattgctactcaaaagcaagagcttaatggagcacctgcaaccaactatgcctgtcgttattggaacgaatacgatgcctcgggaaggcaactctactacttcatcaaatgatattgcctcaatttctattccatcagcccgatga

SEQ ID NO: 21852 - DNA, 216 bp, Glycine max
  Peptide Sequence Number=SeqID_138630
atggcagcggcggcggcagtgacggtgctactcccacctaggattccgaccaccaccaacgttacccgctgctctgctttgccttctctccctcctcgcgtctccaacaccaaaaccactttgttctcaccttccctcaacaacttttcagagatgtcaaattttagtttcagaccggcaaagatcgctttcggccgaaatgcctcaggaaaatga

SEQ ID NO: 21853 - DNA, 360 bp, Glycine max
  Peptide Sequence Number=SeqID_138631
atgcaccacaaccacaaccttaaccttgcaaggttgtggattgctttgcttgcggtctcaaccaccgtagttcattgcaaaactgcctcccaagatgtttcagcccttaatgtgatgtatacaagcttaaattccccttcaaagctgagtggctggaaatcaagtggaggtgatccgtgtggcgactcctgggaaggaatcaaatgctcaggatcttctgtcacagaaattgatttgagcaacaacaacttcaagggtgatataccatatcaacttcctccaaatgctcgttatatgacggtcaagattcaagaatgtaatctgttaagaatttttcttcttctaggcaacctgcatttg

SEQ ID NO: 21854 - DNA, 918 bp, Glycine max
  Peptide Sequence Number=SeqID_138632
atgcttttattctaccaccatgacttgaaattctcgaatctttcctgggccagcccattgaggtttttctttttggaccggcccatatctcactatcactccactcttcctttctcttgccctacctcagaaacccacactccaaaaccaccaccttcccccgagagcacaatccgccaccaacccatcaccggaaccatgctccgcctcctaaagccgcaaccttttccctccgggcaccacctcatccaacgctgcgccgtgagcggcaccgcaaagggcaaagcgaagatcaaagcaggccaagcgctaaaacgctcccgcatcaccacgaagaaacccggatccgcgaccgcaggcccacccatgtcgcgtgagcgccaagaacgtgagcgcctctacgaacaatgccttcaagccccaacccctctccgccacctcacccaaaaggagcgcgaacgcgaagcggagcgcgagaaattgggcctcatcagcaaggatcggcagcgagaaatcgacatgatgaagcgaaaagacgacaaatttaaggtttcggagaagcccacgattattgggacacctgggttggattacgtgagtttaggtttggtggatgtggacaagttgccgaagtatgatttgacggtggaagatgggaggaggttggcgaaggagtatagtagggttttgatgaggaagcatagggcgagacaggctgcggagtccaatcttttgaggatgaagaaggaggctattgaggctttgcctgaggggttgagagaggctgctttggttcctgatttggctccttttccggttaaccggtttatggcgactcttacgccgcctattgagggttacattgagcaggttagggaggcggcgaataggatcagtggaaaggagaagattaggtga

SEQ ID NO: 21855 - DNA, 149 bp, Glycine max
  Peptide Sequence Number=SeqID_138633
atggctttccttaccatgttctccctgctagaaatcacaaatgctcgtgatttgtatggctatgtcactgatgatgctccatgtccctctccaaccactggtactggagatgctgtcacttccaatcatgctcatgttcactggaagcg

SEQ ID NO: 21856 - DNA, 1044 bp, Glycine max
  Peptide Sequence Number=SeqID_138634
atggattctacttcgattgacgtaaaggctttgcaaaaatctccatcagttagtgttaggtcatcagtctccgattgtgtgcaatcctttaatgacaacgagtttgcgaatcgtctaaattctaagagaagcacatcaatccgtgttactactttttcacatgcagagttacagtctgctactgctaattttgcttctggtcgacttcttggtgaaggatccataggatgtgtttatcgggctaaatatgctgatggaaaggtattggctgtaaaaaagatcaatccttcgcttttgcatggtggtccttccgaggaattctctcagattgtttcaaggatcagcaaacttcaccacccaaatattgttgagcttgtcggttattgttcggaaccggagcacatgttaatatatgattatttcagaaatggctccctccatgactttttacacttatcggacgacttcagcaaacccctaacttggaacaccagagtcagaattgcattgggagcagctcgggctgttgagtacctacatgaaatttgttcgcctcctttattgcacaagaatattaagtcttccaatattttgcttgacaccgatctgaatcctcgtctctcagactatggtttggaatccttctaccagcgtactggccaaaatcttggggcaggatataatgcaccagaatgcacaaaaccttcagcctatacccagaagagtgatgtatacagttttggagtagtgatgctggaacttttgacaggtcgaatgcctttagacagttcaaagacaaaagcagaacaaagcctggttcgttgggccactccacagcttcatgacattaatgcggtggaaaaaatggtggaccctgccttgcgggggctttaccctcctaagtcactcttccgatttgctgatattgtcgccctctgtgttcagtctgagcctgaatttcggccacctgtgtcagagttagttcaggctttggtgcgattagttcaacgttcaagtatgacaatgagggaggattttgagtga

SEQ ID NO: 21857 - DNA, 420 bp, Glycine max
  Peptide Sequence Number=SeqID_138635
atggcaaagtggctccctacacagctgaagatgtcctggagccggttcaccaacaagatcaccgacgagccgagaggagcgacgccgctcgccaccgccatcgaagctagagctagggcaaaagcgtccgtaggcacattgggaagtatctttgtgctgagtcttggaggaggaacaatcctagttgcaaattgcacagttgcttcgggttgggaaacatttaggttgtggaggataaacgaggatagttttagattgagggtgtttaacaaacagtttgttgggttagatgggattaacgttgttgctgtttccaatatttgcacttattctgagacatttcatatagttaaggaaggtgacaattcaagtcgaattcgaatcaaagcttctaatggatacttcttgcagagacaataa

SEQ ID NO: 21858 - DNA, 786 bp, Glycine max
  Peptide Sequence Number=SeqID_138636
atggattttatgactagattgcctaactctagtggatttactgttattatggtcgtgattgatagattgaaaaagtatagtctttttgttgcaatgaagtttgattacaccaacaatattgtggctaaagcttttatgtgccatatagttaagttacacggtgttcccaaaactctggtacaataccttttccatagtagtttaggaataacaccttttcaggctttgtatggaagggaacctccagctttacttagatacaatggcagctctcaagatccaccagcagtgttgaaagggaatttgatcaatgcacaaaccgctatgaaaattcaggcggataagaagaggcttgatagaaatttccaagtgggagatgaagtgctagtaaaactccaaccatatagacaacattctgcagccctaaggaagaaccagaaactatccatacgttattttgatccattcacggtgcttgagaaaattggcaaagtagcttataaattgcaattgcctgacaccacaaagattcaccctgttttccatgcttctcaactcaaacaattccaaagagcttccacagagccttatgtgtcactaccacttagcacatttgaattgggacccttattaggccctatggacattctcgaaacttggatcattgttaaaggatccactttaattcctcaagtactaattcaatggcaaggttgtagcacgatagaggcaacttgggaggatgttacaaaaattcaagccagttaccccataattcaaccttga

SEQ ID NO: 21859 - DNA, 663 bp, Glycine max
  Peptide Sequence Number=SeqID_138637
atggagttgcaggctaagacccaggagctggtgactgctgatgttttagaggtgagtgaatgggaagatgatgacccaaccatttttgtgatgacaatagctgcaaggttgcaaggggaattccaagtcacaaacgcaactgtgcaatttgcaactaggattgttcctcctccaagactcagcacaaagatacttcccaatgtgcctacggacgcttttgcctacacacataaattagtaagaaaccctagctctagcttcgatggcggtggcgagcggcgtcgctcctctcggctcgtcggtgatcttgttggtgaaccggctccaggacatcttcagctgtgtagggagccactttgccatcgacctcctgttggatcaagtggcctcagaataattaagaagttggatatcatggatagaggtactgatgcatggaatctattgctaggaaaagttattcccctccgacttggttatgttggtgttgtgaatcgtagtcaagaggctgtgttaccagggctgagagcacgtataagcgcttcactagtgactcttgcgaaagaacatgcaagctatggagaaatcacagagtccaaggcatgtgctggacagggtgctcttctccttaatattctttcaaaatactgtgatggtacttag

SEQ ID NO: 21860 - DNA, 651 bp, Glycine max
  Peptide Sequence Number=SeqID_138638
atggcgatctcggggaacgtgccaccgttgctagtgcagggagaaaaacaaaagaaggtaaagcttgatgatatgaagctttcaacatcagggttggggcagcagggacatgaaggaggggagaagaagtgtctgaattctgagctatggcatgcatgtgcggggcccctggtgtccctaccaactgcagggactcgtgtggtttacttccctcagggtcatagtgagcaggttgctgcaacaactaatagagaaattgatggacatattcccaattatcctagcttgccaccccagttgatttgccaacttcacaatattacaatgcatgcagatgttgaaacggatgaagtatatgctcaaatgacattgcagccattgactccgcaagagcagaaggatacatttcttcctatggaattgggcattcctagtaagcagccatcaaattatttttgcaagacgttaacagccagcgacaccagcacacatgggggattctctgttcctcgtcgtgcagctgagaaagttttccctccactggatttctcgcagcaaccgccggcacaggaactaattgctagggatctccatgatgttgaatggaaatttcgacatatttttcgaggtagtattctagttccttattga

SEQ ID NO: 21861 - DNA, 519 bp, Glycine max
  Peptide Sequence Number=SeqID_138639
atgcgtagtgattgcttagtgcaattctgcattgtcaatctttttcggagccccatgaattgcgttttcgttcatgtgtcctccacccaagcgtttgcagccatgcgtagtgattgcttagtgcaattcttcactgtcaatctttttcggagccccatgaattgcgttttcgttcatgtgtcctccaccttcgagtttggagccatgcgtagtgattgcttagtgcaattctccattgtcaatctttttcggagccccatgaattgcgttttcgttcatgtgtcctccacccacgggtttggagctatgcgtagtgattgcttagtgcaattcttcattgtcaatatttttcgaaaccaaatgaattgcgttttcgttcatgtgtcctccaccttcgagttgggagccatgggtagtgatagcttagtgcaattctccattcccaatcttttttcggagcgccatgcattgcgttttggttcatgtgtcctccaccgacgagtttggagccatgcgtag

SEQ ID NO: 21862 - DNA, 645 bp, Glycine max
  Peptide Sequence Number=SeqID_138640
atggaggccatgatgagtatgagaaaaatgatggaggttaacatggctacagtcgttgccgcaagtactgccattgaggtggacccgactcacccatacggcctcaatcaaggaggcgaagtgttaggaagtacgggcggtccccattttgtgcaaattcagaacaagcattccttgccaccatatggctttcctcccaactatacgccacccaatgttgcacacactcccgatgagaatgtcgacaactccacacccatgccccttgaaagccaacaaccccaatctgatcatgcacatgcctatcaacccctgggggagacacatgaagcaccccaagaccctattctagttgactttgagcctcacctcggatatgtcactaaggggcaggcgttttgtggcatacccctgccaaacactttggggggacctcagtatcgcccacaaccacaacccttgcattttgcaatgggaaaagtccctcttgctatgtggaaagagttgtgcctagtgcccaatgtggtcattcctctgaagttcaaggtgccggattttgataagtacaaggggactactttgccccaagaatcacctagtacacaaatctggaatcctcctgagtccattcctggaaggacctaa

SEQ ID NO: 21863 - DNA, 216 bp, Glycine max
  Peptide Sequence Number=SeqID_138641
atggccaaccagcaggcgaccaagtccaaagccaaagttttgcataaaatttcgaaatcatcattgttgtatgtgtgtcatggaaataaatgtgggacatcccctttatccctgaaccgctggccaaaccaacaccctgacatacatcatgtccggtcgttctgcaagccttttgacccaagacctcaaaccaccataaaccttgactcaggatga

SEQ ID NO: 21864 - DNA, 645 bp, Glycine max
  Peptide Sequence Number=SeqID_138642
atggcacttccaaggaaaaatgagtcctctagcatcccctccttcaacaacattgaagatacctcacaagctttccctgaagactggtttatccctgggaagtggataaactttcaaagcttaaaggaggaaggctttgacgtgaaaggactatttgacagggtgggctggacttctttcttggaaaatttcaacacttggcactatggcccctatgctctcttttgggaaactgctaggcaagatggagtcaacatcaaagggacttttgttaggactcaagtggtgatttcactaaccaccattattgttgtgtctacatgtgctttggatggtctgaccatgagcaaagattgggagaaggagataaccttggagactatggacaaactactttatggaaagcctcacccagatagaaatggtaataaggctctcaacaccttcttaaggatagctaacttaacctacttatgtaggatgatccacaatgtgttgttcaacacagtcatgcctagactacactcaaggcactatgtgagtgatagagaccatttctgcatctgcaagatcatggccttcaaggataggttcaacctcaaggtggagaaaaatcttattccttatggaatgctcttcacctag

SEQ ID NO: 21865 - DNA, 557 bp, Glycine max
  Peptide Sequence Number=SeqID_138643
atgcggctgagagaagcagcttttcgcatggaagatgtcatcgatgaatataacatctcctgtgaggataagcaacctgatgatcctcgatgtgcagctttactatgtgaggctgttgccttcatcaaaactcaaatccttctccttcaaagtgcgtataagattcaggatgttaaatcccttgttcgtgctgaaagagatggtttccaaacccattttcctttagagcaaagacaaaccagttctagaggaaatcaagatatcacatggcagaaacttagaagggatcctctctttattgaggaagatgaggttgtggggcttgatggccctagaggggtgggaaaaaccactcttgccaagcaagtttatgaccaggtgcgtaacaatttcgactgcaatgcgttgatcacagtttctcaatccttctcttctgaaggattgctgaggcatatgttgaatgagctttgcaaagaaaataaggaggaccctcccaaggatgtttctaccattgagtcgttgacagaagaagtcagaaaccgcttgcgcaacaagag

SEQ ID NO: 21866 - DNA, 156 bp, Glycine max
  Peptide Sequence Number=SeqID_138644
atggaaggtaagtttccggtgttgttttctcttaagtatcaaacgcagctctccttgaggtacggccttgatcacaggcttagcgtgagtttggtgctgagcaaaagttcacttactcgcgctaagcacgagaatggcgctaagcgcaacgtcgag

SEQ ID NO: 21867 - DNA, 351 bp, Glycine max
  Peptide Sequence Number=SeqID_138645
atgtgtgaatcagctgcacaaaaagactttcatccaaatggaactacaagtgaagatttagcaaagtgtttttccagtagagaaggaagtagatctaggctcgatgataacaccacatcgtaccttggtgggaactcaaaagtaggtaaggttcagagaattttgaatgttgaagaggaagttgggcagattagtcacataaagcacaaggcccatttgaaaatagagttaaaccatggagataaaaataataagtgggcctataacaacataacacagatagctacaatgaagtggtgggtcaacacaaatgtcctcctcatctggtcatgtagccataagcttgggtga

SEQ ID NO: 21868 - DNA, 300 bp, Glycine max
  Peptide Sequence Number=SeqID_138646
atgagaggcaccatgcataagtctcaagtgaacctaagggcagatcaaaagttcttacccggactcaaagtcctcgctttatctttcacaggactcaaagtcctcgctgtatctttcataggactcaaacagaatggagaaggagaaggattattggagacatcacttcaaggagaagatgagtctagaagaagctcaccaccaaaggaagccatggataagatcttgaaggtaggagaagatgggtggagggagagagagagaagaggcacgaaattttgtgcctcaaatgaggtctaa

SEQ ID NO: 21869 - DNA, 378 bp, Glycine max
  Peptide Sequence Number=SeqID_138647
atgcaaaagaatgcacatgcaaatgcatgtacctcagtcataacagttgattcattagaagatataaattgtgaatctccacaagcatctgattctaattctttctctgacgatgaaaattgcgaatccaatactaatgaagctgcaatcgatactgaaggctattctgacttgggtgatcaggccatggaatgtagacattgcaatgcaaaaatgtggaaatacaacaaagtccaaaattcaccttatgttgtggagatgggaaagttgagcttctgttattacaaattccaccgaaatatcttgaatgacttctgtttgatggtaaagcaagtgatagtaaaaattatcagtgtaacaaacggacatacaacatga

SEQ ID NO: 21870 - DNA, 795 bp, Glycine max
  Peptide Sequence Number=SeqID_138648
ggtggacccttgggtactagtacctaatgcctttagaggactacacatcctagactttagagggctacacgtcctcgccttcagaggactgcaggtcctcgcttttagagggctacatgtcctcgccttaagaaagctacacgtcctcaccttaagagggttgcacgtcctcgccttaagagggatacacgtcctcaccttcagaggactagggctacacatcctcgcctttagaggactacacgtctgcgactttagagggcaacacgtccttatcttcggaggactgcaggtcctcgcctttagagagctacacgtcctcgccttaagaaggctacgcatcctcgccttaagagggctgcatgtcctcaccttaagagggctgcatgtccttgcctttagaggattacatgtcctcgactttagagggctacacgtcctcgccttcagaggactacaggtcctcgccttcagagggctacacatcctcgccttaagagagctacacgtccttgccttaagagggttgcacgtcctcgccttaagagggctacacgtcctcaccttcagaggactaggactacacgtccgcgactttagagggctacacgtcctcgccttcagaggactgcatatcctcaccttcagaggactgcacgtcctcgccttcagaggactgtacgtcctcgccttcagagggcttcacgtcctcgcctttagaggactgcaggtcctcgccttcagagggttacaggtcctcgcttttagagggctgcatgtccttgccttcacagg

SEQ ID NO: 21871 - DNA, 609 bp, Glycine max
  Peptide Sequence Number=SeqID_138649
atgcctggcacttgtggacatcacttcattttggtcgccattgactacttcatcaaatgggttgaagtggcttcgtacgccagtgtgactaggagcatagtggtaaggttcataaagaaagaaataatctgccggtatggttttcctaggaagattatcaccgacaatgccaccaatctgaacaataaaatgatgaaggaaatgtgtgaggatttcaagatccaacatcacaattcttcaccttacaagcccaagatgaacgaggcagttgaggctgctaataagaacatcaagaaaatagttcagaagatgaccgtgtcatacaaggattggcacaagatgctcccttttgcgctgcacggttatcgaacctcggtacgcacatcaactggggcaacccctttctctttggtatacgggatagaggttgtgcttccatttgaagtagaggttccttcattgaggattctagccaaatcaagattggaggaattggaatgggctcgaactcgctttgatcagttgaatcttatagaaggtaagagattggccgccattagccatgagcaattgtatcaaagccgagtgaagaatgctttcgacaagaag

SEQ ID NO: 21872 - DNA, 540 bp, Glycine max
  Peptide Sequence Number=SeqID_138650
atgatgctcatccatgacgacctgccctatatggacaacgaagacctaccctatatggacaatgacgacctctaccacacaaagctaaccaaccataaggtctacgacgaggacgtggtagtcctcgccttcgcgttcaagcacgtggcagtgcccacgaagggtgtgttgtcgtcacacggacctctccgcaacccacttccagatccactcctcttcttgtgcaaccaacctttccagaacccgaaagacgcgccatttcccactgcttcgcctcccctgcccgttacgtcgtctaccacttcgtccctcacctctgccgcctcgccgccccctgctcctcccccgagctcctctccgcgctccaaggatccgacccgaaactcgtccccgtcttcatcaagggcactaggcttcctcgctcgccacgatttccgccacaacaattcacttcttcttccactcacacttcacgagatctacccagatctgcagatcgaaaatgctccttcacgcgatcaatacgagcgcgcactctga

SEQ ID NO: 21873 - DNA, 321 bp, Glycine max
  Peptide Sequence Number=SeqID_138651
atgaatgtgagtggaagaagaagtgaattgttgtggcggaaatcgtggcgagcgaggaagcctagtgcccttgatgaagacggggacgagtttcgggtcggatccttggagcgcggagaggagctcgggggaggagcagggggcggcgaggcggcagaggtgagggacgaagtggtagacgacgtaacgggcaggggaggcgaagcagtgggaaatggcgcgtctttcgggttctggaaaggttggttgcacaagaagaggagtggatctggaagtgggttgcggagaggtctcgtcgtagagaaagaggactcagattaa

SEQ ID NO: 21874 - DNA, 558 bp, Glycine max
  Peptide Sequence Number=SeqID_138652
atggcgaaacacgtcatgtcatcatcatgtcctaagaagtacgatattttcatcagcttcagaggtgaggacatccgcaccacgttcattggccatcttcgttctgctctctctggacccaacatcaaagcatacgcggatgaccatgaccttcaaaaaggacaagagatttggccgtcactgtgccaagcaatccaggactcacactttgccatcgtggtattctccgaaaactatgctgagtcaaaatggtgcttgaaagaactggtgcaaatactgcactgcagaaaaactcagggattggtagtcataccagtcttctaccaagtagatccatcccacataaggaagtgtactggcacttacggggaagcaatcgcaaaacacaaagacaaccaatccgtccaagactggaaagctgctctcactgaagctgccaatatatctggatgggacactcgtagccgtgacaacaagttttacttcttattgcaaaatcatcagtctttgagtcgagtctctctcagacagcgtgttgctagcattcctcttacataa

SEQ ID NO: 21875 - DNA, 2736 bp, Glycine max
  Peptide Sequence Number=SeqID_138653
atgggactaacatctttgtgtgataagcttctttctaagctacttaaggaaggccatcatgaatataatcttgcaggatctgaagaccttacgaggaggctcggcaataaaaaagttttgattgtacttgatgatgtggatagtttcagtcaattagatacgttgtatcaaccatgtaaatatgtaggtccaggtagtaaacttattataacaacaagagataggcatttgcttagaagaagagttgatgtcacacatgtctatgaggtcaagacatggagcattgctgaatctctagagctttttagtgtacatgccttcaatgaaagacgtcctaaaaagggatacgaggatctctcaaacagggcggtaaactgtgcaaggggagttccattagctttagaagttttgggttctaatctttattccagaactacagaattctgggatgatgaattgaacaaacttgagaactatcggaatgacaatattcaagatgtcttacaagtgagctatgatggattagacgacctagagaaggaaatatttctagacattgcattctttttcaaaggtgaacataaaaaagatgtcgtaagaatactagatgcttgtgatttctaccctactaggggattaaaggtcctcgaagataaagctcttataactatttcacattctgggatgatagaaatgcatgacttgatagaagaaatgggtttgaatatagttcgtggagaaagtaaagatcccagaaaccgtagtcgattgagtgatataaaagaagtttctgatgtacttgcaaataaaaagggaagtgatttaattgaagggataaaattagatttgtcttccattgaggatttacacttgaatgctgacacactcaacatgatgactaatttaagaattcttagattatacgttccttcaggtaagatatcaagaaatgtgcaccattctggtgtccctagtaaattgtctggtaaattgagatacctcgagtggaatggattccatttgaagtctcttccagtaactttttgtgctaagatgcttgttgagattcgaatgccgcacagccatgttacagaactttggcagggggtgcaggatgttgcgaatttagtgcgaattgacttaagtgaatgcaagcacttgaagaatcttccagatttgtctaaggcgtcaaaacttaaatgggtgaatctttctggttgtgaaagtttgtgtgatattcatccatctcttttttcttttgacacacttgaaactttgatgctggatggatgcaaaaagctcaagggtcttaaaagtgagaaacatttaacatctttgaggaagatcagtgtcgatggctgcactagtctcaaggaattctccttgtcatcggattcaatcacaagcttggatttaagcagcacaagaattggaatgttagactctacatttgagcgtctaacaagtcttgagtcactcagtgtacacggtttgagatatggtaatataccggatgagatattttccctaaaagatcttcgggagcttaagatttgtaattctagagtagcaattgacaaagagaagctacatgtgttatttgatgggtcaagatatctacgtctactacacttgaaggattgttgtaacttgtgtgagctccctgacaacatcggtggcttatcaaaattaaatgagctaagactagatggtagctgtgtgaagacattgccagctagcatcgagcatctcagaaaactgaaaactctgtccttagagaattgtagggagcttgggagtctaccaaagcttccaccatttatcacagagtttaatgccgcgaactgctggtcattgactacagtatcctctttaaactcttctgcattgggattgaaagggaagggcaaattcatttcattcaagaattgtggttggctggatgaaccttcacttcattgcattatggagggtgccctcgaattaaccgagcttgcgtcgtgtcaaaatgagattgtaaaaatcgtagatgaagccaacaccaaaaattgtaataataaatctgtgaaggtctgtttcccaggaagcaaagtcccaagccagttcaaacatcgaacaacagactcctcaatcactattggtcttccatgttaccgtaatggccgtgtgggattaactttgtgtgtggttctttcacgctcccgggttgctgctaaaatctggtgtcagtgctacttggcagatggcactaagttggaacccgccactacgtggtatcatgaagctgtcacggagttgaattctgatcatgtttttatttggtgtgattcaagcctgtttaacagcattttcgaatcgggtacaccattggttttctttgagttctttgttacaaatgataaggggaaacgcgtgaccatcgacaccccagagtgtggggtctgcgtaatgtttgattcaaaagccttaatggaagctgaagatgataacattgaaattgtgaccattacccgtcagtgtcgggcctgcctaatatttgaagcagaaaattttgtgcgcatttcttcacggtcagtggatgccgcggcatctggttttggtttggaatcaaaggcaactgaaacatatgatatgatgggaacgattgcaatgacaaacaacaatcatgagccagatttgagtgaacattgttcttgttcttgggactacttatttggtatggagtttactacttaa

SEQ ID NO: 21876 - DNA, 360 bp, Glycine max
  Peptide Sequence Number=SeqID_138654
atgtacaaaatgcaaaacgccagtgcagctccggcgggatatgcttctcggcgttcttcgctgtcattttcagcttcagtagagggctcttcccggaagcttctagaagttggtggaggcgctccacgcctgccctcctctcctgcgtgtccttcgcacatgacaattccagcgcttcctctccatttctttcttctatcaaatctgaaaaagagtgagccaccttctatagatcgttggtttgttggttgggtccagattgacgtcgccgaggtcaaggtcttcgtcgttgttgatgcatgtccatggcggtggcgaaatttttgggttctctctctgtgtgagtgtatgagtgattga

SEQ ID NO: 21877 - DNA, 153 bp, Glycine max
  Peptide Sequence Number=SeqID_138655
atggcacataagaaactacagtggcagttgcgggaaagcaatagcaatacacaaagacaaccaatcggtcaagactggaaagttgctctcaatatatctggatgggattctcgtaaccctcacatcaaggtccgtttggtggtaggaatatga

SEQ ID NO: 21878 - DNA, 2545 bp, Glycine max
  Peptide Sequence Number=SeqID_138656
atggcgaaacaaggcatgttgtcatcattgtgtcctagaaagtaccaagtttttattagcttcaggggtgaggatgtccgcaccagcttcattagccatcttcgttctgctctctcccgggacaacatcaaagcatacatggatgaccacaaccttcaaaaaggagacgagctttggccctcattgtgccaagcaattcaggattcagagcttgccatcgtcgtattctccgaacactatgctgcttcaaagtggtgcttgaatgagctggtggaaatactgcactgcagaaaatctcagggcctggcagtgatacccgtgttctacgaagtggatccatcacacataaggaagtatgatggcacttgcggtgaagcaatctcaaaatacgagacatattttggtgacaaagacaatgaatccatccaaaagtggaaagctgctctcgctgaagccgcccatatatctggatgggactctcatagccgtgaatacaagaatgactctcaactgatagagaaaatcgtggtagatgtatccgagaagttgagccaggggaccccttttaaactaaaagtagaagactttgttcaaattgaaaaacattgtggagaagtcaaattgttgctgtccaaaaaccaagatcagttacaaaagaatgttcatgtaattggaatttggggcatgggagggattggcaagacaactattgccaaagccttgttttctcaactctttccgcaatatgatgctgtctgcttcttaccaaatgttagagaggaatcaagaagaattggactaacatctttacgtcataagctactttctgacctacttaaggaaggtcatcatgagaggaggctcagcaataaaaaagttttgattgtacttgatgatgtggatagctttgatcaattagatgagttgtgtgaaccatgtaactatgtaggtccagatagtaaagttattataacaacaagaaataggcacttacttagaggaagagttgatgacagacatgtctatgaggtcaagacatggagctttgccgaatctctagagctttttagtttgcatgccttcaatgaaagacgtcctaaaaagggatacgaggatctctcaaacagggcggtgaactgtgcaaggggagttccattagctttaaaagttttgggttctaatctttattccagaagtataaaattctgggacggtgaattgagcaaacttgagaactatcggaatgacagtattcaagatgtgttacaagtgagctatgatggattacatgacctagagaagaaaatatttctagatattgcatttttttttaaaggtgaacataaagatgatgtcataagaatactagatgcctgtgatttctacgctaccagtggcatagaggtccttgaagacaaagctcttgtgactctttcaaattctgggatgatacaaatgcatgacttgatacaagaaatgggtttgaatatagttcgtgggggcagtgaagatccccgaaaccgtagtcgattgcgcgatatagaagaagtttcagatgtacttgaaaataaaaatggaagtgatttaattgaagggataaaattagatttgtcttcgattgaggatttacacttgaatgctgacacattcgacaggatgactaatttaagaattctaagattatacgtcccttctggtaagagatcaggaaacgtgcaccattctggcgtccttagtaaattgtctagtaaattgaggtatcttgagtggaatggatgtcgtttgaagtctcttccaaaatctttttgtggtaagatgcttgttgagatttgcatgccacacagccatgttacagaactttggcagggggtgcaggatcttgcaaatttagtgcgaattgacttaagtgaatgcaagcacttgaagaatgtcccagacttgtccaaggcgtcaaaacttaaatgggtgaatctttctggttgtgaaagtctgtgtgatattcatccatctgttttctctcttgacacactagaaacttcgacactggatggctgcaaaaatgtcaagagccttaaaagtgagaaacatttaagatctctgaaggagatcagtgtcattggctgcactagtctgaaggaattctgggtgtcatcggattcaatcaaaggcttggatttaagcagcacagggattgaaatgttggactcttcaatcgggcgtctaacaaagctccggtcactcaatgtagagggtttgagacatggtaatcttccaaatgagttattctccctaaaatgtcttcgggagcttaggatttgcaattgtagactagcaattgacaaagagaagctacatgtgttattcgacggctcaagatctctaagagtactacacttgaaggattgttgcaacctgagtgagctccctgaaaacatttggggcttatcaaaattacatgagctaagactagatggtagccgtgtgaagacactgccaactaccatcaagcatctcaagagactgaacactctgtcattaaagaatt

SEQ ID NO: 21879 - DNA, 339 bp, Glycine max
  Peptide Sequence Number=SeqID_138657
atggaggatgctcacttagcaaccaagagtatagtgcttaaaaatatgtttttgaaagagttgtttcgaggcacaaacaccagaattgataactatgactatgtgaaaaggcagttcaaatatcaaacaacaccatactccttagtcattgttgatcttccttcttcaaaatcagactttgtgggatttgttagaaatgatatgcttctttcaccctcccaagaaatgaagaacctttgtgttggcggtgttaaaatctggtgtcagtgctacatggtagatgatgcgaggttgggacccccgcaaccacatggcatcacgaagctgtcattgggttga

SEQ ID NO: 21880 - DNA, 464 bp, Glycine max
  Peptide Sequence Number=SeqID_138658
atgacactggtggaaccaaacgctcttatgagtgcacattctgcaaaagaggcttcacaaacgctcaggctttaggcggccatatgaacatccataggagagacagggccaaggccaagcaattcacacttgatgcttcaccttcagttaacaaattcaatagtaacaacaatgattccatggcccttccctttgtctcagaaattatgaaccaacccacaaggcctaattactcccctttggagtctcagatgaactttcatccaccacatgccttttattatgagttttgtaactcaaggtctcagcctttgagtttgaacaaccaagagcttcgggatgccaatttgagtctccaaattggttcaagtcatgttgatgataatatccatcaagttaggagaggaaatcagaaagagagtgaagtggacttggagctcagacttggccatgatccatactga

SEQ ID NO: 21881 - DNA, 123 bp, Glycine max
  Peptide Sequence Number=SeqID_138659
atggtggttcacatagctggtttgagtcgcttttcagattggagatgcaataactcgaaagtagccaggataatcacgacacgacgcgtggagaacaaagttcagacggcaggagacccttga

SEQ ID NO: 21882 - DNA, 363 bp, Glycine max
  Peptide Sequence Number=SeqID_138660
atggacaaagttgtcagagaaaatgaattgtttgagaagatgaaagtggaagctgagaagtgcttaacccagagtgaaagaattgccaatgagaggctggaatttgaatctgaaatctatgcaaagtttctgggggtcttaaattcaaaaaaatcaaaactaagagagcttcgagataagctggcaaaaccagagaatactgagaaatctcctgaagaggaagacacagacaaaaccgagagttttgatgaagaaagtgattttgacagaagtgatgaggatcctcaaaaggatatttctagttcttcaaaggatgttatggcaaataagccttcttgtccaaaaagaactagacgtaaatga

SEQ ID NO: 21883 - DNA, 405 bp, Glycine max
  Peptide Sequence Number=SeqID_138661
atgtatatcgggatagagagtgttacaagtgggactttaaatggtgaagattgtgctttctccgtggcattagcttatagggtgcttcataatatacagagaggagacttggagtcagatttgctagctaatgtgtggactttcccagtattgtcgaaggctaaactcctgatatggagactttgcctcaatggattacctacacttgataatcttcgaataagaaactgtattgatgtgaccaataatggtctattcccactgtgcggggctgttactgaaacagttgtgcatctcttcttaacatgctcgctagtggaaggagtttggaagcaatggatagagtggttggatatttggacagtgttcccggatgaggtggttcatatgcatattaaaatgtaa

SEQ ID NO: 21884 - DNA, 538 bp, Glycine max
  Peptide Sequence Number=SeqID_138662
atgtttcgacacgttaagaaactgcagtacacggtgcgcgtcagtgcgccgaacccgggcctggccaatctgctgttagagcagtttggcggtccgcagggcgaactggctgcggccatgcgctattttacccagggcctcggcgatgaggatttaggacgccgcgacctgctgatggatatcgctaccgaggagctcagccatcttgagattatcggctcgctggttggcatgctcaataaaggtgccaaaggcaagctggccgaaggcactgaagaggaaggcgaactgtatcgctcaatcacgggtgccggtaacgatagccatctgacttcgattctttatggcggtggtccaccgctgaccaactccggcggcgtgccgtggaccgcggcttacgtggatactatcggggaagtgacggccgatctgcgttcaaatatcgccgccgaagcgcgcgccaaaatcatctatgaacgcctgatcaacgtcactgacgatgtcggcgtgaaggatgcgttaggcttcctgatgacgc

SEQ ID NO: 21885 - DNA, 636 bp, Glycine max
  Peptide Sequence Number=SeqID_138663
atgcagccacaacattatggctcaaacctaaaccaacccaaaaaaatttctgctccatttgaccccgcaggatataattattgggattacatcgacgcctggaccaatgtgttctggcatcaaaatagtaaattcaagcattcatggctaatttactttaaaaataatactgtgtataattttccaaattggttcctccaatggtggaactacttcagaccaattccacagatattcccagaagaagtccaacagggattccaacaattcaacaagctctataatggcaaggaatcacatacggaaaaactgaaacagcaagcaatatccaccgctgctccagatcaagtcaagaactggttccagagcaatcctgagttccttaaacctgctgatccagagacgtctctattcctgaatcagaagtcgcaactggcagcattcttagcaagctcaaaatctaaagagagtcttgctcagaatctcaaagaagttctccaactacttcaacaggaagtggaagaagaaccttccaagaaggaagctgaatcatcagagactaatgatgaccaagaagacgatccattctaccaaaatgaagatgattgtttcggtatatcattagacgatgattaa

SEQ ID NO: 21886 - DNA, 816 bp, Glycine max
  Peptide Sequence Number=SeqID_138664
atgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacagattcattctataagaaaaaagatagattcaaatagaataaatagagaatataagcgggtagcgggaatcgaacccgcatcgttagcttggaaggctaggggttatagtcgacgttga

SEQ ID NO: 21887 - DNA, 357 bp, Glycine max
  Peptide Sequence Number=SeqID_138665
gggggaagttttgggtgaagaaaacgttctcctccccctcttttaacccatctcgtgtaggggttgctcgcccaggcgagctaacctgtacttatttttttagggaagatataagtatggctctttacgggatactaggttgccttgcagcggtgcttcccgtttgtccagggctgggcaagggacaacaatctatcggtcgtgaccctagcctttacatgcgtccgtccctaacttcatcccggcatctgaccactgcctacgatgattctgcccctgttatcacaaaatatgcatgcatatgcgtatgcacgagtgttttcaaatacaacaatctttttagtgaaagccggtcag

SEQ ID NO: 21888 - DNA, 369 bp, Glycine max
  Peptide Sequence Number=SeqID_138666
atggaagaaagtgtggaagtaccatatcctgtggtgccttccaagaaagaaaaagatcgtcatttggcaaggcttttggatattttcaggaaactggaaataaccatgcccttaggcgaagctctgcagcagatgccactctactctaaatttttgaaagatatgttgacaaggaagcataggtacattcatcaggaaaacatcataattgacgaaaattgtagtgttgtaatccaaaagatccttccacctaagcacaaagatcctgggagtgtaaccattccttgttcaataggagaagtcaatgtgagaaagactctgattgatctgggagccagcattaatttgatgccactctccatgtgttga

SEQ ID NO: 21889 - DNA, 219 bp, Glycine max
  Peptide Sequence Number=SeqID_138667
atgtttaatagtggaggacctattgtaatagatgatataccgaggccggttggaagtcggagcataatcgtcttaggcgatggtcaaatactgggccaaatccaaaggcagagacaaatcgagggacggatgcgagtagaggctaggcccatgatcgatggatcgtcgtcccatgcccagctccggacaagcgggaaacgcagctgggaggcagcctag

SEQ ID NO: 21890 - DNA, 348 bp, Glycine max
  Peptide Sequence Number=SeqID_138668
atggagagagaaaaaggaatcgcacatagacagtatatatggaggcttcaatcccttctccgtctctctgacgtttgggaactctatcggagcagtcggaggaaaaattggaggaatctcagggaaccgccagagatgccgctatcgctgtcagaagacacgggatttagtccccaggagggaaaggctctaatggactcttcagagtgtaggccttgggggtcacccggtttgagtgctcctttaagcctgtaccaatcccatatggttggagcattctcgcaaaacactgtgacgctgactggtctccctatgatattacctagtgagagtgacttgacttgctag

SEQ ID NO: 21891 - DNA, 417 bp, Glycine max
  Peptide Sequence Number=SeqID_138669
atggccactactgcaaagacatggacttccaaaagggctatacctcgactcaagaagcacccagtgctgaaggagaagtgctcacctcccctgatcacgcttctaagatacacgtgggctgacagagaggtaggtacctacttctcccaatacaaccacgagttggacctagtcaacctcttgagttggttgtcgattagtataataacagatccagagctatgctcgatcagtctctgcatcatccggacaaatgccacttcgtccacagagtttgtgttcatgaatcgagaagggatgaacagggatttcttttacatgtatgattgcttgtttcattatctgcatgtaagggtcccgtttgatgacttcacaatcagcgtgcttcgcatacttaacgtggctttgcatacttga

SEQ ID NO: 21892 - DNA, 411 bp, Glycine max
  Peptide Sequence Number=SeqID_138670
atgtacccttccttgttctctttgaacaacctagtggatgtaccctccactagaactgatccacaagagatgtaccctctcttattctcagtcacaacaacccaagtagatgtaccctctacttgtaccacaaaggatgtaccctccaatgtgttaagacaaagttctcaggcggttagtccttcgaaactttgtgaaggggaaacaaaagaattctcaggcgggagaagagagacacaaaaagaattcaggcggttagtccttggcgaattctttttggcaaagggagaagagaataaaagatatagcacacttctgttttcaaggtttggaaaaccagaaaactttagaaagcttttgcaaaggaagaagaagaagaagaagaagttcaaagagattcaaaagttgtaa

SEQ ID NO: 21893 - DNA, 768 bp, Glycine max
  Peptide Sequence Number=SeqID_138671
atggtgatttcttactctgattttgctaccaatccctctaatccatactacatgcatccgaatgagaatccttctcttattctcattcaacctatgcttgataacaaaaactaccagatctggtgcagatcgatgaaggtggctcttatctctaagaacaaggtcaaatttgttgatggcactctttcccctccccctatctctgatcctctctatgaaccctggcttcgttgtaataacctcgttctctcatggcttcaacgttcaatctctgaagaaatcgcgaaatctctcctctggtgtgatcgcacttctcttgtatggaaaagtttggagaatcgattctctcagggtgatatttttcgcgttgctgatattcaagaggaagaagaaattgagaattttcgtccaattcgtgattgtacttgtgctataccgtgttcttgtggtgctgctatagatttacgcaaattcaaggagcaagataagattatgctgatgtctccacttccaaccctagacaatgcgttcaatttgattcttcaacaagaacgccagttccatcttccttcaaccactgattcttcaattgagaatcaatcgttggtgaatcacttctcccaaacgccttctcgtccttctaataatttcggtcgtggtcgtggtcgtggatattcctccggtggccgtggcaaccggctatgcactcactgtaatcacaccaatcatactgttgagctatatagggaagggttctcctcactatga

SEQ ID NO: 21894 - DNA, 840 bp, Glycine max
  Peptide Sequence Number=SeqID_138672
atggtagcattatgtgtagcgattgcacttgtattgttaagggtgatcttagcattgacagtgttcaaaccaaggcaccccattaccaatgtggattcaataaggcttcagaacatgagcttgggcatggacatgtttagcatgagtgtaaatgtgaacttcacattggaagtggatgttttagtcaacaaccctaataagcttggattcaattactacaatagctctgcccaactcaattatagaacacaattgattggggaagctcctatccccaatggagacatattagttgaggagattaagggacttaacttgacactcactgttatggctgatcgtttggtctccaattctaaggtcaccaaggatgttgcattgggttcattgcccctcaacaccttagccaggccatgccattccgccgccacgggacttggcaaaaactcagccatgcgaggtgagccaaacccagccatgttattcaatacaaaaagatgcagagaagacagagtcacgaaaaataaggttgcagaaaaatacatgggtacagtggcgaggtatcacgatggtgataagattgtagagagagatagagtcacgaagacgaagcttagacggagaagaagagagtgcaaggaaaatagggctcgcggaggagttgcagcgtttgcggaggaagtgagagcgttgggtgagagggatgacagtgagaatgggcacaagaagaggggtaattcttgtgccgacttccttgctaaacttggcgctgcattggatgatgctttgtgcatccttgaagttgttccagggggtttgataattttttttggtggctga

SEQ ID NO: 21895 - DNA, 744 bp, Glycine max
  Peptide Sequence Number=SeqID_138673
atggcaatttcccttcgtatggttgtggctgttctagggaatgttgcctcaatgtctctttatgctgcaccatcggttaccttcaaaagggtcataaggaaaaaaagcacggaggagttttcatcaattccatacatcatagcactgctgaatagcctcctctacacttggtatggattgccaatcataagcaacaagtgggaaaatttccctcttgtcacagtcaatggagctggaattccttttgagctatcatatgtgaaggtggccataacaacagtgacaattcttgcagtgttctgtttcattgcttttgtatcagctttcgccatccccggtcatcgttaccgaaagcttctcgtcggtagcatcggcttggcggtctcaatagcactgtatgcgtcccctttggttgcaatgaagaaagtgatacaaaccaagagtgtggaattcatgccattgcctttatctttgagctccttgttggccagtttgctgtggatgacttatggactcctcattggcgatattttcgttgcggggccaaatgtggttggaactccattgggaatactccagatcgttctttactgcaaatactggaagaagatagtgacggaagagcctaacaaggtggaattgcaaaaggggaacacagagaaagtggacttggaaattgggcaaggaaaaaaagaatgtgtcacagttcctagtaactgtaactcgagacccatgacaacctag

SEQ ID NO: 21896 - DNA, 409 bp, Glycine max
  Peptide Sequence Number=SeqID_138674
atgtatcagtttgcagggatcacgcctcctcgacacccagtggacccggagaggtccaacaaggccctggggtttcctactttgatcataggcctgtgccaattctatggagtgccggtcaaccccagcaagcttattgggcctcccatcagtagagccttcattgagaaatactacatgcctaggcaggcacagatagaactccagatgcatccatacatgcagcatgtgactagccagcagacggctaatcacaagggttcggggccacagttgcctggcccggagatgaggccgattttgagacacaggcaggacttgcagggacccctggggatgatgaaggagcttaggaggatgacgatatggtcgacgtgctggatttcttcacttgaggaggcagagtcgg

SEQ ID NO: 21897 - DNA, 459 bp, Glycine max
  Peptide Sequence Number=SeqID_138675
atggtcactggggagaatgttgctaagcagcaacgtcatccaaatcgatgtgagggtggtcatgctggtggacatgatccgcacccgtctccccgctatgctctgggaaatgtcctgccccagaatgtacaacaactagctgatagcctcctcatcaaagcccaaggtctgactcctcctctagctaaactcacagtgctagccctcttccaagaccagtggatgccccagaaactaattaatggcatccttatcgaagaggatccactggcctctcacccaggagcgtttgtctttaactccctcctctgtaggccatgcattgtcataaaacttgatacaatcctccctaggaagggaccagtcactagagccatgagcaagagtctacaagaggattgggctagagctgctgaagaaggccctagggttctcatgaacctcagggtagatttctga

SEQ ID NO: 21898 - DNA, 171 bp, Glycine max
  Peptide Sequence Number=SeqID_138676
atgttgctaagttgcaacgtcatccatatttgtgtaatagtggttatgttggtgcgcatgatccacactcatttctttgcagcggcacgggtgaaatcttgccccggtggccctcctccaagatcagggggtggcccaagaactgataaaaggaaactattggccctttaa

SEQ ID NO: 21899 - DNA, 458 bp, Glycine max
  Peptide Sequence Number=SeqID_138677
cttgggtactagtacctatcgcctttagaggactatacgtcctcaccttcagaggactacacgtcctcaccttcagagggcttcacaccctcgccttcagaggactacacgtcctctccgtcagaggactatacgtcctcaccttcagaggactacacgtcctcaccttcagagggcttcacaccctcgccttcagaggactacacgtcctctccgtcagaggactatacgtcctcaccttcagagggctacacgtcctcaccttcagagggcttcacgccctcgttttcagaggactaaacgtcctcgctgtcagaggactatacgttctcaccttcagaggactacacgtcctcgccttcagagggcttcacgccctcgccttcagaggactacacgtcctcgccttcagagggctacacactctcgccttcagtgtactccacatccgcacctga

SEQ ID NO: 21900 - DNA, 669 bp, Glycine max
  Peptide Sequence Number=SeqID_138678
atggcttccaagaagcgtaagagcattggggcaaggccaactgctcagtatgacactagacggttccattcgcttgatgcttggaaccgttatatagataacgtcttaggaaggagcattttgccagagaggaagctagagatataccaaacagagtttgatgacttcaagacagagttggagaggcataatcttcacaaacgcctcaccaacttggcagatgggactattggtgttgctttgcaagccagagttagaggccacttggtgaagatagatgccgacaacctcaacacatttctggagactcctgtagtcctagaggagggggagacattacccacctactctaggtactgcaggttaccatcagaccacagagagattgaggttgctctttgcatagcagggataaggttcattttaaatgctgagggccatccggggaggattcttaggaaggatgtgactaccttggcccaggtgtggactgttctctattactccaacctggcccctacatctcatacatcagaccttactgtagacagagctaggttgatctttggcctggtctctcatatggacatgaacatcggcgctctcatctcaggacagatgacttccattgcccagtctaactcttgcagacttgggtttctactttga

SEQ ID NO: 21901 - DNA, 264 bp, Glycine max
  Peptide Sequence Number=SeqID_138679
atggatagcataaacattccttcatgcattcatcatatttcctctatgatagggtgtctaagtattgctcagcagatttccgtggaagccatcgcatccctcactcagtactatgaccagccactaaggtgcttcacagttggggactttcatgatgcaatcctccctaggaagggaccagtcactagagccatgagcaaaaggctccaagaggattgggctagagctgctgaagaaggccctagggttctcatgaatctcagg

SEQ ID NO: 21902 - DNA, 228 bp, Glycine max
  Peptide Sequence Number=SeqID_138680
atggcggtagggactaccagtgacaacgtatcatcaaagataaaaactctagatgaggtttcacagccatcaagcaagtcggagacccagcatgaccacagatcaacctctacttcctatatttccacggacccgggtatagggcccaatacctcaccgtatgtgcaaagagcatggcccttactcttacgtatcctcaagtgcgatgaggaactcagacctacgtag

SEQ ID NO: 21903 - DNA, 240 bp, Glycine max
  Peptide Sequence Number=SeqID_138681
atggtttttcacttaaggcttgtaatgagcttcaaatcaaagaaaggggaacataggctcaaaggggctatcaaaggcattaattcaaggaagcatcaacaagaatcaagccaaggctattgtgcaagcaatcaatggggcaaaacacaccaaaagattatgatgatggatggctcaaattctcacaaagctccacttatcactttcaaattaagctttcaaaactatcatgacatgtag

SEQ ID NO: 21904 - DNA, 516 bp, Glycine max
  Peptide Sequence Number=SeqID_138682
atgaaccagattcttaacgccacttaccgctacaccgatgacccgcgccgcggctacagcggcaccagtccgcaggcgcgcaacggcttcgcggaaatcgctattgacggccagccgccgtacaccgtcaaggtcgacgcagagggccgctggagctggacgccgcccgccgactggacgccaggcgaacacatcgtgtcggtgcgcatgattgacgccgccggcaacatcggtgaccccgctcagttcattcaggtggtcgactacacggcgccggacgcgccgcgcctgctcaatatgtacgatgaccagggcgacatcaccggcagcttcgacgccggacgcatgaccgacgaccgtcgcccgaccctgaccggcgtcgccgaaaagggcaccgtggtatacctgaaagagggcgatacggtgatcggcagcgcgcaggccgacgccaaaaccggcatctggacgctggagccggacgccgacctgagcgacggcacccaccagctgacgctg

SEQ ID NO: 21905 - DNA, 111 bp, Glycine max
  Peptide Sequence Number=SeqID_138683
atgagtgaagatgctcatatgagtgaaccccgtgacccatcagttctaacttcatttgcggagcatgtcgcacatgccatttggacgggacaagtaacgttctgctgttga

SEQ ID NO: 21906 - DNA, 388 bp, Glycine max
  Peptide Sequence Number=SeqID_138684
atggaactgttcaattatgaagaggtgaaatacctcgagcgcgacaccaacacccccacgttttttggctatgcaaattcagaaattggtaagggcggcaccatgctgattaccgtcggcaaagagaccttttcggtagatatcgaccctgccaacggctactggagctggacacctgcaacaccgctggaggatggttactacaacatgtcttttcagtcggttgataaggctggcaacgtcagtacacccagtctgcgtacgctgattgttgataccacaccgccagcagcgccgacgctgctgaacatgtacgacgatcagggtgacatcaccggcagcttcgattctggcaaaatgaccgacgaccgccgccccaccctgaccg

SEQ ID NO: 21907 - DNA, 659 bp, Glycine max
  Peptide Sequence Number=SeqID_138685
gactacacgtcctcgccttgagagggctactcgcccttgccttggggctacactccctcacctttagaggaccacacgtccccaccttcagagggctgcgcaccctcgccatcagaggactgcatgtcctcaccttcgtagggctacacgccctcacctttagaggactacacgtcctcgccaacagagggcgacacgccttcacctttagaggactacacgtcctcgccaacagagggctgcacgccctcaccttgagaggactacacgtcctcaccatcagagggctgcacgccctcacctccagaggactacatgtcctcgccttcagagggctacacgccctcaccttgggactacacgtcctcaccttcagagggctgcacgcgctcacctccagaggactacacgtcctcgccttgagagggctacatgccctcaccttggggctgcaagccctcaccttcagaggactacatgtcctcgccttgagagggctacacgccctcaccttggctactagttaccctcaccgtcagagggctacacgccctcaccttgaaaggactacacgtcctcgccagcagagggctgcacgccctcacctccagaggactacacctcctcgccttgagagggctgcacgccctcacctttag

SEQ ID NO: 21908 - DNA, 189 bp, Glycine max
  Peptide Sequence Number=SeqID_138686
atggtaatcgattactcctttgtaaaaaccagtttgaaaaccatctcggtcactggtaatcgattactaccaaatggtaatcgattaccagagagtaaaaactcagataatcccaaatttttctccccctttggcatcaacaaaaaggccaaagtgcgttgtaacataaaatcatacacaaatggataa

SEQ ID NO: 21909 - DNA, 210 bp, Glycine max
  Peptide Sequence Number=SeqID_138687
atgtaccaggtttataattccttaaagagcatatccaaagaccagagtttctttgaacatgatgatgaatttcccttgatctttgtggagagttctcacaatggtgttaatgtttatggtttgagcatgtccatgggtgaccctaatcaggttaggttttttgagatcttatctgtttcactgtttgttgtatgcaaatgcaatctctaa

SEQ ID NO: 21910 - DNA, 303 bp, Glycine max
  Peptide Sequence Number=SeqID_138688
atgctcatgtgttctatgttgtctcctgaaatgctaaaccccgatgtctcgtgcatgtttagcctagtcctactcaagtatcatcctcagattcctcttgttgaactaaacttgagcagcaccgcattaagacatacataccaacaactagcgccagtgatgctcagtcagcctggaggttcaagcggtgtgcttagcaaattgattctcgctgagcgcatcattgacaactcatctgcttctaggatcttctacgcgcttagccatgaattgctgcgctcagcggatggctcgctaagctag

SEQ ID NO: 21911 - DNA, 303 bp, Glycine max
  Peptide Sequence Number=SeqID_138689
atggcttcccgcaaaagaaaggttccagcctcagcatcccaggcctgctatgatagatcaagattcacatcccaagaggcctgggatcgctactctgatatagtgattggcaggaagatcctgcctgagagaaatgtcatgatttatcatacagaatttgatgagttcaaggctgagttagaaagaaggaattggcacaaggagctgaccaatttcgtggatgagagcatcgatgttgccattgttaaggagttctacactaacctttatgatcctgaggataaatcacctaagcagatgagg

SEQ ID NO: 21912 - DNA, 357 bp, Glycine max
  Peptide Sequence Number=SeqID_138690
atggctctattcattcaaagagtgcatcaacccaccaagaaaagcttattggagttatcatcacaagacgttgtgttggcacaaaataagttgctttctaagcaacttgagatcttaacagaaacaattggttgtaccatttgtggtggtgctcatgaatccgaccattgtattccttttgaagaacaaacgcaggaagttagttacatgggaaatcaacaaaggcaaggatacaaccaaggaggattctcaggtttccagcaaggtccctacaatcagcaaggacaatggagatcacaccctggtaatcaattcaataaggaccagggtggacctcccaacaggccacctcaataa

SEQ ID NO: 21913 - DNA, 150 bp, Glycine max
  Peptide Sequence Number=SeqID_138691
atggaagcccgtgaaaccattggtttcatgaacccggcctggggagaagacgaaagtatagcaggccaatcagccgcgggcaaaaccgccgcggttgccgcccttcaggttggccttcttcagcaggctctcgtactggtgggacatcag

SEQ ID NO: 21914 - DNA, 390 bp, Glycine max
  Peptide Sequence Number=SeqID_138692
atggctaagcccgctgctaagaccaagaagaagatcaagcgcgtcgtcaccgacggcgttgcccacgtccacgcttcgttcaacaacaccatcgtcaccatcaccgaccgccagggcaacgctctgtcgtgggcgacctccggtggcgctggcttccgcggttcgcgcaagtcgaccccgttcgctgcccaggtggctgctgaaaaggccggtcgtgctgcgctggactacggcgtgaagtcgctggaagtccgcatcaagggcccgggtccgggccgtgagtcggccgtgcgttcgttgaacaacgtcggctacaagatcaccaacatcatcgacgtgacgcctatcccgcacaacgggtgccgtccgccgaagaagcgtcgcgtctaa

SEQ ID NO: 21915 - DNA, 1185 bp, Glycine max
  Peptide Sequence Number=SeqID_138693
atgaggctgtgcggatcgttgtcgccttcctggcgttgctgcgcggactgcggttggtcctggccgcccgtcctggacgacctgccccgcgaacctgcggttcgtcgtggcatccttcaggcattaccgatatcagcccagcatgccgtggctggcgacaccggccggcggccagttctccagcttcatgccgagcgacaggccgcgctgagccagcacttccttgatctcggtgagcgacttcttgcccaggttcggggtcttcagcagctccacttcggtcttctggatcagatcgccgatgtagtagatgctttcagccttcaggcagttggccgaacgcacggtcagctccagatcgtcgatcgggcgcagcagcaccggatccacgccgttgttggccggcttcgccgcaccgcggtcgcggtgggtgaagtcaccgaacaccgacagctggtcgctgaggatgtcggcggcggtgcgcacggcttcctcggcgtcgatggtgccgttggtctcgatatcgatgaccagcttgtccaggtcggtacgctgttcgacgcgggccgtttcaacggcataggcgacgcggcggaccggcgagaacgaggcatccaggaccaggcggccgatagcacgggtttcttcgtccggacgacgacgcgcggcagccggctggtagccgaaaccacgttcgatcttcagacgcatgttgatcgccgtatccttggtcaggtggcagatcacgtgttcgccgttcaggatctccacattgtggtcgaccttgatatcggcagcggtgacaacgcccgggccctgcttggacagggacagggtggcgctgtcgccggagtgcatacggatggccacgtccttcaggttcagcaggacttcgagcacgtcctcctgcagaccttcgaccgtggtgtactcatgcaacacgccgtcgatttcgacttccgtgatggcgaagcccgggatggacgacagcagcacgcgacgcagggcattacccagcgtatgcccgtaaccccgctccaaaggttcgataacgacctttgcacgggtgtcggtaaggcgttcgatctgcggaccgcgaggacgcagaacctggttggcggtaaccgtcatgttgcgggttctcctagtgaacccccggccgtcgccgggggctctccaatgtga

SEQ ID NO: 21916 - DNA, 408 bp, Glycine max
  Peptide Sequence Number=SeqID_138694
atgggttgcactgtgggagaatcgccaacgctgtctttttccccgggcattggtcgtagaacaatgtttgggtttggctataatccgtcaagtgacaaatacaaggttgtagcaattgcattgactatgctttcacttgacgtatctcaaaagactgagatgaagtttatagcgcgggtgacaatagttggagaaaccttaaagggaaaagaaaccattcattctaaaatcgtaattatttttgttgacctggagaaggagacttgcagatcactgtttcttcccgatgatttttgctttgttgatacaaatattggagtttttagagactcgctgtgggtttggcaagatagcaacacccatcttggcttgtggcagatgaggaagtttggagatgacaagtcttga

SEQ ID NO: 21917 - DNA, 147 bp, Glycine max
  Peptide Sequence Number=SeqID_138695
atggctgccaactatcatacagataccccacatgtgcttgacttcactaaatatcctgatttggaggagcgtcgaagatttgcacatgcgtatttgagttcttcgggtaacatttcaattatgttaaaagattgtactacattgtga

SEQ ID NO: 21918 - DNA, 237 bp, Glycine max
  Peptide Sequence Number=SeqID_138696
atgaaagcaccagtgatagcttctggatttcgaggtccagacccctccacagaagagatgaaaaagaagaagataattgggcttgataaccttccttttgggctttccttctctttgcacccctctatcctcttctcccctcttactcagatcatcctcagtgtcttccttcccaagctctgtgtcctctgtactcgtatcaggagcaatccacgcaaaaagttagagaacggatag

SEQ ID NO: 21919 - DNA, 4428 bp, Glycine max
  Peptide Sequence Number=SeqID_138697
atggctgattccggtactgatcgtgtcgaggctgccttagaccgcctcacttcccgcattgaggacctcttgcagcatgtgactccatcagcttctcccccttttcctcctcgcagtccgattcctgcacacacacatcgaatgaaattagacgttccgcgattcgatggcactgatcctatgggctggatttttaaaattactcaattctttgagtatcacggcactcccgatactgatcgtattaccattgctgcgttttatatggagggacgggcccttgcttggttccaatggatgtcaagcaacggccaattcacctcttggcccgtatttctacaggccttacagaccaggtttactctgtccaactacgaggatccctcaggatccctcttcaagctcattcagaagaccacagttgcagaatacttatctgagttcgaggagctcgcgaacagggtcgtcggcctccctgctccgttccttttaagctgcttcgtttttggccttgcgccggagattcgtcgcgaggtgatgatcaaccaaccgcttacggtggcacaagcggcgggtcttgcgcgtctccacgaggagaagttgcgcgaccttcgctttgatttccgccaacccaaccgacctcgccctcttcagctaccacctgtagccccaccgcagacttcaccgctcccaacctacacacctccgcgcgcctccacccttccccctttgctccctctgccgccacgtcctaacccgcaaccgccaccgatgtttcgtcgcctgacctcggaggaactggcgtcgcgccgcgagcgctgcctgtgtttctcatatgatgagaaatttcacaagggccatagatgcgcccctagggttcatctactgatagcagatgatgaagacccccttgaccccgcgggttctaatataaatccaccagactctcccgacccgctacccggcccattggatagacccgactcaccggcccacctcagcatcaactctttagcgggtcatcttgcacccgagaccttgagactcctcggaaccatctccggcgttcccgtcctggtgctcattgacggtgggagcacccacaacttcatccaggagccactcgttcaccaattgggccttccttgtcaatcaaccagcccattaaaggtcatggtaggaaatgggcaacatctgcaatgccacacgatttgcagttccaccaccctcgtccttcaacatcattcattcaccatggatttatatgtcctgcccattgccggcgctaacattatattgggtgtccaatggttacagtccttgggcccagttttaactgattatacaaagctcaccatgcaattctttcatgatgataggttcgtggagctccgcgacgaccccgaagcccacagggacctcttatcttccccacaattccggcgtgtctgccgccatcaaccacagagtctctacttccacatcacagtgcttccggtggattccgcacaaccgttgaccaagcccgatgaccctcaggttcaacatcttcttcatcaattcgccattctctttcaagaccccaccactcttccgccggcaagagacacggaccatcaaattcaccttcttccacatgcgacaccagtgaatgtcaggccatacaagtatccatattaccagaaacgcaaaatcgaagctcaggtggaaaccatgcttcaacggggcataattcaacccagcaagagccccttctcgtcgccggtattattggtaaagaagtctgataacacatggcgcttctgcgtggactatcgcgcattgaatgccctgaccatcaaagatcgttttccgattccgacgatcgatgagcttctggatgagctcggcggtgcgtcttgcttttccaaattggatttgttgcaggggtatcaccagatacgcatgcaaccggaagacataccgaaaacggccttcaggacgcatcacggccactttgaattcaaagtgatgcccttcggtttgtgtaatgcgcctttttcattccaggcaaccatgaacactcttttccggccgtatctccggcgattcatcatcgtgttctttgatgacattctcatctatagcggttccctcagcgatcacttacgtcatcttcaggccacatttcagatactctatgagaatcattttgtgcttaagatctccaaatgcctctttgcgcagtcagaagtcgaatatttgggtcatctggtctcacacagaggtgttcaacctgtcacttcgaagcttgatgccattgctcagtggccaataccacgttcagtccgtgctctacggagttttcttggcctcgccggattctaccgcaggttcattcggggttatgccaccattgccgccctgcttgtaaaggccaccacggttgaacctctccagtggaactcctccactcaggcagcttttgacgctttgaaacaggctctgacctccgctccggtcctttctctccctgattttcaattgccttttacaattgaaactgatgcttctgtaatcggaatgggggctgtattgtcccaacggggccatcccatcgcttactttagcaagccttttagtccaaagttgcttcgagcctcgacttatgttagagaactgtttgccatcacggccgccgtgaagaagtggcgtcaggttgttcaaacacctgaacagcatacttaccttgcaaggttaatgggctacgactaccagatccaatatcgctccggcagtcacaatcaggccgcagacacactatcccgtttgccggaaaacccctctcaggccctcctcatcctctctgttccatgtctcacctttctggaggagctccatacccagcttgctgcgaattcttctttccaacatctcttccaagaggtacgggatactcccgacaaacaccctgatttctccattgccaacaagcttctactatataagggccgcatctggttgccgtcggacataccaatcatcaagaccttgctcacagagtaccacgccacccctacggggggccacgccggcgtcgcgaaaacggtagctcgtctcaccaccaatttctattggactagtctacgagatgacgtcatgcgcttcattgcaacctgtgttgactgccaggtcaccaaatatgagactaagaaaacagctggacttctctgccctctccctgttcccactcaaccttggtcggacttatccttggatttcatatgtgggttaccaccgtatcggggcaacacgacgattctcgttgttgtggatcgcttctcaaaaggcatccacttgggcatgctccctcaaagccacaccgctcttgctgtcgctcgactctttttggacttagtggttaagatccacggccttccccggagcctcgtttcggaccgtgatcctctcttcattagtcagctatggcaagaattatttaaatccagtggtacccagcttcggatgagttctgcatatcatccacaaagcgatgggcagacagaggtcttaaatagagtagtagagcagtatctgcgtgcgtttgtccacaggaaaccgacaagctggggaaaattattaccatgggttgagtggtcgcacaatacctcttggatggccagcacgggcaccatcccttatgagattactttcggccggaagcccttcaattttcccgattatcttgcggggtcttctaaaattgaggcagtggaggaaatcttaactgatagagacactaccttccagttggttcgcaaaaagttgctgaaagctcaaagcaagatgaaactttatgctgatcaacaccgtcgggatgtacagttcgccgttggtgattgggtcttggtccgccttcgtccttaccgtcaatcttctgcaaaagataagcaccacacgaatgagaaactagcccgtcgctattatggtccttttcaagttgttgctaagctcggacccgtggcatatcgtctagcgctaccagagggggtccggctccaccccgtgtttcattgctcgaagcttaagccctttcgcggggatccagattcctcatcccctctgcctttaccagccactttccatgaaaatcaaccactcgtctctcccctctctatcctggattttcatcgggaaacctctgatccccagagtccgtggcaagtcttggtccagtggcaggctcttccaccggaggaaacgtcatgggaagattggcatcagctttgccaggattatcaccttgaggacaaggtgatcctgcaagggccgagggatgatacgagtacagaggacacagagcttgggaaggaagacgctgaggatgatctgagtaagaggggagaagaggatagaggggtgcaaagagaaggaaagcccaaaaggaag

SEQ ID NO: 21920 - DNA, 246 bp, Glycine max
  Peptide Sequence Number=SeqID_138698
atggatgaggggtggaatcaaatccagtttaacctggctgatttcaccaagagagcatatggtactaattacgtggagacactgcgagttcaggtacatgcaaactgttgcctgagaaggatttacttctctgaccgcctctactctgaagaggaactccctccagagttcaaattgtaccttccaatgcagattaatattgctcgttcaagtaacattaagttgtgttctgatgcttgtctctaa

SEQ ID NO: 21921 - DNA, 3552 bp, Glycine max
  Peptide Sequence Number=SeqID_138699
atggcactagaattggtcggtggtgctcttctttctgctttccttcaggttgcgtttgagaagcttgcttctcctcaagttcgggacttctttcgtggaagaaagcttgatgaaaagctgctcaacaacttggaaatcaagctgaactccatacaggctctggctgtggatgcagaactaaagcagttcagagatacacgtgtcagggactggcttcttaaggtcaaagatgctctgtttgacgcagaggatctcttggatgaaatacaacatgagatctccacatgccaagtcgaagctgaatctcaaacctgctctggctgcacttgcaaggtaccaaatttcttcaaatcttctcctgttagttccaaggaaattaaatcaaggatgaaacaggtccttggggaccttgaaaatcttgctagccaaagtggctatctagatttgaaaaatgcaagtggtgttggatcaggatttggtggtgcagtatcactgcattcagaatcaacatctttgcttgttgaaagtgttatttatggcagagatgatgacaaagaaatgatctttaattggctcacatctgacattgacaattgtaacaaactatcaatactttctattgtgggcatgggtgggttgggtaagaccacacttgcccaacatgtattcaatgacccaaggatagaaaataaatttgatatcaaagcttgggtctgtgtttcagatgaatttgatgttttcaatgtaacaagaacaattcttgaggcagtcactaaatcaactgatgatagtagaaaccgagaaatggttcagggaaggttgagagaaaaattgacaggaaagagattttttcttgttttggatgatgtttggaacagaaatcaaaaggaatggaaagatttgcaaactcctcttaatgatggggcttcagggagtaaaattgttatcactacacgtgacaagaaagttgcttcagtagtgggatcaaataaaacacattgcttagagctgttgcaagatgatcattgctggcgattgttcactaaacatgcattccgagatgatagtcatcaaccaaatccagacttcaaggagattggtacgaagatagtagaaaaatgtaaaggactgcctctggccttgacaacaattggaagtctattacaccaaaaatcatctatttcagaatgggaaggcatattgaaaagcgagatatgggaattttcagaagaggatagctctattgtccctgctttagcactaagctatcaccacctcccttcccgtatcaagagatgttttgcttattgcgccttattccccaaagattacaggtttgacaaggagggtttaattcagctgtggatggcggaaaactttttacaatgtcctcaacagagtaggagtccagaagaagtcggtgaacaatacttcaacgatcttttgtcaaggtccttctttcaacaatcaagcaccatagagagaacaccttttgtcatgcatgaccttctcaatgatttggcaatatatgtttgtagggacatctgtttcaggttggaagatgatcaagcaaaaaatataccgaagacaacccgtcatttttcagttgcaagcgatcacgttaaatgctttgatgggtttcgaactttatacaatgctgaaaggttacgcacatttatgtcattaagtgaggaaatgagttttcgtaactacaatcgttggcattgcaagatgtcaacacgtgaattattctccaagtttaagttcttacgtgtcttatctctgtctggttattctaacctaacagagttgcctgactctgtaggtaatcttaaatatctccattccttagacctctcaaatactgacatagaaaaattacctgaatcaacatgttctctctacaacgtgcaaatactgaagctaaatggttgtagacatttgaaggagctgccctcaaatttgcataaactcactgatttgcatcgccttgaattaatagatactggagtgagaaaggtaccagcacatttgggaaaactgaagtatcttcaagtattaatgagttcgtttaatgttggcaaaagtagggagttcagtatccagcagctaggagaactcaatcttcatggaagtctatcaattcagaacctgcagaatgttgagaatccctcagatgcattggctgtggatttaaaaaataaaacacaccttgtcgagctagagttaaaatgggattcagactggaaccaaaatcgagaaagggatgaaattgtaatcgagaatctacagccttccaaacacttggagaagttgacgatgaggaactatgggggtaaacaatttcctagttggttatcggataattcatcatgtaatgtggtgtccttaaccttggagaactgtcaatcttgccaacgtttgcctccccttggacttttgccatttctgaaggagctttcaattagatggcttgatgggattgtgagtattaatgctgattttttcgggagtagctcttgttcatttacatccttggaatctttggagttctccgatatgaaggaatgggaagaatgggaatgtaaaggtgtgacaggtgcttttccacgtcttcaacgtctttttatagtgcgttgtcccaagctgaaaggtttgcctccccttggacttttgccatttctgaaggagcttttaattgaaaggcttgatgggattgtgagtattaatgctgattttttcgggagtagctcttgttcatttacatccttggaatctttgaagttcttcgatatgaaggaatgggaagaatgggaatgtaaaggtgtgacaggtgcttttccacgtcttcaacatctttctatagtgcgttgtcccaagctgaaaggtttgcctccccttggacttttgccatttctgaaggagctttcaattgacagccttgatgggattgtgagtattaatgctgattttttcgggagtagctcttgtttatttacatccttggaatctttgaagttctcccgtatgaaggaatgggaagaatgggaatgtaaaggtgtgacaggtgcttttccacgtcttcaacgtctttctatatattattgtcccaagctgaaaggtttgcctccccttggacttttgccatttttgaaggagctttcaattgacaaccttgatgggattgtgagtattaatgctgattttttcgggagtagctcttgttcatttacatccttggaatctttgaagttctccgatatgaagggatgggaagaatgggaatgtaaaggtgtgacaggtgcttttccacgtcttcaacgtctttctatatatcgttgtcccaagctgaaagggcacttgccagaacaactatgtcatttaaatgatctaacgatttctgggtgcgactctctaacgaccattccgctagatatcttcccaatactcagggagcttgatatcaggaagtgtcctaatctacagaggatttcacaggggcagactcataatcatctccagcgtctgagtatcaaagagtgcccccaatga

SEQ ID NO: 21922 - DNA, 129 bp, Glycine max
  Peptide Sequence Number=SeqID_138700
atgagtgagataggaagatttggaggtttgggaatggaggaacgtcgcaaggaggaaggggctgcgcagggatttctggaaaatgtgatatttatagagcaggacgcgtggccatctgttttattgtaa

SEQ ID NO: 21923 - DNA, 246 bp, Glycine max
  Peptide Sequence Number=SeqID_138701
atggattacttaattcgtatgtgttatacggattccaaagaagacaaagcaaccattaaagaagggaagaagaaaccttacctcgacgatggaaacctcctcaaagctagcaatggaagcagtcatcggcagcagcacaacacaaaacaaagaagaggatgcaagaagacgaaggaagaagtggcgtacggacgaagaataggagggaagtttgaggtggttgagggagcaaacaaggtgcaatag

SEQ ID NO: 21924 - DNA, 300 bp, Glycine max
  Peptide Sequence Number=SeqID_138702
atggtggttagggagggtggtgacaccctaatctcaggtggatattctgacaaccatgcaattatgtgtcaagataagttttcagataaagttgataggcgtatgcagaaagtacaacagatggagggggttgaagggacacaccatgatggaaaaggtcatgaggaggtggggaccaattttgttatcccaaccattgtgaagtcaaaggggaaaactgatatgcaaaatatgggctcgtgtggcaaagtggaggatattgggcctgggctagttcttatgataagtgaacggggatag

SEQ ID NO: 21925 - DNA, 327 bp, Glycine max
  Peptide Sequence Number=SeqID_138703
atggaggccatgaaagagcagatgaccacaatgatggaagccatgatgagtatgagaaaaatgatagaggtcaacatgactacagtcgtttttgcaagtaccgccactgaggtggacccgattcacccatctggcctcaaccaagttcagaacaagcattccttcctactatatggcttgcctcccaactatacgccacccaatgttgcacacactcccgatgagaatgtctaccactttgcacccatacccattgagagccaacaacccgaatctaatcatgcacatgtctctcaacccattggggagacacatgaagcaccctga

SEQ ID NO: 21926 - DNA, 660 bp, Glycine max
  Peptide Sequence Number=SeqID_138704
atggtggaaagggagagatttggtcatatagaggagaggctgagagctattgaaggaggcagagattatgcctttgctgacatggcagaattgtacctaatgcccaatgtcgttatccctctgaagttcaaggtgtcgaattacgataaatacaaggggactacctgccctaagaatcaccttaagatgtacaacaagaaaatgggggcatactcgaaaaatgaaaatttgttgatgcatttcttccaggaaagtcttactggggcaactgtcacttggcagtatcactacaattctgatatggctacggataaaatgcgactacagaacgtgtgtaaaaaggagcacgaatctttcaaagaatacatccaaagatggagggatctggcagctcaagtagtgcccccaatgatggagagggagatgataacaatgatagtagacacgttactggtgttttactatgagaagatggtgggttacatgccttcaagcttttccgattttgttttcactgggaaaaagatcgaagtgggtctgagaagaggcaaatttgattatcctactttgatgaataggaagcctggggcaaatggagagaataagaaggagggagaaacccatgctgatgtaatcctaccccccaagggcattggataa

SEQ ID NO: 21927 - DNA, 159 bp, Glycine max
  Peptide Sequence Number=SeqID_138705
atggatgaggagatgacagatttgctcgatttcttgggagacagcggagcacgtgatcgagaaatttttggcgttatggctctcagttatttcgtcaccgtttttgtgacttaccattttcgtgcgctttttgttcatcttgtggttagacgtaagtag

SEQ ID NO: 21928 - DNA, 291 bp, Glycine max
  Peptide Sequence Number=SeqID_138706
atgcacatgagacagatgcaacttatgaatacgggagtccggggaaattgcctcatttttaagaaggtgacacggaccctccgttggtttccaaaagagaggggatcaagacagaatccgtgcgtgatgcatatgcgaagggcacaacacgggagtgtacagtataacaatattcacaaaatatataagcgaaaagggtacatgctacttatgcatggcagtgtgaaaaaatggaacgcagcgtgtccgctttgtgcccctattcgagggacctatatgggagggagctaa

SEQ ID NO: 21929 - DNA, 270 bp, Glycine max
  Peptide Sequence Number=SeqID_138707
atgaggactctctgcttcccacaagggatagtggaagacttactgatcaaggtcagaaaattcattttccctgtggactttatgattctggatatagaggagaatgaagtcacaccaattattttgggaaaactcttcctcaacacaataggaacattgattgatgtcaaggaagggaaattgacttggtggctaggtgatgaggaagaagtatttaaggccactaacaagataaaagtcattttctcctcaaatacccataaaccctaa

SEQ ID NO: 21930 - DNA, 376 bp, Glycine max
  Peptide Sequence Number=SeqID_138708
gatggacccttgggtactagtaccctcgtctccagaggactatacgtcctcaccttgagaggactacacgtcctcaccatcagagggctgcacgccttcacctccagaggactatacgtcctcgccttgagagggctacacgccctcaccttgggactacacgtcctcgccttgagaggactacacgtcctcaccatcagagggctgcacgccctcacctccagaggactatacgtcctcgccttgagagggctacacgccttcaccttgggtactagttaccctcaccgtcagaggactacacgtcctcgccttgagaggactacacgtcctcaccatcagagggctgcacgcccttacctccagaggactacat

SEQ ID NO: 21931 - DNA, 330 bp, Glycine max
  Peptide Sequence Number=SeqID_138709
atgtcacgaaaccttatggattacgcaatcatcccttctttggcttccaaaatgttatggaactttacggattgcgcattaacacgtcctttcaactcccgacatgtcgcggaacttcacggattgcctaacaatgggtgtcaagcgaggatgaccataaggtatctccgcacgtcatcgggctcgccgcccctggatgacgaaaggtgcagaatgactataatttgtctctgcgtgccatcagacatgattgcgtttgaatggcgaaaaggtgtgcgaaatgaccataatttgtctccgcatgtcatcgggctcgccgcctcaggatga

SEQ ID NO: 21932 - DNA, 1626 bp, Glycine max
  Peptide Sequence Number=SeqID_138710
atggaaagcgtcttctctctctctgtggccgcaagggctgattttatccaatttctggtgcagtcttttggctgcagttacatttgtctatgggcatatgattccatttcaccaaatcgtttgagcttcttggatggtatctacaatctaaggaacaaccaagcaagttcaagtttggggagtgtgcaggcacaacagcttttcagtcagttccggactttgacatttgatatcaatgatgaccgtgttcctggactagcttttcggaatcaacggtcataccttgagctccaacaattggaacttctcagactagcatccacagaaatacaaacacaattttttcaggaggcaaggattaagactgctgttttcatggggtgtaacaaaggagaaattgagcttggtttcttaaatatgtcccaagttgacattcaaacaacacttaggagtttgtttcctgaagatttttccactagagtactgtcccagcaaattgatcaaaaccctccagcatcatcttcatcttctctgagatcaatctccacaggaagccctgaatactcatcacttctattcagtattccaggaacttctcaaccccacttttcacctgagacacttggagcatcatcatcatcaagactagtgccaccaatgcagccagtgccaaatagtcctcaccaacaagccattaataatattcaagcattggcacaagtcccttctctaacccaattccccacaccagaaactgaacatgatgcaatcatgagagcaatcctctatgttatatctccaacaacttctcatcatcatcataatcaacagcaccaacaaaacttgccttatagtagtaataattctcttcctgtggtgcatcctgatgctagtgcattccagaggtatagacaagacttaggctccaacaacatggtctccaatattctcagaaggcaaagcctcatgaagagatcttttgtgttctttagaaacttgaattttatgagaatgagagatcgcattcaagcaacgtctcgtcccaccaatactcagcttcatcatatgatatcagagagaagaaggcgtgagaagctaaacgagaattttcaatcccttagagcacttcttcctccgggaacaaagaaagacaaagcgtctatactgatagcagcaaaggagacattgagctctttgatggctgaagttgataaactgagcaaaaggaatcaagggttgacgtcatttttgtcagccaaagaatctacaactgaagaaaccaaggtagctagtttatcgccaaataaaagattaagtgtcataatttcacatgtacccgaatcaagctcatcagaagagagaatggtggagttgcaagtgaatgtgagaggacaagtttctcaaactgatttattaatccggttattggaattcttaaaactggctcaccacgtgagcttggtttccatggacgcaaacacccacgttgcagaagggaataatgcactacatcaactatccttcagattcaggattattcagggaagtgaatgggacgagtcttccttcgaggaagcagtgagaagagtagttgctgacttgctacagtaccaaatggaccaataa

SEQ ID NO: 21933 - DNA, 507 bp, Glycine max
  Peptide Sequence Number=SeqID_138711
atgcgttgtggcgacgtgaatgaagtgaagaccgagaggcgagaacgaataggcgaagagaaagagaatagaggtgtgagaggcagcgatgacgtggagacggagaggcggagaggcaccacgagaggttgcagtgccaacagtgagagagtttcaatgccacaagtgcgaaaacgatgtggtggtggtagcaatggaggtggtgaaaacaatggtggtgatggtggttgtggtattagtggtggtggtggtggttgtagcaatgtcggtggtgttggttacgatggtggtggctttcacaatggtggcagtggtggaggtggtattgttagtagtagtgacaatgaaggtggtggtggtgatagcaatatcaatggtggtggtgatgttggtgatggtgacggtgacactaatggtggtaacaatgttgttggtaatggtgatgtcggtgacaataataacagtgatagtaatgcttatgattgtagtagtgatagtcaattatga

SEQ ID NO: 21934 - DNA, 258 bp, Glycine max
  Peptide Sequence Number=SeqID_138712
atgattattgaagaatccattcatgttgcttttgatgaaactaatgcaattttgccaagaaaggatatactagatgatatttcagaatctttagaagaaatgaatattcatggtgaagatcacaaaggcaaaggagaaggaaatgatgaagattttcacattgatgaaataaaaacaaatgctgatcttctaagagagtggagaacttctagataccatcctcttgacaatattattggtgatatatcaaaggggtaa

SEQ ID NO: 21935 - DNA, 174 bp, Glycine max
  Peptide Sequence Number=SeqID_138713
atgaaaaagggcgacccgacccaacccgtgattacgcaactgggttgtaaaaccctagttgccttgcgcaaaaaatggggcgaccaacgcggaaaccaccacggagggtggcgcgctactcgtggtaccactggtgcaaggtctagcggtgcaaggccaccatgggggcggtga

SEQ ID NO: 21936 - DNA, 291 bp, Glycine max
  Peptide Sequence Number=SeqID_138714
atggatagatgttttcaagttggcaactcaccaagtgtaactctaaaagtgaagggagcatggtcactgattgaagccaatcagtttccttgtgaagatgaacatcaccaaggtcaagatattgcaataatgaggaaagacgtgaaatccaatggagattttcggcaagaagatcataattatatgataaatcaagataatggaggttggtggagtttccacacagatggggaaggttacctcttgacaagtcatgaaatttctgactacccattgaattataatggatag

SEQ ID NO: 21937 - DNA, 291 bp, Glycine max
  Peptide Sequence Number=SeqID_138715
atggaattttttgttgatggaaaaagacttgtcctgagaggagctacccctacaaatctggccactgctagaaaacagaatcttcataaaaccatctcttctagtgttcacttctccatgattagtttacaatctaatgagccatctggtcttcctccttgtcgaattggccatgatcacaagattcctttattgcaaggagctaaccctgtcaagaagaggccctataggtatgctaaacaacaaaaagatattaatgatggcttgattcagaactatttgaagtcatga

SEQ ID NO: 21938 - DNA, 459 bp, Glycine max
  Peptide Sequence Number=SeqID_138716
atggttagaacacgaggtttaggtcatgctttagctagggttataggtagaggtagacaggatgagcatgatgcagtcgatgctccccagaggcgtagacctactgcatcagcccgtaggcgacgagtatatattacggttgatgagggtattcctcaggtgactgaggatgttcctcatatggcggaggatgttcctcaggtgactgaggatgtccctcatatggctgacgatgttgctcagaggagtgaagatgtgcctcagatgaccgcagacgtagatgcgactgttgcagaggacttaagtcgtgatggtgctgaggggtcatatactgatgagggattccctggtgggccccgtgacccatcagttctgacttcatttgcgaagcatgtcacacatgccatttggactggacaggagcgtcctgagctaaagttggtgtcacacgggaggaag

SEQ ID NO: 21939 - DNA, 318 bp, Glycine max
  Peptide Sequence Number=SeqID_138717
atgactaactgcctgagaattcttttgattcttcccttccccttaaacaaaagatttcaaaggattaaccgcctgagatatcttttgttttcccttacaaagattcaaaggactaaccgcctgagaattctttgtcttaacacattggaggatacatcctttgtggcaccagtagaggttcaagtggagggtacatccacttggttgttcaaagagaacaagggagggtacattccttgtggatctttggcttgtaaaggattttacaaggttgaaagaaatctcaagaatcgttggttgcttggggactggatgtag

SEQ ID NO: 21940 - DNA, 1517 bp, Glycine max
  Peptide Sequence Number=SeqID_138718
gcgaggccaaccggtgctgaaatgtacgaaggcacctgcggtaccaccgccggacgcgcatcgtagcgctgtggcgtgccaaatccgctggtcaccagcgctggctggcagctgtcgctgtcctcgcacacgtagtagtttgccagccgctgtacagccggtactgccacggtccggcaccgagatagccatccctgagcgcaaagctgttctggccggcgttgccgcccacctgcgccagcgaaatgccttcgttgccctcaatgccgccgttgcggttgcgatcggtgagcgccgcgctgcttgccgcatcgagcctgacgttgagcagcgtggtgccgctggcgttaccgctgacgttgatgtggtcggtgaactggttgctcagcgcgccgccgtcattcaggcgcgtcaccagattcgcctgaccgcccagcgacgccagcgagccgttgatgtccagcgtattgcccggcgaaccgccgccattggtgagatccagcgtgccgctgttattcacctgcagcgaatccgctgtgccgcccgccagcgtgggatgcacgttgtcaccggcatacagcgtcgaacgcccatcaatgttgatggtgctgtgcgccaactgcagattgtcagtcagcgtccagcggctatccgcgaagttaatgatgctccagccgctgccgaggttaacgcctttgctcaggtcatccgcgctgaagctgccgccgcgcgccgtaatctggtcaaaggtcaggctgttaccggtgccgttgccgctggtgagatggtaagtggtgctgagatcgacgccgctgacctcggcaatattgttgttgtctgcgcccatggtcaggctgccgttgagcgtgccgccggtccagcggaacgtgtcgctgccgccgccaggattgatgtcgcccagcacgtcaccctgcgtcagcaaaatcacatcgtcagcgttactgcccgccaccgccacgctttgcgccgtggacgtcacgatagtaccgaggttctcgaataccgttttgccgccgcgcagatcgaccaccggtgccgtcaggctgctggagcgcaacgtgccgcggttgacgatggtgccggcggtgctggagaccagcgccgaaccgcctgccgcattagtgatattgacgctggcggcggtgaagatatttcccgtggtgttggcgcgaatcccggtgccgccggcgccggtgacattgaaaacgtaacccgaacccagcgtcagatcgccgccggtggtcgatccatcggcgttggcgatagtcaggccgttaccgctgccggatacattggtggtcacggtggaggcgggatcgaacgcgacggcagtgcggatgccgttgccatcgccgacgttaagcgtcaggttgctcaggctaacgttgtccagctccgcgcggttttcgatgccgttgccgctgcccagtacgttgatggtggcgtcgcgcgcgctgagcgccgccgcgccggtgtcgagcaatatgccatgcgcc

SEQ ID NO: 21941 - DNA, 231 bp, Glycine max
  Peptide Sequence Number=SeqID_138719
atgaaggagatcctaggcctacaagctccaatggagcttacatcaccctccgtccaccatgctctctgccgaccagctcttctacaacgtgtattgcggtcgccgcctctcagacaacctcgctgtcgccctcaaagaaatctacaactaccaattctccttccgagaaatcgacactttgaagctcctgttgtaacgacccgcctcgttgctatgatatcatcatcctaa

SEQ ID NO: 21942 - DNA, 264 bp, Glycine max
  Peptide Sequence Number=SeqID_138720
atggaagaggagcacatgatgttgtctttactattgtgcaaatccttgcaaattagagcacgccatgtagccttatcctctactgtgagacaatggtcttttcaaggaatcaacgttgatcttgtaacagatccttcactaaatttgtatgagagcttggccttaagggttgagtatttggcagtactaaggaaaagatccaggatatcaaagatatggaagaaggattcttcaccaacaaaccacctctattcagaggcataa

SEQ ID NO: 21943 - DNA, 435 bp, Glycine max
  Peptide Sequence Number=SeqID_138721
atggagagagagagagagagagaaaaggacttgttgaggaactccaagaagggaggcaatgatgtaagagacctcaaattcataggaaatgaatggatccactgcagaagagaggcaagcggcatcgagaccgaagagaatttgaatcatccaatgcttgagctcgccagcacgaagggtctagttaaccttagcagtgtcgacgatgatggtggccaagttggttctgaggaactcaaggacaaggatggtgttctcgtcttctcgccagaagtacttgtgcaaaacgacaatgtctgggaagccctcttctcaaagaagcctctgaaggaagcctctcaaggaagcttctcaaagaagcctctcaaggaagcttctcaaagaagcctatcgagaaaagcttctcaaggaagcttcctaaagctgtctcagtaa

SEQ ID NO: 21944 - DNA, 786 bp, Glycine max
  Peptide Sequence Number=SeqID_138722
atgactcttaaagaaaaagagtttgagttatgtcttgatattgagacaagtgccaaagaaaaagatacttttctcaagaactttcaagagttggaaaacaaactgaaagatcttcaaaatgatctaaatgagctaaatgaacttcatgattatcaaaagggagaaggacatgatttgtggagagaatgtgcaaaagcacacaaagattacgaagatctcaaaatgagtaaacataatatttgggtggaatatgatgaacacaaaagatttgtgaatgataagattttgaagaatcaagaagttataggtcaatgtcaaaatgttctcaaacttcatgaggaaactagaacattgaaaactacattagccaaatttgtcaatggaacatataatcttaacaaattgttaggatatagtagaagttccctagaaaactctagaaatggatataatggaaaggtatacgttcatgataaggacaccattgtttgctacttttgtggcaagactggtcatatgacatccaggtgtaaagatcaacctaaaaaggatacaatcaacatttttatggctaacacaaaaggacccaaaaagatttgggtacctaagaaaaagattattcctactgcaaatgaccttgatatcaggaagcatacacctatcatggtacctggacagtggttgcttatgacacatgataggagaaatgtgtatgttccaatgcttgactcgctatcatggtggaacaatcactttcagagggaatcaaaatggaaaaataactag

SEQ ID NO: 21945 - DNA, 522 bp, Glycine max
  Peptide Sequence Number=SeqID_138723
atgatgagtttgtcctcctctttaaacatgggtctcctctattctctaccaagagaaaagaaaaacaaccttgtaagaggtctacctagtatttcatacaaggatgatttactttgtaaggcatgtctaaaggggaaacaaattaaaaactccttttccaataaaaacattgtttccacttctagacccttggagttgatacaccttcatctgtttggtccaaccagaattacgcccaagtggaaagagactcaggtgagtttaggtagactcgcgagtttgcaacgagtccgtgagttcacaaaattttcaaaacggcatcgttttgaagcaaagctactcccttacacacgagtcgcgactccgtggccatgctgtgctgaagctgctactcatcgctgttcactcgcatcatcattgctggccctcagtcgcagtcctccgtcctccatcatcgtcggccatcgctgccttgctggtcctcactcgcgctccaaactttgcttcacgtcacgacgctaa

SEQ ID NO: 21946 - DNA, 228 bp, Glycine max
  Peptide Sequence Number=SeqID_138724
atgagtatgtcagtcagggtcatgctgtttagcgagaatgctccaattatgtggaatcgacacaggcttaaaggagcactcaaaactgggtgtactcccaaggcctacactccgaagagtccgtcagagccgctccctcctgatttgggttcaacccctaaaatttttttgcatgcagacactgctagtgaattatacaatactcacgacctcacactcgtgtcttaa

SEQ ID NO: 21947 - DNA, 340 bp, Glycine max
  Peptide Sequence Number=SeqID_138725
atggagaacgattgttgtgtccacgtgaggaaattccataaatgccagaccttcgctgataatgttaatgctccacctgtatcgttaaacgtgttggcagcaccgtggccattctcaatgttgcccagaaagatcatcaccgataatgccaccaatttaaacaacaagatgatgaaggaaatgtgtgaggatttcaaaattcaacaccataatttgacgccttatcggcccaagatgaatggcgtaattgaggccgccaataagaacatcaagaagatcgttcagaagatgatcgtatcatacaaggattggcacgagatgttacccttcacattgcatg

SEQ ID NO: 21948 - DNA, 486 bp, Glycine max
  Peptide Sequence Number=SeqID_138726
agaattcaagggactaactgcctaagaattctttgtcctaatacattggagggtacatcctttgtggtacaagtagagggcacatctacttgggttgttatactgagaacaagagagggtacatctcttgtggatcagttcaagtggagggtagatccacttggttgttcaaagagaacaagggagggtacatcccatgtggatctttggcttgtaaaggattttacaaggttgaaagaaatctcaagaaccgttggttgcttggggactggatgccacttgatccaacatgatttggtgcaaaactatgctaactggtgggataatagattaaataagaggaatgcaaaagctcccgatttcaagcacaaagaaaccagtaaagggttgtggcttgattcttcatcaaagtgggtgttggaaaaattgccgccacctatgaagcctaaacaaagtgtagatactgaaaggacactggtttcataa

SEQ ID NO: 21949 - DNA, 327 bp, Glycine max
  Peptide Sequence Number=SeqID_138727
atgacgaagaagagaaggaatgaaagtaacgagagagaagaaagaaaggaaaaagggagagcaacaggagaaaagaaaagagcgaggaagagagataatgaagggaatgagagatacttggagacccctctcctttctttgatggtggtgccaagtgtcacccttccattggtcaattctttgtcctcgggatctatgttgctctatatgcaattagtgcaaagatcttcctcttttacactgagctctcctcttgacctaatgggctctccttctgagtccaataggatccagacagaattagggtctgacactttattaaaatga

SEQ ID NO: 21950 - DNA, 1728 bp, Glycine max
  Peptide Sequence Number=SeqID_138728
atgatggattcctctggtgccaccaacgagaagctcttagaaaatggcactccatcttcttctcaaatgagaaaagtgaacgagtctctggagaaagtggcgagctacggaatcatgcccaacatgatactgtatctgagggacgaataccgcatgtctattgcgaagggcacaagcgtaatttacacttggactgccgcgtccgacatcttgtccatcttcggggcattcctctcagattcttacttgggtcgattcctcgtcattgctatcggttccttctccagccttcttggtttaaccatgttgtggttaactgccatgatacctgacctaaaacctacccgtgaatcagacatgttaggctgcaactctgctacagcagtccaactagctctgttgttcttttcaatgggattaatttctattggagctggatgcgtcagaccgtgttccatagcctttggagcagatcaactgacaattaaagaaagatctaatgatgagaggctcttggatagctactttaattggtattatacctcaattgcaatatctagcatgattgcattgagtgtaattgtgtacattcaagaaaatctaggatggaaaattggatttggactacctgctttgctaatgttcatatcggctgccagtttcatcctcggttcgccattctatgtcaaagtgaagccaggtcacagcttactcactacttttgtgcaagtagctgtggtggccgtaaagaacagaaaacttagtcttcctgattgcaactttgatcagttctatcaagatcgtgattctgagccgatgatccctactgatagccttaggtgtttgaacaaagcttgcataaaaaatactgggacagtctcaaaccctgatgtatcagtttcagatccgtggagccaatgcacagtgggacaagtagagtcgctaaaatcattggtcagactcctacctatgtggtcctcgggcgtcttgatgatggtgtcccaaggctcattctctaccctccaagcaactaccttggaccgaaggttatttggcaatttcaagatgcctgcagggtccttcaatcttatcatgatattgaccttatcaatagtcattcccttgtatgaccgcataatggtacctctactagccaaatacaggggcttgccgaatggattcggtagtaaaactcgaattgggattggattgttgtttgtatgcgcagctaagggaacatcagctgtagttgaaactattagacgaaatgcggccattgaacaaggctttgaggaccaacctaatgctataattgacatgtcagttttttggctgtttcccgagtttattttgcttggaataggcgaggcttttaacactgttgcgcaggttgagtttttctacaattatatccccaagaccatgtctagttttgcaatggctcttttcactcttgaacttgctgctgctagtgtagtagggagtgtgttagtgaacattgtggacaaggtcactagtgtaggaggggaggagagctggttagcaaccaacattaacagggcacatctgaattactattatgcactgctcacttgcataggtttaattaactacctctactttcttgcaattagttgtgcctatggtcctcctccagggcaaacacttggagcttcagcaggcaaggaagaagagaaatttgattacagggagttacatacttcctag

SEQ ID NO: 21951 - DNA, 207 bp, Glycine max
  Peptide Sequence Number=SeqID_138729
atgctccaaccatatgggatcaacataggcttaaaggagcactcaaaccgggtgacccccaaggcctacactccaaagagtctgtcagggcctctctctcctgattcagacattgctcatgaattatacaatatgcacgacctcacactcgtgttttcaaacacgtttaacacattgcgctataatttagcactggctcctaaatag

SEQ ID NO: 21952 - DNA, 423 bp, Glycine max
  Peptide Sequence Number=SeqID_138730
atgactactctgatccagatatggatgacgctgctactcagcaacattctgcccaacgaccataactctgacctccctctgcctaagtgccaactggtgtatgccatcctgacacagatgaccgttcatgtggcccagataattgctgacgccatttatttgtttgcagggacggcgcccactaggcaccctttggacccgaagaagtctaatagggccctggggtttccggccttgatcacgggcctctgccagttttacatagtacctgtcacccccagcaaggtaatccgaccaccaattacccgagctttcatcgagaaatattgcacccctaggcaggcacaggggggcgcacaacaggttacaaacacgtcaccacctcagcagcccgatttagttagaccactgagcgtggagtag

SEQ ID NO: 21953 - DNA, 234 bp, Glycine max
  Peptide Sequence Number=SeqID_138731
atgacggacatcactgacgacatagcggaggaaatctccttccagggcttcgaagatgactgtaaattgctagggaaccttctcaacgacattctccagagggaggctggctccaccttcgttgacaagctcgaaaaaattcgagtcctttcacagtctttggttttgttctgttgtggagaaaatgggcgaaggttgaaacatgacatgcgtaatgcatttagactttcatga

SEQ ID NO: 21954 - DNA, 285 bp, Glycine max
  Peptide Sequence Number=SeqID_138732
atgacgccacttccagtgaaggaagataagtcagggctttcatccttctccactcaggggctttgtccttctccacttgggccttcgtccttctccacttggacctttagcctgtatttggccagtttcaggattctcatcactatcaccttggatgacatggcatcgttgctacattttcctatcataggagcgttccatagcttcgagcaacttcatgtcaacgatgctatcaagattttggttgaattactcgaggtcagctttgtagatgcaagagcttag

SEQ ID NO: 21955 - DNA, 460 bp, Glycine max
  Peptide Sequence Number=SeqID_138733
atgtgatattgcaaataccaacagtcagaatctgaaaaatcaggttgtaagcctacattccaaattagaaagcgatccaacggaaaaacatcaaaaatctattttcaattatcgaaaaacatcaaccagacctgacattgcatttgctgttggagttttggaaagatatcagagtgatccaagtgttggccactggaaagttgcaaagaaggtaatgagatatcttcaaggaacaaaggactacatgctcatgtacagacaaactgatgatttgaaggtgattggctactccaatttagactatgttggttgcattgataccaagaaatccacttctatttatatttttatgctagctggtggagttgtatcttggagaagtgcaaagcagcccttgattgctacttccaatatggaggctgagtttgtttctttttttatggctatcttgcatgattga

SEQ ID NO: 21956 - DNA, 301 bp, Glycine max
  Peptide Sequence Number=SeqID_138734
atgcctagaatcataccggtctcatggtatcctcctttatgtggttggattaaatgcaactctgatggatcaggttcttttgaccctgctgccagtggtgaactgttaactgccatgacaactgtggaattggattttgaaaaaggttggtggagattatatcttgagtgtggctcgaccttggttgttcacgcttttcataatcctgatatagttccatggaagcttcaaaaccattggaagaatcgtcttggtttggctaggtttatgagatttgaggtttctcatattcttagagagg

SEQ ID NO: 21957 - DNA, 1018 bp, Glycine max
  Peptide Sequence Number=SeqID_138735
gaaggcgtaactatcctggtcgtcaataccgatgcgggttttcaccgtgaccggaatgctgaccacatcgcgcatcgctttgatacagtccgcgaccagcgccgcctcacccatcaggcacgcgccaaaacggccgttctgtacccgatcggacggacaaccgacgttcaggttgatctcatcgtatccgcgcgcttctgccagctttgcacaggttgccagcgcagccggatcgctaccgcccagctgcagcgccagcggatgctccgcctcgctataggccagatagtcgcctttgccgtggatgatggccccggtggtcaccatttcggtgtacagcagcgtgtcgccgctcagctgacggtgaaaatagcgacagtgacggtcggtccagtccagcattggggcgatggagaaacgttgcgaagagaatgtatcgaagttaaacccgagctgcaccatggccccccaggtattgtctttgccgaccgaaccggccaggtccagatgcaccgcgttgttgaacggcgacacgccgagaccggccgtaaacacatcggtgtcattcgacttcatatccgcgcgatagccggcacgcagcgccagccagtccagcacgcgatattcaccacccacgccagcgtactgactgctctcctgcgatttaaaacgtttggtttcggtcagatcgacatcgccggtcagagtaaagggtccgcgattccacgccagtccggtggttaccagtgggcgaatctgatacgtatcgcgatagccgttaacctctttggtgtcgatatcgcgcgagaccaggttctgcccggtcacgccgaaggtccagttctccgcgaagtcggtagcgataccggcatcgacgttgaaaccggtatcggtgctgcgatagcggctgtcgttaatatcattcttgtcgtagttataaacgctggcggtgtagttatacagccaggttttctgcagcttaggcgtgacgccaacggagaccgggtgaccggcgatg

SEQ ID NO: 21958 - DNA, 240 bp, Glycine max
  Peptide Sequence Number=SeqID_138736
atgtggctcatcttgctctctttgtggttcttcctgtttcttttgtggttcttcttgcttcttttgtggttcttcttgctattctgcactcttaatgacaacattcataggcttctcttcattctgtgtcgcctcattttgcttgaggcagaacaacaaggaggaggtgaagcaaaagctaaggagaatgaaacccaagatgtcgctgaagatcaaggaggaggtcaaaaagtagtttga

SEQ ID NO: 21959 - DNA, 246 bp, Glycine max
  Peptide Sequence Number=SeqID_138737
atggacaactccacctcagatgaagaagatgaggaggaaaccaacttgtgtctgatggatgatatagaaatagaagaatcaaaatcagaacaagaagaagagaaaaatgatgcaaggcaactcgtggaactacccaaggacaagaaagcaattggagccaagtgggtgttcagaaaaaaactggatgaggatggtaaagttgtgagaaatagagcaaggttattttctaagggctactcacaatga

SEQ ID NO: 21960 - DNA, 585 bp, Glycine max
  Peptide Sequence Number=SeqID_138738
atgatgggaagaagagtcactctcaacactgagtccattgctaaggggtgtggttgtgagagattattagacaaccactatctcaacaattggtccaactggtatgacaagtcaagttatgtggagaaagtgttatatggaggagtgtacaacaactctatgaagggaaaaaggtggagtacaaaaatatttgcaagaaggaaaatatttggacgcaaatatgtaacaagtgttttttgcacaagatcgggttctaggactatatctcaaacttacacaaatgaaggggttcccctttctccacctcatgacactgtaaatgcttatgaatcatccacttttgcttatactccaccaaccataactagaaccacaatagagatgcgtcctccttcctctcttctatatttgaccaagtttgtgaggccaacacctacttggctatcaacatggccagcttggaccaatccaccaaagaagataactgaagatgagaagattagagagaagttctctgttgtgatcttcacgaggaatgagcataactattgcaagaagaaggaaattatcgggagaccacattag

SEQ ID NO: 21961 - DNA, 750 bp, Glycine max
  Peptide Sequence Number=SeqID_138739
atggatgatggaaaagaaatgaagatacccatgcatccaaccacatatcttagattggataaggaatcaaagaaggtggacaacaccctatacaaaggaatagtgggatcactcctatacctcactatgtctaggcctaatataatgttcagtgtatgtctatgtgcaagatttcaaaaggatccaagggaagttcacttaactgaagttaagagaattgttagatatctcattgatactcctaaccttggtctatgttttaagaaagagaaagatttcaagttcattagtttctgtaatgttgattatgttggtgacaagattgaaagaaaaagaaccaggggaagttgttacttcattggtggaaacttagtcatttgggtatgcaagaaaggaaccattacattatctactctagaagcagagtatatatcaatttcaagttgttatgctcaactattatggatcaagaatcaactagaagaatacaacatctttgagagtaacgttcctatcttttgtaataataaagctgcaatcagtctttttaaaaattcatcattgcattacagggctaagcatgtagaaattaaacatcactttataagagaccttgttcagaaagggacattagatttgcagtttgtacccattgaagatcagcttgttgacatttttactaaaccccttactgaggacaagctaattcttctaaggaacaaacttggaatggaatttataagggaatga

SEQ ID NO: 21962 - DNA, 237 bp, Glycine max
  Peptide Sequence Number=SeqID_138740
atgcctctagaatatgcagatgagttatgggtagatcgtatgagggttattgaagtaacctctgatgccacatttgagcaagttctcatgcaagttgagtcctcgactttccagatactcaatgttgaagaagttttgaatgtggatggtagcttcatcatcattctaacctgtgatggtgatggtgtaaataaggcttgccaacaagagatgactcagcagaagagcacgaactaa

SEQ ID NO: 21963 - DNA, 1281 bp, Glycine max
  Peptide Sequence Number=SeqID_138741
atgagctccttgactcacctcgacctctctgatactggattcatggggaagattccatctcagattgggaatctctccaatttgctctatcttgacctcggaaattatttttccgaacctctgtttgctgaaaatgtagaatgggtatcaagtatgtggaagcttgaatatcttcatttgagaaatgcaaacctatccaaagcatttcattggctacacactctccaatctcttccttctttgacccacctatatttatcaaactgcacactccctcactataatgaaccatccttgctcaacttctcatctctgcaaactctcgatctttccgatactagttattcccctgccatttcttttgtccccaagtggatattcaaattgaagaaacttgtttctcttcaattatggggtaatgaaatccaaggtccgattccttgtggtattcgaaacctcacacatcttcaaaatcttgacttgtcttccaattcattctcatcttctatacctgatgccttgggaaatttgacttctcttgttgaacttgatttatcaggtaatcaacttgaaggaaacattccaacttctttgggtaatttgacttctcttgttgaaattgatttgtcatatagtcaacttgaaggaaacattccaacttctttgggtaatctctgcaacttaagggtgatagatttatcatatctcaaactcaaccaacaggttaatgaacttttagaaattcttgctccttgtatttcccatggactcacaagacttgcagttcagagttcacgactttcaggcaatctgacagatcatattggggcatttaaaaatattgagctgctagattttttcaacaactcaattggtggtgctcttcctagatcatttggaaaactttcatcattaagatatctcgatctctctatgaataaattcagtggaaatccatttgaaagtcttcgatcactctctaaattgttatctcttcatattgacggcaatctttttcacggagttgtcaaggaagatgatcttgcaaatcttacaagcttgacggagtttgccgcatcggggaacaatttcactttaaaagtgggtcccaattggattcctaattttcaacttacctatttggatgtgacatcatggcagttaggtggtcccagctttccattgtggattcagtcacaaaaccaacttcaatatgttggactatctaacacggggattttcgattctattcccacacagatgtgggaagcactttctcag

SEQ ID NO: 21964 - DNA, 321 bp, Glycine max
  Peptide Sequence Number=SeqID_138742
atggaggatgagtcctctagctatggtcccacattgatcctagggagaccattcctaatgacacctttgcctacacatttgaagtatgcttatggagtagcaaataaccagcttctagtgatcatttcaagcaccctccaagttgaacaagaggagaagttgctacaagttttcagagatcataggagattcattgggtggactctagttgacctttttgggattagccttgccatctacatgcataggatgctattggaggataagttccgaccagtttacagccataaaggtgaatcaatcccaccatctaggatgtga

SEQ ID NO: 21965 - DNA, 288 bp, Glycine max
  Peptide Sequence Number=SeqID_138743
atgatggggtacgcaccttcaagctttgtggatttggtcttttccggcgaaaggatcaaagtgggcctggaaaaaggtaaatctgaccatcctgctttgatgaatgtgaaaactgaggcaaatgaagagggtgagaatgaaggagaaacccatgctgcaaccgccattcctatacggccaagtttcccaccaacccaacaacatcattactcagccaatatcaacttgtcgcaacgtgttcctggtagaagtaggaatagtgggggcaagatacgcgggttaggctaa

SEQ ID NO: 21966 - DNA, 266 bp, Glycine max
  Peptide Sequence Number=SeqID_138744
gaaaaaaaaaatccacaactcaggcgtggaaagcagtgagggtggcagcagtatgggtcatttggcggaatcggaacaacatcattttcaaaaaaggacaattggactcagagaaggttttagaagagataaagttgcaatcttcggcatgtttaaaagctaagatgaaaggtttcaaggcaattcttttaatgaatggtcatgttttccagcattgggtttatcagtggcaggataaatcaaatactttcttgatacatgggtga

SEQ ID NO: 21967 - DNA, 258 bp, Glycine max
  Peptide Sequence Number=SeqID_138745
atgaaggctgatatgaaggtcatgaaggagcagatgacaatgatgatggaagctattatctggtatactaacttggaaccctcttgggtccactcttggaaggatcttatggattccttcattaagcaatatcaatacaactttgagatgactccagatagaatgcaactacaaaacatgtgcaagagagataatgaatcattcaaagaatacactccaaggtggagagatctgacaactcaagtagtacccccatga

SEQ ID NO: 21968 - DNA, 270 bp, Glycine max
  Peptide Sequence Number=SeqID_138746
atgaatttattgcctagcgctgttcatgcatcctccaccaacaagtctggagccccgcgaagttattgcgtagcgctgttcgccgattgtgcattctccaatcttattcggagacccatgaattcattgcctagtgctgttcatgtgtcctccgttatcaagcgcggagcgctgaaaagaagaaggagtagagacgagagttgtcatcacggaaagggcaggacgggcaaaatcagtgtcttatctttgctttcctcttatcttcgatga

SEQ ID NO: 21969 - DNA, 522 bp, Glycine max
  Peptide Sequence Number=SeqID_138747
atgttggttactgaggacaagtctcatgtcgttgttgccatagacaatgatggctgttgtcaccggagctctgccggcggcgagggtttcgccgacgccggcgaacggtcagatgaggagcaaaggtcctctcatgattctggcaccgagattgtgggagtgtgtgagaaggagagaggatcagagtgttctgtggaggtggatctggttcctgaggttaaggtgcatttggccaatgtggagagggattgtaggatttgccatctcagcatggatatgaccaaccatgaatctgggacttccattgaattgggatgctcttgcaaggatgatttggctgctgctcacaagcagtgtgctgaggtttggttcaagatcaagggaaacaatgtctcaatactggagtgtgaatctgggataataatgtggattaaatggtcatgcttgatgaagtgtcccaatagtggagatgtgaatctgattcttcttctgctaacattaggatatcgtgagctaaattag

SEQ ID NO: 21970 - DNA, 972 bp, Glycine max
  Peptide Sequence Number=SeqID_138748
atgccatacagtagtcattacgaatataatgactgtcaattatcaatatctaatgagaattcaatttctgcagaggaagaggatagcatcatagtttcagcccatgcaatccatggaaacaaatgggcagcaattgctaggcttcttccaggaagaacagataatgcaatcaagaatcactggaattctacactgaagcgcaggtgtatggaaatgggaagatatgtcccagcacatgctgatgtgatggaagatggtactggcagctttgataaaacaaaagcatcctctgaagaaaccatgtcaattggggatatcaattcaaagaatcctgctgaagtcagaaatgtcatgatggataatgaaaataaacctccaacaaaagatgatgctaaagtggaggaacatcctactcttcatcgaccagtagcacgtgttagtgcatttagtgtttataacactccaggaaggtcaacaatgggatcatgttcaaagatgttcccaaggcagagccctttgatccaatcccccaaaccagacgtaggatcctgcaagttatttgatgatattgattgtgagcccatggttccatcacaatgtggtcatggctgctgcacaggagactcgagggaaagccattcgcatggttcacttctaggtcctgagtttgttgactatttggagtcaccttcctctagtcatgcatttatttctatagctacagacttgaacaatatagcttggatcaagagtggccttgagaattgtagtactggagtaactgagaatactgcaaacttgacagcatctcgaggagttgccagtgctttgcaaacaaacttcttaggacaagatctaaagaatggctacgggcaatttgaggagggacatggcatgtttttgggtgcgatgcaagaagtgttgtcaacaaagatggctaggcaacattatgcaatgcctgcggaagtttaa

SEQ ID NO: 21971 - DNA, 207 bp, Glycine max
  Peptide Sequence Number=SeqID_138749
atggttaattttggtggactgcctctaattactgcatcagaaaccatcagatgcttaatacccagttcatggcctagaaactgcattctgcatatgaaagagagtggtatgattcatatttcttccatctgtaggagaaatgaatggaaggaaaaaagtaatctctctccaaagtcacaagcgcatattctccctcttacaagttga

SEQ ID NO: 21972 - DNA, 354 bp, Glycine max
  Peptide Sequence Number=SeqID_138750
atggtgattttcatccatggagttgcagcaaaaaataaaggagaagaggtagcttccttgagaagcacgtgttacattcctccaatagctaagctcactccatgccaaaaatacatgaaggaagaaagcttccttgagatgcttccttgggaagcaacccatgagcccaaaatctatcctaaggctcatgagaaccctagggccttctcctgcatctttggcctaatcttcttggagtcttctatccaatgcccttgcggggtaggattgcatcatcccttcccccttgaaaaggatttgacctcaaatccagaggttcttgaaactctgggcttctttcctcgacacctgtaa

SEQ ID NO: 21973 - DNA, 114 bp, Glycine max
  Peptide Sequence Number=SeqID_138751
atgggtaccaatagcaattctaatagtaacaacaacaactccgcatttagaatggcagctaagccttgttcgattaccacattgacccaaaacagcccaactagcggcatttaa

SEQ ID NO: 21974 - DNA, 1536 bp, Glycine max
  Peptide Sequence Number=SeqID_138752
atgtctctctgtcgtattggattggaacgatctttcaaggaaatactcgttgcaatcggtgattctgcagttgttattgaaaccacaatgcggggctatgacgacgaaggagatggttacgacgattattatgagaatgagggacaagaaaatgagtatgaagaggggggtgaggaagagtatgaagaagaggaagaggtgcccaggaagccttcaaaggaagaaatggagtaccttgagttgaggcagaagttgaaagaatccattagaaagcagatgaagaaggatagtagtgctaatggtactttgcgccgggattcaaccgaccgaaacaagaataagcttccttatgataattatggctccttttttggtccatctcaaccagttattgcacagagagtaatccaggagagcaagtcattgctagaaaatcagcatttggcatctaggttttctaacccacaacacattaagaagaaccagaataaagtacctagtggaggatcaaagtcttcatctcataatctggcacccaaagtcagcgagatacaagttaaagcccagaaaatcaagaatactagagattactcatttcttttatctgatgatgcagagcttccagctccttcaaaagcccccccaccacagaatatgcctataagaaattctggaaacttatacaggatttttgctgatgttgaagagggacgaccagctcaagttccagcaaggagtaaactgcctttgagcaatggtggcaagcatgttcgtgccagtcatgaggaacggaatgtaggttctgctgccggccgtttgcctcctaaatcaggatccagttacaagaccagtaaacctagtatggcatcagcagattctagaaagcagcttggtaacaacagtgataatggaccaggctggccagttgggccaaaaggcttgccttcaaagatttctgttggtaccactgggaataagtcttcagcacctggtataaaaaactctgtgaatggtatgcggaaatcactcccttcaaagaatcatccatccattccaaaacagagtgtagatcaaagaatttcgaagcagagtgttgaacaaagaattccaaagcagagtgtggaacaaagaagagacatacgagaactaaatagacctaaaatgacaccaaaacaaccagtggcatcatcaaaaccacagataaataagccacttaaacaaaattcagttcatactgcttcgcaagatcgtcgtcccaagcataaggttgctaaacgaccctttgatgatgatgaggacgaagtggatttcaggaacgtgatcagaaatatctttaattacaaccccaataaatttgttgatgacgatgacgatgacaatatggaggcaggctttgatgaaatcttgagggaagaaaagcggagtgaaatgattgctaaaagggaggacgaggagcaacttaggttaattgaggaggaagaggaaagagagaggagaagaaaaatggcaaagttaaagaaacggaagcttggctag

SEQ ID NO: 21975 - DNA, 174 bp, Glycine max
  Peptide Sequence Number=SeqID_138753
atgctttacagaaatgccagatggcagcaaaggagtggaggaggagggcatgtgaatcatgaaggaatcatgcaagagagaagagagggggaatatgggcatgagaggggattggaacaggtaatccttgtaccgactattgagggcacttcctcagtgttcctaaagcattag

SEQ ID NO: 21976 - DNA, 636 bp, Glycine max
  Peptide Sequence Number=SeqID_138754
atgggtgaggcagagatagacttaaaaccatatgttcagtgtaagcagatgggattgggtaagctcccaaatggttgttcactcaagaggatccagccagatagaactaattaccttgctgaagagagcagctgcatttggcaaaatggaaagattgtccaagaaatgtttttgagattgagaaatgttgagagtggggagatacttgtggaaattgagtgggttgatgttgttggttgcaggggcttatcacagccatgggatgtgttgatcaaaatcttacggttctggtcaacaactatcaatgggttcgtgcttcctaaagctacgattggcctgacccttctagatgtattgactattctcaacttgtcgattcatggtgaggacttgttgtcactctatggaatatgttgtgttccgtctactacccttggcatcaaattctccaaagatgactccagatattccaagttcatgcttctcgctaccaagaagagtgacattgtttcaccagccaaacatgaagacatttgctatgggcaagctttcattcaccttccagcatcaaaagtgtcagcctttttgattgccaactggcacttgatggctgatttttgcctagctcccttttag

SEQ ID NO: 21977 - DNA, 1320 bp, Glycine max
  Peptide Sequence Number=SeqID_138755
atgacgctgatttccaattccgacgtcgaaagccacgccgacgtccaaatccccgacaccgcgcatcaaattagcaccgattcatggtttcaagtggggttcgtgctgacgacgggcatcaacagcgcctatgtgcttggatattcagggaccatcatggttcccctgggttgggcagggggtgtggttggtttgattctcgccaccgcaatatcactctacgcgaatgctcttattgctaggctccatgaatatggaggaacaaggcatattcgatatagagatcttgctggatttatttatggtagaaaggcttattccctcacatgggctctacagtatgtcaaccttttcatgataaatgccggctacatcattttggctggttcggctttaaaggccacctatgttctattcagggaagacgatgggatgaagcttccgtattttataggcattgctggatttattttacctccacatactcagtattcatgcccgagctggaaacatctacaacatggtggggttagctctcttagtagggattttcttttcctatccaggattcaaacccacgaccttcatgaaggggaaacaagtataaaatcaccacctcgtgattatagcattccggggacatcaaccagtaaaatatccacaacaattggggcgtctgctaatcttgtgttcgcatataatacaggaatgcttcctgagatacaggcgacaatcaggcagccagtagtcaagaacatgatgaaagccctgtattttcagtttactgttggagttctgccattatatctggtaacctttgcaggatactgggcttatggatcttcaacagctacctatttgatgagtgatgtcaatggtccagtttgggctaaggctatggccaatattgcagcctttcttcaatcagtcattgcattgcatatatttgcaagtccaatgtatgagtatttggataccaaatatgggatcaaagggagtgccctggcttttaagaacttgtcatttcgagtcttggtaagaggtggctacctgactttgaacacatttgtatcagctctattgccctttcttggagatttcatgagcctcactggagctatcagcacatttccccttacctttattcttgcaaaccatatgtaccttgtggcaaatgcgaacaaactaacatccatccaaaagctctggcattggatcaatatttgtttctttgccttcatgtctgttgcggcaactattgcagccctgcggcttattgatttagactccaaaacgtaccatgtttttgcggatatatga

SEQ ID NO: 21978 - DNA, 282 bp, Glycine max
  Peptide Sequence Number=SeqID_138756
atgcagagtgatattgatagagttggaaaagataagcccaaaaaggaaatggcaagggttgcatatgcaggacatagaatgagggttaagaataaggtgttgggtgatggttactacatgagagtgttccgccttgacgtggcaatgggcatgtattcttgtgtcattgatgctttggtgttgactggattcaattcttggcattgcatggctaagaacactaggggaagtgacaacaaattgggagacaacaaggacttgttttattcccttctcatttag

SEQ ID NO: 21979 - DNA, 405 bp, Glycine max
  Peptide Sequence Number=SeqID_138757
atgtctttgtttcaaactaagaaaaagaagagtgggaaagatagagaaatggcaaaggatctttctaaggaacctcctccaacttttgatactcgctggaccaaaacgattgacagaattggtctcaacaaatgtaaagatgacttagccgctcttacaggatcagtcaattctatccctatactaaaaaaaccatccttactagatgaggtcgcgtttgaatacttccactcttctatgactagtccttcatctcgtctcggcagattgaataatctaggattcagtatcaaaaggcttgagtacgaaagtaggctcttcctttattacgctattcttcccatcgagcaagggaaatgccctactacagaagaaaaactaccatggaaaaagaaagaggaatag

SEQ ID NO: 21980 - DNA, 231 bp, Glycine max
  Peptide Sequence Number=SeqID_138758
atgatacaatatgatttcttcttgtgttggatgccattgagagaagctgcaatgggacttataagggaagcctcattgaaagacaacttcactcctaagctctttcagctaagggcagatgattcccttgccattagatccgcgcttgaaggcgaagtctttcttcttatagtaaggaattcacctattgctcaacagcttcactgggagaaaggtcttccccgggcttag

SEQ ID NO: 21981 - DNA, 576 bp, Glycine max
  Peptide Sequence Number=SeqID_138759
atgaagtccctccgaagcaagtatcgttacttgctcacacactccactttagccacaaaagaagagcttctaccctttaaggatcaccaaaaccaacttgctgctttggattacatcatagcagtagagagtgatgttttcatttacagctatgatgggcacatggccaaagcagctcgaggtcatcgcgcatttgaagggtttcgaaaaactattagcccggacaagcaaaagttcgtgaggctgattgatcagttggacaatggtttgatttcttgggatgagttttcatcgagggttaagagcatacatgcaaataaaaatggaggtcctcatcatagaaaagttaatcgacaccccaagttggaagagagcttttatgcaaacccttatcctggttgcatttgtgagcgtcgtgagacaatgatgatgatagcattttggcaattggagctgcaaaagccaaataactattttgaattgtatattaaaaagaaatttattgagctaaatctcaatcttagacctcaagatcgctttaagttgaatgttgatggtgctcttatgagaatttag

SEQ ID NO: 21982 - DNA, 132 bp, Glycine max
  Peptide Sequence Number=SeqID_138760
atggagtttttgaaaaaggaagtagctttgtccccaatgaataaatcagtggcagatgtcaatgtaactcacgcagacacagtgcagatgctcggcacagccacttcggctgcaccaagagaacagcgctag

SEQ ID NO: 21983 - DNA, 519 bp, Glycine max
  Peptide Sequence Number=SeqID_138761
atgcctctcatgctagaagacatcaacccatatcgttcttctgtgccatctaatagacccctccttaccttgaacatgttcgctccgtttgactatgtctataagaaccccgaaactgatgcaattgttgccactgcttccgccgagcttaggagaatagaagaggagcaggaggcatcaccattgccacaatggttaaaggtcgccaaggagaacgtactctacgtcaggggttcaattcttggatacaagaggtccaagtcaaatcaatacccaagcacctccctaatccagattgagaatgtaaactctaaggaagaagttgcgtggtactgtgggaagcgcatggcttacatctacaaagcgaaggtaaagaagaacggaagccactatcgctgcatttggggtaaggtcaccaggcctcatggtaacagtggtatagttcgagctaagttcaagtccaatctgccacctagggtgcaagggttagagtattcatgtatccaagcaatatatgag

SEQ ID NO: 21984 - DNA, 279 bp, Glycine max
  Peptide Sequence Number=SeqID_138762
atggcgaagccaactcttgctgcaatgaatgcttctacaaagacatttgtatctgttattgctaagaggacaactttgtctctatacttgtcattgctaaagcaaagacatctctcgctgcagcaaatgacttttagagaaatgccagtctctgaaggttttatcgctgtggaaaaacctaaattcactgtagctaataagatgaatgtcaccgtagcaagtagtttcatgtacatgggccaatttactggggaccattattttgtgtcaaggggatag

SEQ ID NO: 21985 - DNA, 438 bp, Glycine max
  Peptide Sequence Number=SeqID_138763
atggcagcggaatggagaaggaagagagagaggagacaccacttcaaggagaagatgagtctagaagaagctcaccaccataggaggccatggataagagcttggaggaagaaggagatgaatgaagggagagggagagaagagcacgaaattttgtgctctaagagagctttgaaatatgaattatggttcagcccactaatccaagatcaagtccaagattctccactaagtgtgcttaggtgtcatgaggcatcccgtgggcccgaaatctaccctaaggctcatgagaaccctagggtcttctcttgcatctttggcccaatcttcttggagtcttctatccaatgcccttgcgggttaggattgcatcacgttgtcatggtggtttttgtggcacctccagcaatggcggtcataggtgtgattagagggtga

SEQ ID NO: 21986 - DNA, 294 bp, Glycine max
  Peptide Sequence Number=SeqID_138764
atgtggaggctgaagatagcagaaggtggaaatgaggcatacatattcagcacaaacaattttgttgggaggcagacatgggagtttgatcctgaagcagggactccagaggaacgagcccaggttgaagcagctcgtaaggatttctaccaccaccgcttcaaggtcaagccctgtgctgacctcctttggcgttttcagattctgagagaaaataacttcagacaaacaatacctagtgtgaagatagaagatggagaggaaataacttaccaaaaagcacaagcactgtga

SEQ ID NO: 21987 - DNA, 192 bp, Glycine max
  Peptide Sequence Number=SeqID_138765
atgaacatcttgagcttgctcttcattgagattccccttgaaaggaaatttgggtgtgggaactttacccatcctttgatcgatcactttgatcaaccttgggattggtattttctccgtgtgggtaactttgcaaaccttgggagaatgcgggtaggatttttccctcggttatatttggccactccgtag

SEQ ID NO: 21988 - DNA, 222 bp, Glycine max
  Peptide Sequence Number=SeqID_138766
atgaagcttgcgattgcgttgggagtgaaagaaggtgaatccaagaattgccctgcactattggaaaacggtgcttctgcatcggttacacaacacatacaacgtcgatttctaaccatcgtcgtagcggttgtcgtagaatgtcaacccacactactacaaaaaggctttctacatcggttaaaaatgtctttctatatcagttatgacgcgtcatcgtag

SEQ ID NO: 21989 - DNA, 513 bp, Glycine max
  Peptide Sequence Number=SeqID_138767
atgatcatcgtagaatcattcacgtatggtcgtgttcacagacccgtcttagaatgtggcacatcctacgacgaatcctctatcgcaaccgtcgtagtagatgacactattagaaaacccaacaaccctaatgtgaagggattcgtcgctcccaaggcctccgccgtctccattatgccagagagagaggcggtaatgtcttcaatcagattcctatggatcttaatggtgaagcttctccacttcagaagtcaacaaaatcccttgaaccatagacttcaaagtgaaaaagaggttcactgttgctcgccacgacgataccgaacaccaccggcaacagcgcgagttgaaggagacgaggaggtagcagagggaggtgttgccgcagacgatggagaagtagaagattgcgctgagagcgaagatcttgaggaactgcttcttggagtggatgtgctggagcagaacgagttcaaggaagttgatggaggcgtaggaataagcggtgcatga

SEQ ID NO: 21990 - DNA, 642 bp, Glycine max
  Peptide Sequence Number=SeqID_138768
gatgatggggaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtagtaagactcgacaggataaaattagaaacgaagctattagagagagggttggagtagcgcctattgtagagaagatggtggaaaatagacttaggtggtttggacatgtagagagaagaccggtagactctgtagtgaggagagtagaccagatggagagaagacaaacaattcgaggcagaggaagacccaaaaagactataagagaggttatcaaaaaagatctcgaacttaatgatttggatagaagtatgtcccggaagccccaaaagccattttttaacaaaacgggggaggtggttgccgcccagctcacccaggcaaactcagctcgcccaggcgagctaggttgcttccaccttaagcaaggaaatgcccagaattctctagaagggcccaaattttga

SEQ ID NO: 21991 - DNA, 498 bp, Glycine max
  Peptide Sequence Number=SeqID_138769
atgaaatgcgtttttgttcatgtgtccccccccttcgagtttggagctatgcgtagtgattgcttagtgcaattctccattcatgtgtcctccaccttcgagtttggagctatgcgtagtgattgccccatgaattgcgttttcgttcatgtgtccaccttcgagtttggagccatgcgtagtgactgcatagtgcaattctccattctcaccctttttcggagccccatgaattgccttttcgttcatgtgtcctccaccttcgagtttggagctatgcgtagtgattgccccatgaatagcgttttcgctcatgtgtccaccttcaagtttagagctatgcgtagtgattgcttagtgcaattctccattctcaccctttttcggagccccatgaattgccttttcgttcatgtgtcctccaccttcgagtttggagctatgcgtagtgattgcttagtgcaattctccactctcaatcttttcggagccccatga

SEQ ID NO: 21992 - DNA, 423 bp, Glycine max
  Peptide Sequence Number=SeqID_138770
atgcgtaacttcattgcgaggctgaggctgatgcgcttcttggtgtccacggtggtgatgaaagcggagcgaagactcgggaggtcaatttttgtattttgtggctatattgttaaggtctccacagatggtggtgcgtctgttggggatgagttgagagaaaagggagtgagtgtgagagcggatagccggtcaaggatgatgtcaagcttggcggtcatctctagagtcttggtggtcatctccaaagtttgggtggtcatggtggataggttcagggtgaggtggatattcgtggagggtgaacaggtagtgcatcgggttggaagcttatccaaaccatccatcacatgttggagccaaatggtaatattaaattggagcacatttatatatagggaggccaactacttcgcagggtag

SEQ ID NO: 21993 - DNA, 198 bp, Glycine max
  Peptide Sequence Number=SeqID_138771
atggaggccccattccagaacactcaatcacaaggagaacatggacaattcgaacaggagaactgccaggaaatcacattacaagcggaaacctcaaagagagttgggcttcgtcctcaaaaggaaacaacaccagaaaaactagtcttccatagattcaaacagaaaacgcaaatgaaacatgaagcagaaacgtaa

SEQ ID NO: 21994 - DNA, 432 bp, Glycine max
  Peptide Sequence Number=SeqID_138772
atgccgactcagccacccatgccacctccgtcgaccataccgactccacctccactccccgcactaaggcagcagcatcccacatcggtgccggctccgcgtaccattgctgtcatccctctccttgctaacaacaagccccacgcgccttccgaccgctgctgggccactcttttccaaatctgcaaggagtaccctagccgccgcatccttccctcggacctttgcttattttccctcgtcacgatcgccgccaaggtcggggacaaggagctcaaccactccttcctcctcaccttttacgctactatcggcgctgcaaaatggctctacttccgcaacactaacctccattcactcattcctttacccattttaatttgggatcccggttcgaattttcaagccatggttgtagccccagcaccttga

SEQ ID NO: 21995 - DNA, 477 bp, Glycine max
  Peptide Sequence Number=SeqID_138773
atgactgccattgtgactctgacctgtgcctcaatatgtcgtcaatcctcagaacagtttcataatcttcattatgcatcccctttcgttaacactgcatcctatcttctccttcacccaatcattatattgcacaagctcaggcttattgcacatgctaatgctctcctacttgcaaccatgccaagccatctgttgctgctaatcaactgtcactgttccgtcaagctccttaatgtcattgcgtgcttgcactatccttacttgagtgggagacccattcaaagacacagctgggccttcaatccatgtccttataaagatgcttgcaacgattacactagtaatggctccagtcttcctgtgagtgagggttgtgttgatatctctattgcggccgcctcagaaaaagcatactcgcgccattttgattttgctaattttggaagtatagggataggttgtatgaatctatga

SEQ ID NO: 21996 - DNA, 1155 bp, Glycine max
  Peptide Sequence Number=SeqID_138774
atgtcgatcagaagcagcgctttcttttgctttcaaataaattgctccgattcaaagcaaggtcgtggttttggagaaaacactaacagtaacagtaacagtaacaggattaagaccaacaaatctgacaagggatcaacaactaaacagtctcgccctctatcttctcaggcaccccgtttaagttcacaacttgacggcaaatctaggaacgactttttggatgttgactttgaggaacggctaaaagcagttagaaggtcagcacttgagcagaagaaggcagaggaggaaaaagaatttggagcaattgactatggtgcaccaattccttccgacaataagacaattggccttggtactaagattggagtaggggtagctgttgcagtcttcggtctggtttttgcttttggtgattttcttccatcaggaagtgttagtcccactgaagacagtgctgtggtcaatagtaagttgtctgaggaggataaagctactcttcagagtaggctcaaggagtttgaagcaacattaagtaattccccaagagatcaaattgctcttgaaggagctgcagtaactttggctgaactaggggaatatgcaagagcttcttctctacttgatgatttgacaaaggaaaaaccaaatgatgctgatgtttttcgtttgcttggagaagttaagtacgaactcaaagattatgaagggagtgttgccgcatataaaagctcagcaagggtgtccaaagatatccaatttgaagttctccgtggcctttccaattcattacttgctgccaaaaagcaagaggaggctgttcaattacttttggcctatcgtgagcatctgagttcagaaaacttgagcaaaaattctgatagcaacccaacagactcacaaaagctggatccagtccaagttgaattacttctagggaaagcctactcagattggggccatgtcagtgatgctgtaactgtttatgatcagctcatatctactcaccctaatgattttcgtggatacttagctaagggaatcatcctaaaagaaaacaaaaatattggtgatgcagaaaggatgttcatacaagctaggttctttgcaccagatagagccaaagcacttgtggaccgttattcaagatga

SEQ ID NO: 21997 - DNA, 264 bp, Glycine max
  Peptide Sequence Number=SeqID_138775
atgaacacccactcaaacttagcatacttctaccatcgtgcaataaccacatcactcattccaaacttagcatacttctaccattgtgcacacagggggttctgtgggttcgagcaagcagtttccagcagtattgaaaacaatatgggacaatgtgggtgtcgagggaacactttccggaagattttaggtgggaggagaaagataagggagagtgcagggttttcgagcgtgtgggttaaaaccgatgttaacatcaactag

SEQ ID NO: 21998 - DNA, 210 bp, Glycine max
  Peptide Sequence Number=SeqID_138776
atgaagaacaatgaagaatggtggaaaaccttcacgaaatcgcccaaggaaacgtctcggaagcgttacgcaagcgcctcggcttggattttcttcatgggaaaagagggaggtggttgccgcccagctgggtttctatttgcacacccttgtttactaaatacacccccattgcctttttttgttgattctttttccgtaacgttatga

SEQ ID NO: 21999 - DNA, 468 bp, Glycine max
  Peptide Sequence Number=SeqID_138777
atggattcaaagaagtgtaacaagatcagagaagttgttaggcttcaacaaatcctcaagaaatggaagaaagttgcaactgcttccaacaacaacaacaacagctccagcagtaaaggcatcaagtttttgaagcgaaccctttcattcacagatgtttcttccaccaacaccaatcaagacatcgttccaaaagggttccttgctgtttgtgtagggaaagagctcaagagattcattattcccacggattacttgagacaccaagcttttgagatgttgctccaagaagcagaagaggaatttggtttccagcaagagggtgtcctcaaaatcccatgccaagtatcagtcttcgagaaaatattgaatgccgtggaagacaacaaacaacccttggatgagtttggcttcaatgcgtctgattgtgaagtcacttcccctcatcatgctcaaccgtgtacatag

SEQ ID NO: 22000 - DNA, 2583 bp, Glycine max
  Peptide Sequence Number=SeqID_138778
atggctcttctgcagccaaggaagatgcagatggtgagaacaaatgacaaaaaggaagaggttccaggtagaggattactagaccaggtcttctcttggtccttctccgatattcttaatcaaaatctctatcaaaatcaggtgaagaaaatccctgagacattttcgtcgacgtctatttatttgagatcattcattttaccacttgttgaggaaacgcatgctgatttgctatcatgcgtaaggacagtgtcaaaggcaccgatacgtcaaataaccagtgtcagaaaaactaagaatcatcaatttcccagtgatcttttctaccaaattactgtgttggaaaagcaaggagggcgtgcatatgtgcctgcagttggagacctcatcgctgtaaccaatctacgaccaaaatacaccgatgatttgaacagtccttgtgtttttgccttcgttcaccgtgcttctaataactctatcaccgtcttatcatctaaacttatagcggctcaaggtgtgcatgaccaaaacaaagatattctattcgcggtttatcttactaacctgaccacaaatataagaatctggagatcactcagcagtgagctggaagcaaggaacctgaatatgatagatgaagttcttcaactccgttcttctgaatgtggtacctgtgctgagtggcttgacaatggtttaaactctgaaataagaggcaaaatatgcaactctgatttgaatgactcacaaagagatgcagttctaagttgcattagcctaagggaagaatggcgtcatcaaaactctgtgaagctaatatggggacctccaggcactggaaagaccaaaaccgttggtttgatgctattctgtcttttgaaattgaagtgcagaactctgacatgtgctccgactaatgttgctgtgctcgaggttgcaaagcgtgttttagttcaagtgaggaaaaatgagtctcatgaatatggtggttacggcctcggagatattgtgttattcgggaatggaaagcgaatgaacattgatgaccatattgaacttcatgatgtctttcttgactatcgtgttaatgcactcagaaaatttttgggagtgtggaagcatagcttagcttcaatcatatctttgcttgagaacccacaaagactgtttctagagtacgtgaataaaacagaggaagatgtgattgtgaatgaccattctcaaagcaagaaaaatgaacaggacactgcagaaccttggacatttgaggagtttataaataagagacttgatagtttgcgagaactgctaacctttagttttatgaatctttgtaagcatctaccaacttcttttatttcactaacagatgcgacaaacacgtttcgagcccgcgatctccttcactctatttcaacacttgtcggcaaacagcatgaggggataaaacaagagttatatggttcaaaacacaatgaaagtgagagattgaccataaaagaatgtcttgatatactaaagttgcttcctaagaagtttcgtattagaggatcattgagagatttctgcttgtctaacgcatgcttggtgttttgtaccgtgtcaagtagtgccaagttgcacgaaaagggaatgactccaatcgagttattggttattgatgaagcggcgcagctcaaagaatgtgaagcaaccattcccttgcagctttatggcatacgccattcaattctcataggagatgaaaggcaacttccagcaatggttcaaagcaagatttctgaaaaggctgaatttgggagaagtctgttcgaaagattggtgcagttggggcacaagaagcaccttcttaatgtgcaacacagaatgcatccatctatcagtttgttccctaatacggagttctatagaagtcaaattttggatgctttgaacgtgaaacagataggctacggcacaagtttcattcctcagatgatgtatggttcatattctttcataaatgtgccgttcgggaaggaggaattagatggcaatcatagtcaaagaaacatgactgaggcttccgttgtgtcggaaatagtcaagattcttcatgaagaatatgttaggacaaataaaaaggtgagtgtggatattatatcaccatacaaggcccaagtttatgccattgaagaaaaagtaaagagacattctagtagagtttcagatagtggtggctttgaagtgagggttggttcagttgatgggttccaagggggtgaggcagatgtgataatcatatcaacagttagatgcaataacaagggctctattggttttctttccgaccagcggagggtgaatgtggcattgacacgtgctaggcattgcctttggatattggggaacgcaacaacgttactgaacagcgaatctgttttgaagaaattggtcatagatgccaaaaaccggggctgtttttataacgctctagaagacaaatgcttggcaaagactcttttatattccctgattgagttgaatgcagtaaatgatttggacaacgtgctttcttcattgttcaacgatgcaagatggaag

SEQ ID NO: 22001 - DNA, 417 bp, Glycine max
  Peptide Sequence Number=SeqID_138779
atgaaactggctacccctaaaataattagaaagatcccaagccctctgaagttggtatccagaagctcaagttcagcagcaaagaagccactattggtgtcaggatcaggacaaccgtcgtcgtcgtcggatggaagtagcaagcaacaggtggttcccaaagggtccctggctgtttacgtgggtcccgaccttcgaaggtttgtcattccagtaagcttcttggccatgccagacttcaaggttttgatggagtcggtggcagaggaatatggctgcgatcacgatggcgctattcaaatcccctgcgatgaagactattttcagcaaatcttgatgtcttgttcccaaagacaacggatcatatcccctaagaaactaattcctaacatcccactcatatgtactactcattaa

SEQ ID NO: 22002 - DNA, 1596 bp, Glycine max
  Peptide Sequence Number=SeqID_138780
atgccgggccagggtgatggtatgcatcgaaacgtggtagtagtggaggaggacgaagaagcgaatttgaagaaatggcttgattttatgcaaacgatgctgggttgtttgggaagcgaaggttttgaagtggaagcatgtagcatttcccttgttccacggcaacttcgacaatcgaaagaggaagcttacacgccacaagtggtctccataggacccctacacaggggaattaccagcagcacggacctactatacatggaagagatcaaatggcgctgcttgctgcgtctcattgaacgatccaaacaagacaaagagcaagtcttgaggaattgcggcaaagcaatgttggagatagatgaaatagctcgcgctagctacaacgttcaagttaagttgaaccgctacgagctcgctaaaatcatggtgttggatggctgtttcctgctggagcttctcatcggtggatcaacccaactaaacgaacaattaaagtgcatctcatcagatagtgattcttctcttgtgactcaagccatagaaagcgaaaaggtgttgttggatttgatcatgcttgaaaaccagattcccctggtggttctctctactttgtctacaaacctttttcccaatacttttacaggggctgctagtaccagactgatacatgagcatgcgctttctatctttggctacagtagttctccggattccaacattatcaactcccccaagttcaaaggctttcattttcttcaacttgttcactccttcatagacacggaaaatgatgctatctggcagcaaccaaccacggaattgcaaatacagattccggatgaaagtcctcaaaaagtaaaactagagcgatgtgctactttgctcgaagcagctggggttacaattaaaccagcaaaggcacagtacaaggctaagactaggtttgacttgaaggtaacattcagagacgggaaactaagaattccgcagctacatattaccaaaaccaccgaagcaaagtggaggaacttaattgcttgggagctgaacagtgctaccctagaaaaacagcgcgagttgaaaacagacagaattagctgtcaattcatttcttatgcttggttctttcaaagtttgacttgttccgtccacgacgttaaacttcttcgcgatagaaaggttataacggtagaaaaagagaggactgacaaaggcaaaaagaaaaaaataatgagcaacaaggatttaatgaatttgtttctcagtatcacagaggaatttcctgaggttgagattcaagtggattcccggtttcgtcatgtaattgagaaattgaactcgtacccaactcaagaagatcgttccatggcaacttgttggaaaatcatcgcatatggtgtcaggggacccagtaaaatcatgtggcattttttcagacgctttctaacatggatttggtgcaaatggattgaggcatatgggattttgaaacgtgtttatatccctagcggctggagactaatagcggtgcttgctgctgcggcggggcttgccctcactgccattcagacatattattcaatccgcaactag

SEQ ID NO: 22003 - DNA, 390 bp, Glycine max
  Peptide Sequence Number=SeqID_138781
atggcgacgaagctatgggatcgatcattcgcttatgaaattggattcgtggcggtaattatgaggttaaacacaaacactggtatgagaggaaggacttcatttgtgttaattggttatgaaaggagtggccggtataggtataggaagaaagatattgttaaaatagatattggtagtaggaaatgtgggtttcccttcaagcttcatgggaaaccagtggttggagagcaaggttggatggtgaagttaatgtgtgggagtcacaatcatgaattgaccaagttattagttggacatccatacgctggtcgattgactaaggatgagaaggtccatggtgaaaccaagaaacattatgctaacgttgaaggagcacaatgtcaatag

SEQ ID NO: 22004 - DNA, 336 bp, Glycine max
  Peptide Sequence Number=SeqID_138782
atgttgaatattggtggatctggaatgcgcagaattggttattggtctaattactcaggtctctcagttgtgactccagaaattttgtataagaaaccacctaacacttcaacaagtagccagcaattgtatgatgttatatggcctggagaaactgtagctaaaccaagaggttgggtgttccccaacaatggaaagccactgagaatagcagttcctaaccgagtaagctacaaggactttgtttctaaagacaagaaccctcctcgagtaagaggctattgcattgtcttggaagctgccataaacttgttgccttatcctgtcccacgataa

SEQ ID NO: 22005 - DNA, 288 bp, Glycine max
  Peptide Sequence Number=SeqID_138783
atggattctctccttgctgacactagcaccacctctggtgagacccttgaggattatgacgatcatgaggatgtttttcacccacaaaaagaggatgttatattcgcatgcgctttagatggttggagatctgggtactctgatgaggaggacgatgtgctggagcgattggaggagccgacaatagaggatggcaacggcacgatcaagaagaaagggaagaagaaaaagaaagagaaaaggagaaggagaagaaggggaagcggaaagagaaaaaaattaaaataa

SEQ ID NO: 22006 - DNA, 564 bp, Glycine max
  Peptide Sequence Number=SeqID_138784
atggttattaatgaatttgttttcttttcattgacacatctgcccagtcaaggtgcaccttttgagggcaccattgttgacgactggaagtttgattactccagtcttgatgcccgtcgtatggtcaacaatgatcaggcacatatgaccggtagattgcttgctggttcattgacattcgattgtcgcatcatgcatttcatcattgttcacattctattacccagatcatcaaacttagctcaagcctctgaagaggatttaatattgatgtgggcttttctcaccggtcgtccgattgaatgggcccatttgatcagataccacatgcataaggcattgcggccaaatgcacctctgccttatccacagcttgttactttgtttcttcatcattttcaaattcccttggataatgagccctttgtgaaagtcaaatgctcttttgctattggtgccggtgcggtaacctccttaggctaccataaggacatggatgggcaatggttgaagaaggacgcgcaaccttcgcaagacgaacatactccctctcctccaccttaa

SEQ ID NO: 22007 - DNA, 246 bp, Glycine max
  Peptide Sequence Number=SeqID_138785
atgaggggacatagagttatgcgaagatatggtgttcctgagccttatgagaagttaaaagaactaaccagaggaagagcagttaccaaagagagcataagagatttcattgaaggcttagatattccagaagaagcaaagaataatctgttgaagttaacacctgatacttatgttggagcagctgttgaattggctagaacagtggaaaatgtggttaatactgtgattggaataaagatctag

SEQ ID NO: 22008 - DNA, 1618 bp, Glycine max
  Peptide Sequence Number=SeqID_138786
atgccttttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcaacggctgagaaagtaccaacttcgactgaatcccaacaaatgtacctttggtgttagatctggaaaactcttgggtttcattgtcagtcagaaaggtattgaagtagatcctgacaaggtcaaggctattagagaaatgccggttccacaaacagagaaacaagtgagaggttttcttgggcgtctaaattacatttctcgtttcatctcgcacatgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccagaaagaaagaacatgtcatctactacttgagcaagaagtttacagattgtgagtccaggtactccctacttgagaaaacttgttgtgcactagcctgggccgccaaacgtcttcgtcactacatgattaaccacaccacctggctaatatccaaaatggacccgatcaaatgttgttatccgagtatgatatcgaataccgcacccggaaagcaattaaagggaagtgttcttgctgatcatttggctcaccaaccaattgaggactatcaacccatcaagtttgactttcctgatgaagagattatgcacttgaagatgaaggattgtgatgaaccattgcttggagaaggtccagatcccgagtctagatggggtttgatttttgatggagccgtgaatgtctttggcaatggaattggggcagttattatcactcctgaaggtaatcatctccctttcgctgcaaggttacagtttgattgcaccaacaatgtggcagagtatgaagcatgtatcctgggcattgaaaaagccattgacttgaaaatcaagaaccttgacatttacggggattcagctctcgtaatcaaccaaatcaaaggagaatgggaaactcgccaccccggcttgattccatacaaagattatgcgaagcatttgctaaccttcttcaacaaagtggagcttcaccacatccctcgtgatgagaaccagatggcagatgcgttagcaactttatcctccatgtacgaagtgagtcaccggaacaatttgccaacaatcagaattcagcgcctcgagaggcccgcccacgtgtttgcagtcgaagaggttgttgatgataagccctggttccatgatatcaagtgtttccttcaaagccaggaatatccacccgaagtatccaacaaagacaggagaactttgagaagattgtctgcagaatttttgatgcatgagatacatgaaggctcctttggtactcactccaatggacatgcaatggcaaggaagttgttgagagcag

SEQ ID NO: 22009 - DNA, 1263 bp, Glycine max
  Peptide Sequence Number=SeqID_138787
atgtttggaccccattccaccgattttgagctctctgctttgacggctctgtccccattggatggtcgttattggagcaaagttaaggaacttgctccttttttgagtgaatatggcttaatctactttcgggttcttgttgagctgtctgtaattcctgaaattgttgaggttcccagtttcagtgacggtgctaaatctttcttacaaggtctgattgatgactttagtgttgaggatgcctcggaggttaaaaacattgagagggtcacgaatcatgatgtgaaagcggtggagtacttcttgaaacagaagtgtcaatccaatgctgaagtggctaaggtgcttgagtttttccactttgcttgcacatctgaggatataaataatcttgcccatgccttgatgctgaaggaaacaatgaattctgtcatgtttcctgtcatggataaaataatgattgctttgtgtgacgtggctaaagataatgcggatgttcctatgctttctcgcactcatggacagccagcttcaccaactactttgggaaaggaaatggcgatctttgctgcaagattaagcagagaaaggaaagatctgtctcaggttgagatattggggaaatttgctggtgcagttggaaattacaatgcacatgttgttgcatatcccaatgttaactggcctcacattgcagaacagtttgtacactctcttggattaagttttaatccttacgttgctcagattgaaactcatgactacatggcaaagctttttcattcgctcatccagttcaataatatattaatcgattttgatagagatgtgtggggctatatatctttgggttactttaagcagaccactaaggctggggagattgggtcatcaactatgcctcacaaagtgaatcctattgattttgagaacagcgaaggtaatctaggtgtagctaatggaggtctgtctcatctaagcatgaagttgccgatttcacgttggcaggcaagacctcttgattttgatttctttttttggttttattctgctcattttggtattgctattattctacactatgatgccaagagggacttgactgattcaactgtcttaaggaacatgggtataggtataggtcattctcttcttgcctacaaaagcacacttcaaggaatagggaagcttcaggttaatgaagctcgcttgagtgaagacttgaaccagtgctgggaggtgcttgctgaaccaattcagact

SEQ ID NO: 22010 - DNA, 1734 bp, Glycine max
  Peptide Sequence Number=SeqID_138788
atggagccacgccttctgacaatattctttgtggttctttcattctcaccatttgttcagtccttggtgcgtcattacaagtttagtgtggtcttgaagaataccactaagctttgctccacaaaatcatttgtcacggtcaatggacaatgtccagggcctactctctatgcaagagaggatgatacggttattgtaaaggtcactaaccacgttaagtacaatattacaatccactggcatggaatcaaacagcttcgaactggttggtctgatgggccagcatatgttacacaatgtccgattcagccagggcagagctatgtctacaacttcaccatcaatggtcaaagaggcacacttctctggcatgcacacatcacgtggctaagagccacggtgtatggtggcattgtcatattgcctaaacgaggcatttcttatccatttcctaaacctgacaaagaaaagataatcattctaggcaagatttatgtgagtggtggaaatcagatgttgaagcaattctcaatcaggctgaaaattctggtctgccaccgaacatatcagatgctcataccatcaatggtcatacaggaccaattcccggttgcacttctcaggttttatcaacctgtgtttagacatgtcctgaaatatagagctttatcaacctgtacaggttacactctgcatgttgaaagtggcaagacctatcttctacgcataataaacgctgctttgaacgatgaactgttcttcaaaattgcggggcacaagttaacagtggttgaagcagatgcatcttacgttaagccttttgaaacagacacaattttcatgagcccaggccaaaccaccaatgtcctattaaccgctaaccaagttgttggcaaatacctaatagcagttactcctttcatggacgcccctataggctttgacaacgttacttcaattgctacacttcgctacaaaggcacaccaccttatcccaaaacaacactaaccaccattcctgcactaaatgcaactcctttaacaagtgacttcattgattccctaagaagccttaactcaaaagaataccctgcaatagctcccttaaccgttgaccactctcttttcttttccataactgtaggccttaacccatgtcacacgtgtctcactggggccaggcttgtgtctgctattaataacatcacctttctaatgccaacaaccacatcacttcttgaagcacattactataacataaagggtgttttcactgatgatttcccttcattcccacctatagcttttaattacactggtactcaaccagctaatattcagacaaataatggcacaagactatacagattggatttcaattcaactgttcagattattctccagggcactgcaatgatagcaccagaaaatcacccttttcatttgcatgggtacaatttctttgttgttggccaggggctagggaactttgatccagagaaggacccattgagttttaatcttgttgatccagttgagagaaacaccattggggtaccaaatggtggatgggcagcaatcagattcagagcaaataacccaggtgtttggttcctgcattgccacttagaagtacacaccacatggggacttaagatggcattcatagtagacaacgggaacggtccccatgagtcctcgcttccaacacccaaagaccttccaatgtgctaa

SEQ ID NO: 22011 - DNA, 690 bp, Glycine max
  Peptide Sequence Number=SeqID_138789
atggaggatcgggacgcgaagcggatggcgacgaggttatcggatgtggttctggactgcgtgatgccgtacatacacgactccaaggaccgcgacgccgtgtcgcaggcggcggttcccgcacctggagtcgttaaacctgaagggaaagccgcgggcggcgatgttcaacctgataccggaggattggggagggattcggatcttcaagttctagctcgttcgcgcggacacatacttcaagcactcaagctggataagtgctctggattctccaccgatggcctctactatatcggtcgttattgcaggaacttaagagtcttgtttttagaggaaagctcacttgttgagaatgatggtgactggctccatgagcttgctttgaataatacagttcttgagacactgaatttttacttgactgatattgccaacgtcagaatccaggaccttgaacttatagccagaaattgccccaacttaaactctgtgaaaattactgattgtgaagtattagatctggtgaacttctttcgatatgcatctgctctagaagaattttgtggaggttcctacaacgaggaatcggagaaccttactgaaaaaattggatcttctctatgcaatgctggatacagaggaccattgtacgttaatccaaaggtgccccaacttggaggtccttga

SEQ ID NO: 22012 - DNA, 186 bp, Glycine max
  Peptide Sequence Number=SeqID_138790
atggttcaaggaaaatttgtcccaaatttgggggaggtattatcaagctgttgggctaagctcagcagttgggctaagcgcttattcaccgctaagcgcagcttcagagcgcttagcgcaaaggagaatttggcagagcatcagcatcaaagatgcgcgctaagcgtagcaggtgccttcatctag

SEQ ID NO: 22013 - DNA, 2241 bp, Glycine max
  Peptide Sequence Number=SeqID_138791
atggcaaactggagagaacgagatttgtttcacatcgacgagatcgatcccgtggacgcgtcgaacggcgaagatttcgacgattcttcgtcggtagacagtgctacttccgatggttcgaggacgcaggttggacttacggagcgtttgacggatattctcgttgacgagcgcgacggcgatctgttgattcagcagactaatagagaggaccggttgttgtggtggcttcaggctctcgatatgcaagttatgggagcgtgtcgcgccgacgagcggttgaagcccttgctgaagatgaacgcttcctgcggcgtcgcggaagatcctctactggctcaattgactcagcattttgagccatctgaagttggaatattagcgagatgcttctgcgtgccgcttgtttcgttccgcgtcgggaagatcaacaaggaagggactcgcttctgccctacctcgaatagtcctgcctccgggggcagtgtaggtgcagctctccatcactactgcataaatgctaagcaaagatgtgatgtgttgtgcatatggaagaataaggagtttacagccacatggaatccctcagtcacggctgctcagggcaggctgatgggcctaggccaagggggtaacttgacactcgtactactgccaagttctgatcttcgtctctcattcattggggatgatggtagaacagagagattattcacccttaccaacaaatcccaatgctctgctgttgtggttgatgaaatcccaactgatagttctggccgatcgttccttgtaaggactccagatagcagagctttttatttctggtgctctgaaaagtctaagcttttgggaattgaattgcttggaaagatgaaggatttgctcaagaggaaaccatccattgttgagctgagtggcattagcaagtcacgacttgactgctttgcaactcagcttcgggcttttcttgtggggacaacaggaggcagtagtcatgatagttcagtttgtgcttcaacatctgctaattccatgtcttgctctaatgttgcttctgaaagttcgcacccttcatcttcaaaatttccccgatctcgaaacattggaggtcagacagcaaagggagatacaacactttaccagagtattcttagtccaagatcaagttcttttaaagaggttccaccaagaaacttgtcttctcacaggattgcagccagggagaaaattaagcgtcgtggtgacaatcatcagccaacggttgacaccttgacaaatgattcaacacacattttggatttatcttcaacttctgatcatgacaaagcatcagaagttaccaaaactcttgcattttcaccaagttttctgggatcacttggaaagcttggtggtgttccatcaagcctggggctgagtggggaggtccctcccattgtgtcacccattttttctccctattattgttggtgtcccccaggtatttctacctgtccttccattgcagcagttacgcaatccccaaactcatctattgaaacactgcctttcccctcaggtgcctctttattagccaatcctctatcggttaacttgttggatccagtacaacctctcggtacttccatggactttcctccttttttgcctgatccactggtcagaatgtccttgccaacatctcagcagattcccacattcacaccattaatgtgtgatccaattgttcatgtcccagtgattgacgtgtgctcttcaggtcagggctatcttgtgagtgctggccctgcaatgtcacctagcattccaccattgcatccaaaccttgtgaagccattgattcctgaatctgatgctgtggtgaagggtgcaagagagactctaagattgctacttagtggttcaagccagggtaaccaacagatgatgagggacactctgcctgcaattttaactaatccagacgaaaatcaaaacaatatccttgtggctggaagtcgtggtctttacactggaaccagagatattaatgctattgcaaacagcattgctgctatgggattagtatcactgtctggggtatccaaggtagacagtggagtctattcggagctatgtgaaaactatgggaatttggaagcagtgaaaaattccaacgattcaggtggtggtgcctttttggatgatgagggcggatcttctttggattcgaagcagtacacttttgaatggttttaa

SEQ ID NO: 22014 - DNA, 216 bp, Glycine max
  Peptide Sequence Number=SeqID_138792
atggatgggagaggcggaagcagaaggaggaaaggcgataatcgcgttggtaattgggagtatagtctactatcaatggttcctcttgatccccttgagtggcaaatatctcaggagagtgcgaacgcgatagtggcatggttggctaatacgattggtgccacgacaagaggctgtttctcaaggtcattctcttaccgttgcctatgccggtag

SEQ ID NO: 22015 - DNA, 2190 bp, Glycine max
  Peptide Sequence Number=SeqID_138793
atggaagagcaacgcaagtgcgacatagaaaatcgggatcgttttgagaagctgcagaaatctatggatatgttacttcaacaccgatctttgtccattggtggttcaaactcaagcagttcttcttcgggtggtcttccggtaactccaatttcttcatctgcacctgttaaagacatttctctgggatttccctattttgatggccatacacctgttttggaatggattttcaaagttgaaaagttcttcaattatcatcatactcctgactctgatagagtggagattgctgcgattcattttgagaaagatgatgatgaaggtgaagctgagatgagttttgatgttgtgtctgaagataataatagtactgctgaaactgtgattgataaccttcaccatctttccttgaatgcattgaaaggaggtcttggtgttggcactattagatttgtagctcatatcaataccttacctgttaaggtacttgttgatggtggtagtttagacaattttatccagccaagagtggccaaatttttgaaactacctatagaaccagcacccttgtttaaagttatggttggtaatgtcttcagtatgcaacttattgaaccttccaattttcagtttcctttatccgaattacttgctgatgtagagccggagttggcacttctcttgcatacatatgaatctgtttttgagactcccacatccttaccacctcccaggtctcatgatcatgctatacccttgttggagggatcaaaaccaattaaagttaagccttaccgctatttacatagtcaaaatgatgaaattgagaaattggtgcaaggaatgcttgaggaaggcatcatccagccgagtaagagcctattttcttctccaattatttttctcaagaagagggatggttcttggagagtgtgcactgactatagagcattgaatgctattacgattaaagatacatttcctattccaatagttgatgaattgagtgatgagctgtttggagctgaatttttctccaagttggacttatggtctggtgcaagagtgactatggaaaccactaagctggaagctattactaattggccacaaccaactactataaaacaactaagaggaattcaaggaatcactgcatttgtgcagctcaagaaagctatgacttcagctttagtgttagcaattcctaattttagagaaccatttgtacttgagactgatgcttctggttcaggtattggagcagtactgagtcaatctcaacatcctattgcttatttctctaagaagttgtcccctagaatgcagaagcaatctacttatactagggaattctatgctatcactgaagccatggccaaattcagacattatttgttagaccataagttcattattagaactgatcagaaaagccttaagaaggaaaatatccctgctgatgcattgtctagaagcttgtttatagcttggttagagcctactaatcattggttagccaaagttgcaacagttactaaggaggataagttactaagtgagctgatcagtcgctatgctcatgggggaaccattgatcctaagtatgatttgtttaaagctcaaggaaccactttagctataagttcatcttaccatcctcaaagtgatggccaaacggagatccttaataagactcttgaaatgtacttaaggtgctttgtgtttgataatcctaagttgtggtaccctatgctagcttgggcacaatattggtacaactcttcttatcatcacaatttgggtatgagtccatttaaagctgtatttggcagagaaccgcctgtagttgttccttatcaagtccatcttaaggatcctgggaacttggctagagcacaaaattacatgaaaatgcaagcagacaagaagagacgagactttcagttggagtcatttgatgctagtgaggctttgtgggaggatttgacagctattaaacaatcatatcctcgattcaaccttaaggacaaggttgatttcaaagggaagggtattataacgagtaattccgtgggtgacaattgtgtggaaaattctgttaggaatgatggacacatggaagacgattcgcaaaacttgaccatgagaaggagcacaagggcctgcggggagaatgtgcattga

SEQ ID NO: 22016 - DNA, 1335 bp, Glycine max
  Peptide Sequence Number=SeqID_138794
atggctctggtcggagttgaagtgaagcatgcggcggagggcgcaccggaggagaattgctccgccaagcccaccaagcagggcgagggcctccgccactactattctcacaacatccacgagcatcagctccttctccgtcaaaagacgcataacctcaaccgtcttgaggctcagagaaacgagctcaattccagggtgaggatgctgcgcgaagaattacagcttttgcaggaaccaggctcttatgttggtgaagttgtcaaagtcatgggcaagaacaaagtccttgtcaaggtccacccagaaggaaaatatgtcgttgatattgacaaaagtattgacattacaaagattactccatccactagagttgcacttcgcaacgacagttatgttcttcacttagttctgccaagtaaagttgatccattggtcaatctgatgaaagttgagaaggttcccgattctacttacgacatgattggtggtttagaccagcaaattaaagaaataaaagaggtcattgagttaccaatcaaacatcctgagctgtttgaaagtcttggaattgcacaaccaaagggtgtcctgctctatgggccacctggtacaggaaaaacattgttggctagggcagtggctcatcatactgactgtacattcatcagggtgtctggttctgaattagttcagaaatacattggagaaggttctagaatggtcagggaactttttgttatggccagggaacatgctccatcaattatcttcatggacgaaattgacagtattggatctgctcggatggaatctggaagtggcaatggtgatagtgaggtacagcgtactatgctggaacttctcaatcagttggatggatttgaagcttcaaacaagatcaaggttttgatggccacaaatcggattgatatcctggatcaagccctccttagacctggacggattgaccggaagattgaatttccaaaccctaatgaagagtctcggctggatattttgaaaatccattcaagaagaatgaatttaatgcgtggcattgatctgaagaagattgccgagaagatgaatggagcatctggtgctgaacttaagatattatatctgggcatgaggcaaataaagtgttttgttactaaaaatgttaaagaactagctccgaagctgggtgatgctgtttgcaccgaagctggaatgtttgcattgagggagcggagggtacacgtgactcaggaggattttgagatggctgtggccaaggtgatgaaaaaggagactgaaaaaaacatgtcattgcggaagttgtggaagtga

SEQ ID NO: 22017 - DNA, 549 bp, Glycine max
  Peptide Sequence Number=SeqID_138795
atggagttggcttttcattcagccctgtacccagcatctctgtcttgtcgagcgaggaggttgtccttggtgccttgtgcattgaagacacgctcttgtatcgaggaggctctggtgagtgtggaagcatgcaacatggcatctcaccctatcaatttctccaagttggatggaacatggcgcctccagtacacttcttcctctgatgttctcgttcttctccaagctgctgctacacttcctttctttcaagttggacagatctttcaaaaatttgaatgtggtgatcaatcccatggaggtgttatccgcaatgttgttcgatggagtattccaaatttgttagaggaacaagaaggtgctacactgcttgtatccgccaagtttaatgttgtatctgtccgtaatatctaccttcagtttcaagagatcacagtccaagatatatatattagtgaagagctgcgggctctgatagctccagcaatactaccgagatcttttataagtcttcagattttgcaatttctccacactttcaaagcttag

SEQ ID NO: 22018 - DNA, 540 bp, Glycine max
  Peptide Sequence Number=SeqID_138796
atggcaaacagaaacgaaaatgtccctgtcgtagtcaactatgatgcctatgtagtcgactgtgatgatggcatagagtttaaggctgaaaagaatgtacttgtttcaatgaagagaatcatgaccttcaatgtcttgaaaacaaaaatccaacgtaagatgggcttaaaccgaggtcaaaccataaccgcaatcatttatcgataccccatctctgctaggtcccgcatgttcaattaccaggctattaccaccattgacgatgacgatattgatggcattgttgatgttagtggcaaccaagttactgacaaccccgactataggcattttttggaccagcaacaacaatctgacttgcaggatggcgagctatttgttggtcaacgatttcttcaattggaagacctcaaacacgcaatcaatatgcggcacattaagaaccatgtcactttcaaacacatgaggtatgtgaaggatacatgggtcttatgttgcctagctgaggagtgccaacggaaacttagagcgtctaaatga

SEQ ID NO: 22019 - DNA, 301 bp, Glycine max
  Peptide Sequence Number=SeqID_138797
gtggggattatctcgtcactttcattatgtccctgaaatactggcagctttcttctggacagtcccagctcttttcgaacattttttgccttacttctacgtgatatttcttaccatccttctctttgatcgagcaaaacgagatgatgatcgttgcagatccaagtatggcaagtactggaaactatattgcgacaaggctggaagcttgaaatttagtcccattcaatcactactgaaaactgaggtaggtgcgcaacatcacaacgaaaatgagttcaagaactcaaacatcaaataa

SEQ ID NO: 22020 - DNA, 492 bp, Glycine max
  Peptide Sequence Number=SeqID_138798
atggatgggctgaagatatattctgaaagtaatggaggggatgaagatgttgaaactcatggatgggtgaagattctcaaactgatgatgaagcattttgtccaaaattttgcatctgatattccaaatatggatgatgtaggagatgatattgatgttgactatatagcacatgaaatgtgcaatgattttcagtttaagattgacatggaattcagttcactgactcaattcaaggaggctatcatggaatattcgatgttaaatggacataaatgcccgagagtctttggtaacaagaagaatgctaagtccaaatgggtagcaatgcaaatgctagacaagttgaagttgaattctagtatgacagtgaaggaagttgatgatattaggagcaggtttgcaactagtattacatcagccacaacttatagggcacaaattgcattggcctttgtggaaggggatgctgtaaaaaaaatacaatgttga

SEQ ID NO: 22021 - DNA, 450 bp, Glycine max
  Peptide Sequence Number=SeqID_138799
atgatggaagcaatgatgaccatgaacaatatcatgaaggagttgtctgaggatttcaagatccaacaccatgatttgacacctcatcatcccaagatgaacggtgcagttgaggccaccaataagaatatcaagaagatcattcaaaagatgacacgaacttttgtgggcacttctactggggcaatcctattttcattggagtatgggatggaagctgacttctccttcaaagtagagattccttctttgagggttttgttggaagcagagttagaggaagtgtcacatgttcaaaaagatctccgagggaaattggccccaaactatgaaggaccttttatggtgaagaaggctttcttggatggaacattgacactcacaaacatggatggtgaagagctgcctttgcctgtgaattctgatgacgtcgagcaatactatgcatga

SEQ ID NO: 22022 - DNA, 330 bp, Glycine max
  Peptide Sequence Number=SeqID_138800
atgcagaattaccttgctgtgaaaccctgtgagttgtctaaacagactggaaactcagcaccccaaacagaccttgcagtcaccactactttcacaaaccaaacccttgcaccagaaatattgaaaaataattgtagtgagcaccagttccccaaaatcacatgctactcaatacaacatggtaaagacaacaaagagtcgcgaaacgtaccttcgatggagaaaaacaaagcgcgaacaagaaccttcgatggagaacaacagagcgcaaagaataaccttcgatggagaacaacagtcgtgattaggttgcagagacaaacattttaa

SEQ ID NO: 22023 - DNA, 360 bp, Glycine max
  Peptide Sequence Number=SeqID_138801
atgggtcttagtaatggtgatgatcaagagaagaagaaaccctgtttgtgggagtggaagagactgagtagcgcttactctgcctatcgggcactttttccttcaagtattggtcttgacatgcttaagaaccttgtcactcacacatatgcccgtttctttcctccaaatatagaaagagaggaggaagggcaagtcaaagagaatggagctggggaaaaggttagagaagcttttgcgaaaagcctaggaaatagcaaagctacgttggaggatgcagcaaaatcagcagcggaaaccgtgaggaccttctctgagtctgatgagaatagggaaacacaacatcaaaacgagctctga

SEQ ID NO: 22024 - DNA, 192 bp, Glycine max
  Peptide Sequence Number=SeqID_138802
atggagaaagagtattgtcgaatacaaagagacacgactgatagaattgagcatgtgagtgaagagtgggtgggtgcatctggggtgagtggatctagaggaaagaggaataggggagtgatggatctccctgaaaatgcaaacaaacaacatgttgggagatcaagcaatgtgatgagaatcagatattaa

SEQ ID NO: 22025 - DNA, 1101 bp, Glycine max
  Peptide Sequence Number=SeqID_138803
atggctccagaaatcatgcaactacagaagtatgatgcgaaggcagatctctggagtgttggtgcaatcttatttcagcttgttacaggaagaacacctttcactggaaacaatcaaatacagttactacaaaatattatgaaatcaacagaattgcagtttccgtctgatagcccaagtctgagttttgaatgcaaagatttgtgtcagaaaatgctacgtcggaatccaggtttagggggtgtggaagaaatgtatttgaagggaggagtggaacgtctaacttttgaagaattctttaaccaccctttccttgctcagaagcaaacagaacgggatgagtcattgaggaatagaagttcttcaaggatggatggtgggttttgttctacagtgtctgatttgagaagaaccgaggaaaattatcaagaagattgtttgcctttcatgttagatgacgactctagtggccccgaggggagttcatccttttcaaggaagaagtcctcaatgaagtcgacctatggatttgatctaaatgctaaactagataaagcagagtcatcatctcctatttcaggatttggtagtatgacacaaagatctgaaaacactactaaaagattggacaaccatacaatttcaagaaatctcactgatcctctagaatctccagagcagcttttcgcaagtccttatccaaaagttatggattcgctggagaatattgatcaagaatatgttctggtgtctggccccactatagatgtttcatctttgtcagtgggtgcttcaaggcccatccataccccaagtcggtcaggtagtttaccccaagagtcttctagtacaatcacaagactaagtgctccaatgccaatagttggtgtacctaccaatagtgtatgccaaattggaagttcaggaagtcaggactctgctcctgggacatcacttggatcaatggatacaggtgatgaacaaccatctgctcactgcatgacaagggtgaaatcattgcaacagtgtgcatcttccatcacagaattagttaatgaaaaggtaaatgctgctaaaagtttgctttctaccatgtcttaa

SEQ ID NO: 22026 - DNA, 549 bp, Glycine max
  Peptide Sequence Number=SeqID_138804
atggcgcaggcggcggggcggagcagggtggtgggagactacgtggtggggaagcaaatcggcgcggggtcgttctccgtggtgtggcacgggaggcacaaggtgcacggcaccgaggtggcgatcaaggagatcgccacgcttcgcctcaacaagaagttgcaggagagcctcatgtccgagattttcatcttgaagcggattaaccaccctaacattatctctttgcacgatatcataaatcagctgtgtgggttctgtactgtaggatttgaagaagaaaaagatttgaccattatgggggttcctgggaagatacatcttgtgttagagtactgtaaaggaggagatctttccttgtacattcaacgccatggaagggtaccagaggcaactgcaaaacattttatgcagcagttggctgctggtctacaagttcttcgggacaataaccttattcatcgagacctgaaaccacagaaccttcttctctcccgaaatgatgagaagtcagtgctgaagattgctgactttggatttgcaaggtag

SEQ ID NO: 22027 - DNA, 714 bp, Glycine max
  Peptide Sequence Number=SeqID_138805
atggctgtcaagaagaatattgaagatgtacaaggaaaagataattacccatgtggacagcaattgttgattcacaatggcaaggttttgaaagatgaaactacattagtagagaataaagtctctgaagatggctttcttgttgttatgcttagtaagagtaaaacatcaggttctgctgcagcttcatctgttcagcctgccagtaatcctcctacgactgtatcaacgtcaaattccacccctccttctgatcctccagtgcaaactcaagctgcaaacaacagtacatctagcacagatgccccaactacaaatgtgtctgcagatacctatggtctggctgcttcgaatttagttgctggtagtaatcttgagcagactattcaacaaattatggacatgggtggtggcaattgggacagagacacagttagtcgtgctcttcgagcagcttataataacccagagcgtgctatagattacttgtattctggaatccctgaagcagcagaagttgctgtgccagttcctcaaacagctgggatttcttctggagcagttcctgtaggacctaattcatctcccttaaatatgtttccacaggagacgatttctagcactggtgctggacttggatcgctagacttccttagaaataacccccagagcaaccaaaatctctttttccactatgtaggatcggctacataa

SEQ ID NO: 22028 - DNA, 615 bp, Glycine max
  Peptide Sequence Number=SeqID_138806
atggcgatgagtttcaataataacaattgcaagaatgatacgaaaaacaatggagaaaaaattggcttccaaaaattgaaaataaaatatatcaacgaacaaacgaacagatatttgagcagttggatcatgctcgaggttacaaatagatatcatagggagacgattacccattatgcagacgaagacaacttaggtcaagcccgtaaggacgctttttcatgcaaaccctcatatctgaggtatttcctgtcgtcctttgtcgctaactactatatgccaccgttagagcaagagagcagcaatattgatgaaaatgaatctttctccaaacatcgatttcgtagcattttgtttgatgacgattgtaagaacgatgatcttaatttaaacctcgagtttagaatcacagatcttcatcgtgggcaatggaatgtgactgcaattgtggtcaaggcaatctttgggagtagatgttccttgccactatatctcggcatttatgtcgtttgtcatgttgtagttgtaacgaacgatgatgctggaaaaaggaaagaggaagaagaacgacaaaggcatgacaacaacgaagcacagacagtgacaaaggcatga

SEQ ID NO: 22029 - DNA, 226 bp, Glycine max
  Peptide Sequence Number=SeqID_138807
ggctgttcatgtgtcctccactttcgagattggagttgtgtttcatgattgcctaagtgcggaccctcaaggcaatcgtccattctcccccttctttcgaagctccatgaattgcgttttcgttcatgtgtcctccactttcaagtttggagctgtgtttcatgattgcctaagtgcggaccctcaaggcaatcctccattctcaccctttttcggagccccatga

SEQ ID NO: 22030 - DNA, 258 bp, Glycine max
  Peptide Sequence Number=SeqID_138808
atggtatttcgtgcaaactcaaccgacgttgcgtttcggctgacattggacagcggtttaccatcgaggtcacctatggtatttcgtgcgaactcaaccgacgttgcgttttggccgatatttgactgcgctaatggaataggcaaaaaaaatatagccgaccttggcagaaaaaaaaaatcctcgacaaacttggataaaaaacaattcaagccgacatcgaccaagaaagatagccggtcgctgtatcccaaatag

SEQ ID NO: 22031 - DNA, 330 bp, Glycine max
  Peptide Sequence Number=SeqID_138809
atgtcggtcgaaaaacaacacttatcgcgcctggatttccggaactgttcggttggttcatccgcggtgatgctctttgggatgcctcggccgtcaccacttaacctatgttttatcatctcattcttccattttatgccaagaaccaccttattaaggcccacgaaattagccaccacccaacccttaaatcttgacaattttctgatgagaatcatgaaactggccaaatacaggctaaaggcccaagtggagaaggatgaaggcccaagtggagaaggacaaagcccccgagtggagaaggatgaaggcccaagtggagaaggatga

SEQ ID NO: 22032 - DNA, 417 bp, Glycine max
  Peptide Sequence Number=SeqID_138810
atggcttctcacaaaagatacgcaccagcctcagcatcccaggcccactatgatagatcgagattcttatctcaggaggactgggatcgctactctgatattgtaattggcataaagattttgtctaagagaaatttcatgatttaccatacaaaatttgatgagttcaaggatgagttggaaagaaggaattggcacaaggagatgaccaatttcatggatgggagcatcgatgttgccattgttaaggagttttgtgctaacctttatgatcctgaggataaatcacctaagcaggtgagggtgagaggccacttaattaagtttgatgaagatgccctcaacaccatcctaaagacccctgcgatcatagaggagaggaagagctaccgtcatactctaggtttgctctactga

SEQ ID NO: 22033 - DNA, 252 bp, Glycine max
  Peptide Sequence Number=SeqID_138811
atggcttgcttaggatcaaacttaaaacatgaagataatgagagaaaaatgaacggggataatgagaacgatgttttgaccaaaaaactagagatagtatcagaattgaaaactggattggcagactactgcaaatcaatgccaataaaagtaaaacatcgtagaccattcatcattttccattccatgaacccgcaaggttcattgtacgagcagttaccacattgtgtgagatacctccaaattccataa

SEQ ID NO: 22034 - DNA, 381 bp, Glycine max
  Peptide Sequence Number=SeqID_138812
atggcatctaagaaaaggaaggctccttctacaccttcccaagttagatttaatcggtctcggttcacatctcaagaagcttgggagaggtataccgatattggggtgcctaggaaactactaccggataggaatgtgatagtttattacactgagtttgacgagttcaaggaggaactcgagagaagacactgggatgaggagttgactgattttactgacagtagcatagatgtcgccattgtgaaggaatttgacgcgaacctctatgacctcgaggataaatcacctaagcagaagaacctagaagaagatgatctgtacaggtgcactgagcgagtgtcaaactcgctaagcgcaccgcttgcacctccaggctga

SEQ ID NO: 22035 - DNA, 1680 bp, Glycine max
  Peptide Sequence Number=SeqID_138813
atggaaaagaagaagtaccccatcggggaggagcattaccttctctacgaggagattggccagggggtcagtgcctctgtccaccgcgctctctgcctccccttcaacgaggtcgtcgccatcaaaatcctcgacttcgaacgtgacaactgcgatctgacaatgatcctggtggaccaccccaacgtcctcaaatcccactgctccttcgtcagcgatcacaatctctgggttgtcatgcccttcatgtccggcggttcatgcctccacatactcaaagccgcccaccccgacggtttcgaggaggtggtcattgctaccgttctcaaagaggtcttgaagggtttggagtaccttcaccatcacggccacatccaccgcgacgtcaaggccggcaacattctcatcgattcacgcggggccgtcaagctcggcgactttggtgtctctgcctgcctcttcgattccggtgaccgccaacgcacaaggaatacatttgtaggaacaccttgctggatggcacctgaggtcatggagcaacttcacggctacaatttcaaagctgacatctggtcgtttggtataaccgccttggagcttgcacatggccatgcccctttctcaaagtttccaccaatgaaggtactgctcatgactctccaaaatgcaccccctggccttgactacgaaagggataggaagttcagtaagtcttttaagcagatgattgctagttgcttggtaaaagatccttcaaaacgaccctctgcaagcaagttgttaaaacattccttctttaagcaggctcgctccagtgatactatagtcaaaaaacttttggaggggttgcctgctttaggtgaccgaatggaagctctaaagagaaaagaagaagatatgctcgcacaaaagaaaatgcctgatggaaagatggaggaattatcacagaacgaatacaaacgaggaattagtggttggaacttcaatcttgacgacatgaaggctcaggcttccttgatccacgatttcgacgatgctatgtccgatatcaaccatgcaggaagttcaagttctttatctacacttgattcactagataagcaattgccaagtgcaattcacaaaccttctcgatctgctgatatggaagagaatgatgagatgcgacgtcaattagcttctgctctcctagttgattctgcagtaaacgatgccaaaactaggttcgaaaaatccgatgatgactctagcatcgccagttcaagccatgaaccacaaacttcttcatcctgtccagatgatcatgtgaacaatcatttgggtgaaaaatctgatatggaaaatggtggaagatccgtggagggaatggctacccattattatcatagaagaggatgttcatccagcatcttacctgaagctactcttcttcctattcgggcagaaagaccctgcgcattcaagaattgctctggaatgtcttgtgcaaagttttctgttaaaaaggaccaatcagttacccctgttccacagacaggagaggacgtgcttaccgaacttccttctagagtctcaaaatcatcagctaattctgatgacactgatgagaaatcaaaggtgccagttgtacagcagagagggcgttttaaggttacatctgagaatgttgacccagaaaag

SEQ ID NO: 22036 - DNA, 210 bp, Glycine max
  Peptide Sequence Number=SeqID_138814
atgtttgataaagttcagggtccacttctcgtcctggatgctggaaaattttggtatgttagaagaagtcagaggtcaattggctttaaacttgaagcagctcacgagagggaaaaggagttacttcatgagataacagatttgcagtggaggcttatctgtacccaggaggagcttcaaaagttgaaaacagaaaacgcccagaagtga

SEQ ID NO: 22037 - DNA, 123 bp, Glycine max
  Peptide Sequence Number=SeqID_138815
atggaccttggagatgtacttctcaatgaaaaccctattgatggaaggctggatgagcttggtgggggtgaccgacactctgtagaactggaagaggcctatgatcagagcaggaaagcctag

SEQ ID NO: 22038 - DNA, 225 bp, Glycine max
  Peptide Sequence Number=SeqID_138816
atgtcgcgagaaatgaagtatgtgcaacaatgtatgggtgtcaatgggctcgagaaaatcattcttagagaagttcgcggtttctctgctgaggtttatttatacggggctcaagttacatcatggaaaaatgaccttggggaagaattgctttttctcagtagtaaggttcaagtttcacttgcatacatatatatgaatctttttgagcttgtgactttctga

SEQ ID NO: 22039 - DNA, 1090 bp, Glycine max
  Peptide Sequence Number=SeqID_138817
actcatccttccttcgagacatgagatgaggccgatgcaactgccaccgccttccgcttccggggccaaccctgcccctgcaaccaccaacaacaacaacaaggagcagcgtccccagcgccgccgcaaggacctcacgctgccgctgccgcagcgagacaccaacttggcggtgccgcttcctctgccgccatcgacggcgcctgctgcggcggcgagcggcggagcgagccagcaggcggcgcagcaggtgatccctttctcggagctggagagactgaaccgcatcgggagcgggagcggcgggacggtgtacaaggtggtccaccgcacgagcgggcgcgtgtacgcgctgaaggtgatatacggtcaccacgaggagtcggtgcggcggcagatccaccgggaaatccagatcctccgtgacgtggacgatgcgaacgtggtgaagtgtcacgagatgtacgatcagaacagcgaaatccaggtgctgctggagttcatggacggaggttctctggaggggaaacacatcacgcaggagcagcagctggcagatctgtctcggcagattcttagggggctggcgtacctgcaccggcggcacatcgtccacagggacatcaagccgtcgaatctgcttataaactcgcggaagcaggtgaagatcgctgacttcggggtgggtcggatactgaatcagacgatggatccgtgcaattcgtcggtggggacgatcgcctacatgagtccggagaggatcaatacggacataaacgacgggcaatacgacgcgtacgcaggggacatatggagctttggggttagcatactggagttctacatgggaaggttccccttcgcggttgggaggcagggcgattgggccagtctcatgtgcgccatttgtatgtctcagcctcccgaggctcctccttctgcttcccctcacttcaaggacttcatcttgcgctgtcttcagcgcgatccctctcgccgctggtctgcttccagctactccctcctccgccaaggcctcttccctcctagtatgatggatccttctacatgcctattgcctattgcctag

SEQ ID NO: 22040 - DNA, 114 bp, Glycine max
  Peptide Sequence Number=SeqID_138818
atgaatgattctcagatgctgttaatattcccccctcaagctgggaatggatatttaacattcccagcttgttacaaagaggctgaaagacagtggaaggtagagctttggtga

SEQ ID NO: 22041 - DNA, 1866 bp, Glycine max
  Peptide Sequence Number=SeqID_138819
atggcatcctcaagagcttgtaccaaacccatcatcttcctctctgccttcaccaagtcaaagttctctcatcaatatcatgtctccttcatcaacaccacctcccacatacccatctacccaaagctctctcagcaacgttccttggtggtcaacaacgtattgaaaacagttgagccgacagaaagctctttgcggagctccaactccgaggaatttgggtctctgggtgaaaagcccaccatcctggtctccgagagacttggagaggcaggactgcaggtgttacgcggtgttggacacgtggaatgcgcgtatgagctctcgcaggaggagttgtgcacgaagatctcgtgctgtgacgctcttatagtgaggagcgggacgaaggtgacaagggaagtgtttgaagctgccaaaggaaggttgaaggttgtgggaagagccggcgtggggattgacaacgtggatttgcaagcagccaccgaatttggttgccttgtcgttaatgcgccaactgcaaacactattgccgctgccgagcatgggatcgctctcctcgctgccatggcccgcaacgttgcccaggctgacgcctccaccaaagctggaaaatggcagagaagcaagtatgtgggtgtttccatggttggaaagacattggcagtgatgggtttcggaaaagttggatctgaagtggccaggcgagccaaagggttgggcatgcacgtgattgctcatgacccctatgctcctgctgatagggcacgtgctattggtgtggatctggtgtcctttgatcaggccatcaccactgcagatttcatctccctccatatgccactcactccaactactaacaagatcttcaatgacaacacttttgcaaagatgaagaagggtgttcgcattgtcaacgttgcaagaggaggtgttattgacgaagatgcattagtaagagcactcgacagtggaatcgttgctcaggctgctcttgatgtcttcaccgaggagcccccttccaaagacagtaagttagtgcaacacgagaatgtcaccgttacccctcatcttggagctagcaccaaagaggcacaggagggtgtagctattgaaatagcagaggctgtgcttggagcattgaagggggaactttcagccactgctgtcaatgctcctatggttgctcctgaggtgttgtcagaattggccccatatgtggtgctggctgagaagctgggcaggctagctgtgcagttggtgtgtggaggaagtggaatcaaatctgtgaaggttgtttatcgatcagctaggggcccagatgacttggacactagacttctgcgagccatggttacaaaaggcctcattgaaccaatttcaaacaccattgtgaaccttgtgaatgcggatttcatagccaagcagaaagggcttcgcataagtgaggaaagagtggttgttgattcatctcctgagctgcctgttgattcaatccaggtacagatatctagcgtggactccaaatttgcgagtgctgtatcagagagtggtcagataagcattgacggaagagtcaagtttggagaaccccacctgacatgtgttggatctttcgatgtggatgtgagcttagaagggaatctaatcctgtgccgacaggtggatcagcccggcatgattggtcgtgttggaaacatactgggtgaacaaaacgtgaatgtgagctttatgagtgtgggaaggacatcgcgtaggaacaaggctattatggctattggtgtcgatgaagaaccaaacaaggaggctcttgacaatattggagccgtgtctgccattgaagagttcgtcttcctcaagctctag

SEQ ID NO: 22042 - DNA, 804 bp, Glycine max
  Peptide Sequence Number=SeqID_138820
atggctggcaccggcatccatccataccaccagcaatgggctccggcggcagccgctcctcctcctcctcctccggcagccgcgggcggtcctcctcctcacccaggggaggaggttcgaactatattcataactggtcttccggaagacgtgaaagagagagagctgcagaatctgctgagatggttgcccggtttcgaagcatctcaattgaatttcaaagctgagaagccaatgggttttgctctcttctccgcaccacaccaagcactcaccgccaaagacattcttcaggacatgctcttcgatcccgacaccaagtccgtcctccatactgagatggcaaagaaaaatctattcgtcaaaagaggaatcggagctgatgcgggtgcttttgatcaaagtaaacgcttaaggacagccggggattatacacacactggctatacaagtccgtctccttttcatcctcctccgcctcctgtgtggggaccacatggatacatggcgccgccaccgccgcctccatatgatccatatgcaggctatcccgttgcacctgtaccaatgcccactcctgctcccattgcagcacctagcacttatgttccagttcagaacacaaaagataaccctccttgcaacaccctgtttattgggaacttgggagagaacataaacgaggaagaagtgaggggccttttcagcgtatattcaaaaaatccatttggaaaaaggaaagataatcttcctgttgctgttcctagtgcaaatggagctccaccaacaatgacttatcagtag

SEQ ID NO: 22043 - DNA, 3285 bp, Glycine max
  Peptide Sequence Number=SeqID_138821
atgcaattcttgcgtggcttgaatgaacagtatacaaacatccggtcccacgtattacttatggatcccataccagccatatcaaagatcttttcgtatgtggcacaacaagaacggcaactgctaggtaattcttcttctcccaattttaatttcgaatctaaagaaatctccattaatgctacgaagtccatttgtgattactgtggtcgagtggggcacactgaaagtgtgtgctataagaaacatggtatgcctctgaatcacgagacgagaaacaaaggtaatggaggaaggaagacttgtacacactgtggaaggataggacacactgttgatgtgtgttaccggaagcacggatacccgctgggatataaaccctttaatggaagatccacagtcaataacatggtgacgatggataacaaaagcccggataatcagactcagcatcacgaatcccaggatctcattcaattttccccagagcaatataaagccttacttgctttaatccagcggccatcaatcggaaacacggcgtcggagcaaaccaaacaagttgcttcaatatcgtcttgcaccactgataagcttcctaacccaggtatgtctcaacctatcatgagctcctggatactagattcaagagccacggaccacgtaaaatgttccctaaacaatcttcattcatacgaatcgattaacccagttacagtaaagctacctaacggtcatcacgttcacgctacccattctggcactgtgcacctttcaaaaactataaccttgttcaacgttttatacatacccacatttacttttaatctcatttctatttcgaaacttgtatcttccactaactgtgccttgattttttcttccacttcatgtatgctacaggacacgaatcttcgtatgaagattggtatagttgaagagagacatggcctctatcaccttataccagaccaaaacgacaaagccatttgctcaaccattgttcatcctaagtgcaatgtaataccaatagatctttggcattttcgaatgggccatctatcaacagaaaggctacaatgtatgaaatcttattatcctattctaagaaatgataaagattttgtgtgtaatacatgtcactatgccaaacacaaaaagcttcccttttccttgagcatttcacatgcatcacatattttttatttgcttcatatggatatatggggtccatgttcaaaaacgtctatgcatgggcataagtatttactaactattgttgatgatcactcacgatttacatggatacatcttatgaatactaaagctgaaacacgaaacatcatcataagcttcattgcatccattgaaactcaatataataagaaagtcaaaaccattagaagtgacaatgggtctgagttcctcatgcccagtttctatgcatcaaaaggaatcatgcatcaaacaacatgtgtagagacacccgaacagaatggcattgctgaacgcaagcaccaacacttgcttaacgtaacacgtgcactcttgtttcaagctaacttgccttcgagtttttggtgttatgcattattgcacgcagcatacttagtgaactgcattcctactccctttctacaaaacgcatctccctatgagaagctacatggacatattccagatatatctcatctccgcattttcggttgcctatgctatgctagcacactcaaagaaaaccgaaagaaattagatcctagagcacatccttgcatttttatcggatttaaaccaaacacaaaaggatatttgatttatgacttacattcacatagcatcactacatcacgaaacgttgtgttctatgaaaattattttccgcaaatcattaactcacaacactcagatataaaacctagcacattactcccagaacccttctccattacccaacatgacccaactatagaaacctcaccaacactacctccaatacatgaacccgtaaccattacacatacagtggaacccatttcctcacaacccagatgctcaacacgacccaaacaagcaccaacgtacttacaagactaccaccgtgagctctcttcgcacgataccaatgcttcaacgaaggttcgttaccccctgagctcggttctttcttattcacgattgtcacctacacacaagcactttgtcatgtccattacatccatagttgaaccttcctcctatgccgaagcttctaagcatgactgctggcttagggcaatgaaagctgaattgcaagctctgcaattgaacgagacttggaaactcactcctcttcctccccataagaccgccattgggtgtagatgggtatacaaggttaagcataaagcggatggctccatagaaaggtacaaagcacgtctcgtagcgaaaggctacacacaaatggaagggcttgattatcttgacacgttctctccagtggcgaagctaaccaccgtacgtctcctccttgctgttgctgccatgaatcattggcacctgagacaattagatgttaataacgccttcttgcatggcgagctagaggaagaagtctatatgcaggttccacctggcttaaccgttccaaatccgaatctggtatgtcgttttcaacgttcactctatgggctcaagcaggcgagccgtcaatggttcgtgaagctatcgggtttcctaacaatgcatgggttccaacagtctcactcagaccattccctttttctccgctttaatggttcagtcaccacgatactcttagtatatgtggacgacattattttaacaggcaacagcaacactgaaatacaggagatgctcacattgcttgatcaagcttttaggatcaaggatcttggaaacttaaagtacttccttggcctggaaatcgcgcgttcctctaagggaatccatttgtcccaaagaaagtatactttggacatattatctgattcgggtatgctgggatgtcgaccaaacacaactccgatggattcctctacaaagcttcaagctgcgacaggaactccgttatcagcagaagcttcttcttcttaccggagactcattggccagctcatatatctcactaacacccgtcccgacatcgcgtatgcagtacaacaacttagccaatacctgtctagccccacgaatgcccatcttcaagcagcctaccgcatattacgctatctcaagggcacaccaggctccgacatttttctttccgccaccggaaccccttag

SEQ ID NO: 22044 - DNA, 1169 bp, Glycine max
  Peptide Sequence Number=SeqID_138822
caccggcgaagcgggcaaagcttgccgaggaacggcttttcccactcaatctttccggtgaccagcagggttgcgagcgcgccgatgacggttctgtctccgtgcccgatggtttcaaggaagcctatgacgcctattgcgaaggcggctggatcggccttgccgttccccaggaatttggcgggcagggcctgccctatacgctgcatgcggcgatcggcgaatatatgtcttccgccaacctgtcgctgatgatgtatcccggcctgacgcagggcgcgattgccgccgttctcgttcacggtactccggagcagaagcagacctatctgccgaaaatggtccaaggtatctggtccggcaccatgaaccttaccgaaccccattgcggcaccgatctcggtctcctgcgcaccaaggcggtgccgcagggagatggcacttacaagatttccggccagaagatcttcatctcggctggtgaacattccatgaccgataatatcgtccatctggtgctcgcccgcatcgagggcgcacctgaaggcacgaagggtatttcgcttttcatcgtgccgaaattcctggtcaggcaagacggcacgcccggcgagcgcaacggcgtcacctgtggtgcgatcgagcacaagatgggtattcacggcaacgccacctgcgtcatgaattacgatgatgcgacgggttatctgcttggtgcggaaaacaagggcctttcggccatgttcgtgatgatgaacgaggcgcgcctctgcgtcggcctgcaggggctttccgtgggcgaaatcgcctatcagaatgcggtggaatatgcccgtgagcgtattcagggccgttcgctttccggcgcgaaattcccggacaaaaaggccgatccgatcatcgtgcacccggatatccgccgcacgctgatgaccatcaaggcctataacgaggctggccgcgctttccttttgtggacagcgctgcaatcggacatcgcccaccgctcgaccgatgagaaggagcggcaggcggcagacgacctgctcggtctcgtcacgccgatcctcaagggtgttctgactgacaagggcttcgaccacgccgtgacggcgcagcaggtgtttggcggtcatggctacatcgaagaacatggcatgagccaatat

SEQ ID NO: 22045 - DNA, 2094 bp, Glycine max
  Peptide Sequence Number=SeqID_138823
atgggtccaagtccaagcatagatttttcaaagtggtgggttaaggagagttcgagttcgagttctaggaaaggaaacccggttgtggtgactatggagaaccccaattactcggtgcttgaaatagatgcgccagactcggcatttcagccagttgacaaagacagaggtaaaaatgctaagcagtttacatggcttctccttctcagggcgcatagatttgtcggtttcctttcttggctcggaaattctctttgttcattgctccatgctgttaaaaaaaggttgtttttggggcacgtggagactgagatgtcttccaaggcaaagtttctgtttcgagtaattctcactttcctggtgatggctttggcattcctgtcttttgaactggttgctcacttcaaagggtggcgctactttcacaaccataataacttgcacctaattcctcaaacttcggagatcactggatggtttcacactgcctatgttaggtggctggagttccgggtagactatattgctcccctaattcagtccctatcaaccttctgcattcttctcttcttaattcagtccgtggatcgaatggtgctttgcttaggttgcttctggatcaaattcaacaagattaagcccgtcgtcattgatggggattccctcaactcacatgatttggaaggatccaacgatggatatcctatggtactcgttcagattcccatgtgcaatgagaaagaggtatatgatcaatctatttcagcagtcagccaacttgattggccaaaagatcgcttgcttattcaagttttggatgactctgatgatgagggcatacagtggttaatcaagggagaagtctctaagtggagccaaaaaggtgttaacataatctaccgtcataggaagtttagaactggttacaaagcgggtaatctcaagtctgcaatgagctgtgattgcgtcaaagattatgagttcgttgcgattttcgatgctgatttccaaccaaatccagatttcctcaagcaaactgttccacattttaagggaaatcctgagctggcattggttcaggctaggtgggcttttgtaaacaaggatgagaacttactgacaagactccaaaatattaatctctgcttccactttgaggttgaacagcaggttaatggtgtcttccttaatttctttggttttaatggaactgctggtgtttggagaataaaagcacttgaagaatctggtggctggcttgagaggacaactgtagaagacatggatatagctgtccgagcccatctgaatggatggaaatttatctttctcaatgatgtgaaggtgctttgtgagcttcctgaatcatatgaagcttataggaaacaacaacatcgatggcattctggtcctatgcaactatttcgtctgtgccttccagcgattataacctctaagattgcgttctggaagaaaaccaacctaatatttctattttttctgcttagaaagctaatcctccctttctattctttcacattattctgcattattcttcctttgacaatgtttgtcccagaagctgagcttccaatctgggttatttgttatattcctgtattcatgtcgttcttgaacattcttcctgccccgaaatccttccccttcattgttccttacctcctttttgagaacacaatgtcagtaaccaaattcaatgccatggtgtccggtttgttccagttgggaagttcatatgaatggattgttaccaaaaaagcaggtcgggcatcagagcctgacctattagctgccgaagaacgggattcaaaggcaatgagtctccaacttcacagagggacttctgatagtggactttctgagcttaacaaaataaaggaatgccaagaaacagttcctgtaaagaaaatgaacaagatatataagaaagagcttgcccttgcattcttactgcttactgctgcagttaggagcctgttatcagcacaaggcatgcacttctattatttactatttcaaggtgtatcattcctccttgtaggtctggatttaattggcgaacagatgaactag

SEQ ID NO: 22046 - DNA, 510 bp, Glycine max
  Peptide Sequence Number=SeqID_138824
atggcttggcagatagctgatacacgatatgaggatcccaagaccaatgtcaatttcctggatcaattccttcagaaagctgcattgtggttcatgctttcaaggttaaattcgattgtccttactattaacattaattacatattttatgaatttcactacctcccaggtggatcggttttggctgcatttgctgactcctttgctcccttgtattttgcggtgagagaacttaaggaagtgatgtcaatagagcagccatgtgatttagcatatgaattcggggatggactacatgatatcgaagagctcccattaggctttccaagaccagttgaacatccttatcctttcaacgatcaaattgttgtgtatgttcgctatctaggacctggggtttcagtagggcaagcatggcaagaggggacaaagttggagcaagtcccacataagttatatggggagattttaatggtgaaggattgcacatcattacgagaagatcaatga

SEQ ID NO: 22047 - DNA, 348 bp, Glycine max
  Peptide Sequence Number=SeqID_138825
atggcgcgaaaaccttgttcacaaccggcaagtgtaccggatcccacaagtagtataaaacagctattctgttatgccattcattattcaaagctttgtttagggttttacgttttcctgcttggatgctacttgtcataccctaatttcgtctggggattattatttgatgatatacaacctttgattggccgcttcgagacacttggcgtcctttattgcacaatgaataaagtcccgagacgtgtcagaaatcaaaaaggaagcaggcttgcgcaatccgtgaaattccgtaatgtggcggaaatcgaaaagaggtgtttttgcgcaatccataagtttttgtaa

SEQ ID NO: 22048 - DNA, 2853 bp, Glycine max
  Peptide Sequence Number=SeqID_138826
atggagaagtcatgcactctggtggtccacttcgacaagggaacgccggcgctggcgaacgagatcaaggaggccctagaaggaaacgacgtcgctgcgaagatcgacgcgcttaagaaggccatcatgatcctcctgaacggcgagaccattccgcagctcttcatcaccatcatccgctacgttctcccctccgaggaccacaccatccagaagctcctcctcctctacctcgagatcatcgacaagactgattctcgcggcaaggtcctccctgagatgatcctcatctgccagaatctccgcaacaacctccagcatcccaacgagtacatccgcggcgtcaccctccgattcctctgccgactcaacgagtccgagatcatcgagcctctcattccctccattctctccaacctcgaacaccgccacccctttgttcgccgcaacgccgtcctcgccgtcatgtccgtctacaagctcccccagggggagcagctcctcgacagcgggccggagattgtcgacaagttcttgtctacggagcaggatccttctagtaagcgcaatgcctttctcatgctcttttcttgctctcaggatcgcgctatcagttatctgtttgcgaatatcgataggattattgactggggtgaacagcttcagatggtggtgttggagcttattaggaaggtttgtaggaacaataagggggagaaggggaagtacattaagatcattatatcccttttgaatgctccttccactgctgttatttatgaatgtgctagcacccttgtgtcactctcttctgcacccactgccattagggctgctgctagcacttactgtcagcttttgctttctcagagtgataacaatgttaagcttattgtgcttgatcgtttgaatgagctcaagacttccaatagggaaatcatggtggagatggtcatggatgtccttcgggcactttccactcccaatcatgatattaggaggaagactctcgatattgctctcgagctcataactcccaggaacattgatgaggttgttatgatgctcaagaaagaggttgttaaaactcagagtggggagcatgagaagaatggggagtacaggcagatgctggtgcaggctattcatacttgtgccattaagttcccggaggtggcgagcactgtcgtgcatctgttgatggacttcttgggggataccaatgtggcttctgccatggatgtggttgttttcgtgcgcgagatcatcgagaccaaccccaagttgcggatttctatcatcaccaggcttttggatactttctaccaaatccgtgctgcgagggtgtgttcgtgcgcactctggatcattggtgagtattgcctgtcactttcagaggttgagagtggaattgcaaccattaagcagtgtcttggtgaccttccgttttatactattactgaggaaggagacggtcaggaggcatcaaaacccatacagcaggtgaactcaaccaccgtgtcttctaggaggcctgctattcttgcagatgggacctatgccacccagagtgctgctctggaaactgccatgtcaccacccacccttgtacagggttctctgtcctctattggcaacttgagatcactcattctttcgggtgatttctttcttggggcggtagttgcatgtacactgacaaaacttgtcttaaggttggaagaggttcagacttcaaaagccgaagttaacaaggcaactacacaggccttgttgatcattgtctccatgctgcagctgggtcaatcttcaattcttccacatccaattgataatgattcttttgacaggattgtcctctgcattagattgttgtgcaataccggtgatgagataagaaaaatatggctgcaatcttgcagacagagctttgtgaaaatgcttgcagataagcagtgtcgtgagactgaggagattaaagccaaggctcaaatctctaatgcacagcctgatgatcttattgatttttaccatctgaagagcaggaagggtatgagccaacttgagctggaagatgaggttcaagacgatctcaaacgtgctactggggagtttaccaaggatgcagatgatgcaaataagctcaatcgcattcttcagctcactggattcagtgatcctgtttatgctgaagcatatgtcacagtgcatcactatgacattgtccttgatgttactgtcatcaaccgaaccaaggaaactcttcagaatttatgtttggagttagcaaccatgggtgatctcaaacttgttgagcgtccacaaaactatacgcttgctccagaatcaagcaaacaaattaaagccaacattaaggtttcatcaactgaaacaggagttatatttggtaacatagtctatgagacatcttctaatgttcttgagagaacagttattgttctaaatgatatccatattgacatcatggactacatttctcctgcatcttgtgctgatgtggcattcagaactatgtgggctgagtttgagtgggaaaacaaggttgctgtaaatacagtattacaagatgagagggacttcctgaaccacattgtcaagtctacaaatatgaagtgcctgactccaccatcggcattggaaggggattgtggattccttgctgcaaacctttatgctaagagtgtttttggggaagatgctttggtgaatgtgagcattgaaaagcaagcagatggtaagttgagtggatacatcagaataagaagtaaaactcagggaattgccctcagtcttggggataagataactttgaaacagaagggagccgcttaa

SEQ ID NO: 22049 - DNA, 1031 bp, Glycine max
  Peptide Sequence Number=SeqID_138827
atggtgaaagttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtccctcctgtttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggatctccaccgcggtggcggccgctctagaactagtggatcccccgggctgcaggaattcgattgttgattgtatacttgacattggactaagagcacgcatgatctggatagcgggaacaattgcatccaatatgcacgactttcctgtatcgcttgtacgatcgttggtttttgagcaattgacgatatcagatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22050 - DNA, 264 bp, Glycine max
  Peptide Sequence Number=SeqID_138828
atggaggttgaagtttttgattgttgggttattgacttcatgggtcctttcccctcatctgctagtaataagtacatcgtggtagctgtagattactgtgaatccttgattcaagatgtcttcaagatcaagtcttgcctcacaatgaaaggtttcaagtcatccaaggcatatgtaatcgattaccaatacatgttgtcataccctaatttcgtccgaggacctttgcttgatgacatgcgacctttctttggtccttgtgag

SEQ ID NO: 22051 - DNA, 297 bp, Glycine max
  Peptide Sequence Number=SeqID_138829
atggagaacaacatgacatgcaaatctgcaataggatcaacgataggcctagggccatccattacagcccccaaccaaagcattccagtcttggattcacaaacaatttatctcacaaacattgcaaagaaaataacaaataaagcaccaaaataccccaaggaaaaggtaaaattggatggagatgtcacttacttgtgtgagatgaaaggaatgcaaaaaaacgaaacaaaaggtgcacaaaggaagcttgaggctgctgccaatggtggttcccgatcccagatgataagatga

SEQ ID NO: 22052 - DNA, 867 bp, Glycine max
  Peptide Sequence Number=SeqID_138830
atgcatggagagacatttgatcatagcataaaagacaagaaagcaaacaaaaaatcaaaaactattgatcaccgtcaaagaagtaaagatttaagttgtgaaagtggaagcaacagtgactcagaaaggcaaacaaatatcatcagtaaaggtgagcatagtaggaatgatcactctgacacacatatcaatggcactaaaagcataccttccttagctagaaggacaagttcttcctcttcatcagaatcatcctcagataatttctttagaataaaggaagcatttaagtataccaagtctggaaaagattatgtttctagcagtgagagctctgacaaatctaaagttgacaacaaccttctagttccaacatcaacatatcaagtttacgatttgagtcgcaaccaaaagggtatgtcaccaactgctagtcctcctatccaagtgatggatcgatctggaagatatgatgcttctattgttccatcttcaatctttgaaacaaatactaatccatcagaatggagtatttcttctaatgattcattatttagtattcaaatagggcaacctagttttaccagagaaaatgcgcttatgtatgctgaattaggcttttcaagagaattgaccaaatctggtgaggagataagcactgtcataaagagtgttgatgtaaagaacttgcaaacaatagaaacatcatatggacctttgatgttggaaggagaaaggctcagtgaagttgataacgaaataaagacttcacatcaaactaaaagttacgagccatccaagtccaatgtgtctattctttctcatagtagcgacattggcatgtcctctattgctttcccaaagtga

SEQ ID NO: 22053 - DNA, 1434 bp, Glycine max
  Peptide Sequence Number=SeqID_138831
atggcttcaagggtgtctcccaatctcaaatgttggcagttcagaaccccttattattgtgattcatggaagacacctcgtgcagttccttcttctatactgaggcatgtgactgagaggaacaatgttatgccaccatgtgggttggtccataggtcaaggaatttgagggtgcaaagaggaaaacgtgtttactcatcactttttgatgactttcaccaagaggaaaggatgaatctggttcaggatggttgttgggatgaaaatggccatgaaatagcttgtgctgtctctgataataccccaaacaaagaactcaaaaatgacttctcaggcggaggttgttcctctgaggaatttgggacaatgaagcctgaagttttggagccttctcttttgggaatccagcctgagccaccaagctggccagagagagatgagatcttgagacgtacctttgagaggaaagtgaacagtgtaggaatttctttgtccattaggatgatcaagaagaagctacaattggaagagggttccaaagaggctggtgagttgaccgaattaaccaactgttctgtgaagaagaccttctcctctatgatgttaatcatgcatgagctgcaaagtcatgccttgcaaacaagggagagcctgtgtggtgaaaacttgcaaggtgtcatgaccaagctagagagagagatggatgcttcatttgtttggctcttccagcaggttttctggaagaccccagctctcatggtctatgtgatggtcctcttagctaactttttagtgttctctatgaatgataacactgtcaaggtaatcactccttcttccatgatcacaaaggctctaaccttgaccagcaatgagagtaaagtacagcattcacatgttgatgttgatcaaggtgagtatgtgaatagggagttgacagaagaggagcacatgttgtggaactcctttctagaggaggcttcaatgttgcaaaaggaattgagtggtgaggttttggaccatgagacaaggcaaaggttagtggccccagtgtctgtggagcttgaaggggatcagtacgaggaatatgtcaaaactgagctttattacaaaaagcatttgttccggacacctcattgttcccttctgctgtctaactatgcacagtttctcttccttgtccttcatgatattgatggggcagaagagtactacaagaaatcagtgctagcagaatcatcggaagctgaggcattcagtcgctacgctgacttcttgttgatggtaagaaaggatgtttgggcagcagaactgagatatctgcaaacattggaagcagatcctgggaacgcctattatttatcaaagtacgccagtttcctttggaacaccggtggacaagatactaatagctttcctatgatggtcatatga

SEQ ID NO: 22054 - DNA, 174 bp, Glycine max
  Peptide Sequence Number=SeqID_138832
atggcttatagaggagtgcaacaatggtggcatcccaacacttccgagaagggtaaaggcatgcaaggggatgaggagaggagaatgaagggtggtttaaatgagtttccagcattatcaataggcctcacattgttagatatcatacacgatgctttcacatttcaacaatag

SEQ ID NO: 22055 - DNA, 1341 bp, Glycine max
  Peptide Sequence Number=SeqID_138833
atggttgggtgtaggaacgaaatgtgtgaagggaagcatgaagcaccactctcaggaaacatcagagtcgcgaaaggacaatctgataaatcaagcggcgcagaaagcgtccaccgattctcgttcggctcgggatggctggccgctgaaccggaccggttcggcttggagagatcttgttgggctcggaaacacgcatttgcggcggtgatgagagggagctgctgctgctggaaccgtcggacagagcagcggttccgcctcctcgcgatctccaccgttaaatcactcaagatcaagcttctcctcttttgctgcgtcgccttcacgcttctcgccttttccaccagcgcttcttccttcgtcctatggatcaacaaccaaacgccgccgcctccgccacctcgcttccccgattccgggaaagggtattctatagtaatgaacacatggaagagatatgatcttctaaagcagtccatcaagcattattcatcatgtcctcgacttgaatcagtacatattgtgtggagtgaacctgatcctccatcggatattcttttaaaatttctgcaccacgttgtaaagtccaagtctaaagatggaagatatgtgaaattgaggtttgatatcaacaaggaagacagtttgaacaatagatttaaagaaattaaggatttggagacagatgctgtcttttctattgatgatgatgttatatttccttgctctacggtggaatttgcatttgatgtttggcaaagtgcacctgatacaatggttggatttgtacctcgtgtccattgggtggattcattggaaggtaatgacagcaaatttatatatggcggatggtggtctgtgtggtggacgggtacatatagcatggtgctttccaaggcagcattctttcacaaaaagtatttcaatatctacacaaatgagatgccatcatcaattagagaatatgtaaccaagaacaggaattgtgaagatattgcaatgtctttccttgttgcaaatgctaccggtgcaccccccatatgggttaaaggtgcagcggaaaagttgtgtcttggtgatgggttcgaatccataaacagcctctttgcatatgtaagtcaaatggtagacagtggattgacggagtatgtaatgcatattgcagttgaatacaacagtaaaatattagagattggatcgactggaatcagtagtttgggaggtcacagtgaaagaagaacagaatgcgtcaacagatttgttgccgcgtatgggcggatgcccttggtatctacttcagttaaggctgttgatagccgcaatatctggttttggtga

SEQ ID NO: 22056 - DNA, 717 bp, Glycine max
  Peptide Sequence Number=SeqID_138834
atggcaggagagaaagaagctcatcaaccaatgagtactcttaatgattaccttgtcaacactaggccaaagtacttcaacaccattgcaaagcctaaagtgcaagcttgtaacatggagataaattcagaatttattcacttggtgcagaaaatccaattttggggatatgatcatgaagacccctatgctaacttggccacttttgtggatatttgttgcaacatgcctttgagaaaatgtccacctcacggtcttgatgaaggagcacaaatcaatactttcttggtggggttaagggctcaaactaagcttctgcttaatgtttcagttggaagcaagattatgttgaagacaccggatgaagctaaggagatcattcagaatatggcttcaaacgattatgaaaccaacatgataggactctggtgcaaagaagaggaggagaacaaggtatcaatgaaccctgtcatcaaggaccttccttatccacatgctccaacaaggaaggataaggagaagccacatgcatggatcctagagatattgaagcagttgcaatttaacatatcattcttaaaagttgctaaaccaaggccaagttatgatgataaaagtgttgattatcagttgaatgtgcttgatgaactctttgttgagcccaagctgcaattgcatattccttttcctcttgagttggctcctattgatgcatga

SEQ ID NO: 22057 - DNA, 606 bp, Glycine max
  Peptide Sequence Number=SeqID_138835
atgccttgctatatttatcactcccatgcaattaatgttgtgcgtgtatgcatgctccagaatataaaggctcacgagaacaggaagcagatattttccaagaacgcatcaagagagaatcctttgcagcatcagccaaagccaactactgagccgccaccttggtcaaattcatcgaatgcatctgagagtttgcatcaagaattggcattaccgtcaaatggagctcctgttggcaatcaactaagacgaaggttggctgtggacagcactccatcccagcaaatggaaatgtctatggtacagcaggttgtgcctcggcatgacaactatgctcaaagtcgggcaactgctctgcacaatgtggaatctactatcactgagcttagtgggattttctcacatttagctacaatggttgcccatcaaggggagcttgctatcaggattgatgacaatatggatgagtcatcggcaaatgttgaaggagctcacagttctttattgaggcatctcaaccgaatatcatcaaataggtggcttctaataaagatatttgtcattctgatacttttcctcatgatcttcatattctttgtcgcctaa

SEQ ID NO: 22058 - DNA, 201 bp, Glycine max
  Peptide Sequence Number=SeqID_138836
atgaagaacgaacgaagaacggtgaagaatcttcacgaaatcactcacggaaacgtctcagaagagaaaagagggaggtggttgccgcccagctcgcccaggcgagcagggttgcttccaccaaaaggcatcgccttcttttggaaccctcaagaaggcccaagtgggcctggttgctatttgcaccccccttttcactaa

SEQ ID NO: 22059 - DNA, 369 bp, Glycine max
  Peptide Sequence Number=SeqID_138837
atgtgggctaagcgcgcagatccgctaggcaatccgctaaggaagaggatcgaaatttgcttaagtgagtgtaacgtcaattacactcacatttgcccaaatttactgaaccttacctgcattttctctcacacccaacttcttgctttcttgctttttctgcatcttcactcatcttctactactgacaaagattcaaaagaactccctaagagcgcctacctcgctaagcgagttcatcttttgaggatgaacactcatcctcttgctgagatgcctgtggctaagcgaggctcaatcgctaagcccatggtgtttccctcgctcctacgtatcctcaactgcgatgagaaaatcagacctacgtag

SEQ ID NO: 22060 - DNA, 423 bp, Glycine max
  Peptide Sequence Number=SeqID_138838
atggagagaaataacgagggtaagaaggccttgattcaggctcactcggtctcgcgtcatggcctcactactgcctccctacgctcgtgctgtcgactctgtcgcgactttgcctcatgtcaagaccaaagcggcacgccactaagttcatccccaaccacaccaccctccaccccccctggtggtagcgccgatcaatgtggtggaccactgcctcccctacgagaagcacaacttctacgacgtcaccttcaacaacaccgtcctccgcgaccaccaccaccacgtgctcaccatgcacacacaagttctattgcaaaagcaggaactgaagaagctattcgtaaatccaagatttctgagtcccaatttgagaaaggactgacgttatgtgatggggatctgggttcaatgaaaatctaa

SEQ ID NO: 22061 - DNA, 2997 bp, Glycine max
  Peptide Sequence Number=SeqID_138839
atgatgccaggaacagttggtcacgctttgagtgcagagagtgataaggtggctttacttgctctgaagcaaaagcttaccaatggagtgtttgatgctcttccatcatggaacgagtctttgcatttgtgtgagtggcagggtgttacatgcggccaccgccacatgagagtcactgtattgcgcttggaaaatcaaaactggggtggtactcttggaccatccttggcaaatctaaccttcctcagaaagctcattctttccaacatcgacttgcatgcccaaattcctacgcaaattggtcgactaaagatgttgcaggttcttgacttgagccacaacaatctccacggtcatattcctatacaccttactaactgctctaaacttgaggtaattaacttgttgtacaataaactcaccggaaaacttccctcgtggttcggaactggatccatcacaaagcttaggaagttgcttctcggtgccaatgatctagttggtactataacaccttccttggggaatctttcatccctccaaaatattacacttgcacgaaatcatttggaaggaactatacctcatgctttgggtcggttatcaaatttgaaagagttgaatcttggtttaaatcatttgtcgggagtagtccctgattccctttacaacctttccaatattcaaatttttgttctcggcgaaaaccagttatgtggtactcttccatcaaatatgcaacttgcttttccaaatcttcgatatttcttggttggaggtaacaacttcaatggaagtttcccgtcttcaatatccaacatcaccggattgctcaagtttgatatctcctcaaacggttttagcggatcaattcctcccactttgggaagcttaaacaaacttaagaggtttcacattgcttataatagttttggaagtgggagagctcaggatttggatttcctttcttcattaaccaattgtactcgattgaacattcttattttggagggcaatcaatttggtggtgtgttgccagatcttattggaaatttttctgccaatctcactttgcttgatatgggaaaaaatcaaatatctggaatgatacctgaaggaattggaaagctaatcggtttaactgagttcattatgggagataattacctagagggaactattccaggttcaattggaaatcttaaaaatctagtaagattcgtcctgcaaggaaacaatttgtctggtaatattcctacagccattggcaatcttactatgttgtctgaactttatctgcacaccaataatctcgaaggaagcattccattaagcctcaaatactgcacccgcatgcagtcatttggtgttgctgacaacaacttgagtggtgatatccctaatcaaacatttggcaatctagaaggcttgataaatcttgacttatcctacaactctttcactggttccattcctttagagtttggaaacttgaagcacctttccatattatatttaaatgaaaacaagttgtctggtgaaattcccccagaacttggcacttgttccatgttaacagagctcgtactggagagaaactacttccatggaagcataccttcgttcttgggctctttaagatccctcgaaatcctagacctttctaacaatgacctgtcgagcacaatccctggtgaactacaaaatctgacttttttgaatactttgaacttgtcttttaaccatctttatggtgaagttcctataggaggtgtctttaataacttaacagcagtttcactcattggaaataaggatctctgtggggggatacctcaactgaagctcccaacttgctctaggttgccgtcaaagaaacacaagtggtctattagaaagaaactcatcctcatcattgtaattggagttggagggggtttggttagtttcatagcatgtatcagcatctatttgttcagaaaaaagcccaaaacattatcatctctattgtctctggaaaatgggcgcgtgaaggtttcttatggagagctgcatgaagcaaccaatggattttcttcatccaatttggtagggacaggatgctgtggttctgtatatagaggatctcttctccatttcaaaggaccaattgccgtgaaggtgttgaatcttgaaacaggtggggcatcaaagagtttcgcagctgaatgcaaggctctaggaaagatcatgcaccggaatcttctcaatgtcctgacttgttgttcaagtattgactataatgggaatgatttcaaggctattgtttttgagttcatggctaatgggagtctagaaaatttgctgcgtagcaacgaagagctcgagtctagaaatttcaatatcaaccttcaacttatgctaaatattgctcttgatgttgctaatgcattggattatcttcatcatggttccgagcaggccgtagttcactgtgatattaagccaagcaacattcttcttgacgatgactttgttgcccacttgggagattttgggttagcaaggctccttaatgtggtcacgggacattccagcagagatcaggttagttcgtctgcaattaaaggaaccattggatatgtccccccagagtacggagcaggtgtgggagtatcaccaaaaggagatatctacagctacggaatccttctgttggagatgctgacaggaatgagaccaacagataacaagtttggtgagagtctaagcctacacaaattctgtcagatggcaattccagaaggaataactgagatagtagattcacgtttgcttgtgccaacaactactgaagagggaacaagggtcagggtcatggaaagaaacattagggagtgtctggtgtcctttgctaggattggacttacatgttctgcagaattgcccgttcagcgaataagcataaaagatgtgatagtggaattgcacctcatcaaaaagaagctggctcgctag

SEQ ID NO: 22062 - DNA, 225 bp, Glycine max
  Peptide Sequence Number=SeqID_138840
atgccaagaccagacaaacccaattggcctacgatgcatttgcgctcagcgccacacctcgcgcttagcgcgttcagatcgcgcgctgggcgcgccatgcacgctgggcctgtgcttctgttggatcgggcgctgggcgcctgtgcgtctgttggatcgggcgctgggcgcctggctggcttagcgcgcgtaacggtttccgccacgctcagcgcctccagttag

SEQ ID NO: 22063 - DNA, 207 bp, Glycine max
  Peptide Sequence Number=SeqID_138841
atgatagttattactactaccttgggagaatttggatggatactgatggaaatcctattcaagctcatggagggggcattttatatgatgaaagataaagaacatactattggtacggtgaatataaagatgggcccacgtaccatgctcacaagagagcatctgctcgggctgattatcaagcaggtctatgtttataagaaataa

SEQ ID NO: 22064 - DNA, 1713 bp, Glycine max
  Peptide Sequence Number=SeqID_138842
gtaactggtgttggtataaataccgaatggggattgttgatggctagtatctcagaggacaatggagaagagactccattacaggtacgcttgaatggagtagcaacttttattggtgtagttgggcttagtgtagctgttttagtgcttgctgtcctcttgggcagatacttttccggccataccaaagatttagatggaaatgttgaatttgttgccggaaagactagtcttagcaatgcagtagatggggtcatcaaaatttttaccattgcagtcacaattgtggttgttgcagtgcctgaaggtctacctttggctgttaccttaaccaaagtggtttcatttccatttccgttcacaaataaaaggcttttgtatggattggagaaggatgccttgtttgttaaggataataagatgactgtagttgaggcatatgttgggagcacaaaagtaaatccaccggatgactcatcaaagttgcatccaaaagcattgtctctgataaatgagggcattgcacagaatacaaccggaaatgtttttgtacccaaggatggtggagaaacagaggtatccggatctcctacagagaaggctattctttcatgggcagtcaagttgggtatgaattttgatgttataagatcaaattcaacagttctccatgtcttccccttcaattctgagaaaaagcgaggtggtgttgctttgaagctgggggattctggaatacatatacattggaagggagccgcagagatagttctaggaacatgtactcaatatcttgattcagatggtcaattgcaatccattgaagaagataagaaggcttttttcaaggatgctattgatgacatggctgctcgcagcttgcgttgtgtagccattgcatacagatcctatgaactagacaaagttccatctagtgagcaggatttagaccaatggtccttaccggaatatgagcttgttttgcttgctattgttggaataaaggatccttgtcgccctggtgtcaaagatgctgtaaaagtatgcactgatgctggtgttaaggtacgcatggttactggagacaaccttcaaacagcaaaggcaatagctttggagtgtggcatactggcttcaattgaagatgctgttgagccgaatataattgaaggaaagaaattccgtgaactatctgaaaaggaaagagaagatattgccaagaaaataactgtgatggggaggtcttctcctaatgacaagcttttgcttgtgcaagctctacgtaaaggaggggaagttgttgcggtcacaggagatggcaccaatgatgctcctgccctacatgaggcagatattggtctttctatgggcatctccggaactgaagttgcaaaagaaagctcagatattataatcctagacgacaactttgcatcagtagtaaaggttgtccgctggggccgctctgtatatgcaaatattcagaaatttatccagttccagcttacagttaatgttgctgctcttgtaataaatgttgtggcagcaataacttctggtgatgttcctttaaatgcagtgcagcttttgtgggttaaccttatcatggatacacttggggcgcttgcactggctactgaaccaccaacagaccgcctaatgcacagatcaccagttggccgaaggtttggattgattggctttctcacttag

SEQ ID NO: 22065 - DNA, 162 bp, Glycine max
  Peptide Sequence Number=SeqID_138843
atggggaaggcgagattagaattgaggagcagttataaacttcaagtagaagtgaaacagaagaagcttgagcagcacatggaggtgtgggacactaagacaaaaaacccaagacacatgtgttttacttctaactctactaatcttgctacagtcggttaa

SEQ ID NO: 22066 - DNA, 2061 bp, Glycine max
  Peptide Sequence Number=SeqID_138844
atggatgaactagcatgctttgctccagggatgattgctttgggatcatttggttacagtgctgctgatgattcacagaagtttctgtcacttgcagaagaggtaatcactgaagatatgcaccttactttgcagcttgcttggacatgttataacttctaccaatcaactccaacaaaattggctggagagaactatttctttcattctgggcaggacatgagtgtgggtacatcatggaacatactgaggccagagacagttgagtccctcttttacctttggcgtctaactggcaacaaaacataccaagaatggggttggaatatatttcaagcttttgagaagaactcccgcatagagtcaggctatgttggactgaaggatgagactaatgacttttactattcatgggcaatctacttggtcatgcttactgttgttgatgaatatttggctgttaatagtggagtcaaagacaacatgatgcaaagcttctttcttgcggagaccctgaagtatttttatcttctcttctcaccttcttcagtcatctcattagacgaatgggtattcaacacagaagcccaccctctgaggattgtgaccagacacgaagagggacttgttaagaatttaaatgagaagcaaaaacctttttctagaataggtggcagaaaggaaggaaggtcagcttgtaagatgtcaggatttcctcattggggagggcttaaagccctagtttcaatgcgaacatcctataatcttgttcttcttcgctctcgcttccgccgctctcacaatttccacgcataccgttccctctccgtcgtaatcctcaaaccagaccaccatccaccagctatcattccctcaaattcccgattccttcttcccggcttcaatgctcatcgccatcgcagtgcggctaagccagcaaccaccaacattgaattcaacgatcaccacagtcagcgagctgttaaaactgcattgtggtgtaactttcttgttttttcactcaagtttggagtatggttagcttcctctagtcatgttatgttagctgaagtcgtccactctgttgccgattttgctaaccaggcactacttgcttatggtttatctagctcgaggcgtgcaccagatgctattcatccgtcagtttatggctattccaaggaaagatttgtttggtccttgatatctgctgttgggatattttgtcttggttctggtgccaccgttgttaatggagtacagaacttgtggattgcacagccccctgagaatatgaaatatgcagctttggtgatatgtggttcattcgtcattgaaggtgcctctcttattgttgccatacaagctgtcaagaaaggtgctgctgcagagggaatgaaattaagagactatatttggcgaggccatgatcccacatctgttgctgtgatgacagaggatggtgctgcagtcactggccttgttattgctggggcatcattggttgcagtgaatgttactggaaatgccatttatgatcccataggttctattgtagttggcaacttacttggaatggtagccatatttcttatccagagaaaccggcatgctttgattggtagagccatggatgaccatgatatggagaaagtacttcagtttttgaaaaaagacccggttgtagattccctctatgattgcaaaagtgaagttattgggcctggattcttcagatttaaggcagaaatagattttaatggagaaatggtggtgcaaaattatcttaaaaggactggtcgtgaagagtgggcaagacagtttcgtgaagctgctaagcagaaggatgatactgccatgatgaagattatgtcaaattacggtgaggaagtagttacagctttaggaagtgaagtagataggttagagaaggagatccagaatcttgtgcctggtattcggcatgttgatattgaggcccacaatcctccaacagaaacaaccttgtcaatatcacgagttctgaagaaatccggagttgagttacatgcctcgggttga

SEQ ID NO: 22067 - DNA, 315 bp, Glycine max
  Peptide Sequence Number=SeqID_138845
atgaagtcagagtttgacatgacagaccttggaatcctgcattattttcttagttttgaatttatgcatacacataagggaatcttcctacaccaaagaaaatacactgattcctatgcaacagcaaacccgacgttagttatggagtgggattgcttagcagatttatggggaatgatcaaaacagattatgcattgaagcctactctgattcaaactagtgtggtgataaggttgaaagaaaaagcacctctagatacttgtttaagtatctggatgcaccaatatcctggtgttcaaagaagcaaagtgtag

SEQ ID NO: 22068 - DNA, 3090 bp, Glycine max
  Peptide Sequence Number=SeqID_138846
atggctgagctagcaacaagggatttgcaggataatgttggtctacctttaggagacaacataaccaattctattattgtaatattccctagcacaaaattacaattcagtactggcccctcgaagccaactgctagctattttcctatcaattttggtgttgtcattgttatggctgatgctttcagggccaaggggtcctcaaataagctggaagatgccattctcaaactcaccaaccaccaattgtcccttggtgaaataatgcaatccatgtcccttaagtttgatgaacttcttcttcgcatgtcaccattgctttccacgcctacgtccgtgccaccacccatgacgaccctaccacttgtttctgcaacaaatcaccgcatgaaactagatgtaccgaggcagagccctcacttggttctagtggatgaccaacaatggtcaattcacttcatggcccgcgtttctccaagccctccaaactcatttggccaaccgattagttggtcttccttcctaattccttctaagttgctttatttctggcctcactccggaaattcatcgggaggtgcaggcgttacagcccttgactcttgtccaggcagccgggctcgcgtgactccaagaggagaaactcttggacacgcgccacgtcttgcacagtcaaccactacccgtcgtctcactgccgccctcgtgtcctatggtgactccatatctccttccctcgccaccatgcccaccgccatcaaccctcaaatgcttatctccggaggagataatgaagaggacgcccctttagctcatatagagggtcttgacccgcctcctgacccactcgatacccatgacccatttgcggcccaaataagttttaactctttagcgggtcaaatggccccgaaaacactccgcctgttaggtatgctcgtcggccaccaggtcgtcatcctcgtggatggtgggagtacccacaacttcattcaggaagagttggcgaccaccttcaccattgacctgtacatgttaccaatttcaggtgcaaatattgttctgggttttcaatggctcaaatcccttgtgccggtcctcactgactataataccctgtgtatgaagttcttccatgatgatcgcctggttgaacttaaaggagataatgagtccaccttaaacttgttgacgctgccgcaatttcgtcggttactcaaaaaacagggagctagtttctactaccacatcgcggtgatttcaaatgagaaacaagatggctcttggagattctgtgttgactacagagctttgaacgcaatcattgtacgtgatagatttccaattcctaccattgacaaactcttagacgaattgggtggagctagctggttctcaaagctggatttattgcagggatatcatcaaatcaagatgcattctggggacatagctaaaacggaatttcatacacatcatggacattacgagttcaaggcaatgattaatatgatctttcatccgtatctttggcgcttcatcattgtctttttcaatgacatacttatttacagtggctctttcgatgaccatgtggagtatctcggccatctagtttctaaaaggggagtggaaccagttgcttcgaaagtgggtgccattcgtcaatggcccgttcctcagtccaccaaagctctaaggagctttctgggtcttgtaagcttctaccaccgacttataaagggatatgctataattgcaaccctattagtcaaggccactacgatagagcctttccagtggacaactttggcccaaattgcttttgagcaactcaaacaggctttctcggaagcccctgttctgaccttaacgaactttcagctccttttcactattgaaacaaatgctttaggtgtaggcatgagtgctattctgtcacaacaaggccatcacttcacgattatcacgaaccatcaaagcctcaaagagctactaatgcaggttatccaaacttcagaacagcacatgtatctagctcgtttgatgggatacgactatcaaattcaataccgctctggtgccaataaccaggccgcatatgcgttatccaggctccttaaacacaatacttccccgttgttgactctctcagtgccttacttgactttcatggaggaactataccgaggacgaatttggcttcctcgggggctccccctaatctctatgttgcttattgagtaccattctacaccgaccgaaggtcatttaggaatcgccaagacaatagctcgtttatcagagaatttttgctggcccgggcttagagacgatgtgatgcaatttgtcgcagtgcctcaccgcccttgggaagatctttcattggactttatcatcgaccttccactgtatcatggaaacactgttatcctggttgtcgttgatcgcttccctaagggaattcatttaagaatgctaccaccatctcatacagctcatactgtcgcctgtctatttatggatattgtgggaaagacccatggcattccttggagcttgagtgacaatcaaacagaggtcctgaattgcgtaattgagcagtacctttgggctttcgttcatcgtcatccaagttcttgggaaagattactgctttgggttgaatggtcccataatacctcgtggaatgtgggcactggttctacactgtatgaaatcacttttggtcgcaaaccattccattttccagggtacattacaggaacttcgaaggttgatgtcgttgacgacatgttggtcaatcgcaaagaaacattccaagtcattcttaagaagcttttgaaggcgcaaactctcatgaaacaacatgttgatgctaagcgcagggaggtcaattaccaacctagcgattgggttatgagggcttcaaccccaccaataagtctccgccaaacagcatcaagccacgtctggcaaacagccctctctaggaggtcttggttcaatggttgggattgtcaccggatgagacctcgtgggaggactggtcacaattgcgctaggattatcaccttgagaacaaggtga

SEQ ID NO: 22069 - DNA, 2036 bp, Glycine max
  Peptide Sequence Number=SeqID_138847
atggatgttattcttggattccaagaacttgatgagatcgtgagagatgggtttcaagaaccctctaagaatgcttcaacagaacaaaaggagatgcatcgagagaacaagcgactagactacaaggctcaagctgcaacctcgaagaaagcatgggatagtttgcaacaagtatatggcaatactgggagaacaaaaaaggtgatgacaaactcaatgcgagcctgtgatgaagcaatggttgattcaaagattatggagaaggtgctcaaaacattaacacccaactttgatcacattgtagtagccattgaagaatcaaaagatcttgagaatatgactgtggaagaattgcaaaactctttggaggcacacgagcaaagggaagaggaagacatagaggaggcaaaagtggtgatcgaaatgcaaaaacacatagttcaacttcctaagagcagattcttggaagcaattcaaatgagcagcgtgataattccagttctagaggaggaaactttttcaaaagtcaaggtgattggcaacaacaatgcccatagcaaatacaagaagaatgattgggcacacttggcacaggaagaagatggatttgattcagaccaagttttgcttatggtaaccacgagcagtaaagaagactattcatcttggtatctcgacattagatgctcgaaccacatgacaggcaatagagactggctagttgatttcaatccaaatgttaccactagtatgaggtttgcagataatagcactattcttgcagaaggtattaggaagaaaggatttaccatggcaatgcagggaaaccatattgagatctttgatgataaacaaaaactagttctcaaggcaccattatccagaaataggaccttcaaggtgaatttaagtattgctgccattcaatgcttgtccactgttaacacggaagaagataactggctatggcactacagatatggccatttaaattttaagagtctgcatcaactaagcagcaaacaaatggttcttggaatgccatccattcactcacctcagaaaacctgtgaaggatgcttgattgacaaacaacccagaaaagccttcaagaccaaggcaccacaaagagctaaacaacctcttgggatagtccatttagacgtgtgtcgaccctttgatactccatcccttagtggtaataggtatttcctgacttttgtggatgaatttaccaagaagatttggatatatatgttgaaagagaaaggtgcagtattttctctctttgtgaaatttttcaaatcagttaacagacaatctgaattgaagctaaagatccttagaatagatggagggggtgaatataactctaaggagttcaaagaattttgtgaagctaaaggaattgaacatgaggtaatagctccatatacacctcaacataatggcttggcaaaaaggagaaacagaaccctattggatatggctaggtgtatgcttaaagggaaaggactactaaattgctactggggagaagctgtcaccacagcagcatatgttttgaatagatgtcccactaagagacttcaatctataacacttgaagaagcttggatcggagacaagcctatggtgaatcatttgaggatttttgggtctcttagctacagacacatcccaaatgaaaggaggaaaaagctagatgataaaaatgtcatggtagatgaaattgtagcctggaaatgggaaaatgagtctaaaattcccaactcatatattcttaaggacaacccaagagccaaggctgttaaccctgctagctcaatacaatctcctataaaaaggtcacagagaacaagatttccctctataagacttacaggttatgagctgtacagtaatggttcaatctctaatgatggtgaaatggtacattttgcttttatcgttgacacaaaacctgtacaatggaaacaggccttggacatcagagaatggaaggctactatgaaagaagagttggatgccataga

SEQ ID NO: 22070 - DNA, 1275 bp, Glycine max
  Peptide Sequence Number=SeqID_138848
atggtggaagaatttgaagagatcctaggatgtcctctagggggaagaaaaccatacctcttctcaaggttctatccctcattagctagaatttctaagatagtccaaatctcagtgcaggaattagaccacaaaaagcaagtcgaaaatggggtggttggaataccgagaaaatgtttggaggcaaaagcaagaatattggcaggtagaggcaaatgggccccgttcatagacatcctcgcacttttgatctttgggggagtcctctttccaaatgtagatgggttggtggacctggcagcgatcgacgctttcctcgcctatcatgaccgcaaggaaagtccggttgtctctatactagtcgatctatacgacaccttcgaccgaagatgtgagaagagcagtacaaggattgtttgttgtactccagccctctatcaagcaaagaaggagcgtctgtcaactggttccctcgatggaagaaggaagaaccaggattcttatttcgtgcggaggatttccaaatccttgatggggacaaggggttgcataagttacaatctccttcttgctataagacaacttggctaccctatgagaggggcaccattagaggaagagctcgcacctattattgcacgaggtttcaataagaccaacgtggaggcacttcagaaggtccgcaaggcgtgggagatggtgcaaaagaaggacaaagaactcataggcagtaacaacgggcccatcagcggctaccgtaagtggttgaaagcccacatgcaaggtttgggttggctcccgagtttgagaaccactaaaggggaggaagttgaggcaccggaggaagacgaagaggtgcatgcccttagggcagaactcgagcaagcccaaacagtcaaagaaaggttcaaatcagcagctctcaagatccgaaaggagaatgccgaactgagagatgtaaatatagctaccaccaaggccttggaacgagagaccaaaagggctcgtagggaagaacacgaccagaacaaatttcgaggggctctgtggggcagtaacagcgagcttaagctccggagagaggagagggaccaatcacgagtagacagtttgatcttgaaggatgagttgaaggtttgcctaaggtccaagagaagcttgtctcagcgtttatgcaagacaaaaaccaacatgttatccatcatcaacaagtaccaagaagaattaaatctagccacagtccacgagcacaaagtggcggacaagtatgcctga

SEQ ID NO: 22071 - DNA, 201 bp, Glycine max
  Peptide Sequence Number=SeqID_138849
gaactgtgtggggaagttgatgaggacacaactaagggcaaggaccatgaagcacttgaagggcccatgaccaaaggcatacttaaaaaggcccaacacagtgatgaggacacaactaagggcaaggaccatgaagcacttgaaaggcccatgaccagagacaaacttaaacaggcccaacatgtcatagagacaaggctg

SEQ ID NO: 22072 - DNA, 231 bp, Glycine max
  Peptide Sequence Number=SeqID_138850
atgaacaaaattaacgccacttgtagaaggcataattcagagagaatcagaaaatttctgcaggacttggaagtagcagcaactccagaagtagaacctcaatcttccgaggcatcttcaagttttcctattgtatggcattctcatatagaacctgttgaagacccaatcatggctgaagagccaagaagagtaaccctggaggattattcaagttctaccgtgccataa

SEQ ID NO: 22073 - DNA, 192 bp, Glycine max
  Peptide Sequence Number=SeqID_138851
atgactttgggcttagctcaccatttttgggctaagcgtgcataccacgctaagcacgacagagaatctggcacaacaccaatatcaaggccgcgcgctaagcgcgagattagtgcactaagcacaatggttgtcatcagccaggctcagcgcatgactagtgctaagctcaaatccacttactcgcgctga

SEQ ID NO: 22074 - DNA, 1162 bp, Glycine max
  Peptide Sequence Number=SeqID_138852
taccctcacctttagaggaatatacgtcctcgtcatcagagggttgcacgccctcaccttcagaggactacacgtccttgccttcagagggctacacgccctcaccttcagaggactacatgtcctcgccatcagaggattacaagtcctcgccattagaggactacacgtcctcgcctttagaggactacacgtcctcgccatcagagggttgcacgccctcaccttcagaggactacacgtcctcgccttcagagggctacacgccctcatcttcagaggactacacgtcctcgccttcagaggactacacgtcctcgccatcagagggctgcacgccctcaccttcagaggactacacgtcctcaccttcagagggtcatggctacacgccctcaccttcaaagggctacacgccctcatcttcagaggactacacgtccttgccttcggagggctgcactccctcgtcttcagaggactatatgtcctccccttgagaggactacacttcctcgcctttagagggctacacgtcctcgccttcagaggactacaagtcccccttttcagaaggctacacgctctcgcctttagagggcgacatgtcctcgccttcggagggaaggctatcgcgcagctactgtgcataccggggcaaggtttcacccgtgccactgcaaagagacgagtgtggatcatgcgcaccaacatgaccactcttacacagatatgtataacattgctacttagcaacatttcgcccagcgaccgtaatgtcgatctccccctgcggaagtatcagttggggtcgcgcccacaagacacccagtggacccaaagaagtccaacagggccctggggtttccagctctggttacgggcctctatcagtcctatagggtgcccgtaccccccggcaaggtcatgccatcacgacatagggatcgcgcccgcaagacacccaatggacccgaagaagtccaacagggtcctagggtttccaactctgattacgggcctctgtcagttctacggagtgcccgtcacccccaacaaggcaggcgcaaggcgaaacaccacaatagcctggggatggccagcaacaggcaacaaatgcaccgtcgccacctccagagcccctcagctcatccaaaaaaag

SEQ ID NO: 22075 - DNA, 735 bp, Glycine max
  Peptide Sequence Number=SeqID_138853
atgccctcgatggtggagagagggatgataacaatgataatagacacattgtcggtgttctactacgagaagatggtaggttacatgccttcaagttttggagatttagtgtttcctggcgagaggatcgaagtgggtctgagaagagggaaatttgattatgctgcttctactggttctaataataagagacttgggatgagtggagggaagaagaaggagggagaaacccatgatttgactgttgttcctacatggccaaatttcccactagccccttataatcccatgtaccaatatcctccccaactatatcactactcaaccaacattagttctacctattacccaccaccctaccaaccaaagccatccctaaatcggccacaaaatctacctgctgcacaaccaagaccaaacaccaccgctaataccaaccaaaacaccaaccaagggaagaatttcccagaaagaaagcctgtagaattcaccccaatcctaatatcatatgttgacttactcccatattttctcaacaatgcaatggtggcaatgagcccaacaaagatttctcaacctccatttcctagagggtacaacctgaatgtgacgtgtgcttatcatggtggagctccggggcattccatcgattattgtatgaccttgaaacataaggtgcaaagtttgattgatgcaggttggctgaaatttcaggaagacaatcccaatgtgtga

SEQ ID NO: 22076 - DNA, 156 bp, Glycine max
  Peptide Sequence Number=SeqID_138854
atggaacataggaatttggggatcccacggtcctgtggctccgcatgccaccggactcttgggacacgcatttcgtttctaaacgaccatttagaggaagcactgggtccaacaaagataggagaaaatcactcaaagtgtatcaatctcacacag

SEQ ID NO: 22077 - DNA, 769 bp, Glycine max
  Peptide Sequence Number=SeqID_138855
tctcgaacatctgcaactggcgctggccaaccatccggcgtttcgctgtgagatcgtcgcctttccgcagcatggtatgctgcattcgcaggtcgatggtctgatgcgtgaagcgatgcagctcggcgtgcagtatgtcggtgggctggatcccaccaacgtggatggtgccatgcaggcttcgcttgatgcgatgttccgcatcgcgctcgactacgatcgcggcgtggacattcatctgcatgagaccagcgccgccggcgtggcagccattcagtacatgatcgccaccatcgcccgtaatccgcagctgaaaggcaaagtgacactgagccacggtttcgcgctcgccacgctggaagcagatgagcgtggcgtcacgattccgattggcaagctgacgatgccattgccgcagttgcaggcagcgggcgtgacggtgatgaccggcaccgacagcgtgatcgatcactggtcgccgttcggtaccggcagcatgctggagaaagccaatctgtatgcccagctgtatcgcggttcggatgagtttggcctgagccgcgcgctgcatatcgccaccggcggcattctgccgctcgccaatagcggtgagcgccagtggccgcagctgcaggatgaagccacgcggcacgccggtattcagcgcctgaaggcgcatcgcagccagcaccagcacgccagacccggccagaaaaaagcctcccgcaggaggctttggaaggtgacaccggcgcggcaagcccgatga

SEQ ID NO: 22078 - DNA, 156 bp, Glycine max
  Peptide Sequence Number=SeqID_138856
atggagaggggtcttgactttgatggaatgggaatatatttgaggagatatggtaggggactagggagccgagtcatcacccccatcaaagaagcttctatgtctctcccagtggggactgtattcgatcaccattcaattctaacatgtcattag

SEQ ID NO: 22079 - DNA, 303 bp, Glycine max
  Peptide Sequence Number=SeqID_138857
atgaaagatagaaagcgttttctaagccgcttagtgcacactaccacctccatctttctctttcgcatccaaattcgagtcagggagagggtcgtcgacgtcgttgtcattgttagagaagttgcagtccagggtttcaatccaagtaaagttggggactctatttgggtcaaaggaggttgggagagttatgatatggatgaggtggaggaagggacaacgtggcggaggccttggtcggcgatgctagcgaggtcgagaaaagagcatcgtggagagaagagttgcaacattgctaagtag

SEQ ID NO: 22080 - DNA, 168 bp, Glycine max
  Peptide Sequence Number=SeqID_138858
atggcgttgtggcagcacttgaagaggaagaagctgcagatattgcagcacctccgtggtgttattttcattttgcactaccctttctccctcttcgtcatagtcgattgtcgtgaaggctttccagcacctctgtggttctcgcgtgtggttgactaccgtctttga

SEQ ID NO: 22081 - DNA, 360 bp, Glycine max
  Peptide Sequence Number=SeqID_138859
atgcaacaaccaattctagggtgtccttcgcaacccttgaatattcatggcataacgctgaaaggcaaacaagatgaaaattgtgagcaactgttcacccccatgatcggtcaatggaacaagcaagttgattttagggtcgacgagacattacaatacatggtgtctcctcaagggaggaatacatggacagttgatgatctcgtgccttatgtggagaaaataacgattttattgaaagagcaagaaagaatcactgagcctgtgtcacatggtccagcatcagagcatcaatttccagcacaagagtttcacattctccagtcaagtgttgaaactcaaggcataggcaggcgaagg

SEQ ID NO: 22082 - DNA, 486 bp, Glycine max
  Peptide Sequence Number=SeqID_138860
atgggaaaacagagcacacaattctctgccctcaactacatccaccttgcacttgatttggatgctattttttttatcagccataaatgcttggagagcccattgcaactctgtgtttgctgcactatgaagggcaatgaatttatccctgcaggtttccccgttggtccgtgggatgattctgcaatcatgtctgacaatatgacaggtctgaagagatttagagatgaagatgtgaaaccattttctggtttaaatgcacctgaaagtcaggtagagtaccactggaccaaggcctgtgcattctcacctctccaaattgttttctctgttgccatgggtgtcatattccttggtcacactcttcatgttggaagtggtggaggattggccgagtttgctgttgctaagaaaaacattttgatcaatgctgcattaggtggtgtaggtcactatgcactccaacgggcaaagctgggaagatga

SEQ ID NO: 22083 - DNA, 366 bp, Glycine max
  Peptide Sequence Number=SeqID_138861
atgggtgttaagtacctcgaggtggtcaagcgaaggtttcatgccaccaaacaatggtccccggatgaaattagggatcaccaagtatttgaacttgtaatggttctctcggtaaggcttcaactttcccaatctactcgaagcacaagattgtcaaagttggtggaaatgaaaggagcctttcatccacagctagtcaaggttttctacagctatgcacttgttgaccttgaaggtaacctctcttctacaataaatggagtagaaatagtcattgatgctattgtatggaaggaagtagctggtctggatatgggtggagtccacaagttctatgaaacgactgatgggtacaacaagatgtag

SEQ ID NO: 22084 - DNA, 198 bp, Glycine max
  Peptide Sequence Number=SeqID_138862
atgaaggagaggttgaaccacgtgtgtttcagccgcaagggagagtgtgcgtatgagaatggggatttggcggcagaggactgggataagttgaaggggttggaggaagcgatatcgaaattcattaagagggagtacaatgatttgcccttggcgcatgaaaggattctgagtcctgcaattgcacaagctttctga

SEQ ID NO: 22085 - DNA, 498 bp, Glycine max
  Peptide Sequence Number=SeqID_138863
atgccttgcatggtgtctcgaacgggaagagagatgcagagatacaacagtagtggtggtcgtcaagttgtggggtgcataccttacagatataaagaagatagtgatggcaatgtgagcaatgaattggaggtgcttatggttagttcacaaaagagtcaagcattaatgttcccaaagggaggatgggaactcgatgaatctgtagaagaagcagcatgcagggagtccctcgaagaagcaggagttacaggattcgttcagcatgaattgggccaatggagcttcatcagcaaaagacatggaacatactatgaagggcacatgtttcctttgcttgtcgaagaacaacttgactcgtggcctgagaaagatctacggagaagaatatggatgagtgttaatgaagcccgagaagtttgtcagcattggtggatgaaggaagcattagacatcctcgttgaacggctcactttacagcaaaataggaacatataa

SEQ ID NO: 22086 - DNA, 333 bp, Glycine max
  Peptide Sequence Number=SeqID_138864
atggagcacgcgacacgtgacacagcgcggtgcacgaggcagcagcagggtagcgcccctgcgtctggtagcgccctgccactgggcgcggctggtagtgcccaacgcgtgggcgcgactggcgtctgggtcgtgcccgcgtcaggggcactaccagtcgcgcccacgcgctgggcactaccagtcgcgcccagcggcagggcactaccagacgtgcccgcgtcagggtcgctaccctgccgctgcctcgtgcgccgcactgtgccacgtgtcgcgtgctccatggaagcgccttcctggggggcgctttgtaataaaaaaacagacccccag

SEQ ID NO: 22087 - DNA, 1497 bp, Glycine max
  Peptide Sequence Number=SeqID_138865
tgccaccttcaccctcgcgaggcgatactttgtctccaacgaggtggagaaggatcccggttggagatggaggctcgaagaagaaccctcgggtttcgttgacaaggaagaagaagaacaagaatcagcgcttcagatttcgcatccctggcccgagtggctccaactcatgaagtgcttgcacgacaaaggacacttcagtcacgaagagagaaacatcaacgctgctatgggcgccaaggattgcaatgtcgttagaaccgcatgcctcaatttcggtagagaccactttcatattttaaggaaacatgatttgcacagaagttattttgaaaatgactttgttctcagattcttgtctcgaaaagatataggagttactgtggcacttggatgtccgagcttagataggaaagtgatcaactcaggaaaacgtctgagagcatatattggtattgatgagggaaatgcacgtgaagatgaaggtggaagaacagtggacattatgcgtattgttttaacttacggacttgatccaattaatggttcagtggagaacaaaccatgtctaacaaaaagggtagaagaatctgtgagaagactgctgaaagaaatagtagagcacagtaacaaagaggaaaattctaattttccagacagcacagaggttgtcactggacatgttcatcccaatgagcaagacaagggaaaaatagatgtttcaaagatgaagcaaggcgactggctttgcccgaaatgcaacttcatgaactttgctagaaacatcaggtgcttgcgctgtgacagcttctttgaggaaagaatcaagcaattgaaggaggataataatcacatgcctttgaagaagggagactggatatgcaataaatgcaatttcctaaattttgcaaagaatacaagatgtttgcaatgcaaagagaggccttccaatcgtcaaattaatcccggggagtgggaatgtgactcgtgcaactacgtcaatttcagaagaaacatggtttgcctgaaatgtgaccatagacgccctatagtgtcaaaggcttcaagcttttcctttgaacctcaaccagaagatctagaccactataagaatagcaaattttcctttgtggcacgtcagggtgatagaatcgatgaaacaccaatggtgtttgaaagaaaaaacaggaacagagattcacctaagtggagatttgtagaggatagaaatgaaaataacaagtgcttaaataaatcaaatgattcttctgaatttatagattttcctattgttggaggtaagactcacttgactaaggtacaaaggagagaagcatacaagactgagttgccaaatcagtgcagaaggccttcatggcaaagtgaaactgaaaatgagttttgttcttcagataacctgagtactgatgatgaattttgttctgtcaataatcagagtactgatgatgaagaaatggacgaatggtttggaaaaag

SEQ ID NO: 22088 - DNA, 667 bp, Glycine max
  Peptide Sequence Number=SeqID_138866
gtcgactctagaggatcccactggcaaaggccgctttctgcaacagctagaactggcgcgccgcgagaacctgactattcgtcagttggtgcttaaattccgcgttgcgcgcggccatttgcaagccattggatcagtcaacaccgtggctgatctgatcgaagagtggtttgtcgagaaaggcgcggatggctttaatgttgtgccacctttattgccgcaaggctttgaagatttcacgcgactggtggtgcccgaactgcagcgccgcgacagcgagcacattgtgaatcgggtgttcgccgctatgttaaacaaagcgggggtgcctattaccttagaccacctgtttgagaagtttatggggtattccttagagcaatgcctagcgatgattcatcagcaatacggtattgcattgggcgctgactttgtgacggaatataaagtgcagcgtgacctagcactggctaagcatatcaaagccgtggagggtgttgagcaattaatctgtcgcttatgccgccctttttgtgtggcttcaaacagcgatgcgcaaaaagtacataccatgctcacgcttactggattgattgaccactttgccggaagatattcagtgcggccgatatggccaaaccaaagcctgcgcctgatgtgtatttga

SEQ ID NO: 22089 - DNA, 265 bp, Glycine max
  Peptide Sequence Number=SeqID_138867
atctcccacaggcaacatagtacctctagacttggagattgaagccaccttaagaaggaacagggccgagaggagaaggaagttgttgcaagataggaaaatagcttccattctagaagaagaagctcaatcttctgactctacatcatctgattcactatcatcaagggaatcagctatatacttacctgaagcttctgtcatggctgatgaacaccataaaagggttatccttgaggattactctagtagctcagtgtcgtaa

SEQ ID NO: 22090 - DNA, 195 bp, Glycine max
  Peptide Sequence Number=SeqID_138868
atggagtggctgcaccagcacaaaaaaacttctaggtcaagttgtgtgaggctgatcatcaaaggtgtcttgttcttgtgcgaggtgaaggacgatcttgtgccttctaacccaacggtgaaggtctatatggcggtgttctcccttatggctgaaatggttgcccctaaagttattgacttcattggaggataa

SEQ ID NO: 22091 - DNA, 690 bp, Glycine max
  Peptide Sequence Number=SeqID_138869
atggtcattgaccaatcccttttccataacttaacccaattgtccagtgacggtgtaccatttgaaggtacactgaatgacgattggaaatttgatttctctgcatatgatgcccgccagttggttttcaccaaccatgcggatatgattggacgccttcttgccggttcattggcttttgaaagtcatatccttcattatctcattgtgcatattttgcttccacgatcttccaaccttgcccaggtttctgaggaagatcttgttatcatgtgggcctttcatatcgggcgtcaacttgactgggcacacttagtcagatatcgcatgcataaggcattgcgattaaatgctccattgccatatccacaccttgtcactctctttcttcgccattttcaaattcctcttcattctgaaccttatgttccaatcaagagatcctttttaattggtgctgctgtgattgcctcctttggttaccacaaagagcatgatggctcttgggtcaaaaagggtgctcaacccgctgatgatgaaggcaacctaccagttgaagataattcctctcttcttcgaaggcttttggacaagttcgatggtcttcggacttttgttggtggcaagtttgatgccatggaattgcaagtcgacatgcggttcgatgccatggattcaaggataaccaag

SEQ ID NO: 22092 - DNA, 915 bp, Glycine max
  Peptide Sequence Number=SeqID_138870
caggccagtccactgcgcgagctctcggcgctgacgcgcaagcaggttctgctgacgctggcgattggcgcgattggcagcggcggcatgttctcggtattcagttacgttaaacccaccatgatggaactggcccacctgccggaaaatttggtaccggcgatactggcgctgtttggtcttggcatgattatcggcaaccttgtcgggggacgtctggccgatcgcgggctggagaaaaccatccgcattgtgctggtgtggtcgctgctggtattgagcgcgtttgtctttgccgcgcattatgcgctggcgggcgcgcttaacgtgatgctggtcggcaccatggtggcgctgggaagcgtgctacagatccggctgatggacgtggccggtgatgcacaaaccctggcggccgcacttaatcattcagcgtttaacattgccaatgcgctgggggcgtggctcggcggcatcaccatttccgccgggctgggctggcagtccaccggctgggttggggccattctgtccgtgctggggctgctgattcatgccgttgcgacatctgccgttgttactgctggtcgtcattattcccggattactgctggtgctgtttcttgctgcaggcggttggctgacgccgcagcgcctcagtgcgcaaagtctggtgcagtcgctgcagcaaaacagcggtgtgcatccgggataccggcgcaatcatgccaagggcgtgtgcgttaccgcgttttccagccgggtacggtgccggtgattggccgctttgccattgccggcggtaatccgcacgcgccggactatggcgtgccggtgcgcagcctggcgctggaatttcagctggcgcacggcgagcagtggcgtaccggcatgaacgcgctgccgtttttcccg

SEQ ID NO: 22093 - DNA, 1140 bp, Glycine max
  Peptide Sequence Number=SeqID_138871
atactatcagagttttcaacttctcatgcaactcaactcaagtccctcagaatgacattacttccgttcacccttttaggctccaaatgggaccccatcaagatccgcaagaacgccaagctttcccctcttctgttctcctcgtccttgtcgtcctcgtcgtcttcgtcctgcgtacaaggtggttcggttccgttggagtcgcacgtgtgccagttgaaccagtccccatgggatgtgatcccctttgactctgactcgatccaggttccttccctctcccaatctcttcattctattcgttatttcattattctcgttattccccgtccccgtttagatctctacgccctcacccatttagggttttccctcttccgtcttaggttcaagctcgacgacaacttcaccgcgggaaacaacaatggcagcgctgttaattccttcgccgccgtccagagcgtggcgtcgatgatggatgcaggtaacaaaactacttgccactcgacggtaatggttgacctggtggcgccgacaaatattgacgccaccgtaaacatgaccaatccttgtcagtttcacgatgacaagggttggccatgtaagaatgaagccggacaagggcagtcattctgcgagcagcatttatcttattctctgctcactcccctccaccacaccagcagcaagaaatcgcaaccatccgcgaccggaactcgccgtggcaagactcggggagcggcggggaagaaggcggcagctgtggcggcggctggggcgagttcaaacccgtatgaattctactactactccgggttcgggccctcgtggagcaaacgaagaggtgatagaaacggtggaggagaagggagcaagaataatagcgttggggttgagaattcgacaatggtggagtccgagaatgtagtgggtggtggtgctgacgatgttgtcgatgatattaatggtaatgtggcaagtgttgaggttgttccttcggtttcggagatggaacatgatgggataatcgactatgtggatgatgacgaagaagaagaagaagaagaggtacttgacgatagcgggaagaagagaatgaggaagcccgtgaaagcaaggtcgctgaaatcgttgatgtga

SEQ ID NO: 22094 - DNA, 399 bp, Glycine max
  Peptide Sequence Number=SeqID_138872
atggcacatcagcggatcatgcgcaccagcatgacccctctcacacagatatggatgacgttgctgcttagcaacatcctacccagtgaccataactcagaccttcccctgccaaagtgtcagttggtttatgccatcctgacacaggcaggcgcagggctaggcaccacagcagccagagaagggccagtagcaggcagctgcaaatgcaccgctgtcatctccagagtccacctctgctcacctactgagtttgaagccgcagtggcatggcctggagattggcccaattctcagacaggggcaaggctcgcggggacctccagagatggagacggagcagagcaagatgatggcatggccgatgtgatggactttttcttgggaggaggcggactc

SEQ ID NO: 22095 - DNA, 687 bp, Glycine max
  Peptide Sequence Number=SeqID_138873
atgaccctgctggcgttaggtataaatcacaaaaccgctccggtttctctgcgtgaaagggtgaccttctcgccagagtccatcgatgaggcgctgaccagcttgctccaacaaccgttggtgcagggcggcgtcgtgttgtccacctgcaaccgcaccgagctgtacctcagcgtagagcagcaggaacacatgcacgagcagctggtcgcctggctgtgcgcctatcacaacctgcgtccggaagaggtgaagaaaagcctgtactggcatcagggcaacgacgcggtcagccatctgatgcgggtggccagcgggttggactcattggtactgggcgaaccgcagatcctcggccaggtgaaaaaggccttcgccgagtcgcaacgcggccagtcgctctccggcgagctggagcgtctgttccagaaatccttctccgtcgccaagcgcgtgcgcaccgaaaccgacatcggcgccagcgcggtctccgtggcgttcgccgcctgtaccctggcgcgccagatcttcgaatcgctggccgatctcaacgtattgctggtgggcgccggcgaaaccatcgagctggtggcgcgccacctgcgcgagcataaagtgcggcacatgatcatcgccaaccgcacccgcgagcgcgcgcagctgctggcggacgaggtcggcgcggag

SEQ ID NO: 22096 - DNA, 333 bp, Glycine max
  Peptide Sequence Number=SeqID_138874
atgttggtggcgactccgggtgtttcccttccttggaagacacaccgtgagcctcatgtcgccctcccaccgaaggaaccaaaccacaacacaatggaggagattcatggagaagaagatgaagaacaaggaattaaagtgaattgtccgaataaaaagatagaggaagcaacaaaacatcacctagaggaaaatgctctgataccacatgatgtagctccatgtagagtttgtaggccttggatcttcttcatcaatggagtcctttgcttcttgaagataaatggcagcaaaatggagatgccacttcaaggagaagatgagaaaagataa

SEQ ID NO: 22097 - DNA, 233 bp, Glycine max
  Peptide Sequence Number=SeqID_138875
ttcggagactccgacgttggcgccctactaaacggcttgtgcgcagtgtgcctgttcgagttctccgaggaggaggaggttcggtgcctgcgcaactgcaagcacattttccaccgcacatgcgtggaccgaccccctttgtgcctgatgatatgcttgatgattataatcaacgactctgggctgcttctggggttaacgagttttacgccgattacacttcttccttctga

SEQ ID NO: 22098 - DNA, 189 bp, Glycine max
  Peptide Sequence Number=SeqID_138876
atggcgtgcataatgttcaactatggacacaaacaattggagcaagttcttgtacatgctggtcattggtcagctaggggaatgctctgtcaccgtctgattgatacctttcagtgtgcaattatcaagaaccacataaacaacacaagagaactttttttggagggtcaagataaacaagtgagctaa

SEQ ID NO: 22099 - DNA, 693 bp, Glycine max
  Peptide Sequence Number=SeqID_138877
atgacctctcttgaagatctatacctcttcgataacaaactgcaaggcaaaattccagcttccctggggaatatatgtgttagcattaacagacaactcagtgtctctacctggattccacctttccagttatttactttgggaatagcttcttgcaaactgggtcctagtttcccaagttggcttcagactcaaagttgcttaagctttctagatatttctgatgctgggattgatgactttgtaccagattggctttggaacaagtctataggtgagatgaatatgtctttcaacagtctcaaagggaggattccacagttcatgggtactcttgttaatttggaagctttggtcctacgcaacaacaatttaattggagaactaccactcacattgaagaactgcactcgtttggttatattagatgtgagtgaaaatttgctgtctggtccaattacctcatggactggagaaagtctacaacaattggaaatcttgagcttgcgagtaaatcacttctttggaagtgttcctgtacttctctgtaatttgaggcaaattcatctcttggaactttcaaggaaccacttgtcaggagaaattcggtcatgtctgagaaattttactgcaatgatggaaagcggaggagagattgcaagtgaaagaagaatgttacgaaaaagaatctga

SEQ ID NO: 22100 - DNA, 234 bp, Glycine max
  Peptide Sequence Number=SeqID_138878
atgaagcatgtgtacaagaccagtttcattgttgcattgaatgcctttccatttgcaacaatctctgttatcgtcactgtccctccacgtagacagcatgccagagtgatctatgaggcattgtttgaagttgaggagtgcttttctctcactatctatgcactattattggaaacccagtggaatccaagaatggatcctgcagcatgcaataaaagcagcacaaatgcataa

SEQ ID NO: 22101 - DNA, 1077 bp, Glycine max
  Peptide Sequence Number=SeqID_138879
atgtggtgctgggaagtaattaaaattaacgctttaaccaaggtcgacgaaaccaaggtcggagtcaaaggtttgatcgattcgggaatcagaaccatcccccctttcttcgtccatccgcccgaaaccctagcggacctcaagcggggtgccgaacccggatctgtgcaggagatccccacggtggacctcgccggcgtggaggacttccgcgccggcgtggtggagaaggtccggctggcggcgagcaccgtggggttcttccaggtggtcaaccacggcatcccggaggaactcctccggcggacactggcggcggtgaaggcattccacgagcagcccgcggaggagagggcgcgggtgtaccgtagggatatagggaagggcgtgtcgtatatttctaacgtggacctcttccaatcaaaagccgccagctggcgcgacacaatccagattaggatggggccaaccgtagtggattccagcgagattccagaagtgtgtaggaaagaggtgatggagtgggataaggaggtggtgcgtgtggcacgtgtgttgtatgctttactcagtgaggggctgggattgggtgcggagaggctcacggagatgggtctggtggaaggaagagttatggtggggcactattaccccttttgccctcagcctgatctgacggtggggcttaactcgcatgcggatccaggggctcttacggtgttgctgcaggaccatattggggggttgcaggttgagaccaaacagggttggattcatgtcaggcctcagcctaacgctttggttattaacattggagattttcttcagataatttctaatgaaacatacaagagtgctcatcatagggtgttagctaattactctaatgagccacgagtctctgttgctgttttcctcaacccaagtgatagggtgagactttttggaccattgccagagttaacatcaacagagaaaccagctctttataggaacttcactttcgatgaatttatgaaaaggttcttcacgaaagagttggacggtaaatcattgacaaatttcttcaggcagtga

SEQ ID NO: 22102 - DNA, 3408 bp, Glycine max
  Peptide Sequence Number=SeqID_138880
atgactcatcatcatatgaaggcattgattgctttgaaaaagggtgctcaacttcttaaatatggtcgtaaaggaaagcccaagttttgtccatttagactttccaatgatgaatcatccttaatctggattacaagtagtggagaaagaaatctgaagctatcttctgtctctagaattattcctggacaaagaactgctgttttccaacgttacttgcgtcctgagaaggactatttgtctttttcacttatttacagtaatggaaagcgatcacttgatttgatttgcaaagataaagctgaggctgaagtgtggattgctggcctcaaagcactgatatcttctggtcaaggtggtcgttccaaaattgatggatggagtgatgggggtctcattcttaatgatagcagagacttaacatcaaatagtccaagtgaaagttcggctagcacatcacgaggcattagttctcctgacatttcttcaactcttccaaatacttcaccaaagtcctatcgacctgacaatacaatttctgaaaggtcacatgcgtcaccagacccaacaaacatgcaagtgaaaggatctgcttcagatgtatttcgtgtcagtgtttcaagtgcccctagtacatctagtcatggatctgcacctgatgactatgatgctctgtgggatgtatacatatggggagaggttacctgtgaaaatgttaaagttggtgctgataaaaatgtaaattatttcagcccgagggcagatgtacttctccctagaccactggaatctaatgtagttttagatgtacatcatatagcatgtggtgttagacatgcttctctagtcactaggcaaggtgaagtttttacatggggtgaagaatcaggaggacgtcttggccatggtgttgggaaaaatgtggttcaacctcgtctagttgaagcactgatttctacaactattgattttgttgcctgtggggagttccattcctgtgctgttacaatggctggggagctatatacatggggtgatggtatgcataatgctgggcttcttggtcatggcagcaatgtcagtcattggataccaaagagaattgctggtccattagagggacttcaaattgcatttgttgcttgtggtccatggcacacagccttgataacttcaacagggcagctgtttacgtttggtgatggaacattcggtgtcttgggccatggagataggcaaaatgtttcatatccaagagaagtggaatccttattggggttgaggacaatagctgttgcttgtggagtgtggcatactgcagctgttgtagaggttatcgcaacacactccggtacaagcatatcatcaggtaaattgtttacttggggtgatggagacaaaaatcgccttggacatggggacaaggaggcacgtcttaaaccaacttgtgtgtctgcacttattgattacaattttcataaaattgcttgtgggcacagtttgacagtaggcctgacaacatctggacgtgttttcactatgggaagtactgtttatggtcagcttgggagttctctatccgatggaaaggttccatgcttggttggagacaagattgccggggaatctattgaagaaattgcgtgtggtgcatatcatgtagctgtattaacatccaaaaatgaagtttatacttgggggaaaggtgcaaatgggagattgggtcatggagatattgaagatcgtaaaacgccagctttggtagaagcattgaaggatagacatgtgaaatatattgcatgtggttcgaactactctgctgccatatgccttcataagtgggtatctggtgccgagcagtctcagtgctctacttgtagacaggcatttggattcactagaaagaggcacaattgttataactgcggacttgtccactgccattcgtgcagctcgaggaaagcattaagagcagcacacgcccctaatcctggcaagccgtatcgtgtgtgtgattcttgttatgcaaaattgaacaaggttgctgaagcttgcaatagtaatagaaggaatgccttgcctcgtctgtcaggtgagaacaaggataggctagacaagtctgacctaagattgtccaaggcagtaattccctctaacatggatttgataaagcagctagatagtaaggcagccaagcaaggaaagaaaggtgatacattctcactgattcgcccctcacaaccgccttctctgctacagctgaaagatgttgtcttgtccactgctcttgatctgagacgaacagttccaagaccagtggttgcaccatcaggagtaagttccagatctgtgtcccctttctctagaagatcaagccctcctcgttcagctacacctattccaacaacttcaggactttccttctcaaaaagtatttctgatagtttgaagaaaacaaatgaacttttaaatcaagaagtgcagaagttgcatgctcaggttgagagcctgagacagagatgtgaactgcaagaattagagcttcaaaggtcagcaaaaaagactcaagaagctacagcactggctgcagaggaatctggtaaaagtaaagctgcaaaagaagttattaagtcactcacagcacagaataaattaccccacatttcccttatactgctgtgttttcacacttacacttattgctcattaacattttctcagctcaaagatctggctgagaagcttcctcctggagtttatgatgctgagaacattagaccagcttacctaccaaatggtcttgagccaaatgggatccacaatccagattcaaatggggagcagcactccagagcagagtcaatcattggctctagtttggattccatgggacttgaatccgctctattgaataaaactgcagggaactcgccaggaacatatggaactaatcttcaccagaaaattcggagccccgtgtcctctaatgggaccaataattatccaggtgttaaattgccaaatggtggtggtgtaattcaggcaagcagcggtactgtgtcagatactgctgatggtagggattctgggaatttccacgatgacgagagtggtttgaaatcgaggaatgctgctccgactgctgatggtaatcaagttgaggcagaatggattgaacagtatgaacctggtgtctacataacacttgtggcactgcatgatggaacaagagatctgaagcgagtgcgcttcagccgaaggagattcggagagcaccaagcagaaacctggtggtccgagaaccgtgacagggtatatgaaagatacaacgttcgcagcacggacaagtctgccaaccaagcagcacgtagttccaaaggtgctggttcacctgtttcccaaacttag

SEQ ID NO: 22103 - DNA, 424 bp, Glycine max
  Peptide Sequence Number=SeqID_138881
attgcttaatcctgaattattttggcacaatcctggaacacttgtacgttatggaatagtagatccaggaaagaacaaacaccaaatcgatgctcgaacaaaatttgaagacacaaccacttatcttcaacaacgtagtggcttcattgacaaaggtggggttgctagccttgtcgaacaaagagttaggtgtaggaaaggagttgcgaatgggtgctataatggaagaagtgggacgatgcaagggaaacacaaaacgacagggagttggaaggacaaaggaggaagcaataaccttaacatgtccttgaagagtccaaaaaacaatattacaaaaaccattgggctttgctttgctactgggctgaaacagggtcttttcaatcgaaacactaataatgaggcactcagaaaggacaagtag

SEQ ID NO: 22104 - DNA, 739 bp, Glycine max
  Peptide Sequence Number=SeqID_138882
atgacggacggctactggaaccgacaacagacgcttctgtctcaatccggcatgctcaaacgaccgcattccgactacgtgagaatcttagttgcacggaggccaaaactcaattacatgggtatcccaatgatatgcctgcttccggtctgtctttcaggtaatgagatgcataataattttgctcgtgatgatgaccgtaccggtcaccgaatgctaaaggacacaaaaacaattggatctgcttatgaccgctaccttcagagtgggcaactttcttcatttacttctggggaagccagtacagttgggggtcttgggttggctaggggtggtggtggattatcagaccattcactagctgatccttctgtcatggggcgtcatgggggtggtggtccagatctagcaccaaatggacggggtgttaactatggtggtcagctacctgtagatgcagtttccagacctggacctgagacagtacctctacctccagatgcttcaagtactctatatgttgaaggtctcccttctgatagcaccagaagggaagtagctcttattcatatcatattcattaacatcaccttagatatttttcgcccttttgttgggtatagagaagttagacttgtgagcaaagaatccaaacatcgtggtggagatcctcattacctttgttttgtggactttgcaaatccagcttgtgcagcaactgctatgagtgccttgcaag

SEQ ID NO: 22105 - DNA, 1272 bp, Glycine max
  Peptide Sequence Number=SeqID_138883
atggcaaaggtaagggatcagaagctatacgtgaccgttccgagtctctttcggtgtccaatctccatggacgtcatgcgctctcccgtaagcctctgcaccggcgtcacatacgatcgcgccagcattcagcgctggctcgactcaggccacgacacgtgtcccgccaccttgcaggttcttccctccaaagacttcatccccaatctcacgctccaccgcctcatccgcctctggctcctctcctcctccgccgccgaacccttctccccctcctccgccgaccatctccgtcctctcctccgcaaaatccatacctccgacgacgacctcgccggaaccctctccataatcgccgaattctccctaaaatccggtgagaaacgccggtctctcgccaccttccccggcttcgactctgccctggtccgcgcgctcgccggaagcaattcactgattgacgctgcggaaaactcgatctatcttctcgattcggttttccgagaaaacggagagaaaatccggaagctgattctcgacgctcgcgaagaatgctttagttcgatggtgtttgttctgagaaacggatctatgaaatcgaagattgaaacagttaggattttggagtttctctcgtgcgattttcagtcttcgaaattggtcgcggagacgcgaggattgttgccgttggtggcgagttttttgaaagacggtgtagaggagctaaacgatgccgttttgtctctgctcggcgtcgtttcggtgactcactccgcgaagatggaactcgttagttccggaatcgttgaagtggttacgaaattgctgcgagcgtgttcggcggcgacggcggagaggtgtctgaggatgctggctattctggccacgtgcgcggaagggcgggcggcgatggcggtggagccatcgcttgctgcggcggtggtggagagaataacgaaggcgcccaaggctgcggcggcggacgcggtggcggtgctgtggagcttgtgctgtttgtgcgggaacgtgaaggtgcgagatgacgtggcaaagcgcaacggcgtcgtagtggttttgttggtcatgcagagggggtgggaggagcacgtgaggagcatgtgcgtggatttgattaaggttttgaagggtcctgcgtgtaagaacggtaaaggggaaataatggggaaagtgagaggaagaaaagttgaaaatgggggtaaggaaggtggcactatagatgaaaaggggagggagggtggttctattgtttaa

SEQ ID NO: 22106 - DNA, 261 bp, Glycine max
  Peptide Sequence Number=SeqID_138884
gtgccggagggtgctggtgcgggagtgggagctggtggtgctagtggagctgaagtaggaggagcggaagaagaaggggctgaagtgtctgatggttctcgagccctagctttacgggtccacggaaatgtgatcgtgggatcatctgggttccaacagttcttcctaatgtatgccaaattaatggcagggcttagggactcaaagtctcgaaggtcaaagaatctggaacaactccccgggcgatgcataaggcagtga

SEQ ID NO: 22107 - DNA, 507 bp, Glycine max
  Peptide Sequence Number=SeqID_138885
atggtgaggctcatgaaacaagccaatgtattcccattaaagaaaacaatcaagaagttcactatatgggaaatcaacagagacaaggatatactcaaggaggattctcaggcttccagcaaggtccttataaccaacaaggacagtggagatcacaccctgacaatcaaattcaataaggaccagggtggaccttctaacaggccaatcccacaagggcctaacatctttcagaggatgactaagctggaggagactttgactcagtttatgcagatagctgacaagtcatctaacagttttagggcgaatacagaaaagaatcccaaggaggaatgcaaagctgtgatgacaaggagtaagtggtttgtggaggcggaggatgaggatagtgttgtgtccaagaagaaagctgttgaaaagaaaggtaatgatgaaaagaaagatgatgtgagaggtgaaagcaatcaggaaaaagaaaaacaaataatggtcaagaaaaaataa

SEQ ID NO: 22108 - DNA, 1354 bp, Glycine max
  Peptide Sequence Number=SeqID_138886
atggttcggtgcggtgcccgcagcggcgattggcggtgtcggcactctggtggtcgtggcgctgtggatggcgctgttccctcatctgcgcaaacggcagaaactggaaaacgacagtctcgcctgacgttcgcggctgcctggcacggtggccgtggccgggcacgcacgcagcgacgcaacaacaataatcatggccgcctcattaacggtgcgtgtgaagcccggcacgcaccacgaccctacgttatcaatgaggcgaacatgaaacagttctctgcagaagggatggtgattattgtcgggattgtcattgcctacatcctgttcactacctggctgacctggcggttgcgcagtaaaaacagcggcgactttatggcgggttcaaacgtgatgccagcgtttgtggtcggcgtaatgctgatgtctgaatacattggcgccaagtcaaccatcggtacggcgcaggcggcttttgaggatggctttgccgcgtcctggtcggtgatcggtgccgccatcggctttccgctgtttggtattctgctggtcaaacgcatctacaacaccggcaaaattaccatttccggcgcgattgccgagcgctatggcaactccaccaaaaatattatttctatcatcatgatctacgcgctgctgctggtgaacgtcggtaactatgtcagcggtgcggcggcgatctctacggtactgaaccttgatctcaccacggcggcggtgatcaccgcgctggtcagcaccttctattttatgttcggcggcatgaaaggcatcgcctgggtgacgctgctgcacagcggcctgaaatatatcggtattctggtcattctcggcgtggcgctgcacatgaccggcggcgtcagcccgatgatcaaagagatgccgcacttttactggacctgggacggtaacgtgggcgccagcaccatttttgcctggatgattggcaccatcgggtcgatcttctgcacccagtttgtgattcaggctatcgcctcgaccaaaagtgcggcgtctgcgaagcgcgccacctgggtcgccttcttcttctgtatgccgattgccatcgccattgcgctgattggcgtggcggcaaagtatctgcatccggagattaacagcctgtacgcgctgccggtgttcctgcaggacatgagcccgtggctggcagggattgtcaccacctcgctggtggcatcgatttttgtcagcgtcagcaccgtggcgctggccatcgcttcgctggtggtaaaggacttttatgtgccgtaccgtaatccgacgccggaacgcgaatttcgcatgacgcgctggctgtcactgctgatcg

SEQ ID NO: 22109 - DNA, 951 bp, Glycine max
  Peptide Sequence Number=SeqID_138887
atgcacctgattcatcaatgcaaaacagtggagcctgacatgaccgactcaaccattaccgtcgaacgtaacggtaagcttcatccgcacgcgcaggacgcgcagcagctcacggcgatgctgccttcggtctgtccgcagaaccacgccgctaacctgctgccgttaccaaacggcgacctgctgtgcgtgtggtttggcggcacgcaggaaggcatcgcggatatttcggtgtggtgctcgcggctggcgcagggcagcgcacagtggagcgatccccggcagttatccgacgatccagcgcgatcggaacagaatccggtactgttcctcgatcccgagggcgtgctgtggctgctgtggaccgcgcagaagtccggtaatcaggacacggcgattgtgcgctatcgccagtcacacgatttgggtcacagctggagtgccatcgatacgctgctcgatcagccgggcacgtttatccgccagccgctggtgatactgccgaacggcaactggctgctgccggtgttctattgtcgcacccagccgggagtgaaatgggtgggcaacgatgacatcagtgcggtaaaaatctccagtgacaaaggccagagctggcgcgatgtggtggtgccggacagcctcggctgcgtgcacatgaacattacgctgctgcaggatggcagcctgctggcgctgtatcgcagccgctgggctgattatatctaccagagtcgttcggacgacggcggtgaaagctggagcgcgccgcaggcaaccgatctgccaaataataactcatcgattcaggtgaccacgctgcacaacggccatctggcgctggtgtttaacgccatgagcgcgcgcgatgccagcgagcgtcgcctgtcactgtacgacgaaatcgaagacgaagatgacgctgcggtggacgtggcggcgcagccggtg

SEQ ID NO: 22110 - DNA, 465 bp, Glycine max
  Peptide Sequence Number=SeqID_138888
atgggtgattacccggtggccggtgtacaaagtacagagcgccagcgcggtaatcagataagagacggtaccggcggaatcggtcagcaatctgatgcggagccaccagataactggaaaaatagaatattttgcgcggtaaggcttcaaccaccagtgacgacgccagcgcgatactcagcagcacaaaacagagctggcgccacagcatggcctgccaccatcttttttgacgaaaaagcgacttatacattctttttgcctgctgcgcattggctggctggtcaaacgccatggtggacagcggtgaatcctgataaatatcgcgataatggtgaaccacaaactgttgattccatacctgccagggcttatccgcaccggcataatgaatcaggcaggtttccgccggcacgtcgagcgtataaccatgatcgtcatgggccagcatggtcagggtattga

SEQ ID NO: 22111 - DNA, 206 bp, Glycine max
  Peptide Sequence Number=SeqID_138889
atgacttcatcattacgccctcgcgccaccgcgctggctctggcgctgctggcagccatgagcctgagcgcctgtcaggcgccggctaaaaaatcagtagcgcctgccgccgcggctaagccagcggcagcggagaaggtacagcagcgtgaactgggcgacggcctgtatgaaatggcctatgtgccgggcgatccggctgcgct

SEQ ID NO: 22112 - DNA, 978 bp, Glycine max
  Peptide Sequence Number=SeqID_138890
atgatggttcctgactatttaatcagtgtgttgctaacggcccataacagtgaaaaatttttgcctgacacgctggcgagtttagaaaaggcctgtcatggtgttgagcagtatattgaatttattcttattaatgacgcatccgtcgacaacactgcagcgttactcgatgatttttcccggcggcatccgcaggcgaaagtatttaatattgattaccgcaacattggccgggtgcgtaattttggcgttcagcagtgcagcggtgaatatattacgatgctggatggcgacgatcagttgctggccgacgccctcgccgatattgtccgctacctgaaaagccatcgtccggacgcactgttcacggcgcttaatgaggtatatgaatcccggcctcagcacatcacatggcagggcctgcaggcggaaacactgtcacggcatcaggccattgaaaaattcctgatccatcgtgatttgcaggcgcactttatcggtcagtttattaagcgcaccatgctgctggcacatcccttcccggattatacctgctacgaggacgcctggcttttcccggaaatcctggtcagcagtgatgcaatcgcttatagccgccagagcccttatctctattttaaacgcggcaacagcttatccagccagctggataaacacaaaatttcactcttagtgagcgcaacgcagcatatggatgaggtgttgcaggcgcgctatcgcaatctgctatcctgccactggattaatattgcacataaacaccggcaagccctggataatcctgacgacagaaagcagggaaagtgcgccagcgatcccctgcagcgaaagcgtttcaaggagatcatcgtgcaggtgatacatgacgtttttatacgcttcgggattgtggcgctcatgctgcgtgatgtattcccgtgcttttgccgtgcgctgatccggactttgccccagtag

SEQ ID NO: 22113 - DNA, 276 bp, Glycine max
  Peptide Sequence Number=SeqID_138891
atggaggagaaagtaaagctgaaaattagtggaggtttaaggagcacctacttgaagctcttgtgctctgataccacttgttggaagcttgcttatgaagcttctatggaggctagatctttgagcttcaataagatccttcaatggagaagcttcaccaccaagagagtgacttggataagaagcttaaagaggaagcttcaatggaggaagagaataccagagagagagggggaggaggggggggggcgaggtgtgggaattgaaggagattag

SEQ ID NO: 22114 - DNA, 219 bp, Glycine max
  Peptide Sequence Number=SeqID_138892
atgcccagctctgtatcggctgcgcgccggcctgggcgttgcgcatgtagtcgtagcggtcgcgggtcaggcgctggccggcggcggggtcacgcaccacgtgcgggcgcaggaacaccatcaggttggtcttggagcgcttgcgcgtatcactgcggaacagcgcccccagcaccgggatcttacccaggcccggcaccgcatcacggccatggctga

SEQ ID NO: 22115 - DNA, 270 bp, Glycine max
  Peptide Sequence Number=SeqID_138893
atggacatcctcaccccgggtcaaggtcatgcggacgagggcgcacactacctacttacgcctaaccacaaggtaaacgaaaaacgcacgaaatggtgtggtgacctcggtcacgtggctccttttcctcccaagaaaccgagcaagttcgtcatctcctcatctctacgggcctcctctgcatcgccgggagatcctgcaggcgcctcccctgtctgggcctcgggccaatcttcgggccagacgacctcagccctaaactgctctggg

SEQ ID NO: 22116 - DNA, 249 bp, Glycine max
  Peptide Sequence Number=SeqID_138894
atggtggcacctccagactctattccttcagtagagcagtttaatgagtgggtagcctggcccggaactcaatcttctcttcacagggaagatgaagagcccttggtcagaaggaagaaagcagatcaaacacaagaagctgcagcaacttctgagaaatctcttgaggccacttttgagccttcagaaccagtggcagatatagcttcacttcagcaggcagcagacccttccactcctgaggattag

SEQ ID NO: 22117 - DNA, 888 bp, Glycine max
  Peptide Sequence Number=SeqID_138895
atgacacggcggttatttgctgaccgttacgcgacctgtcgcggcggtggcaatcgtatcaatcgcggcatgatcgatcttgcctttttgcaggcagtggaaataagacagccggacgacggggctgcacgccagacccgctggatcgatgaccttagtgccaatcctggctggctcgtcttttatacgcatgatatcagcgatacgccgactgaattcgggtgcaggcctgagaccttcgagcgcctcgtatcccatgcggtgaaaagcggggcgaccattctttctgtccgcgaggcggtggcgcgccttgaagcgcatcccgaaagacgtgaaacgatcggctggcaagccgcaccgtttgccatgcagcatccggataattttccctccgactggtcctcctattttgtttccgaaatcgagtatggccgggaaagcagcccgttcaccaaagtcgtgcaggcgggcaagatcatctattcatgggaggcgcgggaccggatcaaggcattgatcgagcactttcgccccaacgtcgcgcatgcgcataatatctatcatcatctatcgccgtcgatttttccggttctgaaagacgcgggaattccgacggtcatgacggcgcacgaccttaaacttgcctgtccggcctataagatgctgtcccacaaccagatctgcgagcgctgcaagggcggacgcatctataatgtggcgctccacaaatgcatcaaggattccacggcgctgagcggactggttttcgtcgagacagcgatccatcgcatgcttggcctttatcgcaatacgcttgaccgtatcgttgtgccgagccgtttctatattgcaaagctcgccgaatggggatggccggaggaaaagctg

SEQ ID NO: 22118 - DNA, 384 bp, Glycine max
  Peptide Sequence Number=SeqID_138896
atggaagtaaccagcttgcaaaagttggggcagaagatggatcaaatgcactttgactctgacaagatgaaagaacgcgttttacggtgcccttaccgaacgtgtgccaaagctaaagtgatgagtgaaatagaggagctacaagagtggatgaaggccgacatggaggccatgaaagagcaaatgatcacaatgatggaagccatgatgagtatgagaaaattggtggaggccaacatggctacagtcgttgtcacaagtactgccactgaggtggacccgactcacccatctggcctcaagcaagtaaatcgtctagcctcggatatggttggtcagggaggcgaagcattgggaagtgcgggcgacccccattttgtgtag

SEQ ID NO: 22119 - DNA, 375 bp, Glycine max
  Peptide Sequence Number=SeqID_138897
atgggaagactgcctcctgctatggtggaaagggagaaatttgatcatatagaggaaaggttgagggctattgaaggaggcgaagattatgtttttgctgacatggcagagttgtgcctagtgcccaatgtggtcattcctttgaagttcaaggtgccagatttcgatatgtataaggggactacttgccccaagaatcacctgaggatgtactacaggaaaatgggggcatactcgaaagatgaaaaattgttgatgtatttcttccaagaaactcttactggggcagccatcacctactcaagtagtgcccccattgatggaaagggagatgataacaatgatagtggacacgctactggtgttctactatga

SEQ ID NO: 22120 - DNA, 477 bp, Glycine max
  Peptide Sequence Number=SeqID_138898
atgggaaagttgaaccatctagaggaaaggctcagggccattgaaggaggtgaagattatgcctttgctaacctagaagagttgtcccttgaacccaatatcatcacccctcccaagctcaaggagctggactttgacaagtacaaggggactacttgccccaagaaccatctaaagatgtattatcggaagatggaggcatgcgcaaaagatgaggaactgctgatacattccttccaagaaaatcttactagggtagctgttacctggtacactaacctggaaccttctcgagtccactcttggaaggacataatgattgccttcattaggcagtatcagtacagttttgatatggtttcggataggatgcaactacagaacatgtgcaaaaagaaggcacagatctttcaaaggatacgcccaaaggtggagaaacctggcagctcaagtgggacctcaatgaagaaaaaatga

SEQ ID NO: 22121 - DNA, 336 bp, Glycine max
  Peptide Sequence Number=SeqID_138899
atgtctaacctatcttcttccctaaacaccaacaaccaccctaaccccttatacccactgtggacggcgcgccgagccctaggttccttctttgccatctcctcaagcgtggtgacaatattaaagttagagttgttgtcgttgtcaatgagaatgattggtagacagggggctgctgtggtgattttgggtagtaaaggaggtattataaaggaatcgatctacttgacgattttgcgagtggtcttgagggtgaaggttgcggtggtgtgcaccgtcaacgatgggtacaacggttacagtggctcttggtgtttgggaagggagaacgattag

SEQ ID NO: 22122 - DNA, 207 bp, Glycine max
  Peptide Sequence Number=SeqID_138900
atgattggtgagtctgaaccccttccttcagccctctcatgcctatttataggaaaggaggggacttggttgatcaacagctcacccaggcgagctggttacttcactcctaagttttgtgggcgagctaggggtcagaaaaggcttccaaatgaccctttcaccctcccttttgggtattttccacattctcttctgaaacgttga

SEQ ID NO: 22123 - DNA, 912 bp, Glycine max
  Peptide Sequence Number=SeqID_138901
atggccctaaattccttcaaacattatcctctcttcacgtttcttatgtttactctcactgaagcatcatcagatgttcctattttccttcgcgaaaactgcacaaccatcgaaaccttcatctccaacaccactttccagttcaacctcataaccctcttgtcttctctatcttccaacgccaccggaaacacccaattctacaacaccaccttatccggcaaaagctcctccgacaccgtctacggcctcttcctctgccgtggtgacgtgccccctcaactttgccaacagtgcgtgttgaacgcaatccaaagactaagcaatcaaagctcagatacatgcaagtttgccaaaagtgctataatttggtatgacgagtgtttggttcgctattccaacaggtatttcttctccacggtggacacaaggcctagaatgcgtttgcgaaacactgccaacgtttccgacacaaaaagcttcttgcgtttgttgtacaccactttgaatgaaactgcagatgaggcagcgaattcttcgaacggtgctaagttatacgccacaaagcaagctaagatctctgggtttcagaccctctattgtatgactcagtgtacaccggatttgtcaccccaagattgcagaaggtgtctcagtggtgtgataggggatctttcttggtgttgtcctggaagccaaggaggaagagttttgtatccaagttgtaactttaggtatgagttgtaccctttctatagaatggattccccggcacctgaaggaattattagtccaacacattctacaatggataaaggtgaagcaggaaagaaaggaatctcatcagagatagcaactgcaacctttgtttcgattactgtcgcagggctgtcttgggtatttggttcttaa

SEQ ID NO: 22124 - DNA, 1872 bp, Glycine max
  Peptide Sequence Number=SeqID_138902
atgggttcttttcatttgttccttctgctcccaactttcttttccctctttcttcacacctctccctcccctatcatccaagcagctatcgatcaaggtaccaaagcctactataactgcacaagaaacagcacttttgcttcctatagcgcttatcgttctaatgtcaaaatactcctagattttctctcctccaatggcaccaacaatgccaaattctacaacactacagtttatagtgaagacactgcagaccctgttcatggtagcttcctttgtacaagagacaccattccaaaacagtgtcaagaatgtgtgacacaagctgccaaactcatatcatcgctttgcaacaatgctacagaagctatagtatggtaccaagtatgctatgtgcgctactccgatcgtcgtttcttctccacggtggaggagagtcctaaactctcctttatgaatgatcaggattatgtgggtaacgttgggcgcttcaacaacattgtgtgggatatgatgaatgatttgagaagtgaggcagcaagtgcttctaacaaatcggctgataagtccgtgaacatcacagataatcaaaaggcatatggctacgtttggtgcctcccatacctgtccggtgagaactgtagctggtgtcttagtgatgccatagcagaaattccaacaggttgctgcagaggaaaatctgggggaacaataatatatcccagttgtggtgttagatacgaattatatcaattccataaggcacatatcaggggtggttcggtgtcgccgccgccacttcccaatagttcttcttccccattttcttcatcagttgggaatgacagtaccactctggaaactttgcgatttgaattagccaaaattgaagctgcaacaaatagatttgctaaagaaaacatgataggcaaaggtggatttggcgaggtttataggggtattctttcagatggaaaagaaatagcagtgaagaggctcactggaagctccaggcaaggagcagtggagtttagaaatgaggttcaggttatagcaaaacttcaacacagaaatttagtgagattacaaggattttgcttagaagatgacgaaaagatacttatttatgagtatgtgccaaacaagagccttgattattttttattggataccaagaagcgaagactactatcttggtctgatcgtcaaaagatcattataggaattgctcggggaattctatatctacatgaggattcttgtctcaaaataatacatcgtgatttaaaacctagtaatgttttactagatagtaatatgaatccaaaaatctcagattttggcatggcgagaattgttgttgcagatcaaattgaagaaagtacaggcagaattgtagggacatatggttatatgtctccggaatatgcaatgcatggacaattttctgtgaaatctgatgtgtttagttttggagtcatggttctagagattattaatggaaaaaggaaaggttgttcttctgtatcggatggtattgatgacatccggagacatgcttggacgaaatggacagagcaaacgccattggaactattggattctaacataggaggaccttattccccagaagaagtcatcaaatgcacacacattggtttgttatgcgttcaagaagatccaaatgataggcctacaatggcaacagttgtgttttacctcaacagcccttcaatcaacttgccccctcctcatgaaccaggatattttaagcgtgatagaatagaaggcaacaagacaaccaacaaagaattggataatatcagtgattccatcaacggaattactctaactaatttgtttcctcgttaa

SEQ ID NO: 22125 - DNA, 1983 bp, Glycine max
  Peptide Sequence Number=SeqID_138903
atgattatcaggtccaaacttagtctaacactgttcctactttgcaccctttcactcaccgttacagaaacctctgcatcagtgttcaacaacgttagctgctcgagcaacaagactttcactccgaacagcaccttcaacaccaacctcaacaccctcctctcttacctttcctccaacgtaaccaacaacgttagattcttcaacgccaccgcaggtaaagattcgaacgccgtctatggcctctacatgtgccgtggagacgtgccgtttgctctatgcagagagtgtgtgggttttgcaacactaaccatagcctcctcatgtcccacatcgaaagaggctgtgatttggtacaacgagtgtttattgcgctactcttataggctcatcttctctaaaatggaagagaggccaaggcacaagatcaatattccattgggggaccctctggttttgcatagtaatggattctacactgcgttaggatccattttcgatgaactaccacataaagcagcactggctcttgccgagtctaataatggatatgcggttaagcaagaaaatacttctgcgagtgtgacactgtatggcctcgcgcagtgcacgccggacttggctgccggagactgcatacggtgtgtcaccgatgcggcggcggagtttgtcaagtcttgctgcggagggagcataggagcgagtgttctgtttccgagttgcattgtaaggtatgagacgtatccgttttatcagcattcgggaacctccgcgccaacaatgattaagcgtggaggaaatattggaactgaagtgattgtgatcgttgttgtcttggttgtcgttttggtgatgctttttggctttggctattgtttcatccggataaaagcgagaaagaaacggaaggccggtgacagagaaaaatttgggccagaacacactgtcttggagtctttggaatttgatttggttacaattgaagcagccacaaacaatttttctgaagaccgcaggattggcaaagggggttacggagaagtgtacaagggaatccttcctaaccgagaggaagtagctgtaaagagattatcaacaaattctaagcaaggagcggaggaattcaaaaatgaagtgttgttaatagcaaaacttcaacacaaaaatttggtgagattagtaggattttgccaagaagacagagaaaaaatacttatttacgaatatgtgcctaacaagagccttgaccacttcttatttgattcccaaaagcacagacaattaacttggtcggagcggtttaaaatcataaaaggaattgcaagaggtattcttcatcttcatgaagattctcgtcttaagattatacaccgtgatatcaaaccaagcaatgttctattggacaatggcatcaatccaaaaatctctgattttggaatggcaaggatggtagctacagaccaaattcaaggatgtacgaatagagttgtgggcacatatggttatatgtctcctgaatatgcaatgcatggacaattttctgagaagtctgatgtattcagttttggagttatggttcttgagattattagtgggaagaagaactcttgttattttgaatcatgccgtgttgatgacctcttgagttatgcatggaataactggagggatgaatcatcatttcaattactggatccaactctgctagagtcttatgttccaaacgaagttgaaaagtgtatgcagattggtttattgtgtgtacaagaaaatccagatgataggcctacaatgggaaccattgtttcatatcttagcaacccatcgcttgaaatgccattccctctagaaccagcatttttcatgcatggcagaatgagaagacattcagctgaacatgaatcatcttcaggttactccaccaatcgttcttccttgtcctctgtgaataagatgtctacgactgctttcttccctcgatag

SEQ ID NO: 22126 - DNA, 432 bp, Glycine max
  Peptide Sequence Number=SeqID_138904
atggggtctgtttttggagggaactcgccaatggagttggcgagttggacacatggcagtagcaggtggggaacaagaagcactggttgtgactgggggagtggctttgagggaagggggggggggaggggattgcgaggccgtgtttttaaggcagctagacgcgctagttgggacccaacgcgacccgtcgcgcttgcgacaacagcgctaacgaacgcgcctgcacgcggagcgcgtcctaaggcgcctccacgcagagcgccaaccgaagctccagcactgccgacgcatccaattctgaagcgctctcgtcagcagtgcgtccagacctgtcccaccgctagtcacgtcatgccacatgtcactattacggggaacgcgctcatcgaagaagcgctttgtagtaaaaaaaatagacccgtgaaataa

SEQ ID NO: 22127 - DNA, 589 bp, Glycine max
  Peptide Sequence Number=SeqID_138905
acggagagggaaggcgggaaacggtggaaacgttgtaaaatggaaacaattcatatctgacactacagcccggaagcaggacccgtgcacctcgtttgccgtcacagcaattcggaaaggcaccgatggagcttgcgaagcacgtgttgcactcagaagtggacaaatcgggcgtgcactgcgccagtgtgtagagcttcatggagctcgtgaaattcgcttcttttgtagcaaacttcttactcgaattcacggcttcccgtgccgcatcgttcaacgtgggcgcaagaacatcgttgaaccgtgtgtggtccgagtcagggacgctcggttcgttaccgaggccaaaacttggaactatgttgttgagaatggagctgttggagtaacgcagcatacagtggtcgtaccagattatggactctgtttggttggtgcagaggtctgtgatatttttggccgcggcggtgacgcagtcgtgacaggcggagggggtggcgtcgccgcggcagaggaagagtcccttgacatcgtcgatggtggtgcggtggaatccgtcgtggagggtggcgctggagacgagggatga

SEQ ID NO: 22128 - DNA, 1202 bp, Glycine max
  Peptide Sequence Number=SeqID_138906
ttgcagatgatcttacagatgtcggtgatgtggagtccttgcaattcgacttgcctacagttgaagctgccacaaacagattctcggaagagaacaagattggccaaggtggatttggggtggtttataagggtgtcctccctagcggacaggagatagctgtgaagaggttgtcagtaacctccttgcagggtgctgtagagttcaggaatgaagctgctcttgtggccaagcttcaacatagaaatttagtgagactattgggattttgcttggagggacaagagaagatccttatctatgaatacataccaaacaaaagtcttgattactttttatttgaccctgcaaagcaaaaagagttagattggtcaagacgctacaaaattatagttggtattgctcgaggaattcagtatttacatgaagattcccaacttagaattatacaccgggatgtcaaagctagtaatgttctattagatgaaaatatgaacccaaagatttcagattttggtatggcaaaaattttccaggcagatcagactcaagtaaatacaggaaggatagttgggacttatggttacatgtctccagaatatgcaatgcgtggacagttctctgtgaaatcagatgtgttcagctttggtgtcttagttttggagattgtgagtggcaagaagaacactgacttttatcaatcgaatcatgctgatgaccttttaagccatgtgagtataaacaagagtaatttcctttctttactgataccaagcttagccacaatgcctagctacatttcagtgggtgaggaaagagatattcccggtttaaatgctaatattatacaacttcaggcgtggaagaattggacactgcagacacctctggagttgctggatccaacactgagaggttcttattcaagaaatgaagtcaacagatgcatccatattggtttattgtgtgttcaagaaaatccatctgataggccttcgatggccactattgcacttatgctgaacagttattcagttaccatgtcaatgccacaacaaccagcatcttttctgcgtggaagaggtcctaacaggttaaaccaagggatggactctgatcagtctaccaccgatcagtctacgacttgttcaattccatggtctgtgaatgaagtatccattactgatgtataccctcgctaa

SEQ ID NO: 22129 - DNA, 1938 bp, Glycine max
  Peptide Sequence Number=SeqID_138907
atggggatggcaccttcaagactgatttcccttctctttctccttcttacactcatatcttataccaccgctcagccaagcttcctgtaccatttctgcacgaatgataaaggcaactacactgcaaacagttcctaccagaccaacctcaatacccttttgtccactttgtcttcttccaacacacaaattgattctggcttctacaatttctccgagggccaaaactctgacaaagttaacgcaattgggatgtgtagaggtgatgttaagccagatgcatgtcgtagttgcttaaatgactcaagagtccttctcacacaacgttgtccaaaccagaaagaggccattgggtggtatgacgattgcatgctacgctactcgaatcgctcaatatttgagacaatggaacctaaccctacttactttctgtggacacaaagcaatgcaactgatatggatcagttcaatgaggctcttaggggcttagtggatggtctcagaagcaaagctgcatctggtgattcacttaagaagtatgctgcaggaagtgcagctggtccaagctttcaaactatatttgcacttctacaatgcacacctgatttatcagaacaacagtgcaataattgcttggttagagctataacagatatctcaagttgttgtgctggcaggacaagtggcagaattggaaaaccaagctgcaatcttaggtttgatacatcccctttctatgactctgcagctgatgcctctcctccgtggtcgccaccacaagcgccttctcctcctcctccttcagataccaatactgctccctctgaaggaaagagcaacacaacacaaattgttgttgcggtagttgtgccaactgttgtcatccttgtgctggtcatctccgtttgcattttcctaagagcaaggaagcaaaggaaaaatgttgacaatgacaatgaaattgacgatgaaattgaacctactgagacactgcaattcaactttgacatcataagaatggctacaaataacttttctgagacaaatatgctaggaagaggaggattcggacctgtttacaagggtaagctttccaggggacaagaagttgctgtcaaaagattgtctatgaattcaggacaaggagatgtagaatttaaaaatgaagtgcagttagtggccaagcttcaacaccgaaatttagtcagactacttggttttagtttggaaagaaaagaaaggttactggtctacgagtttgttcccaataaaagccttgattacttcatatttgatccaattaagcgtgcacatttagactgggaaaggcggtataaaatcataggcggcattgccaaaggccttctttatcttcatgaggattcgagactgaggattattcatcgtgatcttaaagcaagcaacattctcttggatgctgaaatgaatcctaagatatcggattttggtatggcaagattgtttcttgtggatcaaactcaaggaaacacaagtaaaattgttggaacttatggatatatggcacccgaatatataagtcaaggacaattctctgtgaagtcagacgttttcagttttggtgtactggttttagagatagcctggaaaaactggagggagggaacagcatcaaatctcatagacccgacattgaatacaggttcaagaaacgaaatgatgagatgcatccacattggtttactgtgtgttcagggaaatttagctgacagaccaaccatggcttctgttgcactcatgcttaatagctactctcacacaatgcctgtgccttcagagcctgcgttttttatgcacagcagaggcttgtcagatattcagtcgagggagtataattcaggggcaacagaatcaaaaagcaaatctgtcaaagcatactcaagtgaggaatcaacatga

SEQ ID NO: 22130 - DNA, 339 bp, Glycine max
  Peptide Sequence Number=SeqID_138908
atggccatggagatcgatgttaagccagatgaatgcagcaaatgtttgaatgattccaaagtccttctcacgcaccggtgtccaagccagaaggaggcaatcgtggggtatgacgattgcatgttacgctactccaacggatcaatattcaacactaaggaaactgttcctgaataccctctgagtaactttaataatgcaacagatgttgaagagttcaatcgagtgcttaggaacttgctagatagccttataggccaaatgattcagtaccaggctgacttgtcagaacaagattgcagtgcatgcttggttgatgctataaaaggaattccttaa

SEQ ID NO: 22131 - DNA, 150 bp, Glycine max
  Peptide Sequence Number=SeqID_138909
atgtacacaaaaatacgaaaaataaggttgcatttagcaaaagtggcacagaaaggaggaaaaaaagaagaaattctgaagcaggcccaatccaataggggcgctcagcgcgcattaggcgctaagcgagcaactaactggaggcgctga

SEQ ID NO: 22132 - DNA, 686 bp, Glycine max
  Peptide Sequence Number=SeqID_138910
atggtcactcaaagagcatcattttacctttgtctccttgttattctgataactcaagctactgcggagccagacgaccaatacccagtctgcctcagtcgtggaggagactatgcccctaatagcacctatcacaccaacctcaatactgttctttcaaggctcacttccaacacgcaaatcgactatggcttctacaattcctcctacggccaagactctgatagagtctacgcaacaggcctttgcagaggagatgtttcccgacatacttgccttacttgcctcaacaattctagcttttttctcctaaagaactgtccacatcagaaggaggctgtgggatttggaggatatgataaatgcattttacactatgcagatcagtcaatgttcagttaccaagattcttctttccggttctatttttgggaggaaactaatgtaacgaattgggatcagtacagttatgtgctcaatcagttgctgtcaagactaagagtgaaagctgcaacatctaactccaatctcaaccgtaaatttgctgctggaaatgcaacagttccgactccgagttcccaaactatatatgctgttgttcagtgctatcctgatctgacagccgcagaatgcaacgactgcttaattggcgctttctcagaaatacccaaaaattgtaataacag

SEQ ID NO: 22133 - DNA, 672 bp, Glycine max
  Peptide Sequence Number=SeqID_138911
atgacgacacttgctcagacatggagtgtcctttcttattacgatcttgcgcccacttctcacacatctgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgcgacattcagggggtggtttctgataccctgatctttgagtcactcagccctgcgatcaacctagcctatgtgaagaagaattgctggaaccccgccgatccatcgatcacgttccctgggcctcgccgcacacgcaccagagcttcagcatcagcttccgaggcccccctacctacccagtctccgtctcagccatcccagcgaccgcgacatccacctgcttccacctcagcatccatggacacgcatgggcagatgctgagatggaccccccgctcaccactccagaggcctatcgtcagcgagtcgcctggccaggagaccagccctccactgacaggggggaagagcacttctagagtcgctgaggatcctgcagtcgatgaggacctcattgctgacttagccactgctgactggggcccatgggcggacttgggcggaggcagttga

SEQ ID NO: 22134 - DNA, 1548 bp, Glycine max
  Peptide Sequence Number=SeqID_138912
tttgactttgacaccataagagtcgctacgaacaacttctctgatgcaaacaagcttggacaaggtggatttggacctgtttacagcgaagaacggctccttgtctatgagtttcttcccaataaaagtcttgacaagatcatatttgatcccatcgagcgtgcacatttggattggaaaaaacgccacaaaataattgaaggcattgcacttggccttctttatcttcatgaggattctcagcaaaggattattcatcgtgatctcaaattgagtaatattcttttagatgccgatatgaatcctaagatttcagattttggctttgcaaggctgtttaatgcggatcaaactctgcttaatgcaagtaaaattgcaggaacttatggatacatggcacctgagtatgcaaggcatggaaaactctcaacgaagttagatgtctttagtttcggtgtagtaatactagagattgtaagtggcaaaaagaatagtggatttcgtattggagagagtgtggagcatttattaagctttgcttggaaaaactggacgaaagggacagcagataaaattatagatcctgccttaaataatgctttgagagatgaaatactgagatgcattcacattgggctactttgtgttcaagaaaaggttgctgatagaccaacaatggcttcagttatacttatgcttgatagccactcttttgctctaccagttccattgcaaccggcctattttatgaaaaatagttgtttatcagtcatccagttttcggggtgcagttccgtggaaacaggatcaaatgaacagaaaagtgactctgctgatgtatcagcaaatgaggcctcaattagtagtctatatcctcgcagattcacagccaacaacacttatcacacaaacctcaacacccttttatccaatctcacttccaacacaggaatcgactatggtttctacaatctctcttacggcgaaaacatggacaaagtaaacgccattgggctgtgcagaggagatgttaaaccagacgaatgcagcagctgcctaaacaattcaacggtccttctcacccagctttgtccaaaccagaaagaggcaattgggtggtatgacaagtgcatgttgcgctactcaaaccgctcaatatatggcgtcatggaaacttcacctttgttttatttgtcggaaataaccaatgcaacggacgtggaccagttcaatcaagtgttggggaacttgatgagtaatctaacgggcatagctgcatcaggtaactctcttcgtaagtatgccgcggcaaatgcaactgctccaaattctcaaaccatatatggtgctgcgcagtgcactcctgacttgtctgaacaagactgcaacagttgcttggttgaggctttctcgagaatcacaagctgttgtatcggcaatataagtggtagggttgctgcacccagttgtaatattagatatgaaaacttccgcttctatgatgagcatgaacatgctacagaagatgcaccagcaccatcactttga

SEQ ID NO: 22135 - DNA, 1154 bp, Glycine max
  Peptide Sequence Number=SeqID_138913
gagatgttgagccagatgagtgccgcagttgcctcaacgatgccagaggcaatctcacacagcgttgtccaagccagaaaaaggcaattatatattatgacaattgcatgttacgctactccaacaccacaatttttggcgtcatggaaacttctcctgctcttttcctggggaacacagtcaatgcaacggacgtggaacagtttaatcaagtgctccaaaccttgatgagcaatctaacggacagagctgcatcaggtgactctcgtcgtaagtatgctacagacgatacaactgcggcaagttttcaaagaatatacggtttggtgcagtgcacacctgatttgtctgggctagactgcagtagctgcttggttggagctatagaaaatatccaagattgttgtagtggtaagagaggaggtagagttattagacccagttgtaatgtgagatttgaactcggacccttctacggacaaacgacaacaatagacccagtcccagaggtatcaccacctcctcctccgcccaccaataacacttcccaacaagttaaaggagaagaagatgcaattgaagatgatgatgaaattaaaattgctgagtcattacaattcaacttggacacaatacgagttgctacagaagacttctctgaatctaataaactaggacaaggtggatttggagctgtttattggggtaagctctctaatggacagatgattgcagtcaaaaggttgtcaagagattctgggcagggggatacggaatttaaaaatgaagtgcttttagtggccaagcttcagcaccgaaatttagttaggcttcttggtttctgcttggaaggaagagaaaggctactcgtctatgaatatgttcataataaaagccttgattatttcatattcgattcaaccatgaaagcacaactggattgggaaagacgctacaaaatcattagaggtattgctcgaggccttctctaccttcacgaagattctcgactgcgtattatccatcgtgatctcaaagcaagcaacattctcttagatgaagagatgaatcctaagatagcagattttggcatggcaagactggtattagtggatcaaactcaagcaaatacaagtagaattgtgggaacctag

SEQ ID NO: 22136 - DNA, 318 bp, Glycine max
  Peptide Sequence Number=SeqID_138914
atgacttttgtgattccagtaaactcggacaaggaggatttgggttggggctgtttacagggtgggctttccaatggacaagaggttgctgtcaaaaggttgtccacagattctagacaaggggatatagaattcaaaaatgaagtgcttttagtggccaagcttcagcaccgaaacttagttaggctccttggtttctgtctagaaaggagagaaagactacttgactatgaatttgttccaaataaaagccttgattacttcatatttgctaggcatggcaaagctggagagaaggaagagctacagatatcgtag

SEQ ID NO: 22137 - DNA, 474 bp, Glycine max
  Peptide Sequence Number=SeqID_138915
atgaagcccaggtcgaagggtggcgacgacgacggcaccatgaggaacgtgttctccacgaccatgaagaagagaagccccaatgcaaacaagcatgacatccaatgcgccgtcggcgggagctgcggggccgagggcgcaccagcgacgggggtggagaaggtggggccgaaggatcgggttttggtgagggggtggaagatcaagggccggggagaggttgtgggtggtggcagcgaggaggacgaggcggttagcgacggagatggactagacggagaggctgtgggagaggaaggaggggtggaagagagggagggggagccacatggcaaagatggggtcaaaagtgtggaactggatgatagagaaggagtgggagtgggagagaatggcatggctatggcgaagatcgggttgtggtggtggtggtggaagaagaagaagaatttttgtgaatgtaaaattttttaa

SEQ ID NO: 22138 - DNA, 900 bp, Glycine max
  Peptide Sequence Number=SeqID_138916
gcaggcccagaatacctcttaattccagctagagggccaaaagccgtgaatcccatacccagtcttccaattatccaagtaaacaacctgcttgacagccaaaaacgaaaccaagagtgcgaagatcatgaccaccctctgcacgctgacgttgctaaccctaacgagtccgtgggtcgtaaacgccaagagcaggcccacgacggtgtacaagaagcccacagcaaagccctctgcaccaagctgcatcccggagccctggtagaaaaacacaagcttggaagggtcgttgcggtcgacgagaaacataggcatcttcctgattatgttatgcattgcaccagaaacgctgaagaagatgatctggttgcgggagaagagaggggggcggtggatggggcccacggagagtttggtcttggattcaacgaactcggccatggaatcggcgaggcgggagaagtcgccttggtccatgggctcggagtccttgaggcccgccgtgggcccaatgagacggatgtgagggagggcgttgacgccgaactgggagaaggtgagctgggactccttgaactcgatgtcgcagaagaagagcttggtgttggaagggttgttggcgaggaaggaggaggagacgatggagaattcgttgcggagctcggtgaggcggagctccggcttgtcgtggagctgtgcggcgtcaaagaaaaggaggatggagtaagggcgaggggttttcacggaggtgaggaagcgggcgagggattggtcgttcagccggattacgcccgatttggatctggattgcagggagagcaattcgctcactctctcgtcggaggaggccatcgcggaggagatgaacaccatcagtatcagcaacgagagcttcgataa

SEQ ID NO: 22139 - DNA, 1035 bp, Glycine max
  Peptide Sequence Number=SeqID_138917
atgaaagaaaaagccgaccgttcaggtaatggacactgtggtcctaacttgcaacgggtgcgggcccaatttaataacgccgtggtaacggataaagccaagcgtgaagcggtgaagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttaa

SEQ ID NO: 22140 - DNA, 225 bp, Glycine max
  Peptide Sequence Number=SeqID_138918
atgtcagtgtcacaaatcctaactaacttcccccatagtcatatttggatctgtgacaacattagaagatggaccccttacggaaacactaagtgcaccatttgcaagcagcaagtgcaccagaatgctaagtactgccacacctgtgcttactctaaaggagtttgtgcaatgtgtggaaagcaagttcttgataccaagttttacaaacaaagcaatgtgtag

SEQ ID NO: 22141 - DNA, 171 bp, Glycine max
  Peptide Sequence Number=SeqID_138919
atgacaagcaacaggagatgcattgaaagaaggcaagccaaggaatgtgcgacactaatgtgggagtgggaccttagccaggctgcaagaatggaaatcgcactggggctccacccattctcacttgctacttcaataatggaaactatctactcttccctgtatgtttaa

SEQ ID NO: 22142 - DNA, 333 bp, Glycine max
  Peptide Sequence Number=SeqID_138920
atgtatcccgtgccagtggagagggttgtgttgcaaacgcacaaaacgcaagtcgaattgctcgacgaacagttgctcaaagattgcccggttttcgattttccctacaatgaggtcgacgtgtacttaaaacctccgccgcagctggtggtgttgaagctgacggtgttgccggtgaactcgaaggagaagatagagattattctgtcatcagtgttggcgggatacaccaaaggattacaccaacacgaggagccaaataaatgcatgtgggttacgccaacagcaccaaggagaaatacccatgcatgcatcattatcaccgatccatag

SEQ ID NO: 22143 - DNA, 708 bp, Glycine max
  Peptide Sequence Number=SeqID_138921
tttccaccgtcattgaatctgaaaacgctcccacaagatcatcaagatccgtctggatttggaaagctgcagtttccatcgccaacgcaggtgacgccgatgcaacagatgccgccgccacagcttccgtctctggggccaccgagagtgaccgtgaacgtgaaattgccaaagtccaaagatcgtatccctatagaaatggcagagaacgacgtcgttgggaagctgaaaaagaagattgttgcgctgaaagacatgcaaggtgtggcggtggataggatcgtgttgtatccgggtttaacgcgtggaggcatgtggaatcctaatatagacgtgttcttgaaatggtctgtaccggtgacccgtggcagtagtagcgcgtctaggaagcagatggtggtgctgatgccgttgcactctaacctagcgaatgtagtggtagaggtgaatcccatggataatgtgtcgtcggtgttgaagaaccagatgaagaagttggaagagaagctcatgttccgtcttgcccaatatggcacttattttttcctttacaaggaggaggtgatgaatcaacaagaaacctttgagtggcacggagttagggacggtgactccatcagagtctttgttggatacgttactgattcaataccactacttcatgttgctgaaaatagaaaataccgctacttcgtcttgcatagttaa

SEQ ID NO: 22144 - DNA, 636 bp, Glycine max
  Peptide Sequence Number=SeqID_138922
atggatgtaattcttgacgttctgggagggaactcgttctctattgaagttggtccttttgacacagtcctccatgtcaaagagaaggtgcaaaagattcaccacattcccgtttcctaccaaaccttcgtcttccatggcgaaatccttcccgacgatctccaactttccagatctcaactccgtcgcggttaccgcattaacctcctagtcaccgcccccgatttccaaaaccttgctccgccaccgccaccacttcctttagggacgccggagtttccaccgtcatcgcatctgaatccgttggcagactactgcgatcagttgtttggatcgtcaacgcaggtgatgccgatgccgtcaaatagaaatgtgtttcaagagctgatgccgccgccgatgagaatgacgcttaaagtgaaagtgcctacgatcctagatcgcatccctatagaaatggagtgtgaagacaccgttcggaagctgaaagagaagatacttgcgctcgataacttgcgaggtattccggtggagaggatcgcgttgcagtcgcattccgcgcgtgtagaattgcttaaccatcaggttctgcaggattgttgttcggttccagagaataacgagatcgacgtggtg

SEQ ID NO: 22145 - DNA, 462 bp, Glycine max
  Peptide Sequence Number=SeqID_138923
atgggaggatacataacacatcccctcggacttgaatacaacaattacaatcatctcggacaatcgctggtgttgccgatgccatttaggactccgatgttgtcgatgccgtcaaatcataagagtttggaagagccgccggcgccgtcggacaaacagacgtcgcaggtgattccgaagccatacgatccgtcacggattgtaacggtgagcttgaaggcgcataaatactggaaagatcgtttccctatggaagcggacctggacgacaccgttctgaagctgaaaaagttcattcttgcatctatgaaagttcttgcaggctttgagatggaacatgtcacagtagataggatggtgctgcactcgcattctacgcgtgtggaactgcttgatcatcagcttcttcgagattgtaatgtttcagagaatcatgagatcgacctttccatcaaggaatag

SEQ ID NO: 22146 - DNA, 1122 bp, Glycine max
  Peptide Sequence Number=SeqID_138924
atggagattaagtttcatgtccagcagcagggagggaaaaatttcagtcttgaagttgatccctctgaaacaatccgccatgtcaaagagaaggtgttaaactctcagcgcattcccatttaccgccaaataatcatctaccacggccaacttctcagagacgaatggaccgtttcgcaatgcgatctccatcatggcgctcgaattctcctccaacttagcgccgaacgtcctccttcgccgctgtctcactcagacttgcccaagcatccgcaaccaacgcccgacctgcaactgccaactcttcccaccaaagaacacgttccctccgccatcccaccgtgggatccctcgttgcagctcattcctccgcaagacttttacgatccgcttgcgatgccggagtgtccttcgttatcggacgtgatcccgatgccacaaccaccgtccgagctaaaggagatccaagagttgccggcgtcaacgatactatcgcggcggcttcagctctttcgtccgacgccgtcgcaactggttccaaatccgctgccgcctcctcctccgacggtgacgctgaacgtgaaagttccaaggtcgcaagatcgcatccctatcgaaatggagaaggtcgaaaccgttctgaatctgaaatggaagatttctgagcgcggagagatgcgaggtgttccggtggcgaggatcgtgctgcagtcgccttcgatgggcatggaattgcgagacgatcagatcctgcaaaacattattgtttcagggagtcctgaaatcgacgtgttcttgaaaccttctctgccggttcccggtaggaggatgaaggtgaaggtgataccgaggaattcgagacacacggtgaagatagaggtgaattccacggacaaagtttcggtgctgaggcaggagctggagaggttgcagcagctcggtgggttttctcttcccgcgaatggtggttattttttcattcacaagcggaatgccatggatgaaaataattcgtttctgtggcaccgagttagggagagtgacaccatagaaacctttgatggattaatttcttctactgcggcatcggcatcggcatcttcctcgtcacgccctgcctaa

SEQ ID NO: 22147 - DNA, 783 bp, Glycine max
  Peptide Sequence Number=SeqID_138925
atggacatcgaagaaatttcagagtcgaatttgggtggttcttcttcttctcacgaggctttggaatcagaagagaagaacatgggtacccagagaatcttggtttcagatcacataaacgcatatcagtattcggctgaggaagctgatagctttgtgattgatatggattccttctcttccggcatcaacaaagatagcaataatgctaattccagaattacacggagcctttccaggaaaggatctcagcgtgggggcgacaggaaggtgaatggcaatgtcacacttcatgatagggatactgccccaactacatgctcaccaaaaggtgtttttgtttctatttttgaccattatggaacttgggttcatcgatatgcatatgtggattgtggacacgggtattgtcattataagaaattgagacaatattttgatgagttttatggaactgcagctgctctagcagggtcctgcacggctgaaaagtcagcggtggtggcagtagggtccacacatcattccacaaacacacaagttcatcatcagattactattactgccagtaacatgtgcaccaccaccacccccaccaccgaaagcaaatgtataactcgaagaaatagttttaaacgatcttcttcatggctccttgatcctaaaagagtccttcttttctttgccaccttgtcaagcatgggaacaatgttgctgatatacttcactcttactctcagcaagcaaaatgcagatgaatatgggggtgactggcagcagtga

SEQ ID NO: 22148 - DNA, 1590 bp, Glycine max
  Peptide Sequence Number=SeqID_138926
atgctgggttccgccggaaccaacacttttagctggacaattcaacagtttgctactcaagtttccattttggcgcaaacactagctgaaattctggcacaagtcagcacgttctttgaggagaattgtttgcccagatcctgttatattagattgaatcgatatcctccttgccccttggcttctggattgatgccacacacagatagtgccttcctcaccatcttacatcaagatcaggttagaggcttgcaaatgctcaaagatgggaaatggtttgccgtaaaaccaaaccctgatgctcttataatcatcattggtgacttgttccaggcatggagcaatggtgtttacaagagtgtggagcacagagttgtgaccaatccaaaattggagaggatttttggtaatgttgtcattttcccaatctttgcctggctaagggaaaaaaaaaccggaagcgctcactcggcagccatgccaatttggcagttgtgtccaaacatccattccgttcctcaaatcgtagcgtgcacccgcaacgacaaaacgggatcgaaatccgtttcagggagacccaaggtgagccctcaactgaaccggtggtccagagcccgagccgtgcggtccggtcagaaattggaccagtccagtctccgaacccaacccccggagcccaaccctcctgtacgtccacttcctctcccggtggacccagacggcgccgtcaatttggacggcgcagatgtcatgaccgtcaagtccatctatatagtctccgacggaaccggctggaccgccgaacactgcgttaacgccgctttgggtcagttcgattactgcttggtcgaccgtggctgccccgtcagtacccatttgttttctgggattgatgatgcagagaagttgttggagatcacaaagcaagcagcgaaggaaggtgctttctttgtgtatactttagctgacccatcattggcttcagctgcaaagcaggcatgtaagttatggggtgtgccttccactgatgtattaggacccattacagaggccattgcttctcatttgggtgtttctccttctggccttcctcgtggggcttccggactccccctctccgatgattactttcgtaggattgaagctgttgagtttaccatcaagcaagatgatggggcatgtccccagaatctggctgaggctgacattgttctcactggtgtttcacgcaccggcaagacccccttgtctatttatctggctcagaaggggtacaaggtggccaatgtgcccattgtcttgggcgtgggagtgccaaggactctgtttgaggtggattcaaagaagaatattagaagaacaagggctaaaactatgggattaagttcagatggtaggagtaattactcggagatgaattatgttagggaggagcttgaatttgctggaaggctctttgcacagaaccctctttggccagtcattgatgtgactggaaaagccatagaagagactgcagcagttgtattgaggctgtaccatgacaggaagcacatatgcaccatgccaaggatctcaaaacgctattag

SEQ ID NO: 22149 - DNA, 288 bp, Glycine max
  Peptide Sequence Number=SeqID_138927
atgcatatacaagacagggacgagttagaagagatgatgcagcgaaattcagatgcgccgccaccgccaccgccaccaccgccggataaaaatgaataccaagagttgccgcagtcgattgtagacatgccgccaccaaaggaagagttgctgtcatcgattccggacgcgcctccggtggcaccgcagacaccgatgacagtcacagagaacgcattgccgccgcggaatcctgagtttacacagtctccgccgcctcctcctcctccaccgcagctgccgctgacg

SEQ ID NO: 22150 - DNA, 678 bp, Glycine max
  Peptide Sequence Number=SeqID_138928
atggagcttcaattcaaagagcaaccaaacgattttgtagctattattgcacttcctgttgcttacttcctggtgtacacattggggttccaacccgaagcccgtgaaactgaaccggcaccacacgatgcggtactacgtccaccgggtccacgaaagcctcacaacccgcgtctccaagatgatctgcgctaccttcttaggccttctttttattgtgggcctcatcaccttcatcctctggctcagcctccggccccacaggcccaggttccacatccaggagttcaacttgccgggcctgacccaaaactccggaacatcggggtttactacgagtccatggacggcgccgtttattaccgggaccagaaaatcgggtccaagccgttactttacccgttttatcagcagcccaagaacacgacggaggtggacggcgatcttagtggggcgacgttgaccgttagtagtcagcgctggtcggagttccagagcgatagggctgacggtagcgtggtgttccgcttggaattgacatctgtgatcagattcaagatatccacgtgggacagcaagcgccacacgatgcacgccaactgtaatgtgggcgtgggacccgatggttccctcttgaccctttacaaggacaagaggtgccccgtttatttctcttga

SEQ ID NO: 22151 - DNA, 309 bp, Glycine max
  Peptide Sequence Number=SeqID_138929
atgaaagccaacaaaacaagaaatgaattgaaattcttggattcgaaaacttaccggttgaagactgaagaacggacgaagaacggtggaaaatcttggtggaattgctcatggaaacgtctcggaagcgttacggaagcacctcggcttgaattttcttcatggaaacacgttttttcacccaaaacaactgaaatgcatagcatagggggttacaggaattttacagaagcattacggaagccccggaagccatttttcaacaaaacgggggaagaggttgccgcccagctcgcccaggcgagctag

SEQ ID NO: 22152 - DNA, 552 bp, Glycine max
  Peptide Sequence Number=SeqID_138930
atggcgggtgaacctgagaatattgccttcctgaccaaagacattcatatgctgccttatttccacggcaaccgctcaccgcgtgccaatccgacactgaccggcacgctgactggcctgaaactgtcacgcacgccggaagacatggcgctgcattatctcgccaccattcaggcgctggcgcttggcactcgccatattattgagaccatgaaccagagtggttactgcattgataccattatggccagcgggggcggcaccaaaaatccaatctttgtgcaggagcactccaacgcgacgggctgcgcgatgctgttgccggaagagagtgaagccatgttactcggcagcgcgatgatgggcaccgtggcggcgggcgcgtacgactctttgcccgaagcgatggccgccatgagccgcatcggtaagaccatcacgccgcagaccaacaaaatcaaagagtattacgaccgtaagtaccgcgtattccatgagatgtaccacgacagcatgaaataccggcagctgatgcagggaaaaactgaataa

SEQ ID NO: 22153 - DNA, 315 bp, Glycine max
  Peptide Sequence Number=SeqID_138931
agatctttttccattggtgctggagtggtaacttttttttggtaccgtaaggatattgatggacagtggattaggaaacaagatttaccactacggattcctgatgagcgtactccgtctcctctgccacatagagatgcttcctctactcttatgcatgaagtcctttctgaactacgtggccttcgaccgttcatagatgaccatttggatgccatggatgcttattttgaaggcatggatacacagattactcagcttgaagatgacatgggtttcattcgccgttgcttcgatccaccagctgccccatag

SEQ ID NO: 22154 - DNA, 226 bp, Glycine max
  Peptide Sequence Number=SeqID_138932
gtagtctgcgcggaagacgacgtaaatctctgcatgtcaacgggcttgttggccgcgattgacaaagggtgcagaggacgactctgcgcggaagatgacgtaaatctctgcgtgtcaacgggcttgttggctacgactgacaaagggtgcagaagacgacatagcaaaaggacgtttgcgggttaccgtcgggtgtcttcgcatgccaccggactcttgggtcacg

SEQ ID NO: 22155 - DNA, 270 bp, Glycine max
  Peptide Sequence Number=SeqID_138933
atgcaagtggtggggatgtctcctccacctctaggacctctcaatcactcacaaactcagctcatgctctcaggacgaattccttttccagctctgcggatagaccgaagtggtgcgcttagcgggatgacccttctcgtagcgaacatgcacaggtcatccttcttccagattcttcctcgcgctcagccgaggagtgttgcgctcagcggatggcttgctaagctagcagattggcttagcaagaaggtgaaaatcagcacttcataa

SEQ ID NO: 22156 - DNA, 459 bp, Glycine max
  Peptide Sequence Number=SeqID_138934
atgggtgaagtagaggaggtgcaagagcagatgaaggctgacatggaggccatgaaagagcaaatggccacaatgatggaggccatgatgagcacgaagaagataatggaagccaatgcggttgcagttgccgctaccagcgctgttgctaaggtgaacctgacgcccccatctggcctcaaccaaatgaatcatccaacctcagatatggtaagcaaagatttgggaagtacgggcggcccccatgatgtgaaaattcaaaacgagctgccttcctgccatatgacttgcctcccaactatacaccacccaatgtggcgtacactcccaatgaggatgtcaataactccactcccatactcattgagagccgacaacctcatcatgcacgacaacctcatcatgcacatgtctctcaacccatgggagatacatatgaaataccccaccataatctag

SEQ ID NO: 22157 - DNA, 244 bp, Glycine max
  Peptide Sequence Number=SeqID_138935
tagaggaggtgcaagagcagatgaaggccaacatggaggccatgaaagagaaaatggctacaatggtggaggcatgatgagcatgaaaaagataatggaagccaatacggttgcaattgccaccaccagcgctgttgctaaggtgaacccgatgcccccatctgatctcaaccaaatgaatcatccaacctcagatatggtgggcaaagattttggaagtacggacggccccatgatgtgctaa

SEQ ID NO: 22158 - DNA, 336 bp, Glycine max
  Peptide Sequence Number=SeqID_138936
atgagtgtagctggtaaggaagtatgtaactactgtctgagtgataatagtagtggtagtgtaaatattaggatcattaatgctccagaagttgggcctgaaagactcagtgttgaggcagagaatggcttttatctggtgactttgcttgaatatgatgagtctgggagcgatgtaaggtctatatgggatcaaacttcttcttctggggaaaatgtcatgattcttggtaattactggccgaagcggcagcttactaaggactttgatcttgttgtcaggatctttaaagagttctttgatacaggcaatgtttcaatggatcttctgaattaa

SEQ ID NO: 22159 - DNA, 222 bp, Glycine max
  Peptide Sequence Number=SeqID_138937
atcaccaccgtcaccgataagaccacctggcgcgaactctgccaggccagccaacagcggcaagatttgggggccgaccaggcgcgagagaacggcgagcaggttatcgctggcgactggctaagtcagcccgggatcaccgaggcggaacacctggaggtctctgctgcgcccggtgtgatccggttgcggcggcgagaagtgggaggatttagagattag

SEQ ID NO: 22160 - DNA, 251 bp, Glycine max
  Peptide Sequence Number=SeqID_138938
atgtggttgagcgacggccgcctggaggcgtaccgcctgcggcccgacctgtacgaggtgtctgaggatttcgcctgcgtcgaaggggcgcgccaggctctgccgggaggcgcccgcatgctgttcgatgtgccgcgcaatgtgtcggcgccgcgccagcgcgccatcacggtggccgatgccgcggcgctgggccgcgtgcgcccgaattggcgcagccagtccaaggcgcaggagatccgccacttcct

SEQ ID NO: 22161 - DNA, 651 bp, Glycine max
  Peptide Sequence Number=SeqID_138939
atggccgccctcgcagatttcgagcggttcgtggtgccgcttatcgaaggcgcgcccacgccggcggtcgaggatgccatcgtcgacgcagcgatcgaattctgcacccgcacccgcgtgctgcgcgcgttcctcgatccggtgacgctggtgcctggcacgaccgagtacgagctggacccgcccgaggctgacacgcagattgtcgatgtggtggcggcttggctgcccgagggcccggtgacgtcggccacgcgcaccgaactcgaggagaaattccccgacggctgggcttggcgccaggtcggcagcaccgccgacgtgcagcacttctactgccggctgccgggcttcgtgcagttggtgccggcggtcacggtcaaggcgccgcgggcgctgcggctcgaggtggcctacgcgcccaccaggaacgcgcgcgagctgcacgacgtgctgctgaaccgctacgccgagaagttggccaacggcgcgctggcgcgcctgcaccagcataaggcggactatgcggatcctggccgcgccgggggctaccagacggagttcgaccgcgattgcaacacgctggccgatgatggcgcccgcggctttgcaaagcgccggatgcgcactggaggggacgaattcaaatga

SEQ ID NO: 22162 - DNA, 189 bp, Glycine max
  Peptide Sequence Number=SeqID_138940
atggaagtgcttcttagtccaatagctcttaaagtggttggccctttgcttcttgacccaaattcttcaagggatggcaccaatcctcctttccaattccctatatggcaactcacaaacaagaaaacaaagagacaagcaataatcaaagaccaaaatgaaatgaaagctaaaccaatggagttttaa

SEQ ID NO: 22163 - DNA, 261 bp, Glycine max
  Peptide Sequence Number=SeqID_138941
atggcgacggaggtggtggcggtgttcattgttgacatggtcgccattaatgatatctctgacagtgacacaaaagtcaaccatgtcgtcgtgaagtgcgttaaagtcctggagctgcaagaggaagcaaactgtgtcgtgaggacggagcgaggtagtattccgatcctaagtggatttgacattcaactttcctgtgttgaggccttttacattctaagcaaacaatgtcaatcttgtagtcctttggatagttcttga

SEQ ID NO: 22164 - DNA, 315 bp, Glycine max
  Peptide Sequence Number=SeqID_138942
atggcgtatggtttggcagcaacaacattgagtgcctctcaaatccctccaacttgcaatggagatgaagcattactcaccttttgtgggtcttatttggggaatatcctacccaaaccaacttctgattgttgtaaatcagcaacttctgcgtttgacaaagccatgttcgactccaccggtcaaggtataagagatctttgtgattgtctcatggttgctggaccagttttgaactttcaacaaaccaaacttgaaagccttcccgatgcttgcgggattaagctttccttttctatattcttatgtgtatga

SEQ ID NO: 22165 - DNA, 1929 bp, Glycine max
  Peptide Sequence Number=SeqID_138943
atggaaaacccatgtgagatatccttgtggaatggcttgatggcaggttacactaagaattacatgtatgtggaagccctagagctttttgagaagttgttacactacccttacctaaaacctgatagttatacttaccctagtgtttttaaggcttgtggggggctgcatagatatgttttgggaaaaatgattcatacatgtttgataaaaactggtttaatgatggacattgttgttggaagctctcttgtcggtatgtatggaaaatgcaatgcatttgagaaagccatatggctgttcaatgaaatgcctgagaaggatgtggcatgctggaatacagtgatttcttgttattatcaaagtggaaacttcaaagatgccctagaatattttggcctaatgagaagatttggatttgagcctaattcggttacaatcacaactgctatttcatcttgtgctagacttttggatttgaacaggggaatggaaatccatgaggaattgatcaatagtggttttctgctggacagtttcattagctctgctcttgttgacatgtatggaaaatgtggtcatctagaaatggccatagagatttttgagcagatgcctaaaaagactgttgttgcttggaattccatgattagtggatatggtttgaaaggtgacatcatatcatgcattcaactttttaagaggatgtacaatgaaggagtcaagccaacattgactaccttaagtagtttaataatggtttgttcacgatcagcccgactactagaggggaagtttgtgcatggatatacaatacgaaacagaatacagcctgatgttttcgttaatagttcactcatggatctatactttaaatgtggaaaggtagagttagccgaaaagatctttaaattaataccaaagtccaaggtagtttcttggaatgttatgatttctggatatgtggctgaagggaaactttttgaagcccttggcctctttagtgaaatgagaaaatcgtatgttgaatctgatgctattacttttaccagtgttttgacagcttgttctcaactagcagcactagaaaaaggtaaagagattcacaatctgattattgagaaaaaattggacaacaatgaagtggttatgggagctctacttgatatgtatgcaaagtgtggtgctgtagatgaagcattcagtgtttttaaatgtttgcccaaaagggatctggtgtcctggacttccatgattactgcttatgggtctcatggtcatgcctatggagctttggagctttttgctgaaatgctgcagtccaacgtgaaacctgatagggttgcttttcttgctatactatctgcttgtggccatgctgggttggttgacgaaggatgctattacttcaatcaaatgatcaatgtttatggcattatacctagagttgaacattattcatgcttgattgatcttcttggacgtgctggaagattgcatgaagcatatgagattctgcaacaaaaccctgaaatcagggatgatgttgagttgttaagcacattattttctgcatgtcgtctgcacagaaatattgatttgggagctgaaattgcaagaacgcttattgataaggatcctgatgattcatcaacctatattctcttgtcaaatatgtatgcttctgcacataagtgggatgaagtacgtgtggtgagatcaaagatgaaagagcttggattaaagaagaatccagggtgtagttggattgagattaatcagaagatcctcccgttctttgtagaagacaattcacacttgcatctagaacttgtttttaaatgcctttcatatctctctgatcacatggaagatgagtctaaatcatttacatatcatcttgatgttgaaacattgagattatattag

SEQ ID NO: 22166 - DNA, 519 bp, Glycine max
  Peptide Sequence Number=SeqID_138944
atggcgaacaccgatgaacccaatctcataaacttctcctccgttggtgaaccctcgaaggttctcatggacaaggttgggattaaacggagagtatctattgacaaaaccaaaaaggaggttgacaacactaccttgatagagaatcttcctcttgtctcatgttctgcagcatcagatcaggttgatgtgccgaagcaatctcaaaagaaagaagagccggagccacctcaacatcagaatttcattgttaatgaacccaaaagggttcaaatttcccggattgttttggactgttttaatctctacgctggtaacgggaatttgatcaagtctggtcgtggcatgactgtgcatttaaacaagtttgacgactgcataaaggattgtgaaagggctgttgaaaggggaaaaatactaagatcggattacaagatgatagcaagagctttgacaaggaaagggactgcattggccaaaatggctaaatgcattacccaaattttaacctgccattga

SEQ ID NO: 22167 - DNA, 729 bp, Glycine max
  Peptide Sequence Number=SeqID_138945
atggtgattgtttatttggcttctgaatctagtaagttttgggaaaattctcttagaacagagtcaaatcaagggaaagaacaggctcaaaagcagttccttacattaggaaaacagcctaaatctagaccttttgctactgtaaagggattaagagccaacactactgttgttcctcatcaatctgtgaatccaagattggaaaagatattagagaaagttctagttaaacaagaggttttagtgtgtcatgcaaacaccaatgtgaaggagatgctggaggatattgttctcttagcttttgcggatgatgttattctttttgcgaaggctactcttgaccagatcagcactcacaaggagcagggagggctaggcttgaggaaaatgagatatgatgagagccaattggagattctcctaatatcattcgaagttaccatcaccttgataaaattttggaacgatgcttggattccaagctgtggcagattggtggatgtagctgctagtaacactccccattatgagcttcaaaaatctgtggctgagtatattgatgtgaatggttgttggcaaattcatacaattaaggattatctttcccctaatgttgtgaagatggtaacagatatggaagtgaatggtgtagcaactcacaagaatcatgctctcttcatggagatgaggaagtggaaggatcctgaatatgcaaagggctttctttga

SEQ ID NO: 22168 - DNA, 981 bp, Glycine max
  Peptide Sequence Number=SeqID_138946
atggcttcagaagaaggagacaacacaaccaagggagtcaaagcatgggtgaaggagttgagagaagcatctttccgcatagaagatgtcattgacgaatacatgatctttgttgaacaacagcctcatgatgatgcttttggttgtgtaaatttcctcttcgagtgcaatatcactcacttcattgaatctttgaagcggcgtcatcaaatagcatcagagattcagcagattaagtcatttgttcaaggaatcaagcaaaaaggtattgattatgactacctaatcaaaccttctcttgagaaaggatcaagcagctacagagggagccaaagtgtccaatggcatgaccctcgaaagcattcacgttaccttgaagaagctgaagttgttggccttgaaggccaaagagataaattgattggttggttagtggagggaccatcagagcgcactgtcatctctgttgtaggaatgggcgggttaggaaaaactactcttgccggcagagttttcaacaatcagaaggtgactgctcactttgaatgttgtgcatggatcacggtgtctaaaacctacactgaggaaggagtgttggggaaattgttgaagaaattgtacgaagaagacaaacaagagaaagctcctcaaggaattgatgaaatggatcgagattcattgattcataaagtgagaaagtatttgcaaccaaagaggtactttgttatttttgatgatgtgtggagtatagaactgtggggtcagattcaaaatgccatgcttgataataaaaaaggaagtagagtgtttatcacaactaggatggatggtgttgtagactcttgtatgatatctccttttgatatggtgcataagctgaaacctttaactaaagaagaatctatggaactcttttgcaagaaggcatttccatgtcacaatactgaaattgtccagaagattcaagaaaatttcttctga

SEQ ID NO: 22169 - DNA, 447 bp, Glycine max
  Peptide Sequence Number=SeqID_138947
atgaagggaagaaaacataaatatgggtttaacaagaataaacgtgagaagccagagaagataagggtggtggatgatgaaactggcgacaaacatcaattggatgaagtcctaaggattccatctacatatatcatgggttctcaacctgcctcccctcctcctcctcctccttctcctcctcctcctcctcctgctccttcggacgcatcggctttgccgtttgccacgaagcggacacacaaagcctcacgtctacgatcattgtctactagaccacctggtgttgagagaccagtggtccatgttgatcctgctaccggcaagaccgacggtccccacaggaagaaattaagaatatatttggggattgtggcgcgtgataaggtggacgtcacctacgagaactggaagaaggtccctacttctcagaaggacctgatttag

SEQ ID NO: 22170 - DNA, 243 bp, Glycine max
  Peptide Sequence Number=SeqID_138948
atgcatgtatgtgtacattatggaaaaatactgccaacaccttatgttgggggaaatgtcttgaaaattatgaccaggccttgcttaaagggaatagaagagaagactgccaagttgaaaggaagtgagaaggctctagttgcacggcatgaagctagtcatgctgtagtaggtactgcagtagcaaaccttcttgctggacagccacatgttgaggctctggttatcagactcctggtttaa

SEQ ID NO: 22171 - DNA, 270 bp, Glycine max
  Peptide Sequence Number=SeqID_138949
atgggctttgtcggcgtgggcggagagtatggcgttctaggcgaaggagatggagctgcatttggagtacatggtggtgagcttcttcttggatatgttttcctctccaggcttccctcactaacagatattttctcaaatttggattttcttttgttatgtgaatggtgcgtttgggattgggattgggataaagaggtcttggaggaaggagggtggatttttgaaatcattcaaggaaaagagagaagaggacagaagaaaaggtga

SEQ ID NO: 22172 - DNA, 2349 bp, Glycine max
  Peptide Sequence Number=SeqID_138950
atggaggcctgttatgagcatgtccttcataatattgcaattgcggaattcttccgagatggttgttcagatcccaagaagttgcttgaagtaattaatggcatcaagagaaaaaatgatgagcttgctctggttttggaagaacaaggagagtcagttaacaatgttggaaataaagttttggggtccaaaggaagtaatgcttcggcacaccagttttcaggtgcaaacagcaccagcaccagcaccatgtatacagatgaatttgactcttctgtggcaatgctaaatattgcaatcatttggttccatcttcatgactatgcaaagacattgtcagttttggaacctctctttcaaaatattgaacccatagatgagacaacagctctacatatttgccttctgctgcttgatgctagccttgcttgccatgatgcatcaaaatcagctgatgtgttgacttatctggaaaaagcatttggtgttagtagcgtgagtcaaggtgatagtgggaacacagcacagcagcaagctgcaaatctaattacaaaatctgtacctgttgccagtaatgtatcagctgctgatgcatctagttctgacttagggccaagtgcaaatgtatctgaaaatcatctatccagagatttgtctgaagatacacttgattatgaagccatgattttggatatgggtggacaaaatctagcgaggccaatgggcccatcttcaaatgatctttcaagggctttggttgacaggttttctactgttgatttgaagcttaaattgcaactgtacaaggttaggtttctgcttcttactaggaacttgaagctagcaaaacgagaagtcaagctggccatgaacatcgcacgcggaagggattcatcaatggctcttcttttgaaatcccagcttgaatatgctcgtggtaaccaccgcaaagctgtgaagctattgatggcatcaaataatcggacagacacggcattttcaagcattttcaacaacaatcttgggtgcatttattatcagcttgggaaatatcagacgtcttcattattcttctcaaaggcattaaccaattgttcatcactgcggaaggaccagtcattaaagctagccactttctcacaggataattctctccttataatttataattgtggtgtgcagtacttggcttgtgggaagccaatacttgctgctcgatgtttccagaaggcaagtctggtcttttacaaacaacctctcttgtggctccgactctctgaatgctgtttgatggctttagaaaagggcctaatcaaatcaagtcgggtcccatcagagaagttgggggtaggagtttgtgttgttgggataggaaaatggaggcaacttgtggtcgaagatcagatttcaggaaatggacttgtggactcatctgaaggggatgattgtccaagtgaagatgggcgactaaagttatcgatgtcccttgcccggcagtgcctcttgaatgctctacacttgctggactccaacagtgcaaattgtttgaagtctggtttgccctctaattcgtctgtggaggataacaatggaagtgaagtgtcgccttcaaaaaattcaaatattaaaaactcacatggcattgattcaaaggcattttcagtagcagtagggttaggtcaggtcaatgcaaatggggacactaaagaacaaaagggagtaaatagtcaggaacttgttcagaactccctctcctgttatgaaaatgtccgtaatagagaaaatcaattggttaagcaagctgttcttgctaatttagcatatgtggagctggaattggacaatcctgtgaaggcactatcagttgcaaaatctctcttagaacttccagaatgttccagaatttacatctttctaggccatgtttatgcagcagaggctctctgcttgatgaacagaccaaaggaagcagctgagcacttgtcattctatttgtctgggggaaacaatgttgacttgcctttcagcctagaggactgtgagaaatggcaaccggagaggactgccgattttgaagaggtgaatggaggatccacagctgctaagaattcttctcttgaaggcactcagagtattgttttcctcaagccagaggaggcacgagcaacaatttatgcaaattttgctgtaatgtcggcgatgcagggtgaatttgagaaatccaatatactggttgcgcaggcattgtccttattacctaacagtccagaagccactcttactgcagtttatgtggatctcttgctcggtggtggctgtgttttggttagtgctggtgcccacctttga

SEQ ID NO: 22173 - DNA, 909 bp, Glycine max
  Peptide Sequence Number=SeqID_138951
atgaaatcaagcccacatcatctcccatgtaataagcaagggattgggaaaagagttctcaggtgcaaattagggttcttaaccatgagtattgattatttcaagcaggacattgatgaacttatcggtgaattcacccaggatgagtcaacaactttggctgagataaaaagagtatggctttctaggaagttctcctacatttatgaagctcgtccttctgccaacctggccttctttatgcaatcactgtatgctcattgtataggttacatggttggtaccgcaactttatctcacagattaggtggcctttactgcctctactgtctttatgagactcaaccatttaatccttcttttaaggtctatctatcccttggagaattaaagaaacttagaatccttgttgctgatgcaaaagcaaatgatattaaagtagcacttgctttagtaaaaagaatgcttgaaagaaacacattcctttttggctctgttgacttgatggaaggttgtgtcacagagacagtaaatgaactccaacaattacagaatgcccgtattcaagttgcatatgaaaagttatttgatagcacttcaattgacaactacatccagatggaccttggcttggaagttgaccttgatttgctgaagaaaaagtcatctggatatgccacggccaagaatgtggctattcaagaggcgagcaatattttagacgttgaaaacataaagcacttacaaaaagataaggaactgataggagatgttgtggagaaggttgctaacgactggcacgttcagaaacaaacattttataaacaaacaggattaggggacgatgcatatgagaaggaactggagcaattacttctagagcagcatccacatgatggaaactcttaa

SEQ ID NO: 22174 - DNA, 1182 bp, Glycine max
  Peptide Sequence Number=SeqID_138952
atggctaacaaatttgaagggagaaaccctaggatttgcttgcttcgaagcgaaaccgggttttggcgcgaagaatttgttctggctgcgtctttccccggtgatgctgatgaggtagtgcgagtgagtgagggatttcctttcttcgttcagaaagcttctgcaagaaagacaatgtcagaacaacattcttgcgccaacccttcttcgcttcaatccctcgctcactcctcccaatcgataatctcttccatcgtctccgacttttctcacgaccacgatgaagaaatagtcgcacaagccttgaagtgtttgggcttcatgctttatcatccctccgtcgtttccgtctttggagtggatgatgccaatttggtattgggcgcattgcccaaacttattaccaccacacagttaaaggctagtgcatcgtttcttgttattcacttcccttctttgttacgggcaattgttcacgccctagacaatcctatggattctttgtccacaacatttgaagctacccaggctattgtcaaagatatgaagataaaattgctaaatgggatgaagggtttgctagacaatggtatgaagactcaagctattcgtgcatggggatggtttgccagaatgcttggatcccatgctttaaggaatatacatatgctgaaaattcctgaacgtacatttacagatcttgaccctcaagttcaaattgctacacagcttgttatctctatcaatgaaacatcgatgataaaaacagtttttgagcctttacctaaagcaatatttcagaatggacctgatagcaagaacatctgcttatggaacctgggcctcgatctgcttagtgatagtatttcacataagcgtggggatgtcctttaccagtcaactggcccagtaagccacagagtctctgataatggaccttctctatctggaaaatgctcttggaagcaacacctaatcagatggatgcctaggaatatcaatcaattggacttttatcttagtatgattttccatctcattcatcaagcatctaggccaactgtcacttatgatcgtagaaatcatgtgtatgatactgccttgaagctatttatttatattctgaaaggagtcaaactggacgtggaaagtccatctaccaattatgatggtattatgtag

SEQ ID NO: 22175 - DNA, 834 bp, Glycine max
  Peptide Sequence Number=SeqID_138953
atggcacattctgaagttccaagaatgaccttgtcaaatgatagtgcctctttggataaatatcccgtatcaccagaaagaaaggtgaagtttgaactggttattcaaacctggaaatcactttatggatctcttagtgctttgggctttggatgctcatcagccaccaatttctctggggatctgtgcatgttgttaagcaactgccttgatgaaaatggtggcatggttgagagcggcactgattttgagtcaacatgcaatgatgtggatcatggcgttcttcatttatctggcaatttcttgatatgcattctagaacagattcagactttggaattagttactgagttgcgcagaagtaaatctgaccgtgatttcaaaatattttgctgcataaagaactgcttaaaatttgttgccaagtatatgaattttttgaggataaagatggttagagatccactgtctggttttgttgggacctcaagttgccttcactggaagcaagatattcttcatcttctagagctatccagaaatggaagattaaaactccagaagagaagcctaccgtgtcttcaaaaatgtcattctcatgaagaagccaatgatgctctagagggatgtagggactctccaaaacataactggacctctaagagggtggaactagtgttggatacactaaaagaagcaccacctcctttaagttttaaaaagaggaggttagaactgactgagcatctcaagggagttaggcgagcacagcaaggaagggaaagggatactggaggacgtggcccaggaattagaatttacacaagggcgtga

SEQ ID NO: 22176 - DNA, 400 bp, Glycine max
  Peptide Sequence Number=SeqID_138954
atggtatcatttttgaagtttgttcaaatcagtgcagaatttggtgtgtggaaggtcgttaggcgcagggcatctggtgtgcagtgctctctgtcatatggaagttccggaatgaaagttgctgctgtgcgtgaaataaaattcatggcttcaattactcatttgtacatcttctcacgtggtggcattaaggctttggggttgcagattgagtggggggtgataaagaataatgagcaaggtttcattgttgctttctcagctaagattggtaattgttctattgctcaagctgaattgtggggcatctatcatcgtttgtttcttgcctgtgaaaagggtttcagtcacatcctgctggaatctgactatcttcctccattcagactttttcattctg

SEQ ID NO: 22177 - DNA, 240 bp, Glycine max
  Peptide Sequence Number=SeqID_138955
atgattttcaacgaggtatcgaccccaaatgccccacttgctggtccgtggaatgtacctggagatatacccgacatggacgacttattaggggtcgatttacgtcatgatttctttggcgaggctgaccaagtggatgaaagggtgaatcctagaagaagaaatcctgatagggcagctagaaattgggaccgaccatgtgggacttcgtcgcggcatcacagacatagtgatgattga

SEQ ID NO: 22178 - DNA, 99 bp, Glycine max
  Peptide Sequence Number=SeqID_138956
atgaacagggctatggccatattcggtgttgttggattctcggagcttccattggctctgcctatcaatcttctaagagttgtgatttctaagacataa

SEQ ID NO: 22179 - DNA, 3458 bp, Glycine max
  Peptide Sequence Number=SeqID_138957
atggtgtccatgatgccaggaacagttggtcacgctttgagtgcagagagtgataaggtggctttacttgctctgaagcaaaagcttaccaatggagtgtttgatgctcttccatcatggaacgagtctttgcatttgtgtgagtggcagggtgttacatgcggccaccgccacatgagagtgactgtattgcacttggaaaatcaaaactggggtggtactcttggaccatccttggcaaatctaaccttcctcagaaagctcattctttccaacatcgacttgcatgctcaaattcctactcaaattggtcgactaaagaggttgcaggttcttgacttgagccacaacaatctccacggtcagattcctatacaccttactaactgctctaaacttgaggtaattaacttgttgtacaataaactcaccggaaaacttccctcgtggttcggaactggatccatcacaaagcttaggaagttgcttctcggtgccaatgatctagttggtactataacaccttccttggggaatctttcatccctccaaaatattacacttgcacgaaatcatttggaaggaactatacctcatgctttgggccggttatcaaatttgaaagagttgaatcttggtttaaatcatttgtcgggagtagtccctgattccctttacaacctttccaatattcaaatttttgttctcgcaaaaaaccagttatgtggtactcttccatcaaacatgcaacttgcttttccaaatcttcgagatttcttggttggaggtaacaacttcaatggaagtttcccgtcttcaatatccaacatcaccggattgcacgtgtttgatatctccttaaatggttttagcggatcaattcctcccactttgggaagcttaaacaaactaacgaggtttcacattgcttataatagttttggaagtgggagagctcaggatttggatttcctttcctcattaaccaattgtactcaattgcacaaacttattttggagggcaatcaatttggtggtgtgttgccagatcttattggaaacttttctgccaatctcactttgcttgatattggaaaaaatcaaatatctggaatgatacctgaaggaattggaaagctaatcggtttaactgagttcactatggtagataattacctagagggaactattccaggttcaattggaaagcttaaaaatctagtaagattcaccctggaaggaaactatttgtctggtaatattcctaccgccattggcaatcttactatgttgtctgaactttatctgcgcacaaataatctcgaaggaagcattcctttaagccttaaatactgcacccgcatgcagtcagttggtgttgctgacaacaacttgagtggtgatatccctaatcaaacatttggcaatctagaaggcttgataaatcttgacttgtccaacaactctttcactggttccattcctttagagtttggaaacttgaagcacctttccatattatatttaaatgaaaacaagttgtctggtgaaattcccccagaacttagcacttgttccatgttaacagagctcgtgctggagagaaactacttccatggaagcataccttcgttcttgggctctttcagatccctcgaaatcctagacctttctaacaatgacttgtcgagcacaatccctggtgaactacaaaatctgacttttttgaatacattgaacttgtcttttaaccatctttatggtgaagttcctataggaggtgtctttaataacttaacagcagtttcactcattggaaataaggatctctgtggggggatacctcaactgaagctcccaacttgctctaggttgccgtcaaagaaacacaagtggtctattagaaagaaactcattgtcatcattgtaattggagttggagggggtttggtttcttatggagagctgcatgaagctaccaatggattttcttcatccaatttagtaggtaccggaagctttggttctgtgtataaaggatctcttctccattttgaaagtcttgttgctgtaaaggtgttgaaccttgaaacttttggggcatcaaagagtttcgcagctgaatgcaaggctctaggaaagatcatgcacaataatgttctcaagatcctgacattttgttcaagtgttgattataatggggatgatttcaaggctatagtttttgagttcatgcctaatgggagtctagatagtttgctgcacggcaatgaagagctcgagtctggaaatttcaatctcaaccttcaacttttgctaaatattgctcttgatgttgctaatgcattggaatatcttcatcatgtttctgagcaagctgtagtccactgtgatattaagccaagcaacattcttcttgatgatgactttgttgctcacttgggtgattttgggttagcgaggctctttcatgtgctcacggaacattccagcagagatcagattagttcgtctgcaattaaaggaaccattggatatgttccccctgaatacggagcaggtgtacgagtatcaccaaaaggagatatctacagctacggaattcttctgttggagatgctgacgggaatgagaccaacagataacatgtttggtgagggtcttagcctacacaaattctgtcagatgacaattccagaagaaataactgagatagtagattcacgtttgcttgtgccaattaataaagaaggaacaagggtcattgaaaccaacatcagggagtgtctggtggcctttgctaggattggagtttcatgttctgcagaattgcccgttcggcgaatggacataaaagatgtgataatggagttggaagcaatcaaacagaagcttccccacgcgtggttgtcagcgcttggaggagttgttatcgtaatcgatgatctcggaatcggtgacggatctggagtgctggacgatggagcggccgatagagttgatccaatcctccttctccttctcggagtcggcgatgaagtacatggtgtcggagcgcgtggagagctcgaaggcgttgggcttgttgaggatgtcttcggcgcctttgacggtgaggcacgtggcgacggggaccacgccgcgtggacgagacgcacgcgtgacggcggagtccttgaaccagaagagcttgccttgcttgaggacgaaccagcggcggcgccaggtcttgatgtactcgccctgcttggtgagccagccggtccgctcggggttcgaccagaactcgacgccgtcgtaatcggtggcgttgtccgtcatgccggttgccgcgcgccacaggctcgccatcggagctcgaagatgagagggcagagaaagagaataaacacagctcaggagaaccaaagaaaaaaccaactcactcacgacattgcgttgctggctttgcccttacc

SEQ ID NO: 22180 - DNA, 1116 bp, Glycine max
  Peptide Sequence Number=SeqID_138958
atgcataccatatgcctaatagccatatccaaggatttctttgagagtgatcttccgaaacccgagctatctggagatgaagatgacttgccagaaagattatggaaagagttcttgtcatccagccttggtggagctagttttcgcatatttattaccctctcaaccattttggtgcccattacaacaggactaacattgtcatttgccttggagtatgcacgattaactgctggcatagagcttccagttggacgagaaatgccattggaggaacgtcctcttgaaggagagcatgattgccgccttggtctaccattagaagcaggctcaacagatgaggaccgtagattaggtgctccaggcctccccctagttgttgacagtgacctttctggaagcgttgtcctcaaattgggtggagcatcaagtgaaaagccaggcatctccgatggcttccattgtcttgatttcacagttggtgaagtgccacgggatggtactggctgccttgatatcacaggagctgacttggagactgaagaagtcttaactgaaggagaagatacagtgggtacattaggtggtgttgacggtcggcgagctggggttgatgcccttgatgtaggtctggatgcaggtgttgaaggtctggctgattttgaaactgcggtaggtgttgaaggtctaggtgattttgaaactgtggtcaatgtagaacgtccagcaggagttgtagatcgtgacccaatattccctgatgatgagtgcctcctagttacaccacctgaagaggtcaacccaggggaggaggctgattgtttagatactaaattgctccttccactatgttctgacagattctctgatgatgagggcctcctaattccaccacctgaagaggtcaacccaggggaggaggctcgttgtttaattactgagttgctccttccagtaagttctgacagattcccggctgatgagggcctcctaattccaccacctgaagaggtcaacccaggggaggaggctggttgtttagatacgaagttgctcctcccagtatcttctaatggagaatttgcaaactacaaccacaaggaaacaaatacatga

SEQ ID NO: 22181 - DNA, 129 bp, Glycine max
  Peptide Sequence Number=SeqID_138959
atggaaacatcaaaaactgttatgagccagcttggggctccaactgtccgtcccacaccattaaaagctcgaatgttgtctttggcatctggttttaattcgttaatgaaattgtacatctccttgtaa

SEQ ID NO: 22182 - DNA, 441 bp, Glycine max
  Peptide Sequence Number=SeqID_138960
atgaatcggagcttcagagcggtggaattgcaaatgcaagacgcgtttaatcagaggcggcaccaattggcggctctcaggtcctcctctccgcgcgtcatggacagggacgacgagctcgctttgttccttgaaatgcggaaccgcgagaaggagcgcaacgatctcctgctccgcgcagcagaggatttcgacgctgcagcaccattaggctctgatccgggaaattctcccttgtttaacgttccgccggctgcgtcggctccggcgaggaagaccggtgctgatgattttctcaattcggaaaatgataagaatgactatgactggtactacgtagcactctttgtcattggcctatatcagcaatacatccatgggacttgggaaagttatgtgatatggacccaggcactaagctattcagaactcgggttttag

SEQ ID NO: 22183 - DNA, 348 bp, Glycine max
  Peptide Sequence Number=SeqID_138961
atggagttaaataaaagttggatgcaaataactgataggacgactcctctatatgacaaaggagttcaagaatttcttgattttgcattcaatagttttgaaaaaggaaaggactatgttatatgggagcatcatggagaagtgattagtgagcctggtgaatttgatgatgatgatcaaaataattgcaatgatggggttcgtgatatgttacatgatcttggaagtgctatgaatattgagaacatcacaggagatgaggaaataaattatataactggcacagacactaataatgtgaatgaagaagaagataagttttctaaactattttttattgtcgaataa

SEQ ID NO: 22184 - DNA, 375 bp, Glycine max
  Peptide Sequence Number=SeqID_138962
atgcatatatggagaaatcttgttgagagggagatcccacttatgagtgccaacagaatattctataaaaaggttgaatatgtgcttgaagattgtaacgaggttctcgtcaaaatcaacaaatttgtcgtcaacaaagaaggcttagtatgtgtggaaacgttgtgtatgcctgttactaaaccagaaagatttgagttggatgcttttgtgttagatgaacctgaagatgctggcaggtatatagttagaaagagcataaagagtgcaaaagacatagttcatttccctttccaacaggatgccaccatactttacttattgcacactgtgtacagaggcagagagtatctcccattacttactgtgcactat

SEQ ID NO: 22185 - DNA, 285 bp, Glycine max
  Peptide Sequence Number=SeqID_138963
atggtaaaatcaaaggatattcttctcattttgaaggagcaatatgccaacaattgtacaacaatgaagcaagtctacaattattactgcctcttatggaagaacgatatgcatatcttacgcagatatgtaaaaaatttacctctggacagtcgttgccaccgcgagatgtacaagaaaggtttagtactgacgatgactagcactagaaaatgtggttgtccttttaagctgcgaatgaaaccagtcccgcgagatgaagggtggatgatcaacttaagatga

SEQ ID NO: 22186 - DNA, 387 bp, Glycine max
  Peptide Sequence Number=SeqID_138964
atggaacaagaaggtggattatgtgatgggaaagaagttgatcagtttcatcaaccgtctggtagtaatgaggttgccattgctaatgaggatggtatttcatatggatcagagctcatagaggttgacaaagtaaaaataaatcaaggtgatttgttgtttgggggggatgcttcagatggtgctctctgggatattttttggagacaggatgtccctaagttgcaggaatatctgaagaagaatttcagagagtttaggcatgtccattgctgtcgtttaaagcaggtgagagagtacaactgggaaattgagtgtatccgactagaccgagtttcccagttcttactggttcagtgttgggttgattacatggcaccgggttag

SEQ ID NO: 22187 - DNA, 339 bp, Glycine max
  Peptide Sequence Number=SeqID_138965
atggaaaagagcggaggcaaacagaataattttgggtcaatgaaagaaaaggaatggaaaatcttcagacaagataaattctcggcaagattgccattctcgactggcgatatcccaccccacatgaacaaagaggaaaagaccgaaacacccagcttcctctcagaaaacactaccctcgagaaaatcctattggttcgtgatcgaatgtcattgcctagcgttgttcatgtgtcctccaccttcgagtctggagccacacgaagttattgcgtagcgctgttcgccaattctccattctccacttttttgcggagccccatgaatgtcattgcctag

SEQ ID NO: 22188 - DNA, 823 bp, Glycine max
  Peptide Sequence Number=SeqID_138966
aggtcatattgcagtgaagagttttaatgcagaagtagttgatgaagcagggaaccctgtgcctctccatgaaacttataccactggtggtacatgccagagagatattcttgcacaatactacggccttggatccgaaacacggcgaacagctacggatattccagacccttttgaaataattgttggtaatcctgcaaaaattccagaggggtacgaggagaaatggttggtcaatatccatgccattgatacacgcggtgtagtggataaaatggggtgcactgagtgtaagtgtgagctttataatgttacaaatgatgaatatggagagcttcttctaaggccagactataaaggaggtttgctatgttgctatgatcaaacccagtgcaggttgagggaaggctttgtgggccaaaagaggaacctctaccttagatgcacagtaaagtgggttaattgggacaagttcattgtgcctgttaagatttatatacttgatgtcactgatacttcaaaaatatcacatgattctaaaggaatgatcgctgagcatgattgccagattgaatatgaggttgaatcttgcagcactggcaatgaggatggtaatgactgtctccatgtgaagaggacaaacctctcaatgaaaaattgtggttatgtcatatatggtgttgctcatcagcattcaggtgggactggatcaatgctatatggacagctgatgttcaatgttacagtcattcttaaatatttggaatttggatcgaagggttatatgttcttcaataccaagttatggaaagggaaaggatga

SEQ ID NO: 22189 - DNA, 192 bp, Glycine max
  Peptide Sequence Number=SeqID_138967
atggtcccagacgaaattaggtattcgacaccagttgctgcacaaagaaaaagatcactcagtgttttgatcaagaatacaaaaggatgccaaggaagggggcaaaagggtctttttcttgatttttctagaccccagatcgcccaggctagcatctggctcacctggaccatggaattacctcctggctaa

SEQ ID NO: 22190 - DNA, 405 bp, Glycine max
  Peptide Sequence Number=SeqID_138968
atgaagggatctacagtctccacaccggaggacactcctttgccaccaaagtggtgcgagctggctactactaaccaacactcaaggcaaatgcccttgacattaccaagagacatactgggaccactaccaaaggcctcaggagtagtcaaatacttactagttgccatcgactccttcaccaaatggatagaagcaagaccactacgggaaattatgaccagtgaggcagagaaattcacctggaaaaacctcatatgtaggtacagcctcccatacgccattgtaacggacaacgacactcaattcaaagctcaaacccatgaagacttcctaacatggttaggcattaagcacctagtcacttctactgaacatcctcagaccaacggtcaagtagagtag

SEQ ID NO: 22191 - DNA, 1230 bp, Glycine max
  Peptide Sequence Number=SeqID_138969
tgcctgtttaaggtcttggggcttgttctccccttgattgtcttccaatgtgctctgcttgagaatttgaatgtggctcattttgagctccacccaaatagttgggccatggtgagggcctttgaaattttgtgctctttcttcaacatccaacctaatgtgttggtcttcttgtttttcttccaagtgaagctgactggcaagaatggttgggtctccttaaacagcatgtctaagaagctatttgagtttgactcaaattctgaccccaccaagttgaagtcgtttgacgaggatctgttgacctttgtgaagagggttgacaaaactattttggagcagctcgatcccctcgttgccttggacggtattatgagtgactacgtctggaggccactcgtgaagcaggtcggacttgttggtgatgttgtgctaccatctgttgttgttcctattttggagaaaggggtcaacctgctggctacaaggttgacgctcggttcaggtcgcccttcaagtgtgctagatgtgtctccggctccaccggctgtgaaggctcctgctgctgatgacgccgctcttgtttctcctgaagtgagtgcacccgctgctttggttggttctgctatggcaccctcatccgtcatcactgcacctttattaagtgtcagtgtggtgaccagtagtgcccctatggtgcctcttccttcctcttcggctccaatggttcctccctccactgcattggctttgacttccaccttttctctcccctgtgtttccctagatcacatctacacttccaatgatgtagattacttgtcggagtggaaccaccaactgtcttctaaagttggcggtgtgttggccaagtttttgtgcaccaggttggatagtgatgaactgtccaaacactacaaggacttgcaggaagagaataaaaacttggctggcttggtggaggaagtgccaacggagaaggaaaagcttgccaagaaggtggcggatctcgaggcccagctgaaagagtcagagttcatgctggaggagtccgagctgcaggctgctagagatagggaggccaacaaggagcttgaggaggaactgctcattttcaaaaaaaaggccagagagcagaatgaaaagggcttcaacaaggacatgaagggtggtgttttgcttgatgaagatgatattgttgctgaagaggaggtcgacaaagagcagtag

SEQ ID NO: 22192 - DNA, 402 bp, Glycine max
  Peptide Sequence Number=SeqID_138970
atggtccaagttcaacaaaacgaactaccaccagactatttggcaagaccttcaatcaggtgcagttcatgcttacccctcataaccatcagaggagaaactctacaagtcaaacgacctacgactagactggttggcatgaccttcaaccaggggcaagtcaaacgtactcctcataagcatcaagggagaagctatgcaaagcagaaagaagccccaccagatggtggcaagacctttaaccaggttgaaatcaaaccagagatgatttcatgtcatctactttttacaggaccaccacgatcctacgcctacatcgacaaggtcttgctttctgcaccatcaaagattccacacttatcatcacgacaacctatccataccaccaccagtaacggatga

SEQ ID NO: 22193 - DNA, 354 bp, Glycine max
  Peptide Sequence Number=SeqID_138971
atggtggtctggtctgtagaactttcaaagttcaacatccaatatgaaccttgcggccccatgaagacacaattcatggatgacttactagcagaattcgctggaaacgacacaaccaccccagattggtggaacctttacattgtcagtgtgtccaatgtaaaaggaagcatggcaagaattatcctcgaaggccctaacaatgtcaccctagaacaagctcttcaacttcagagcctcaaacaactaggaagaatacaaggctttcattgcagggagagcaacaccagagcaaacctactcttcaagctggccagcaccaagaaggtcgagcaccttaagactattatctag

SEQ ID NO: 22194 - DNA, 2418 bp, Glycine max
  Peptide Sequence Number=SeqID_138972
atggcaagaaaatcgtacccgtctgaaaccgtcttgattttgatggataatacccgagttgatcaagaatgggttcagtatagtggatggtctgagctttttgccatggaagcaagagaacatgttgcaccaaaaaaaccaatccttacacctaaagctataatacaccaaaattttggcagtagggcttgctatgtggtagaggaagtgaaggaggctcctcaaactgaatgtccaggattgaatattccacaaatgggtccctgcctttaccgttgcacattgcagcttccagaactttctgttatttcaggaacctttaggaaaaagaaggatgcagagcaatctgcagcagagattgctatagacaagtcctactttggagatgatcatggtcaagtgcttgttttcttgcatttgagaatgtcaatgtcagacactctgatattgccacatcttggcatttgtacagagaccattgatcctactccacaagaagcacaagaaagtttagtatctcgaatcaccttcatattttctgaaaagtttgttgtatgtgatcatccactcagtggtcacattcgagcaactttgtggaggaaaggtgatctttgtggttccattcctctttctgtcattgctttctatgatgcaaagcttttcaacttgtgcaaatgtattaatcctgaggtggagtcaaacccatttttagttatttcatacataatgagggccactgcaaacttacaccagtttcttgctacttctgaacggcatctctggattagaaggctgagtccatatccccaagatattatagagtcattgatgaaagaacatggttcacaaaaatgcatacaggttactgctgtacacattcctagttcagttgaacaatcgattgaagcagtgactcttcatatttcttcaagagaatactaccttgatatcattgcaaatgaacttggttttgaagatgcttccaatgttctgatttcaaggaatttgggtaaagcttcttctgagacaagactgttctttactgctccaaaatcatatctaccggatctatcttctaaatttccaaatggaaaagaaactctttatttaaagggatctctgaatgtaagggcaagttactttgccgggcaagatataaccggtgatgcaatattagcatccattggatatacacggaaatctagagatcttttctatgaggatgtaacgattcggttatattacaggatgcttctagggaagaccccaggcgggatttataaattgtccagagaggcaatgcttgcatccgagttgccatcaagattcacctcaagagcaaactggagaggttctcttcccagggatatactttgtatgttttgccgccagcaccgtctgtctgaacctctcttttcatttcatcctatcaaaacaacatctggattatcaggatcatgtttgaaggttgcagaatctggtgagaatgtgattgagtgtgtcaatgggttctctgtaacaagtccaaagcattcagattctgagttgtttaaatgtgaaataaaattactttctaggtgtggagatttgatacttttgtgttccccaaaagattgttataagaagcagaatgatgctattcagaatgcttcattgaaagttctatcatggctgaacatgtgttttaagagtatgattctcccttttgagcagctttatgagactgtagacaactttaatattcagatctattccaaaaacattatcagagatcttttagcaggccaatcaactcacaatggtcagcttaatggaattcattgcaataagtttgttgaatcaatctatatgaattcatcatatgacatgctgggaaatatagtggactcattaaagattgaaggtccatattctggggtgtgtccatccagtggatctttaccttgtataaggtattcagtttctttggctgtagagggtgagaatctgaaagaagttattgaagtttgtgatgagtttgagtttgaagtgggagttggtgctgtggtttcctatgttgaggaggttgtgatgcagatgtctgttggtcagtacgcttatttctctacaaacttactttctactgagttgatttttgctgcttcagctgaaaaatgttgtatggaatatgaaataagtttgatcagagttgcagaacctcctgaggaaagaatggagcaggctcttttcagccctccactttcaaagcaacgagtggaatttgcagtgcaacaaattctagaatcccatgcttctactttgattgattttggatgtggttctggaagccttttggaagcattgttaaattatccaacatctttaaagaaaatggctggtgtagatatttcacagaagggtcttagccgtgctgcaaag

SEQ ID NO: 22195 - DNA, 1290 bp, Glycine max
  Peptide Sequence Number=SeqID_138973
atggatttgtattttcctttggcaatacttgtgctgatattaggcacaccatactctagtgcttttgggaagagtgaaagtaatgtgaaaacagctgtttttctgtctcccaagtttgaacttggaccgggttcggtagccaataaatttgattatgatattgattttccaagaggtcatattgccctcaagagtttcaatgctgaagtagttgatgaagcagggaactctgtggctctccatgaaacttatctccatcactgggttgttgcaagatactatcaacctaaatatgttaagacacacacaagctatgatggccataggatacttcataactctgatttcgtatttgtgaggaacagtggcttatgccagagaaatactcttggacagtactttggccttggatccgagacacgaggcacagctacggatgttccagatccttttgggatagctgtaggggatcctgcagaaattcctgaagggtatgaggagaagtggatgttcaatatccatgccattgatacacgcggtgtagtggataagagggggtgcactgagtgtaagtgtgagctttacaatgttacaaaggatgcatatggcaagcctctaatgccagactacaaaggaggtttgaaatgttgctatgatcaaacacagtgcaggttgagggaaggctttgagggcccaaagaggagcctctacctaagatacacagtaaagtgggttgactgggacaagtttcttgtgcctgttaagatttatatatttgatgtcactgatactataaaaatatcagatgattctggaggaatgatccctgagcatgattgccagattgagtatgacgttgaatcttgcagcactgaccaaaaggatggtaatggctgccttcatgtgcagaagacaagccttccactgcaaaagggtggttatgtcatctatggtgttgctcatcaacattcaggtggaactggatcaactctatatggacaggatggaagagttatatgttcttcgataccaagttatggaaagggaaaagaagcaggaaatgaagcagactacattgtaggaatgagcacatgttatcctcgacctggttctgtaaatataattgatggtgaaactttaactctagagtctaattacagcagcagccgtgagcacaccggagtaatggggcttttctatctattggtggcagaacaacttccacaccaacacttgaaacatacctctcggtcttcattctttatagatattaatagtatagttcattga

SEQ ID NO: 22196 - DNA, 1185 bp, Glycine max
  Peptide Sequence Number=SeqID_138974
atgacctgcgtcttcctccgcgatgttgcagaaagggcatcgcccatcaattatctcaacttggcatgtttgcagggagtccaatgcaagcgagttgcaagaagtattaattctgttggtctttatgttccagggggaactgctgtattaccctcaacagctctgatgctttcagttcctgcacagattgctggatgtaaaactattgtccttgcaactcctccagctcaggatggtactatatgcaaggaggtagtgtattgtgcaaagaagggtggggtgactcacatccttagagctggaggagctcaggccatatctgccatggcttggggaacagaaacttgtcccaaggttgagaaaatttttggcccaggaaaccaatatgtcacagctgcaaaaatgatactacaatttatcccgctttacattattgttgaaaatattctgcagaacagtgaagccatggtttcaattgacatgccagctggtccatctgaagttttagtcattgccgacaagcatgcgattcctcgtcatgtagctgctgatttgctttcccaggctgagcatggtcctgatagtcaggttgtgcttgtgatttctggtgaaggtgtggatctgaatgttatagaagaggaactcaacaagcagtgccagagtctcccaagaggagagtttgctgctaaggccctaagccacagttttattgtttatgcacatgatatgcttgagtcaatcaagttctcaaacttatatgcacccgaacatctaattgtcaacacgaatgatgcagagaagtgggagggttttattgagaatgcaggttctgtatttttagggccgtggacaccagagagcgttggtgattatgcaagtgggacaaatcatgttcttcccacttatggttatgcaaggatgtatggtggtgtttcattggattctttcttgaagttcataactgtgcaatctctcacagaagaaggcctaagaaaactcgggccatatgtcgttaccatggcagaagttgaaggtcttgatgcccacaagctagcagttaccctaaggcttgaggacatagaagtcaggcagtcaacgttaatcattgttgagtttttcgaagatcgtaagggagaaagtggtcagtgcaaagcaaagagctttgataccatatttgagatctag

SEQ ID NO: 22197 - DNA, 798 bp, Glycine max
  Peptide Sequence Number=SeqID_138975
gagcaacaccacaaaggtttggtcacaaaagatgcaaatgaaaagaataagccttctacacgacatttcatccatggatatcacttgatccaaggacagatgaatcatggaatggaagaccatatttttgctcaacacaggaatctcgacggttatgacttagggttgtatgcaatatttgatggtcactccggtcatgaagttgcaaaatacttgcaaagtcatctgttcgaaaatatactgagtgagcctgaattctgggaaaatccagtgcatgctgttaagaaagcatgtaaagccacggatgatgagattttagaaaacatagctgattcacgtggaggatcaacagctgttgcagcaatactaattaatggagtaaagctactggtagccaacattggtgattctcgagcaatatcgtgcaaaaatggtcgagcaaaaccacttactgtggatcatgaaccagagaaggaaaaagatcttattgagagtagaggaggttttgtgtctaagaagccagtggatggccaattagaaatgacacgagcatttggagatggaaaactgaaggagcacattacggcagaaccagatgtgacgattcggaagattgatgaagacactgaattcatcattttggcaagtgatggcctatggaaggtgatgacaaatcaggaggcttgtgactgtatcagggatgaggatgatgcgcaaaaagcatccaagaagttagtcaaagaagctaaatctcagggaagctatgatgatatttcatgcatagttattatattctag

SEQ ID NO: 22198 - DNA, 198 bp, Glycine max
  Peptide Sequence Number=SeqID_138976
atgatgaaggccaattctaacttgcataaaagaaagtctagcttgattagtggtggacatccttctgcattcaagatgagcttcaagcagaataatatgtcctcaaaacggaaaattgctcctccatacattgctttccaaactcttccatccaaacatagccataggcttgctcacaaaaggaaccatggcaattga

SEQ ID NO: 22199 - DNA, 614 bp, Glycine max
  Peptide Sequence Number=SeqID_138977
atgtcttccatgatggatcccatgctggaaatgaaacaactaatggagagtaacgcggccaccgccgccgctgttagttcagctgccgaagcagacccgactctcccaaatgccacgcaccaccctattccaaacgtacttatccctacggattaccacccaattacacaccaccagccatacatgaagacgtgggtcactttcctcccctcatcctcgacggggaacctcctcgacatcctgacggggtccacgagaatcctcgagagcatgcttagggagacgtcgactcctactccccgtttcccgctgaggggccgaggaccacccccggcaccggaaggaaaggggaaactcgatatcatcgaagagagattgagggctgttgaagggtttggtgattatccgttcgcagacatgaccgacctatgcctggtaccggacgtcgttatccctccgaagttcaaagtacctgacttcgataggtacaaagggacgacttgtcctaagaatcacctaaaaatgtattgtcacaagatgggtgcatattccagggacgagaagttattgatgcatttctttcaagatagcttggccggggcagcagtcatcta

SEQ ID NO: 22200 - DNA, 621 bp, Glycine max
  Peptide Sequence Number=SeqID_138978
atgcctgtaattgatcgaagaagacaaggcacaaatctctggagaggtattgtcaagtgctggagtaactttcaacttaatttgatttggaagctaggaaatgggagatctatccacttttgggaagactattgggtgccaggttctgggaaccttaatcaattctgcactaaccaatcaagaagtggtgcgaatgttccagtgtgttttcttgttgatgcgagtgggggatgggattcacagcgtctgaattctgagcttcccatgaaggatggaaaattttctactaaaaatgcctatcttaccttgtcccaagctggtgatcttgttgagagtcctatgaacaaggaagtacttctagagaagcttacacccaaacaggtcctttgtctttcgctattcctggacaaatacagatggggtggtgaacaaagctcaggcactgatcaaggatattggcagaaggatgagtctggaatttggaaggcgccaaagaagggcttcttgaagattaactgtgatggtgcttacttccctacgctgaaggagaatgggagctgtgaatctgatagtaaaaattgtcctcatgctgtgaagctgatagatgaatgtttcaaatga

SEQ ID NO: 22201 - DNA, 1575 bp, Glycine max
  Peptide Sequence Number=SeqID_138979
atgggttctcagataaggcttctgggtctgtgtctatggatgtacttgtcaagcttaagcttcattggagccggtgctgtgtatggaagagaaggtgaagttgtgaaagggattgttttagttcatgggaaaactgcaattggaaggattgatgatgattctgtttgtgcaactctggattggtggcctcctcagaaatgtgactatggaaaatgcagttggggtcatgcttctctgctcaacctggacctcaacaacaaaattttgttaaatgcagtaaaagccttttcacccttgaaaattagattaggtggcactttgcaagacaaggtcatgtatggaactgaagattgtcggcaaccctgtactccttttgttttgaatgcgaatgaaatgttcggtttcactcaagggtgcttaccgatgtataggtgggatgagctaaacagctttttccaaaaagcaggggctaaggttgtctttggattaaatgctcttgctggaaaatctatgaagtctggttctgctgttggaccttggaactacaccaatgctgaatcgttaatacgatacacagtcagaaagaagtacaccattcatggttgggaacttggcaatgaattgtgtggaagtggaattggagcaagtgttgcagcagatcaatatgcttctgatgttgctgctttaagaaacatagttgaaaatgcatatagagggattgaacctaagccactagtcattgcacctggaggcttctttgactcggattggttcaaggaatttataagcaaatctggtaaatctgcagacgtgatcacccaccacatttataaccttgggccaggagttgatgaccacctaactgaaaaaattcttgacccttcctatctggatggagaggctaacacattcagcagcctcaaaggtatacttcaaagttcatcaacctcagtaaaatcatgggttggtgaggcaggaggggcttacaatagtggccatcatcttgtgtctgatgcatttgtctacagcttctggtatttggaccagcttggcatgtcagctgtttatgacaccagaacatactgcagacaaagtttgataggaggaaactatggtttgctgaatactagtactttcgtgccaaatccagactattatagtgcacttctatggcaccgactcatgggaggccgtgtcctcttaactaccttctatgggacaaagaagataagaacttatgcacattgtgcaaaggaatccaaagggatcacaatactagtgctcaacttggacaacagcaccactgttcaagtcaatgtggccttaaaatttaacaagttaccataccgtagagtgggtgaaccagccagaagagagtaccatttaactgcaccagacaggaatttacatagccaaactatgttgctaaatggaaaaatgttaagtgtaaactcagctggtgaaattcctcctttagagcctctatatgtaaactcaagaaagccaataatagttggtcctctatctattgtatttgctcatataccaaatgttcttctttcggcctgcagctaa

SEQ ID NO: 22202 - DNA, 1137 bp, Glycine max
  Peptide Sequence Number=SeqID_138980
atggccaggctcacgctgagaccagacaattcctgcttcttttcacacactcaaagagctaattcccacaccccttttaccagaacaacctcgtttcaacgttttcactttcatctctcatcatccaaccacaccctcaggctcagcagaatagtttctagtgctcaacaaaatgctaaagaaacccagagagtgtccatggccaaggcaaaggccaaggttctcacggaccttcaagtggaagaggtggagaagcagcatgagaccttgtcttggaactggccaccttggaagaatcttccccaaagatacaagctcatcggcaccacatcattggccttcattatttgtaacatggataaggtgaacttgagtattgccataattccaatgtctcatcaatttgggtggaactcatcaacagcaggattggttcagtcctccttcttctggggctatgcattgagtcaattacctgggggttggctagccaaaatatttggtggcggagctgttcttgaggttggagtattgatatggtcagtggctacagctcttgttccttttcttgctggatatatgcctggcttattgttgtcaagggttttggttgggataggcgaaggtgtttcaccatctgctgctactgatctcattgccaggcatctccctcccaaaattgataaaacatcttgctttaggagtttagggtttgttcctaggtcaataccattagaagagcgctcacgtgcagtagcattggtttttggtggtttgagtgttggaagtgttatggggcttcttttggctcctccccttatccaaaatcttggttgggaatcagtattctatatatttggtctcttgggaattgcttggtttttggggtttcaagttcttgaaggaggtgaaacacaattaaatgcagaatctctttcatcccaagatatcatgacacaatcatggaagacttctctaagagaattgaatggctctttgaaggatgtaccatggaaggcttttttccaaaatcgtgctgtgtgggctatgatatatgctcatttctgtggcagttggggtcactataactgtctatcatggcttcccacattttttaggtacagtgtgagcatttaa

SEQ ID NO: 22203 - DNA, 546 bp, Glycine max
  Peptide Sequence Number=SeqID_138981
atgaggacaatttttactatcagattcacagctcccatctctaaggccatatataaaccatataaaatagcccataactccgcatccacaatagaaccatgccccaacctactagcaaaggcacgaaaaactctccttcagcgtagggaagtaagcaccatcacagttaatcttcaagaagcccttctttggcgccttccaaattccagactcatcccttctaacactaatcaattcaggataaaggacattgttcaaaattttacttctgccaatatccttgatcagtgcctgagctttgttcaccaccccatctgtatttgtccaggaatagcgaaagacaaaggacctgtttgggtaagtgcttctaaagaagtttacccaaacaggcccaaagtcatttcgtctccaccaaagtatattcaggataacaccgaacatagtagcattgatattcttgcaatcacgaatattagtgatcatccagctattgatatcctgttgaaaaaaggagtcattgagatttttatcaattgcagcccctaa

SEQ ID NO: 22204 - DNA, 171 bp, Glycine max
  Peptide Sequence Number=SeqID_138982
atgaacaacaatggcaccacctctaacaacaacaacaatattgctcatcagcacctgaagttaagaaggtacatacaaaggagcattttcaccgtagagttgcaagagaaaggagttgcattgaaggcgccactagggtctcaatgtcaagctcgagggagtagagtttga

SEQ ID NO: 22205 - DNA, 312 bp, Glycine max
  Peptide Sequence Number=SeqID_138983
atgttgggccattgcaataccgctcctacgggaatgttcatttaccaagcactgcattgttccatttgtgtgcagcatggtcaaaaatatggacaaccagatatcaacaggaccactatatttgcgcaaaatattggtgctaacctaagaataatgaagatatcccaggagaataaggcaattgagatcacatatatgaggacaaagagagctgttaaagaatccacaaggaaaattctaacaatcagcaaagcaaaatactacaacaaaagtcttattccacttggtgaggttgactatatggatcgatga

SEQ ID NO: 22206 - DNA, 259 bp, Glycine max
  Peptide Sequence Number=SeqID_138984
atgtcccatgctgtcaaggaccaccgagggaaatgggccccgaactatgaagggccttttgttgtgaagagggctttctccggaggagccctggggcaggatcaccttgggctaccttctggagtgaagacaaaacatgaacggcagaaaccaatcaagatacttaaggatgaacgcgagcggggatggggtcacgaccgaccaatcgtcacctttctccgtgcgaaacaagcagggaatgtcgctgcaaggcagcccc

SEQ ID NO: 22207 - DNA, 1326 bp, Glycine max
  Peptide Sequence Number=SeqID_138985
atggctaccacgcaatccttcgaagatttggaagcgaaatatgaaacaaaggaaacttctgaatcagtcatcttagttgttcacattcctgatggttttgtacgagagcatattggagcaaaaattgagtacgagttttcaagggtgagaattcatggcgaacgatcacttggaaacaataaaagggcacgtttcaatgcattatatcaatttccagagtattgtgacattaacaaaattaagggaaagtttgatggaaaaactgtcatcattacaataccaacaattccagggaaagtccctaagctagaaacacaaccaactgaacaagaaccacccaaagaaccatcagaagaagaagaatcaaatccagaggaagaaaaagaaggtactcctacagatgataatcaagacagtaaagaagaagctaatcatgtgacttcgactccaccaaatgccacacaagagtccatgcatcaaaaggatcaagagggaattccccaaaaagctacacttaccaaagttgaaagtgaaaaacatgttggtcaagaggcttcaacttcaaccccaccaaaagacacacaagagtctaagggtcaagaaggaattcccacaaaagatactattacaaaagttgatagtaaaaaacaagttgctcatgaggcttcttcaacctcatcacaggacacaccagagtctaaggctcaaaagggtcaagaagaaatttgcacaaaagatactataacaaaagttgatagtaaaatacaagtaggtcatgagggttcaacttcaacaccatcacaagacacagaagaatctatgcctcaaaagggtcaagaagtaattcccccaaatgctacactagcaaaaaatggcaagcttcaaggagagcaaaattctgaaggagaaattgacgaaaatgtggaaaagcaaaagcttgttgaaaaggaagaaactgaagaccattccaagaagacttgggaatcaggaaagccacctgaaaaggctatggtggatgattcccctaacaaggaagggaaggaagaaagcaaaggtttgggcccatctgaaggagagaagagaagggaaataaatggtaaaattggcaataatgttggaaaaaagagtgataagaaggccattcctgaatcaacaacaagggcaagaattaaggaagtggctgcttctgcttctcaagctataactagtctagccaagaaattcaatgaagaagataaacaaaggatagtatacatgggtgcagcagttcttgtggtggcacttggagtttatggtacctacaagcttcgttcacgtagaccatag

SEQ ID NO: 22208 - DNA, 618 bp, Glycine max
  Peptide Sequence Number=SeqID_138986
atgtatgtcaatgttctaaagtatgggagaggaaaggtgaggtttgacgagcataccaccatacttaggacccaaatggaaggacacaacaatgaagtggcaatcgcgcgacacacgtcaatgcactataggacccctcttaagtcgtatgcgaaggtggtttccactaccaaagcggatgtcgaacacaagaatcacttcccacctacgcatcccagacaggctgagtcacaatcctcggtccaccttgaagttgcagtgggggaaaagaagtggctcacagacgcatgggagctaggagtaaatgtggtgtcgaaatatatcggcgatgatatgatactcctccttgggctatcggatatcaaagttgaggagatcatcaatgaagaaacccaacacgacacatctccgttccactcgatagaaaagtggaatccaacgatcaggccgggaaatagattggtctgcgtccaatgtttgggagtccctttagaagcatgggacatagggaacattcgaaaaatagtggcggcagtcggagaccttatcgaggtcgccgacgatgttgaagagctaagaaggctagatggggccagaatcctcatcagaactccatag

SEQ ID NO: 22209 - DNA, 354 bp, Glycine max
  Peptide Sequence Number=SeqID_138987
atgaatggtgtattaatcatgagagagagagagagagagagagtgagagggagcgagagtgagtggaccaccgtgatcagagggagaggaagacagagggaaggggagagaaagagagaggatcccaaaacgaactatgcctacaacaagccaggacaatctcaaaggtattaccatgaaaactggagggacaaagatgctatcacaacgttctacttcacgcgattccctgaacacacaacaaagaaggatctctgggctcatttcaagaaatggggagatgtgagagagatcttcatccctaaccacaggaacaaaaggggcagaagatatggattcgtaaggttcaaaggg

SEQ ID NO: 22210 - DNA, 507 bp, Glycine max
  Peptide Sequence Number=SeqID_138988
atgagaagcttaggtgcaagagatgttgttggagggctgtttggggtaggagatgatgcctggggtatcagtagcaacaacaacaatctaagttggaacaataggctgatcaaccagaggtgcattattgtcaacagtctcaaagaaaaatggagtagactcaaagaaagtgacatcagtagaaacaatatacctttgaagctgtggacaaaagcaacgatatccttcatggaggcaagagtaatcgagaaaaccacacttaagagacttggtagagagtttatctttacttggagtaagattatgggcaaaacaagtacatccaaagacatagagaggaacatggtagaggtcctgttgcgggtacaaaatagaatatggggtttgattgttgaggatagacgagggcatgcgattgatcaaggaatgtgcagtaagaatcgcatcaccctagaagcagataagaacattatagtgaaggagaagggtacaagcggtttcaactag

SEQ ID NO: 22211 - DNA, 1821 bp, Glycine max
  Peptide Sequence Number=SeqID_138989
atggagatgtacatgtgcgtcgaggttgtgagaagattggtgacggtgttggaagtgtggggtgcggcggttgtcctcggccctttgcgcggtgcagcggtcatgacggtgttgagtgttggcagtgtcgaagtatggggtgcagagcggcgatgctttgcggcggtgcgttgccgggtggcagtgctttgtggcggtgcgggcgatttccctgaagtgatagaggagtatttggaatatggttgtatgaaatgcattgccttcaatcgccgtggcacccttcttgctgctggatgcaacaatggaagttgtgttatttgggattttgaaaccagaggcattgctaagattctgcgtgatgatgaatgttcttctcccataactagcatttgctggtcaaagtatggtcatcaaattcttgtatctgctgctgataaatcattgatattgtgggatgttatgagtagtaagaagataacacggatagttttgcaacaaacccccctacaagctcgtcttcatccaggatcctcgaccccatctctttgcttagcatgtcctctttcatgtgctccaatgattgttgatctgaacacaggaaacacaactttacttaaagtttctgtcttagagacatgcaatggaccaacaccaacccctccttcacgtaataaatgttctgatggaattacctccttcacaccaactgctgcttgttttaataagtatgggactctggtttatgtgggaaactcaaaaggggaaattcttgccattgattacaaaaatggtgacgtgcgtgctgtagttccaatctctggtggttctgttgtaaagaacattgtgttcagcaggaatgggcagtatctgctcacaaattcaaatgatcgaataattcgaatctatgaaaaccgtctacccctgaaagatgaagtcagagcccttgatgacctgagtgagaaccacaatgttctaaataatatcgagaatttgaaggctgttggatcaaaatgtttaactttattccgggaatttcaagattccatcacgaaggtacactggaaagcaccttgtttcagtggtgatggtgagtgggtagtcggtggttctgctagcaaaggtgagcacaagatttacatatgggatagagctggacatcttgtgaaaatccttgaagggcctaaggaagctctgatagatttagcatggcatcctgtgcatcctattgttgtatctgtttcgctgaatggtttggtttatatatgggcaaaagattatactgagaactggagtgcatttgctcctgatttcaaggagcttgaggaaaatgaggagtatgtagagcgtgaagatgaatttgatctgattcctgagactgagaaggtgaaaggacctgatgttaatgaagatgaggaagttgacattataacagtggagaaagatgctgctttcagtgattctgatatgtctcaagaagagctatgttacttgccatcaacccctagtcgtgatgttcctgagcagcaagagaagtgtgtagaaagttcttctaagttgttggacagcaataacactggatcccctctttcggaagaagctggaccaaatggacatatgatgaatcatgcatctagtcctcttgaagatgatgctgggcgcatgaaaagaaagcggaaaccttcagagaaggtgttggaattacaagcagaaaaagttaagaaaccctcaaaatctagcaaattggcaaaacctaagagcaaatctttggccgatcaagataatggtaacggttttcatggtgatggactttatgatgaataa

SEQ ID NO: 22212 - DNA, 303 bp, Glycine max
  Peptide Sequence Number=SeqID_138990
atgataaacatcatggcagagacggtgtccatagtacctaaagaagccattaaaagtgaaaacaaaaatatagccaaacaaggggcttgtgtgggtcgctttagatggaagaggccggggttgtcttgtcagcaagcgagtgtcatcggagatgcgtcacgtgctggaaaagagggcaagtgtgaacttcacgcgccaaaattgtgtattgtggaaacatttttaagaggggaggaagaaatcaattcaccattgtggaaatattttgaagtggggaggaagcagtcaatccaccatcaataa

SEQ ID NO: 22213 - DNA, 384 bp, Glycine max
  Peptide Sequence Number=SeqID_138991
atgaacttacatggctacagcaacttctccaacagctccaatttggagacacctagggcactaagcttatttgtgataatcaagccgctcttcacattgcatctaatccgcttaacgggggatgttaaagatatggagcattttctgcatttaaaaaaccccactctcacactcttggcatcatcaaagcgaccagcagcacctgcacccccattaactctcacaacaccactactcccacatgaaaacatttcaaaccagcatgatacaacaccaaaacaagacaaacttatagaagcaaaggagagaacaacttcacaagcactcaacccaaaagcaaagaagaaagcagaagcaaaaagagaaaccaaacaacagaagtaa

SEQ ID NO: 22214 - DNA, 729 bp, Glycine max
  Peptide Sequence Number=SeqID_138992
atgattgagcccattggcggcaaatcgacacctctttatgtagtgtcctttggttctctattgattcaagctttgtaccaagcatttgacacgtgttataaggcttggagcaaagccaagaaagtctactccaatgatgttcatcatctctatagtgagataaccactatgttgtccaccaaacttgagaatgtggatatatggacatatcttgctcttgctgctctcctaaatgaccttcattcgatgcgtaaccagattctatcggcccctactgttcctacttatgacatggttagtgaacaattactgcatctctccacttcgcatgtttttgatcattcctctacctctgcctcttctgcggattccttcacccttgtctcacactcatctcctggcaaaaggtatggggaggtggctgaggtcgtggtgggaagaatcgatgttgcaattattgtcaaatttatgtgtcaaacagcccaacaatctgcctcgactgttactgtcacgactcagtctggtaatcctatagcctttgtctctcaatcatcctcacttggaccttggatacttgactctagtgcctctgatcatatgaccgataacaatcttttttctctcaattgtcattatcagattctttgccttttgttactctcacaaatggctcttagattaaacttcgtggcattggtcaaacccacccccttcctaacctccctttga

SEQ ID NO: 22215 - DNA, 231 bp, Glycine max
  Peptide Sequence Number=SeqID_138993
atggccaattggttgcttagcaaggatggcaacacattagcatacaacattggtattggggtgaactctccaggttttctttctgggaattggtattggggtgaactctccgggttttctttttgggaagttcctccttggggaatggattttgtgggtgatgttggggaagtctttgtggttgagtgggcattctctattggatgggcgtcggacagagagaagatctaa

SEQ ID NO: 22216 - DNA, 393 bp, Glycine max
  Peptide Sequence Number=SeqID_138994
atgtacgacaacctgaaaagcttaggtatcagcaatcctgaagacattgaccgctacagcctgcgtcaggaagccaacaacgacatcctgaaaatctacttccgcaaagacaagggcgagttcttcgccaaaagcgtgaagtttaaatacccgcgtcagcgcaaaaccgtggtggccgatcacaccacccagggttataaagagattcaggaaatcagccctaatctgcgttacgtgatcgacgaactggatcagatctgccagcgcgatcaggtagaagtggatctgaagcgcaaaatcctcgccgatctgcgccatctggagaacgtggtgtcgaacaaaatcgcggaaatcgaatccgatctcgatcagctgacccgcaacggtcgctaa

SEQ ID NO: 22217 - DNA, 1245 bp, Glycine max
  Peptide Sequence Number=SeqID_138995
atgctgctgcgccctcagtcatctgtgccttcccagtgtgaccgctgccgcaattccggtaatcaccctgcggctatgtgcagttgcacaatgccaggggcaatcgggatgcgtattctgtcggatatcgttgcccgcaccatgaaaattatcgacagtaatgtcaatgtgatggatgcgcgcggccgcattattggcagtggcgatcgcgagcgtattggcgaattgcacgagggcgcgctgctggtgctgtcacagggcagggtggttgatattgacgaagcggtagctaaacacctgcacggcgtgcggccgggcatcaatttgccgctgcgcattgatggcgacatcgtcggcgtgattggcctcaccggccagcccagcacgttacgccattacggcgagctggtgtgcatgacggcagagatgatgctggaacaggcgcgcctgctgcatatgctggcgcaggacagtcgcctgcgtgaggagctggtgctgaacctgatccgcagcgatacgctgtcgtcagcgctgaacgaatgggcgcagcgactgggcatcgatctcaatcagccgcgcgtggtggcggtggtggaagtggacagcggacagctgggggtcgacagcgcaatgtcggagctgcagcaattacagacgctgctgaccacgcccgatcgcgacaacctgatcgccattgtttcgctcaccgaaatggtggtgctgaagccagcgctgaatgcccatggccgttacgatcaggacgatcatcgccgccgcgtcgatcaactgctgcagcgcatgaaagagagcggtcaggtgcggatgcgcatcgcgctcggcaatttctttaccgggcccggcagcattgcgcgctcttaccgcaccgcccgcaccaccatgatggtgggcaaacagcgcatgccgcagcagcggagcttcttctatcaggatctggtgctgccagtgctgctggatagcctgcgcggcggctggcaggccagcgagctggcacgtccgctggcaaagctgaaaagtatggacaataacggtttgctgcggcgcacgctggttgcgtggttcagtcataacgtgcagccgagcgccacagcgcgtgcgctgtttattcatcgtaatacgctggagtaccgcctgaaccgcatctcggaactgaccggcctcaacctggcgaactttgacgatcggctgctgctgtatgtggcgctgcagcttgatgagcaggcataa

SEQ ID NO: 22218 - DNA, 183 bp, Glycine max
  Peptide Sequence Number=SeqID_138996
atgacttatcaaggtaaaacttgtggcgtctaccctgacttatcttccttcaccggaagtggcatctaccctgacttatcttccgtcattggaagaggtgtcaaccaaatctctgtagcctgtatcaaacgatccgctcctagtcaggttcgcatcatctggtatcagagcttcggctcttga

SEQ ID NO: 22219 - DNA, 159 bp, Glycine max
  Peptide Sequence Number=SeqID_138997
atggaggagacaatggcgcgtgaacggaggagagagagagagagcactgacatgaacggaagagagacaaaccagaatagcgcgagagagcagcaacaatatcagaaggttagttttcataacatcatcagcatgctttcaaacttgagaaaattgtaa

SEQ ID NO: 22220 - DNA, 765 bp, Glycine max
  Peptide Sequence Number=SeqID_138998
atggggggcgtttgttctaggaagagagatcagcatgttgttgaagatgatttacacagaggagtctcggggaggtattgtagaagtggcagcacaaaatggttgagggccagaagtttgcgtgctaagcccaatcattgtgcaggagggggaacatgcccctctctcatggatctgtgcataaagaagatgcgtgaggattttcataaatacaattccttttcaattcttccgagagacataagccagcaaatcttcaatgaattggttgattctcactgcctgaccgaagtgtctcttgaagccttcagagattgtgctcttcaggatattgacctgggtgaatatgttggagttaacgatgattggatggatgtcatctcttcccaagggttgtccttactttcagttgatgttgctggttctcaggtgacagatgatggattgcgactcctaaaggattgctcaagtcttcaagcattgactctcagttactgtgaccaattttcagaatatgggcttaagcacattagtggtctttcaaacttgacttccttgagtatcaggaagagcagctctgtcaaacccgatggaatgcgtgctttctccaacttatttaatttggagaagttggaccttgagaggtgttcagagattcatggtggatttgttcatcttaaagttaggtatggatggctgattggcttgcctgacatatggggtgtttggtggggtgttggtcccccagtaggctaccaaaaccat

SEQ ID NO: 22221 - DNA, 1734 bp, Glycine max
  Peptide Sequence Number=SeqID_138999
atgaaaaaatcaagtctttttccatctgggaatttccttttccttttccttcttcttcttctcaatgtctctgcttcgttggcagcaccaacaccagaatcggtgtacacctccttcctccagtgtctcacaaactacacaaaatcacctgaccaagtttccaacatagtatttgctcaaaccaacgcttccttttcttcagttctccaagcctacatacgcaatgcccgattcaacacaacttcaaccccaaaacccttgcttgttgtcactccctcggaagaaccccatgtccaaggtgcagtaatttgcgccaaaagcattgcgattcaactcaagatcagaagtggtggccatgactatgagggtatctcgtatgtctccgaccaaccctttatcatcctcgacatgttccacttcaggaacatcactgtggatattgaaaacgaggttgctgtggttcaagcaggtgccacacttggggaactttattataggatttgggaaaagagtaaagttcatggctttcctgcaggggtgtgtcccactgttggtgttggtggacacttgagtggaggagggtatggtaacatgttgagaaaacatgggttgtctgttgatcatgttgttgatgctaaaattgttgatgccaaaggtaggattcttgacaaggaatccatgggggaggatcttttctgggctattagaggaggtggaggagcaagttttggagtcattttatcatacaatgttaaacttgttcctgtacctgaagttgttagtgtttttcggattgcgaagagtttggatcagaatgagagtgccactgagcttgtgttgcaatggcagcaggtggcgccgcacaccgatgacaggctcttcatgaggctgctgttgcagccagtgagttccaaggttgtgaagggccagaggaccatcagagccactgtcatggctttgtttcttggaggggctgatgaggttgccacattgatggggaaggagtttcctgctcttggcctcagcaaggagaattgcactgaattgagttggattgattctgtgctttggtggggtaatttcgacaataccactaagcctgatgcactgcttgatagggatctcaattcagcaagtttcctcaagaggaaatctgattatgtgcagaaaccaattcccaaaaaggggttggaggggatatgggagaagatgattgaattggggaaaactggatttgttttcaatccttatggagggaagatgagtgaggtttcgtctgatgcgacgccatttcctcaccgtgcagggaatctgttcaagattcagtactccgtgaattgggatgatcctggagttgaattggaaaataattttactagtcaagctagaatgctgtatagttacatgaccccttttgtgtctagtagtcctagaagtgcattcttaaactacagggaccttgatattggtaccaacagttttgggaagaatagctatgcagaaggagctgtttatggagtcaagtacttcaatgacaattttgagaggttggtcaagatcaagactgaggttgatccagaaaacttcttcaggaatgaacagagtattccagttcatccaagattggacagtgaagccattaaatctggtgcaggcaaattgttacacttaaccctttattggacactgatggtgttaatcgaggtttcttggataatccagcagaaagaataa

SEQ ID NO: 22222 - DNA, 646 bp, Glycine max
  Peptide Sequence Number=SeqID_139000
gacaattgataaattcgacagttacttggtcagtagtggttatataccatttaattcatcagttactcggttgtttttttgcaattactttccccgatatcacaagttggccggaacatttcagaacttggccatagctcaacacaactcagatggaacatgtgcccactatggcaccaaggaaattgtttcctttgaccatgagatggtagcaacaaggagagacgatatcaggttatatgcacgctccacccaggtggagacatcaacaatacaagaaatcagagcacaaatgaaacaattacgcaataaaattgaggctaacttaaaggtctcgaggcaaaagcatgaagcagacatgcggcggttaagggaggagaacgcgaacatcagggcaagacatgtcatccatcatccacctccaccacccccatcactactaaccccaccacactctccatcctttcaagcacccatccatgctcaaacgagaaatcaggaaaaccatactctgctctcctcctatagtaatcgggaggaaaccccaatccactccaaacttaggtcccttaatatccataatgatgtcattcacttgcactcatttgtcgatgacatcatagacatacctctacccataacctag

SEQ ID NO: 22223 - DNA, 1044 bp, Glycine max
  Peptide Sequence Number=SeqID_139001
atgcggcactcgctggtcacgctgtttcagcaatcgccccacaccgccggcacgctgcgcgatcgcctgtgcggcgcactgcggcaggccatccatcaaggggcattgaacgttgggcaacgcctgccttccagccgggtgctggccagcgatctgagcctctcgcgagtgaccgtcgaagcggcctacggtcagttggaggcggagggatatctacagcgtcgcgtcggccagggcacctttgtggcgattaccatcgccaaatcgccgccgccggcaagcggctccggcatgccgcgcctttcgcagcgcggccaacagatcgtgcaaaccggcggctgccgcgatccgcagcagccacaggcgttcgccgccggttcaccggacctgcgcgcgtttccgctggccttgtggaagcagctgaccgcacagcgcctgcggctacagggagaaagcttgctgcgctacggcgacccgcagggctatttaccgctgcgtgaggcgattgccgcccacgtcaaccaaacgcgcggcgtggtctgcgatgcacggcaggttatcgtgctgaccagttcgcagcaggcgctgcagctgatcgccacgttgctgctggaccgcggcgatagcgtctggatggaagagccgggttacaccggggcaagaaacgcctttatcagcgccggcgccgccctgacgccggtcgcggtggacggcgacggcctgcgtgctgaatcctccttgccggacccacgtttgatttatctgaccccctcacaccaatatccgaccggcgccgcgctcagcctggcgcgccgattggcgttgctggcgctggcagagcggcaacaggcctggatcatcgaggacgattacgacagcgagtttcattacgacggcctaccgataccggcgatgcagggcctggatcgccgtgggcgggtgctgtacctaggcaccttctccaagtcgctgttcccttcactgcggttggcgtatctgatcgccccgcccgcgctggttgaagcgttcgtcaccgcgcgtacg

SEQ ID NO: 22224 - DNA, 1584 bp, Glycine max
  Peptide Sequence Number=SeqID_139002
atggccacttcaatggtaaaattagctttcctttctatcacagttttcatttcaattttcccttcagcctctacttctgctggccacgataaaggtttccttcaatgttttcaaacaatgttaggagttgacaacacaacttcaggagtaatattcaccaaaactagttcttcttatgaacccattttgaagtcttctataagaaacgccagattcctagacacttcagtcccgaagccaaacctcattgttactccacataacctattccacatccaagtagcactgttttgctcaaagaaaagtggcttacaagtaagaattcgaagtgggggccatgactatgaaggcctttcatatgtctctcacgttccattcataatcattgatcttttcaaccttaggtccataaccattaacatggacgaagaaactgcatgggttgagtcaggtgcaacacttggagaactctattatgcaattgaaaagaaaagtgaggttcatggtttcccagctggaagttgctccactgttggtgttggagggcatttgagtggaggtgggtttggtacaattttcagaaaatacggcttagcttctgataatataattgatgctcaaattataaatgttaatgggaagatactgaacagaacactgatgggagaagatctcttttgggccataagaggaggaggagggtctagctttggagtcattactgcatggaaaatcaagcttgtacctgttccttcaaaagtcgcaacttttgatgtttcaaggacccttgatcaaggtgccactacccttttccacaagtggcaaactattgctcccaaacttcctaaagaacttttcttgcacactgttgtgggagttaccaattcagcttctgaagaaggtggaaaaactgtggtggtttccttctcgggattgtatcttgggacaccagagaatctccttcctttgatgcaaaacagttttgcagaattaggtttgcggcgcgacaacttcaccgagatgacttggattcaatctggtctttactttgcaggcttttcaaaagatgagtccttggaggtcttgcttaggagaaatccaacatctccatctttcaaagcaaaatctgattatgtgaaggaaccaattccgttgcatggcttagaagggctatggaagatgctactcttggagaacccaccaccgtttatcttcacaccatatggtggaataatgagtgagatttcagaatcagaaactccgtttccacacagaaaagggaacttatatggtatccagtattcggtgaatttggtttctaatgaagaagcgccaaagcatatagaatggttgagaagactgcatgcatatttggcgccgtatgtgtcaaagtttccaagacaagcatacctaaattatagagaccttgatttgggtgtgaacagagggaactcgagctatgaaaatggaaaatcttggggtttgaaatatttcaattgcaattttgaaaggctggcacgagtgaaggcagaagttgatcctggaaattttttcagggatgagcagagcattcctccattgtag

SEQ ID NO: 22225 - DNA, 1590 bp, Glycine max
  Peptide Sequence Number=SeqID_139003
atggctaattcaatggtaaacctagttttcctttctctcacccttttcatttcaattttccctgcaacttctacttttgctggccaccagaaaggtttccttcaatgttttcaaacaatgttaggagttgacaacacaacttcaggagtaatattcaccaaaactagttcttcttatgaacccattttggagtcttctataagaaacgccagattccttaacagttcagccccaaaaccaaaccttattgttacaccacatagcctattccacatccaagtagcactcttttgctcaaagaaaagtggcttacaagtaagaattcgaagtgggggccatgactatgagggcctttcttatgtctctcattctcacattccattcttgatcattgatcttgtcaaccttaggtctataaccattaacatggacgaagaaactgcatgggtacaatcaggtgctacagttggagaactctattatgcaattgcaaagaaaagtaaggtccatggtttcccagctggaagttgttccactattggtattggagggcacttgagtggaggtgggtttggtacaattttcagaaaatatggcttaggttctgataatgtaattgatgctcagattatagatgttaacgggaagatactgaacagaacactgatgggagaagatctcttttgggccataagaggaggaggagggtctagctttggagtcattactgcatggaaaatcaaacttgtacctgttccttcaaaagtcacaacttttgatgtttcaaggacccttgatcaaggtgccactacccttttccacaaatggcaaactatcgctcccaaacttccaaaagaacttttcttgcacactgttgtgggagttaccaattcagcttctcaagaaggtggaaaaactgtggtggtttccttctccggactgtatcttgggacacctgagaatctccttactttgatgcaaaacagttttgcagaattaggtttgcggcgcgacaacttcaccgagatgacttggattcaatccgttcttcactatgcaggcttttcaattgatgaatccttggagatcctgctcaggagaaaccattcacctccatctttcaaagcaaaatctgattatgtgaaggaaccgattccgttacgtggcttagaagggctgtggaagatgctactcttggataactcaccactgttgatcctcacaccatatggtggaataatgagtgagatttcagaatcagaaactccgtttccacacagaaaagggaacttatatggtatccagtatatggtgaattttgcttcaaatgaagatgcgccaaagcatatagattggataagaagattgtatgcatatatgacaccttatgtgtcaaagtttccaagacgagcatatttgaattatagagaccttgatttgggagccaaccaagggaaaccgtggtatgaaaaagcaaaatcttggggtttgaaatatttcaattgcaattttgaaaggctggcactagtgaaggccagggttgatcctggaaattttttcagggatgagcagagcattcctccattgtag

SEQ ID NO: 22226 - DNA, 180 bp, Glycine max
  Peptide Sequence Number=SeqID_139004
atggaggcttggatgtgggacacgtgtgttggtgcaacaatgaaggtgactgcagagattggacgagaagggtcagaatggagagagaggcattggagaatggtctctgaggttgccgttagaacatggagcagaaagattgagacaaagggtaggatcacagacatggttttggattga

SEQ ID NO: 22227 - DNA, 1650 bp, Glycine max
  Peptide Sequence Number=SeqID_139005
atgtcacaaaccccatttgtgattgtggacatgttcatgctgaaatcagtggaggtcgacgtcgaggaccagacagcgtgggttgactcggggtcaacgattggtgagctttactatgctattgctgagaagagtagggtcctaggtttccctgctggtgtgtgtcacagtgttggtgttggagggcatttcagtggaggagggtatgggaacatgatgagaaggtttggtctctcagtggataatgttttggatgccctaattgtggattctgaaggaagagtcttggatagggcaacaatgggtgaagatcttttctgggccattagaggaggtggtggtgctagctttggggttattgtttcatggaaaattaggttagttcctgtgcctgaggttgtcacggttttcagaattgaaaaaacattggaacaagatgccagtgatcttgtttttcagtggcagtatgttgctgataagatacacgatggcttgttcattagggtggttcttagtcccgtgacgagatcggatcggaagacaataaaggccaagttcaatgccttgtttcttggaaattcacaagagcttctttctgtgatgaatcaaagtttccctcaactgggtttggttgccgaacagtgcattcaaatgagttggattcagtcggtgttgttttgggataactatccggtggggacttcggttgatgttttgcttcaaagacatgcaacaaaagagaaattcttgaagaagaaatcagattatgtgcagcaacctatctccaaagctgcccttgaaggtatatggaagatgatgatggaactagaaaagcctgttttcacattcaacccctatggtgggaaaatgggtgagatttctgagttcgaaacaccgtttccacatagatttggtaacatatttaaaattcagtactctgtgagttgggatgaggagggtgaagatgttgctaaacaatatttatatcagattcggaggctatatgattacatgactccttatgtgtcatactcacctagaagttcatatctgaactatagagatgttgatataggcgtcaatggccctggaaatgctacttatgcacaggctagtgtttggggtaggaagtatttcaagagaaattttgataggctggtgcagaaaagaagaagccttgaaggcttgaagagtgctaactcgtctcactctcatgtatctccacactatgcgcctcctgaaaccgagtcactactcaaccattgttaccaaagagaccttccccgagccatgcatgtgttggatgccatggaaagacgcggagtctgggccgacgctatttcctattctgagctcatcaagtgttgcttggctcatggtgctgtcagggaacgaaaacgcgttcaccgccacatattctcaaatgggcatcacccaaaaacatttttgaccaactctctcatcaacatgtcaaattcaacctcttggaagaagcgcagggttggtgtcgtgcctaacatgtttactttctcttcggttctgagggcgtgtgagagtttgtctgatctcaaacagctgcattctttgataatgaaagtggggttggagtctgatgtatttgttcgcagtgcgcttattgatgtttactag

SEQ ID NO: 22228 - DNA, 744 bp, Glycine max
  Peptide Sequence Number=SeqID_139006
atgttgaaaattatcaggctggcctgcgcttgcctgtttatgctgtggctacctgccttgcaggcggcggacagcggctggctgcaaaatccggccaacgatcatgccaaggtgcggctgcgcgccgacacgtcacagccgggggagacccgcctgctgctgtcggtcgagctgcaaaagggctggaaaacctactggcgttcccctggcgaaggcggcatcgcgccggctatcgtctggcagggcaatccaccgccggcgacctggcactggccgacgccgcagcgtttcgaggtggccggcatttctacccagggctatcacgatcgggtcacgctgcctatcgtgatgtcaggccaggtagccggcccgctggcgggcaccctgacgctatccacctgcagcaacgtctgcattctgaccgactacccgttcagcctggatctgacgacgccgaacgatccgcagtttaaccacgacttcgcgcaggcgatggggcaggtaccgatcgccgccggggtagcggagagcgtcaaggccggttacctcaacggcgagctgcagattgccgccgaacgcgccgccggctggcagcagcccgcgctgttcttcgatacgctggcggatgccgatctcggtaaacctcaagtcgagactgacggcgctcaactgttggcgcgggtgccggtcagcgacggttggggcgatgcggcgccggatctgcgcggcaaaacgctgacgctg

SEQ ID NO: 22229 - DNA, 604 bp, Glycine max
  Peptide Sequence Number=SeqID_139007
atggcgcggggaggaggaatgcgcaggcgcgcggcgatggtcggcgccaacagcgccagcagcagacccagcccgaacagcacggtttcgaacatcatcggcggcgcggccagcaatgacttggcgctcagctcacagggcgtcggctgcgcttcggcggcggtatcaccggaccgaacggcagtggccgccgggatccccagcgtttgctgcagcgcatgcaggcccgccatgcgctgggtcatgcacgtcagcaccaccaggcaagccaggcataaaaaccattttgcaatccgctgccgtttaaccatgccatcctcacgttcgggtatcatagtgggtaagcctgtgcttttcgccgggtacgatgatgattctctcctccaggcattctgcggggatacacagcgaaggactggtgatatgcaacctttgagtgggccgggcaccccaatcgccggcgaacgccctccctccccgggcaaaacggcggccactgacgatcaacccctctctccggcgcagcgcacgacgctggaaaagctgatcgtgaaaatcatgacgctcagcccggcaaagccggcggagatctgggcgactctgc

SEQ ID NO: 22230 - DNA, 1992 bp, Glycine max
  Peptide Sequence Number=SeqID_139008
atgtccggccctctcgaccgtttcgcaagaccctgttttgaaggtttctccgggagtgatgagaagaaagaaaggagatctgattttgagaactccgaagatgaaagaagaacgagaattggatctctgaagaagaaagcgcttaacgcgtcctccaagttcaagcattcgctcaagaaaaagagcagcagaagaaaaagcgatggccgtgttagctctgtttcgatcgaagatgttcggaacttcgaggagcagcaggccgttgatgcatttcgccaagccttgatcatggaagaattgcttcctgaaaaacacgatgattaccacgtcatgttaaggttcctgaaagcaaggaagtttgatattgaaagagcaaagcatatgtgggctgatatgctacaatggaggaaggagtttggtactgacactattatggaggattttgagttcaaagaagtagatgaagttgtgaagtattatccacatggccatcatggtgttgataaggagggaaggcctgtttacattgagagacttgggaaagtggatccgaacaaacttatgcaggttacgaccatggatagatatgtaaaataccatgtgcaggagtttgagaaagcttttaagataaagtttcctgcttgcacaattgccgccaaaagacacattgattcaagcaccacgatactagatgttcaaggcgtgggcctcaagaactttacaaagtctgctcgggatctcattatgcggttacaaaagattgatggtgacaattaccctgagactctctgccaaatgtttatcataaatgctggccctggatttaggttgctatggaacactgtcaagtctttccttgatcccaagacaacttcaaagattcatgttctcggaaacaagtaccaaagcaaattgtttgaaataattgatgccagtgagttgccagaatttctgggaggtacctgtacctgtgcagatcagggtggttgcctcagatctgataaaggaccctggaaaaaccctgaaattttgaagatgattctcagtggtgaagcacggcgagcaaggccagtagtaaaagttctaaacagtgaagggaaggttattgcctatgccagaccacaatatccaatggtaaaaggcagtgacacatccacagctgaatcagggtcagaagctgaagatatagcttctccaaaagtgacgaagagctactcacacctgaggttgacacctgttcgggaggaagctaaggtagttggaaagtcgagctctgctggtggtggtaacttagctgggtatgatgaatatgtaccaatggtggacaaagctgttgatgctgcctggaagaaccaagcatcactccagaggtctcaaacttcaaaaggaaaacctcccctccctgacactcctaacccccctgaagggattcgagctcggattgtggtagctctaactgtcttctttatgacgctgtttactctcttccattcattcgcatgccgtgtgaccaagaaacttcctgccgtatcatctaatgatgatcagggcacttcagagcctactcttgatataacaaaaataaacaatgatgactatcgtcctccttcaccaactccagcatatgcagaggcaaatctcctttcctcaatgatgaaaaggttaggtgagcttgaagtgaaggttgacacactccaatctaagccatctgagatgccttatgagaaagaagaattgctaaatgctgctgtatgtcgggtggatgctttggaagcagagttaattgcaactaaaaaggctctttatgaagcactaatgaggcaagaagagctgcttgcttacattgatagtcaagaagaagctaggttacgggtaagtttgtcttttgtatcttctgaacatcattgcaaacttagaaagagactctgggagagggtgttttcaaatcatggagtttctagtgctgaccttgctcatgatgttaaactctga

SEQ ID NO: 22231 - DNA, 249 bp, Glycine max
  Peptide Sequence Number=SeqID_139009
atgtggattttagcatctcaatttagcatcaatctcaacatcgacgctgctaatgttaattgcattgacacaaatctaacgcaaaggcttaaaaatattttcttcttagaaaatgaaacttgtcaccaaaccaacgctaactttgctcaatgccaaggccaagtcattcgtgcgtgggtcaagtccaaccctaatatcgatatttacgacccatctaatccaggcttcatattatcagtggaccagtga

SEQ ID NO: 22232 - DNA, 603 bp, Glycine max
  Peptide Sequence Number=SeqID_139010
atgggcatttaccgaagtgcaaagaaactgaagtatcacaaggaatacgcaaacgctaactcaacaattcaagcactcgcaaactgcgatgcatcattttttaaagaaatacagaatgatgggaatttaaagtcgctcatcccttcgttagatatatccatgttaaaaaccaccggaaaattatcgttcccgaccacatttacatccccggaaggcattgaggttaatagttttattgttacttataccgactttgataaatacaaagaaattagcacatttgatgtgaaaggccaattctactattggggatttgagtcccttcaatcctttaatgagattgtgaaaattctatcccagaaaatcaacctagttaaaattggaaatatttacacctacaacccaatgatacgaaacaccgttgatggccaatggatggctaataactcagccgttgacggtgtagcaccagaagagaactcagcagaaaaattgtttataatagaagacaataaagagaaaggtgttgtgagtatcatgtgtacattacaaggggaaattactgacaaagacttatatcttactgggttattgaaaaaatga

SEQ ID NO: 22233 - DNA, 372 bp, Glycine max
  Peptide Sequence Number=SeqID_139011
atggttattctgcgtcttttgtcatccagaggcggcgggcccgatgacatgcggagacaaactatggtcattctgcttaccttttgccatctagacagagtcgtgttcgatggcacgcagagacaaattatggtcattctgcgtcttttgtcatccagaggcggcgggcctgatgacatgcgggaaccatttggtaccgcactttttcaccttttgtcatccagaggcggcgggcccgatgacatgcgggaaccatttggttccgcactttttcaccttttgtcatccagaggcggcgggccaatgacatgcgggaacaatttggtcacgcactttttcaccttttgtcatccagaggcggcggcccgatga

SEQ ID NO: 22234 - DNA, 695 bp, Glycine max
  Peptide Sequence Number=SeqID_139012
gtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagactttcaagaagtttttgaagatttctcttgatgaaaactataacctgcatccttttgagttcaaccattcccacttctgcaccatggggtttgttacctggtgggaaaaatattattcgacccgttcagttggagacactactatcatgatctccaggcttgagagtggttttacacaaccaacggtcgagaatattcgctcaaaccttcaagctcgaggcaaaacaatcatgacgaagaaaagtgctgaaacgtctcgagctgatgtgagacccaagaaacctactggggtgaaaatacaagaagggaaacaagaagaaaagattcaaaagaaagatgacagtactgagactaccacgacttccaaacgctcgaagcatgcaggcgtcgaattagatgaagagaaagatgcaagttttatttctaatgtcaatattatagctttctttcaagtctatactctgacaattctttaccctcgtaatacaggaagaagaggaaagaccactcataagaaaaagaaagttacctacgacttcgaccaagtctgctga

SEQ ID NO: 22235 - DNA, 279 bp, Glycine max
  Peptide Sequence Number=SeqID_139013
atgagcgagaaccacacgggaaccaccatagtagagaaagagaaattgacggacaagaaagacataaagggtctaataaagccaatttccaactcaccaaccatgaaaagctctgcatgcatgaggttgttcagtgcaagcttgccacgtttcagcatgagatggaactacgccattattttgctcttggctatgccctttctcaacatgaagaacaacatgcgtaccatgttccataccttctttgccaccaccatcagtagtgcttgttttctttga

SEQ ID NO: 22236 - DNA, 1128 bp, Glycine max
  Peptide Sequence Number=SeqID_139014
gtatggaatccacgtgcaaataaagagtgctttgctccttctgctcttgaaattctaggaatcatagaagactctctggaagcgttctttctgttgccaatacccatgcatgcagctttgcttcctgaattgatgtctgctcttgataaatctctccaacaataccttttgaaggccaaatctggctgtgggaaccgcaatactttcatcccaatcatgccagctttgactcggtgttcggcaagatcaaaatttcatgatgttttcaggaaaaaagaaaagtcacaagcgactgatcagagaaggatatttcatcatggaactacaaacgtagacagctcatttggattaccccagttttgtgttcgcataaataccatgcagcgcattggcatgggactaaaggttttggaaaagaggacagttgcccgtcttgggaattctaaatcaacaaaagaggatggtatagagaaggggttgaagttcaagctttctaaagctgcatctgtggaaggtatccgtcaactctccgaggccatggcatacaaagtgattttccaggatctgcgttatgttctttgggatggcctgtatgttggtgaagtttcatccacgagaattgagccttttcttgaggagcttaaccaatgcttgaagattatattgtctacggtgcatgatagagtcctaacgcatgtaattactgaggtgatgaaggcttcttttgatgggttcttgttggttttgttagctgggggtccagcacgtgctttctcccttgaagaccatgttataatagaggaagactttaagcttctgactgatttgttctggtccaatggagagggtttacctgctgatctgatagaaaagcattgtaccactgttaaagaagtgcttcccctgttccgcatggatactgaggacttgactgagctattcagtgagcttattctgggaatgtatggctcttcagccaagttccacttgccattgcccacaacatctggtcattggagtccaagagaaccaaacactcttctgcgaattttgtgtcatcgaagcgatgacgcagcagctaagttccttaaaaagaactacaacttgcccaagaagtctaaccgctaa

SEQ ID NO: 22237 - DNA, 969 bp, Glycine max
  misc_feature (96)..(96): n is a, c, g, or t
  Peptide Sequence Number=SeqID_139015
atgcagaagaatggagtatcaatcttttggaagagtcccgagaccaaaaggtcaagcactcaagaaacaatacagagaactatagcgatcaaaccnaagcttgatgaaggacatggagttattttgttggggcgaaaagggatgccatcacggttagatcaaatggattttcctgactcaggaaatgtagattttgcaggagaagctaaagagtcaagtagtggcagggatgatgagtctgatggagccaaggaagataaggctgaagaagagtttggacatatcaatgagatattcggcagaggaaaagaagtggaacttgaaccagaaagtactcaacctgaggaatcatccaaaattcaacacaaacatttgtgcaaaacaaaatctgaaaaggttggtttagaatcaagaagtgagtcaggtcacaaggagcatggcaatgagaaataccgaaacagaccgataataaatgattctaaaagtagcaacaaagaagaagatgtacaactcagggaacagctaaatgaagtgcatgttagaaagaatgctacatcaggtttctcaaaaaaggagaatgatggggatgaagggtccagaattagagaaaaggaaaccaggaagcacaaaaatgtggccgagaatgacacaaatgctgaagtgacagaggaaatagatgaggtccaaagctttcatgatgaaaatggtgtcccacctgatgttaatgaaactgaaatagtgtttgcccaggcacacatcgtgcatgaagaaaacatttcaaatgttcgcaaaggaagttggcttagaaaacacacttatgaagtcacatatgttgaagataacattgttgaagtgaatttggaagcatcgaagaacgatgctgatgttgaaagtaatacagaaagtattgctcatgtcgacatttcaggcgtcaaatgcaattcagaaatcagtgagggaaatagctag

SEQ ID NO: 22238 - DNA, 489 bp, Glycine max
  Peptide Sequence Number=SeqID_139016
atgggtcgtcgtaagattgagattacggaggtgaaggactccaacaccaagcaagttacattttccaagcgtcggacagaagttgctattgttgtgttctctcctgggaacaacccttactcttttgggcacccaagtgttgatgtcgttgtagacaagttccttaaacaagagccgaaatcaaatgttgtccaaggaacatctaatgaagctggtgacattgataggctgaatcaacaactatctaatgttgaagatcaaatacgcgaggaacaaaagaaggctgcagaactcaacgagagaatgaaacaaaaaggagtgacacaaacttttcaaaacaaagaattgcaaggttcatatttagagatccaaaagatgaaggactattttgatgcaatcgaggtgtcagattatatgttgctccttgcaaaagaaccactagttggaataaccaaacaagttgctactaagaaaagaagaaggaattga

SEQ ID NO: 22239 - DNA, 1248 bp, Glycine max
  Peptide Sequence Number=SeqID_139017
atggttctgccgctagagctaatacaacagctcaagtgctcagattttcctagtgaacaagagtacgaggcttggctaaggaggaatttgaaggttctcgaagcaggactcctcttgcatcctcgcctgccattggataaggcagatactagtgcactgcgcctgcaacagataatccatgaaggccttgagaagcctatggacattggaaaagacagtgaatcaatgcttgcacttcgcagtgttgttatgtctcttgcttggaggtcatttgacgggtctgttcccgatacatgccattgggctgatgggtttccactgaaccttagaatctaccaaactctgttagaagcatgtttcgataatcatgatgaaacctgtgtgatacaagaggttgacgaggtcttggagctcattaagacgacctgggctatgcttggagtgaatgagatgctgcatgatgtttgtttttcctgggtcttatttcaacggtatgttgccaatggtcaagtggataacgatcttttgtttgcatcgagtaatctgctggcagaagttgagaaagatgccaaggcgatgaaggatccgttttacgcaaaatccttgagctacgcattgaatttgatgttaagttgggcagaagaaagactccttgcataccatgatactttccataatggtaacattgaatcaatgcagagtgttgtttctcttgcagtatcgtcagcaaaaatattggcaggagatatctctcttgagtgtaataaagaagctgataaattggagaaactggatccccgcaacagcaagcatgtacctagacaacaggataaagtctttccaactctctccgttcttgcacgagacatcagcgaactggcttttaatgagaaggcaacatttagtcccatactgaagaggtggcatccacttgcggctggtgttgctgttgctacccttcatgtttgttatggtcatgaggtgaagcaatacgtcaagagtgttacagagttgactcctgatgctgtagaaatgctgatggctgctgacaaattggagaaagatctggtacagatagcagtggaagattcagttgacagtgaagatggtggaaaatctgttataagggagatgtacccttatgaggctgaagctctaattatcaatctggtcaagtcatggatcaagaccagagtggaaggactggaggagtgtgttgacagaaatctacaagaagagagaatttga

SEQ ID NO: 22240 - DNA, 169 bp, Glycine max
  Peptide Sequence Number=SeqID_139018
atgcacgagcacgctgtggagttcgaggaccttcctttccccttcgctccaaacttatcggaatcggagatccgggaaacggcctatgagatgctcgtgggggcttgccggagttcggggccgaagccgttaacgttcttctctcactctgagcagtctaaccgaggag

SEQ ID NO: 22241 - DNA, 1185 bp, Glycine max
  Peptide Sequence Number=SeqID_139019
atggaagagaggaggatgcttggatgttgtttggtgacatgctacgtagaaatgttaaaacctgacagttacaccatttctagcatggttagctcttgtgccaagctagcttccttgtatcatggtcaagttgtccatggaaaagtagttgtaatgggtattgataatagcatgctcatgtcaagtgctcttgttgatatgtactgcaagtgtggagtcactttggatgctcgggtcatttttgaaactatgcctattcggaatgtgatcacttggaatgccttgattctggggtatgcacaaaatggacaggttctagaggccttgactctgtatgaaagaatgcaacaacaaaatttcaaacctgataatattacttttgtgggtgtcttatctgcttgtatcaatgctgatatggtaaaagaagtacagaagtattttgattcaatcagtgaacaaggaagcgcacccacattggatcactatgcttgtatgatcactctccttggtcggtcaggtagtgttgataaagcagtggatctaatccaaggtatgcctcatgaaccaaattgccgtatctggtccaccttactatctgtttgtgccaaaggtgacctaaagaatgcagaattggcagccagtcgtctctttgagttggatccacgtaatgctggaccttatatcatgctttccaacttgtatgctgcttgtgggagatggaaagatgtagctgttgtaagatttctcatgaaggaaaagaatgcaaagaaatttgctgcttacagttgggttgaggttgggaacaaagtccacagatttgtttcagaagatcactctcatccagaagtggggaaaatctatggtgaattgaacagattgatctcaatattgcaacaaattgggtataatctagatacaaacattgtcctacacaatgcgggggaggaagaaaagtttagatccatttcttaccacagtaagaaacttgctcttgcatttgccttaattagaaagcccaatggagttgcaccaatacggatcataaagaatatacgagtctgtgatgactgccatgtgtttatgaagtttgcatcaattactatatcacgaccaatcattatgagagattcaaacaggtttcatcatttctttggtgcgaagtgctcttgcaatgacaattggtaa

SEQ ID NO: 22242 - DNA, 234 bp, Glycine max
  Peptide Sequence Number=SeqID_139020
atgggttacatgagatttaatttaaagaaatttttaaaagtaacaagtaaggaaagcgccattattgctggcgatttgagaccacgtgacgtcggaaacgccagcactgttggcgccacagtgaaagcgccactactattggcgattcagcctaggggattgcagagatcatttcccaggaggcttgcagcctgcgacgtgcagaggaggtgcagcagggtgtcgccaggctga

SEQ ID NO: 22243 - DNA, 195 bp, Glycine max
  Peptide Sequence Number=SeqID_139021
atggaaaccagcacgtgcaagaggggaagccttccatgcgcaagccccaacgtggttatctcgtgggtcgctgacagaatgtccaagttcagcgagaaaagagcaatgctgagtctcagtagcaaagagaacccaaatccaacgcagatgaatccggtgcacgacgatgtcaccgagcaggatgatgtctcatag

SEQ ID NO: 22244 - DNA, 1749 bp, Glycine max
  Peptide Sequence Number=SeqID_139022
atggagatacaaccagcagcagatttggatgaagaagatatttcagcagtttcatcacgactgctatcattatcatcaccatcatcattcctgttaccgtaccaaactgatgacagtaatcagaatttcacgcgcattgatcgtaaattatacgttgctgcgatgaaaggcgacttccaagaactctccaatgaacagaatttggagagtctgctcaccccaaacaaaaacaccgtccttcatatacacttgacttctacaacaagtcaaacagtttcagaagaatttgtgactaagattcttaaggagtgtggatgtctagttctactccctaacgccaagagagaaacagtccttcacatcgctgcaaggtatggacactccaatatcgctaaattattgcttgaacatgtcaaagcttttccaccttcagatattgagaaaggtattggagcagaaaagaagtttatgagggccacaaataatgagaaggacactgcattgcatgaggctgtgcgctatcatcacattgaagtagtgaagaccttgttagaaatggatcctgattactcctatgatgcaaataatgccgatgagactccgctttatctggcatcacaacgacaaaatcagcaagtggtggctgagatattaaacaaaatgaaatcaccggcatatggtggccccaataatagaacagcattgcatgctgctgtgattaaccaagatatagtaatggcaagagatcttgtgaagaataaacatgtgagaaaggctgtgaaacatgcggacaaggaaggttggattcctcttcattatgctgtgaaaacagggaatttaggtttgacgaagttgctgcttgcacaagatgggaacacagcatacatgcaagataatgagggcatgacagctcttcacatcgctgcttatgatggtgattggcttattatgaacatgataatagaatactatccagattgttctgagatagtggataaaaaaggcttgaatgttcttcattatgctgtcaatggggggagtggaactacagtggatataatcatggagaacctatcgctaagcaacctttacagtgagaaagactttgatggaaacacacccattcatcacctcaccaattccaaccttatgtgtgagagttttgtatttcaccgcagagttgacaagctggccgtcaacaaggaagctcaaacagctcttgatgttgcctattgtaagattgaagattcagatcaatcagattttagtagcatatcgataacagaggaagcaaaggagactcatcttttagtggccacactcattgcaaccgtaagttttgcagctgggattactgtaccaggaggtaccatacaagatggtgaaaataaaggtagcccagttttggtgcaaagtagttttttcaaagcattcatggtatcaaacaccatatcaatggttctggccgctactgcagtttctatatatcttttcacgccagtgactagaaataaaaggaaggaaaatgctttctctaaaacagccctcgtattcactttgatcgccttagcagcaatgatcattgcattcattacaggcacgtatgtcgtattggaatcatcccgagtaattgctgttgcaattttccttattgggttatcctcttttatgttagcatactatgtagtggccttttggcatgggtatggcaagccacttccgccaacttgtggtatctatcttaagtag

SEQ ID NO: 22245 - DNA, 759 bp, Glycine max
  Peptide Sequence Number=SeqID_139023
ggtctcagaagtttgaacaaagctgcaagggatctcatccagcgtcttcagaagattgatggtgacaactaccctgaggtcctaggtaacaaataccagagcaagttgcttgaaatcattgatgccagtgaacttccagagttcttgggtggtacttgtacctgtgcagacaaaggtggctgtatgctctcagacaagggaccatggaatgacactgaaatcatgaagatggttcaaaatggcgaaggaaaatgcaagaggaaaaccttatccgggattgaagagaaaacaatcattcaagatgaaacagcatgccaaaagttccctgtgcaactcggtgctgttccagaagtcacctttgtcccagtgattgacaagcaagttaatgcatcttgggaaaaagcggtacaaaatattcagtttgcagtttctaaagattgtttcccttgcgatgcttccaagactttaaacgggttaagaattccatttactggtgtaatcatggccattcttatgggagtgataacgatgatccgcatgacacggaacatgccagggaaagtcactgaagctgccatgtatgcacctgccaattccatggatgatcaaatgtgcctgatgaagcacatggctgagctagaagacaaggtgaatgtcctttctatgaaacctgccatgtcatctgagatggaagaattgctgaataatgctcttaacagagccagcacgctcgaacaagagttggatactaccaaaaag

SEQ ID NO: 22246 - DNA, 285 bp, Glycine max
  Peptide Sequence Number=SeqID_139024
atgtctatgtcgtccttacctattgcagatcatcgacctgttaaagatgaggatgataagaaaacaaagcttggttctttaaagaaggtagcaatcagtgcatcttcaaagttcaagcattccttgcaaaagaaggggagaaggcatagcagggttttggctgttgctattgaggatgatgttgacgcagaacagttgcaagtagttcatgcttttcgccaagcacttatcttggaagagctattacctgcaaaacatgatgatcatcataagatgttaaggtag

SEQ ID NO: 22247 - DNA, 501 bp, Glycine max
  Peptide Sequence Number=SeqID_139025
atgggcatttctaaggatgcaaaactgccctggacattacctactgaactcaaattttttgaggagatcactacaacaacatctgatccggggaagaagaatgccgttgtgatgggtaggaaaacatgggagagcatccctcctgagaacaggccacttcctggtcgccttaatgttgttctgactcgctcgggtagctttgatattgcaacagcagagaatgttcttatatgtggaagtatggcttctgctatggagctgttggcttcttctccttactgcctatcaattgagaaagtatttctcacaggaggtggagagatatttagagaggctcttaatgcacctggatgtgaagctgcccatattacagaaattgaggcaagcattgagtgtgacacttttatgcctcgagttgataccaatgtatttcagacatggtattcatctttccctttggtggaagacaacctccgctattctttcaccacttatgcgcgt

SEQ ID NO: 22248 - DNA, 606 bp, Glycine max
  Peptide Sequence Number=SeqID_139026
atggactcgttcagtttcaacaacctccaagcagagaaagccaatgcaatcctaaaacaccgcaagcttcgaagggtcgcaagcttcattcgaatcattgaagtgtgtaccattttggtcttcatttcaaggttctccatgcagctaccagtagcagtaaaaaactccagcgtgtacttcaaggacttgtcactcttcatgaacagcccccgctttgttttcctcatcggaaatgtcataatcatcgcactctttgctcagttctctgctcaaggtaacaacgttccagagcctgatctttaccaggagttcgttcagaacaccacaaaaaatcacagacacacagaaacagttgtggcagaatatagcaagaaaaaacagaggatgaaaacagggcaagtgaataatggtttgaagaaaggttatagaaggtgtgagactgagaatggaaggaaaagcattgaacccgctcctgttgaagaagtggcgcgaatttcgtgccctgaagatgggatgagcaacgaggagtttcgtcgcactgtggaggctttcattgctaggcaacagaggatgagaaaagaagaagaagattattatttaatgtga

SEQ ID NO: 22249 - DNA, 264 bp, Glycine max
  Peptide Sequence Number=SeqID_139027
atggggagcactatagatattggtgttcccttcaagcattgcttcttgttgtatgcatcccttgcttctagtagccaccaaacggaatctccacgttggtggaagtctaaaacgaatttggctgcgatggctacaaacatgaaacatcactgcacagtcgcctcaatagtctgccctttgctcctcaccctttcatatcccaatatgaaagagatattcataagcaagagagaacctcaaaatagtcgatggatcaactattaa

SEQ ID NO: 22250 - DNA, 579 bp, Glycine max
  Peptide Sequence Number=SeqID_139028
atggcatgcattggtttgacagaaagggagaagggtgacttaggacctgtttatgggtttcagtggaggcactttggagccaagtatactgacatgcatgctgactactctggccaaggatttgatcagcttttagatgttattaacaagataaagcataatcccaatgatcgaaggatcattctctcagcgtggaatccatctgatcttaaattgatggcacttccaccctgccacatgtttgcacagttctatgtagctaatggggagctatcatgtcaaatgtatcagcgatctgccgacatgggcctgggtgtcccatttaatattgcatcttatgcactcctgacatgcatgatcgctcatgtttgtggtgattttatccatgttattggggatgcacatgtttaccgcaatcatgtgagacccttgcaggaacagctccagaaccaaccaaaaccttttccaattttgaagataaacccaaagaagaaagatatagattcttttgtggcagctgatttcaagctcataggatatgatcctcaccagaagatagaaatgaagatggctgtttag

SEQ ID NO: 22251 - DNA, 974 bp, Glycine max
  Peptide Sequence Number=SeqID_139029
atgcctaagaagaaaaagaaggtaaagcaggtcgagcctgaacctcctgtggctgtcgagggtggtgagtcaattaagaagaaaaagaaaaagaccaagtcctcaaaagaacaaggtaataatcaacctgttgacgtccaaccaccttcgaccaacattgatggcactgaagtagaggctactccttctattgctgagatgggcaaccctgtcgatcgaccgaactcaccccgagaacaatctgtcgtcgaggtacaacaaaatgtttctgtagaagaaataccctcgcatgctcgaacatctcccgctcctgagacggatgcagtgaatgttgaggaacagggtgaaggtcaaggcattggacccagcagtcctcatggatcgagtcagaaaagttcatccgaagaaaactttttcgatgaagagcccatagaagaggctgaagctggtggttcggacatttacccggcgtcttcgacatctaagctttccgctagcatagggatcgcagaagatacattcattcaaatgcaagacgaagaccctgctgcagcccttcgactcctgctgaacaccagtcaagccaacacctcaagtgaaaagaatcctggtgcttcgtcctcatctgatgccgaaataaattcttcagtacgccaagattgcctgctcctgaagttatctatggaatacgcacgggaagacgtacttaaatccattgaagagaacccctctgctgcttttgggcacctgaactttttgaagaaactgcacaacccccttacttctgatgagattctgggcaaagttatccaaatcgagtcgatcaatttgcaagtactgtgcagaaaaaatgcgaaaatggcgccagactcgatgcccagaaacaggcccatatccttctgctcgagaaagcccgagcggctcaacgtgaagtcgaacgtctcaccaaagaggcaaaagaaggatcttctgag

SEQ ID NO: 22252 - DNA, 500 bp, Glycine max
  Peptide Sequence Number=SeqID_139030
atgaaggccgacatgaaagccatgaaagagcaaatggccacaatgatggaggccatgatgagcatgaagaaaataatggaagccaatgcggttgcaattgccgctactagaactgttgttgagacacatgaaatgccccaccacaatctagccgacttcgagccttgcctcggatatgccactgaagggcgagcagttggtgcgggtaaaaaccctcatgctatggcagaaatgggaaagttggatcatctagaggaaaggctcatggtcattgaaggaggcaaagattatgcctttgctaacctagaagagttgttcctagtacccaatatcatcacccctcccaagttcaaggtgccaaactttgacaagtacaaggggactacttgctccaagaaccatctaaagatgtgttgtcggaagatgggggcatacgcaaaagatgagaaactgttgatacatttcttccaagaaagttttactgggatagctgttacctg

SEQ ID NO: 22253 - DNA, 1359 bp, Glycine max
  Peptide Sequence Number=SeqID_139031
atggctatttcttcaacttggtacttgtttcttcctataattttatcgttatgtctcataacactatgtggaacagtgctagaagacctcaaaaacttacaccaaccaccagattttaacactacaattttctccaagtgtctcaagaacccctctcttaggtactgcagttccaatcccatgatggaccttgaaaaaatattaggattcactattgttgcaagctatctctgcaatgaaccaaagaaccctaattgtgtggagtcattccccaaagttgatcttagaaaccgaccaaacattgcacctctttatttgtcctttgatttcttttggaagtactttcccttaagcattatttccattgacttgtccaacaattctatgaagggtgattttccaattgatgttctccattgcacccaaattcagtctcttgatttaagtatcaatgcattttctggtgacattccaattcaaagtttctctccccttatcaacctcacttttctcaaccgctcctataattgcttttcagagagtaaactctctgattcccaattctccaaaaggtttaactcttctagttttcttcattctggtgctcttttggatcaaaaaaggcctgattttctaccaagtaaacttcaaagaagtaggaggtttacaccggcaattctaaaggcagcaattgatggtttttcaaataagtatttggtaggaaagagtgatgttgttcacatctacaaagggatcttgagagatggtactgaagtgaaaattgagatgtactgggatgatataccgagggatagttaccgtaaatttgtcgaagaatttaatgttctgtcaaagttacaccacaagaacctttttagagttctggggtggtgtaggagcagaaaattcaggtccattataacagaatggacaagagaagaaaatgttgaaatgtggctatcgggtcatcaggatgaatggcctgaagttgactatgaactcaacacaagtagtattttattgtctgacaaaatggaaccattaatttcgaggttcaaagttggagatcaaaacagcaaccgaagaaagatatgtaggtttggagtgttcttgctagagatgagagatttgcagcaaaaaattgatgagagaatggaagtaactgaaacaaattttcatcaagttaaacaggcattgtctataggattaatgtgcatagaccaatcaaacagtgagaagccaagcttgggcatgatatttaacactatagcaagaggctacaaggctagcctcgtgtctgcaaatcatagaatatctcacggggagaaatttaagggacacatgcatgttcaaacctga

SEQ ID NO: 22254 - DNA, 183 bp, Glycine max
  Peptide Sequence Number=SeqID_139032
atgggacagcgagtcaggtggcaggcggagataccttatggtcgtccgcaccattcgttaaccaaggagaacgaattcgatggtttttactctagtcgtccagagacatcaagcccgacgacgcacgagattcttctttgttgggcggggatgatcaagttcgatagcatgtggaaacgttga

SEQ ID NO: 22255 - DNA, 1530 bp, Glycine max
  Peptide Sequence Number=SeqID_139033
ccaaactcagttctgttctgtcctcttttctctgtttctccctttctctctgtctctctctcgctcttcttctcatccagcaccgagtcacagactcaccgatcttccgattccctttcgtcttggtttatgagctcgaaggagagacccactcttggtggcacgcggattaagacccgcaaacggaatattgctgcgccgctggaccctgcagcattctcggatgcagtggtccagatttatttggataatgctggtgatctggaacttattgctaagagcattgaatcttcagaccttaacttttcaagatacggcgataccttttttgaggcaagcttcctaaactatctgaaaacctttactctcattgttgattgcagtgcaatgggcttagatgctttccgatttatcaagaccttctcaatctatgttgttttcactgggggtcgtacacaacctggaactaccaagcctgatgagggggaccgccatccatactctataatagagtgtgagcctaagcgggaagtcattttaccatctgtaatctacatacaaaagattttgcggcgaaggccatttcttatcaagaatcttgaaaatgtcatgcggaaattccttcagtccttggagcttttcgaggaaaatgagaggaaaaagttggcaatcttcacagcacttgctttttcccagaagctgtctggtctcccaccagaaactgtgttccaaccacttcttaaagataaccttgtggccaaagggctagttctgtcatttatgactgacttctttaaggagtatctgattgacaacagtcttgatgatcttatttcaattctaaaacggggtaaagtagaggagaatcttttggacattttcccccctacaaaaagatctaatgaagccttctctgagcatttcaccaaggaaggactggtggccttggtggagtataatgaaaagaaaaattttgaggtgaaacttaaggaaatgaagtcttctttaacagcacagttaacagacgaggctgatacatctgaagtcattgagactgtgaagctgcgagttagagatgctaaattgccggacattgaggtggtgcggatcttgtgggatgttttaatggatgctgttcagtggtctggaaaaaatcagcaacagaatgccaatgcagcccttcgtcaggtaaaaacttgggcagaattgttgaatacattctgcaccactgggaaacttgagctggaactgatgtacaaagtacagatgcaatgctatgaggatgctaaactgatgaagctgttccctgagattgttagatctctttatgaccaggatgtgctggctgaagataccattcttcattggttccgaaaaggaacaaactccaagggcaggcaaacctttgtgaaggcgctcgaaccctttgttaattggctggaggaggctgaagaggaggactttatcgaattgaatgtgaacgtgagtattgttcaaggggaagaagaaagtaggaatcttacctcataa

SEQ ID NO: 22256 - DNA, 1785 bp, Glycine max
  Peptide Sequence Number=SeqID_139034
atggcactgtcgtgtctcactctcactgccaacccttcttccgttatctgcaaatgcaaagtgtccctccccaccgccccccacgcgctcgacgccacctacatccgacgcgctgcccacctcgccgacaaatccgccggcttcacctccccccaccccaacttcggctgcgtcatcgtttccccctccggcaaagtctccggcgagggctacctctacgcccagggcaccactgccgccgaggtccaggccgtcgcctccgccgccgaactctgccgcggggccaccgcctacctcaacctggagcccagcgactgccatggcgaccacagcgccgtgtctgctctgctccagggaggggtcaaaagggttgtgattggaatgaggcatcccctgcaacatctccgtggcaatgctgtccgtgcactcagaaaccaaggactgcatgttgatcttcttggagaggatctcactagtaatctcattgaggatgcacagaaagagtgtcttcttgtcaatgcacctttgatttgtagagcttctttgcgtgttcccttttctgttcttaagtatgccatgacccttgatggaaaaattgctgctaccactggccatgcatcatggataagctgcaagcagtctagaaatctagtttttgagttaagaggccgaagcgatgctgttattgtgggaggaaatacagttcgaagggacaatccaagactaactgccagacatggaggggggcatatgccaatgcgcattgtaatgacccagactcttgatcttccagaggaagcaaacctgtgggatatgtctgaggtttctaccatagttgtaacacaaaggggtgcaaggaggagtttccagaagctgcttgcatcaaaaggagttgaggttgtggagtttgacatattgaatccccgagaagtaatggagtatttccatgattgtggatatctttcaattttatgggaatgcggaggaacattggctgcatctgctatttcatctggagtaattcacaaggtttatgcttttgttgctcctaaaattattggtggaaagaatgcaccatctcctgtgggtgatcttgggatggttgcgatgtcacaggctttaaatctaattgatgtttgctatgagcaggttgggcccgacatgcttattagtggatttcttcagcccttaccagacatggtacctgtaatcccatcactcaatgaaacttttgttgttgatcccactgtctcaccatatgagtcaaggatcatatttttctataaaacatgggatccttacggtgtgttgtcaaattactctcctcatcccattcaaatgcctgatgaaaatggtgattgtgtgacttggatgagtgttgagcattactaccaggctcacaagtttattcgggtggatgatcctttggcacaagattgtgttgaaaggattaaatctgcaataagtccagaagaagctgcaagaataggaaggtcaatgcaaaagcagaaaccttatctgataaggtctgactgggacaacataaagatcgatgtcatgtacagggcactgaaatgcaagttctcaatctacccgcaattgaattctatgctgctatctactgctggttctgttctagttgaggcttcaccacatgatctgttttggggtagaggccgagacggagaaggcttaaattatcttggaaaactgttgatgaaattgagatcagagtttcttggggagtcttcatcatcaagtgagacccctagtttaactgtataa

SEQ ID NO: 22257 - DNA, 330 bp, Glycine max
  Peptide Sequence Number=SeqID_139035
atggacgccgccggcttagattccgatggccgtgaattcaaaacccccgaggacatgtggagggaacaggcgggtgaccctagcaagaagacccagtggtatcgcgacggcgtctcctactgggagggtgttaaggcaaatatggatggggtattgggagggtttgcaaatgtgaacgagcctgacataacttgcagtgaggatttcttgaacattctcttctctgaacgttttcatgctgctgatgccagacaccaaccacttgttgttcttggtactcactctttgttcttgagccccacttgtgagaatcaatgtggttcttgctga

SEQ ID NO: 22258 - DNA, 753 bp, Glycine max
  Peptide Sequence Number=SeqID_139036
atgggagataatgttactgtctcgaccactcaacaccacattgcaatccccattgagaaattgaatgcatcacttgaagctgcaaaggaagaaaattctgtaaccgatgatgcctatgtggacaatgatgtccaaaaatctcaagagaaagatgaagaaactgaagagaagggagaatgtcgctactgtcaggaagaggacttagtttctaatatggaatcaccctgcaattgcaatggtagcgtcaagtatgttcacaggagatgcattgatcaatggtacaattccaaaggccgcatgatattgtgtgagatttgcaggaagccttacaatccaaatgattacccgccacttccagaacttcattctgataatgatgacaccgagataattatattaaggcaagaatggacaattcctggaaccaacactcaaattcgatcacctctggtgctggcagatcgtgctaccaagggcctcattgattcgatgaacaaagacttcagcttgagaaaccccactggtggtgtgatatttggcatgtcactcgtcatctttatcgcggtgctacttataaaggatgcctatgaatttgcgccacccaaggaggagaaatttgctcattttttgtacagtgctgtgatgactatctctgtgccagtttacattttatcgtgggttttacaatgccaagcctatagaaaaagcgagagagagagggaaagagaaagacaaagagatcgcaatgcatag

SEQ ID NO: 22259 - DNA, 507 bp, Glycine max
  Peptide Sequence Number=SeqID_139037
atggaggttgatcttctggagccagtatcacatttcttagagactgcacgtgaaactttggctctaggatgtcagacaaattcagatatgcacaaagcagttaatttttactgtgttcctcttcaggattttacaccagatactgcaagatatgatgtaatatggattcaatggtgcattggtcatcttacagatgaagattttgtttcatttttcaagagagccaaggttggcctcaaaccaggtggattttttgtcctgaaggagaatattgccagatctggatttgtgcttgataatgaagaccgaagtgttacaagatctgatttgtacttcaaagagctattttctcgatgtggattgcatgtttacaaatcaaaggatcagaaaggattccctgaagaattatttgctgtgaagatgtatgcattaactacagaccctccaaagaaggctccccgagcaaaatccaaaacatcaactaatagacctagaactattatgtga

SEQ ID NO: 22260 - DNA, 3870 bp, Glycine max
  Peptide Sequence Number=SeqID_139038
atgggatcttccaatgaaggatcttcttcttccaccctaacctccggaaggtcatggtccaaccatgttttcttgagttttcggggtgatgacacacgcaaaggtttcactggccatctttttgcttccctagagagaagggggatcaaaacattcaaggatgatcatgatcttcagagggggaaattgatatcagtggaactcatgaaagccattgaagggtccatgcttgcacttatcattctctcaccaaactatgcctcctcaacatggtgtttggatgagctcaaaaagattctagagtgcaagaaagaagtttttccaatcttccatggtgtagacccctctgatgtgaggcatcagagaggaagctttgcaaaggctttcagtgaacatgaagagaaattcagagaagacaagaagaagttggaaagatggagacatgccttgagagaagttgcaagctactctggctgggactccaaggaacagcatgaggcaacattgattgaaacaattgttggacacatacagaaaaaaataattcccaggttgccatgttgcacagataaccttgttgggattgattcacggatgaaggaagtgtattcactcatgggcataagtttaaatgatgttcgcttcataggactatggggcatgggaggcataggtaagacaaccattgctagatttgtctacgaagcaatcaaaggggatttcaatgttagttgctttcttgaaaacattagagaggtgtctaagacaaatggcttagttcacattcaaaaggaacttctttttcatcttaatgtaagaagcagtgatttttataatcttcatgatgggaaaaatataatagcaaattctttaagcaacaaaaagattcttcttgttcttgatgatgtaagtgagttaagccaactggagaatttggctggaaagcaagaatggtttggttcagggagtagagtaataatcacaactagagataagcacctgctaaagacgcatggagtgcatctgacttgtaaggctaaaggcttagcccaaaatgaagccctgaagctcttttgtttgaaagcatttaagcaagatcaacctaaagaagagtatctgaatttgtgcaaagaagtggttgaatatgcaagaggtcttccattggcacttgaggtattgggttcccatctttatggaagaaccgttgaggtttggcatagtgctttagaacaaataagaagttttccgcactccaaaatccaagacacactgaaaattagttatgatagtttacaacctccgtatcagaaaatgtttttagatattgcctgtttcttcaaagggatggacatagatgaagtgaaaaatatcttaaaaaactgcggttatcatcccgaaattggaattgacattttgatcgaaagatgtttggtaactctggataggatgaagaagttggggatgcatgatttgctacaagaaatgggaaggaatattgtatttcaagaatctccaaatgatccaggcaaacgtagtagattgtggtctcaaaaagacattgattatgtgttgacaaaaaacaagggaactgatgaaattcaaggcatagttctgaacttagttcaaccgtgtgattatgaaggacgctggagcactgaagccttctccaagacaagtcaactcaagttactcatgttatgtgatatgcagcttccccgtggcctcaactgccttcctagttcactgaaagttcttcactggagaggatgtcctttgaaaaccctgccacttaataataaactagatgaagttgttgacctcaaattgcctcatagccgaatagaacaactttggcgtgggacaaagcttctggaaaagctaaagtccatcaatttgagcttttccaagaacctaaagcagtccccggactttggtggggctccaaatcttgaatcattggttctagaaggttgcacaagtttgactgaagttcatccatcccttgtacgccataagaaacttgctatgatgaatttaaaagactgtaaaaggctcaaaactcttccaagtaaaatggagatgagttccttgaaagatttaaacctttctggttgctctgaatttaaatatcttccagagtttggggaaagcatggaacatttgtcagtgctttctttagaggggactgctatagcaaaactaccctcttcactgggatgtctagttggccttgctcatttgtatttgaagaattgcaaaaatcttgtttgccttccagatacctttcataacttaaactccctcatagttctgaatgtttctggctgctcaaaacttggttgcttaccagagggtttaaaggaaatcaagtctttggaggaacttgatgcaagtggaactgctattcaagagctaccttcatctgtcttttatttggaaaacctaaaaagtatctcatttgctgggtgcaaaaagccagtatctaactcagtaagtggatttcttctcccctttcagtgggtatttgggaatcaacaaactcctactgcatttagattaccaccttctaaactgaatctaccctctttgatgagaataaatttaagttactgcaatctatctgaagagtcattcccagatggttttcgtcacttatcttcattgcagtttctagatctcactggcaacaattttgttaccctaccaagttgcatttcgaacctcacaaagcttgaaattcttctcctaaacttgtgcaaaaaacttaaaaggttgccagagctcccttcaagaatgaaacatttggatgcaagcaattgcacttcattggaaacttccaaattcaatccatccaagccatgcagtctctttgcatcatcaccttcaaattttcatttttcgagagaattgatacgctatcttgaggaactccctcttcccagaacaagatttgagatgttaatcccagggagtgaaattccatcatggtttgtccctcaaaaatgtgtttcattagctaaaataccagtccctcataattgccctgtaaatgaatgggtgggatttgctctgtgcttcctattagtaagttatgcaaatcctcctgaggcgtgccatcatgaagttgagtgctacttgtttggacctaatggtaagacgattatcagttccaggaatttacctcccatggagctagattgccctcacctttatattctctacttgtccattgataaataccgtgacatgatttgtgaaggtgttgtcggcagtgaaattgaatttgtattgaaaagttattgttgccaatcattggaaatagtgaggtgcggatgtcgtttggtatgtaagcaagatgttgaagatatttatgaaaatagtatcatttcttctagtgaagagatcggagtggccagtgagaagtttgaactcaacccttttgcatgttttattgagatgatccgtgctaatgtgaatcaagatattaaacttctggaaaagctgaagtctatcgatttgagtttttcaaagaacctaaagcagtccccggactttgacggggctccaaatcttgaatcattggttcttgaaggatgcacaagtttaacggaggttcatccatcccttgtacgtcataagaaacctgttatgatgaatttggaagactgcaaaaggctcaaaactcttccaagtaaaatggagatgagttccttgaaatatttaagtctttctggttgctctgaatttgaatatcttccggagtttggggaaagcatggagcaaatgtcagtgcttaatttagaggaaactccaataacaaaactaccctcatcactgggatgcctagttggccttgctcatttggattga

SEQ ID NO: 22261 - DNA, 147 bp, Glycine max
  Peptide Sequence Number=SeqID_139039
atggcctccggcggcatcttgaccggagcagtaacttcttataaagcaaatatatctatgtgtatagttcaactctgtgctgaattgatgaatgcttcggagttgctatattcgatgctcgatgcaggaagtgaatgtttatcttga

SEQ ID NO: 22262 - DNA, 348 bp, Glycine max
  Peptide Sequence Number=SeqID_139040
atgactccttcacagcagcacgatgcccccatggcaacacctaacgccccatttgctccgcaatggaataggctgagcaagcagaaccggggagacaacgcggcggcagaagaaatcctgatcgtcaagcgcgaagatgggatcgaccatgtggcacatcttcacgacatcacagacaccataatgactgattttgatgggtttatggattatgggttagtgtggcctatggattatggattatgggttagggggttggattatgggttatggttagggttagaggtttggggtttaagggttgaggggttgagggatagggttgagttgtttgggttagggttaggg

SEQ ID NO: 22263 - DNA, 246 bp, Glycine max
  Peptide Sequence Number=SeqID_139041
atggcgctttcctcccccctcgacacgtgtctgccatgcacgaagtcgccatcagaaatggttgctggctatattgcttccatttcaggcttttccttcagtgaagttggttctatatgcaaaagcaacaacaaagttgtttgctgtcatttctcttcagatgggaaattattagctagtgttggacttgacaagaaggtgtgtcctccttctggtaatttcatgagtttgtttgtcatttggtaa

SEQ ID NO: 22264 - DNA, 1179 bp, Glycine max
  Peptide Sequence Number=SeqID_139042
atggcggcgcatctcatcatgccccagctcgagtctctggtcaaacactctccaccggacgtcttcatccctgacatcctcttcacctggaccaaagacttctcccagaaactctccatctcgcggctagtcttcaaccttatttccatcttcgacgtctgcatgatccacgccattaaaacccaccctgaagccttcgcttccgactctgggccttttctaattcctgatctaccccaccctttaactctccccgtcaagccttcccccggtttcgccgccttaaccgaatctctcctcgacggggaacaggacagtcacggcgtcatcgtaaacagcttcgccgatctcgacgccgagtacactcaacactaccagaaacttacagggcgcaaggtgtggcatgttgggccaagctccctcatggtgcaaaagacggtgaaaagtagtactgttgatgagagtagacacgattgtctcacgtggcttgactcaaagaaagaatcttcggttctctacatttgtttcggaagcctttctctcatctccgacgagcagctttaccagattgctaccggactcgaagggtcagggcattgttttctttgggtggtgcatcgcaaaaacaaagacggagaagaaggagattcttcttcttcttccggaaagtggttgccggaagggtttgaggaaaagatagctaaggagaacagaggcatgctgattaagggatgggcgccgcagccgttgatcctgaaccaccctgcggtgggaggatttttaacgcactgcgggtggaacgcggtggcggaggcgatcagctccggggttccgatggtgacaatgccggctttcggggaccagtactataacgagaagctgataacggaggtgcacgggttcggggtggaggtgggggcggcggagtggagcatttcgccgtacgaggggaagaagaaggtggtgagtggggagaggatagagagtgccgtgaagaggttgatggatgatggagagaaagggaagagaatgagaagcaaggccaaagagatgcaggagaaggcttggaaagctgttcaagaaggtggttcttcttacgacagtctcacggctctgattcatcatttcaagactcttgtgcctaatcatgtgaatgggaatgggaatatcgatcactga

SEQ ID NO: 22265 - DNA, 190 bp, Glycine max
  Peptide Sequence Number=SeqID_139043
atgcgccgccatgtggatcttgtaggcggtttcattgttggtggcggcggagagggtgctcgatgccttccgggagccctacgtgggcgttggggaaactttgatgatgtgggacgcggatgtggtgggccggaggcgggtgtcctttgtcggatgttctgggtcaaagagtttgagcgtttggcggggg

SEQ ID NO: 22266 - DNA, 150 bp, Glycine max
  Peptide Sequence Number=SeqID_139044
atggagtctcaatttccccttcctgttttctttccacaactagaggcctctaatgcttacaatggcatgggtgacaggagatcctctagggttcatcagatgaagatgttgtctagacagatggagattatgatgaaggctcaggtgtag

SEQ ID NO: 22267 - DNA, 641 bp, Glycine max
  Peptide Sequence Number=SeqID_139045
tctttggcataggagcctcagcaaagctttggaagcagagaaaagagtacatcaagctatggtggaggcctaatgagatgcgaggggttgtgtggttggagcaaaaggtcaaaactgaagctcaaaatgaggacttcttgcccccattgaggatctctagtgatacttcaaggttcaagtataagaaccaaaagggtcatagatcagctattagaatctcacgcatagtgtctgagacactcaggcttgggatggagggtgtgaggtggtttgtgatgggggatgatgacacggtttttgtggcagagaatttggtgaaagtgttgcagaaatatgaccacaatcagttttattacattgggagttcctcagagagtcacttgcaaaacatttatttttcttataacatggcttatgggggtggtggttttgcaattagttatcccttggctgtggcattggagaagatgcaagataggtgcattcagaggtatccagggttgtatggctctgatgataggattcaggcttgtatggcagaattgggagttccactcaccaaggaaaaagggttccatcaggaaaactatagggaaatagggggaagggtgaaaatagatagaaaatggaaagacatatga

SEQ ID NO: 22268 - DNA, 1368 bp, Glycine max
  Peptide Sequence Number=SeqID_139046
atgaaagttgaagtagaaatcatttctagagaagacattaggccttcttctcccacaccctctcacctgagagtcttcaatctttcccttttggatcacctcattccatcaccatatgctcccataatcctatactacacctcacccaacagtgacaaaacttgcttctctgaagtccccaagaggttagaattgctgaaaaaatctttatcggagacactaacccaattctatcctcttggtggcaaaatcaaagaattagacttttccattgagtgcaatgatgaaggtgccaattttgtgcaagccaaagtgaagtgtcctcttgataaatttctagtccaacctcagttgaccttacttcacaagtttcttcccactgatcttgtttctgaaggatcaaattcaggaacctatgtgactaacattcaggtaaacatctttgaatgtggaggaattgccattggcttgtgcatttctcatagaatcctagatggggctgcactaagcacctttataaaagggtggtcagaaagagccaagggttttaattgtgaccaattaaccaaaccaaactttataggatctgctctcttccccacaaacaacaatccatggcttagagacttatcaatgcgcatgtggggttcttttttcaaacaaggcaagtgggtaacaaagaggtttctctttagaaactcagatatagccaaactcaaggctcaaacattagggacagcaacttccacacgtttggagatagtttcttccatgttgtggaagtccctcatgggtgtgtctaaagtacggtttggcacacaaaggccttctttggtgactcatttggtgaaccttaggaggagaatggatgaggctctttgtcctcaacatgcaatgggaaatcttctttggttggtggctgcggagaaaatgtgtgatgatcatgatgagatggggttggaggacttggtggggaagttgaggaaatcaatatcacaagttgatgaaaaatttgttgaagaattgagaggtgataagggaaggtcaattatgaaggagagtcttggggcaataagtgagaagggatcaaagggtgaagtagtggattatgttgggtttagtagttggtgcaattttgggtattatgaggctgattttgggtggggaaagcccacttgggtgagtggtgttggttcaattggttcagtttcaatgtttatgaatctcatcatcctagtggatacaaggctgggagatggcatagaagcttgggttaccttggatgaggaggacatgactcatttggaagcaaatactgaactcctcacttgtgcaacacttgatccaagtcctttaacaatgagttga

SEQ ID NO: 22269 - DNA, 1761 bp, Glycine max
  Peptide Sequence Number=SeqID_139047
atggcagctgttaggtcttcctctgtaagacggttggggagcacaattaagggttcttttagtatggaattagttcaccatagtatgtgtatgaatcttgcaaggtttccgagtgattcgtttaatgatccttattacaaaagagagttacagttttctaagaatcagtttagtaatttggcttctgaatcccttggaagtagtcatcactttggtactagagccaatgtattggttaaaccaacgttctctggttattgtttttggagttcccttccttttgcttccatgagcaaccacgttttgaatcgtcgaatgtattcatcgtcgtcggtgggtgacaaaggaagtagagatggtggtacagaagtttctgctggttctggtgcgagtgatatgaatactggtggtgattctgttgttgggggtgattgggctgagaggattaaagatgcttggaagagtgtggcagaggcagcatcatatgctggagataaggttaaagaaacttctgatgatctcactccatatgctcagcagttgcttgattcacacccgtatcttgacaaggtggttattccagttggtggtactttaactgctaccataatagcttggttcttgctgcctaggattttgaggaaatttcacaaatatgcaatgcaaggtcctgtttctctattgccagcaagcgtggctggggagccagttccttatgagaaaagcttttggggtgctatggaggatccagtgcgatatttagttaccttcattgcattctcacaaatttatatgacagctgactttgatttccagtggtgttatggtggctccaacaactataacctcacaatatcttgctcccgtttggagggatggaaaacaaatgtttttgcacggtcattgtctagtcaaagtttacttgggcttgatagggagaaagtgtttgctctagacaaaatctcatctattggtctatttgtgattgggataatggctttggctgaggcttgtggtgtggccgtgcaatctattgtgactgttggtggtataggagattttattggtatatgtaagccaactgaaaggattggttggggttgtgttaatggtgctttgtgtttgcaaaatggttcaaaaagtacacccattcacttagaggagttggatacttggatcctacttctagttgtaaaagcaaagtataagatcaatagtgtggctactgcttttgctaccaaggacattcttggcaatgtgttcagtggtttatctatgcagttttcaaagcccttttcaattggagatacaataaaagctggctcgatagagggtcaagttgtggaaatgggtcttactagcacgtcattgctgagttcagagaagttcccagtcattgtgccaaactcatttttttctagccaggttattgtgaacaagtcccgtgctgaatatcgcgccattattactaaaattccactgcaaactgaggatttaagtaagattccccagatatcagatgatgtaaaaagcatgctcagatcaaatgcaaatgttttcttagggaaagatgttccctactgtttcttatcccgtatagaaagttcatatgcagaattgactcttggatacaacctcaaacatatgcgcaaagatgaattatactctgcagaacaagatattctcttgcaggcagttcaaatcattaagaatcatggggttgctcttggcagcacatggcaagacacgtcttctaaatga

SEQ ID NO: 22270 - DNA, 168 bp, Glycine max
  Peptide Sequence Number=SeqID_139048
atgaatgaaggtgagaaaggaataggtgcagagaaacaacagcttttaactgacccagcaattgatttggtggtagaacccctgagtgagtatgaggaagaaatggaggaagctagaaatcaccatgccctttggagaagctctacagcagatactgctctatgctaa

SEQ ID NO: 22271 - DNA, 408 bp, Glycine max
  Peptide Sequence Number=SeqID_139049
atgcagagactgttgcgggcagaagcaaaagaaaggtccaagaagaagggggtgcacggtgaacctttcttcccacgcgactgcgtgcggcggcgtggttggtgcgagggcgcagatcgtgcgacaaaggcgaggagcgtgcgtgcggtggttctacaagcagccggaggtgcgttcgacggcgccgacagcggcggatggctagggttcgagtttggtgtttcagcgttcagtcttcaggctgtgtttgtttccgcggacggaaacatcttcatctcatatcttagaatagctattgggctcggtgactatctggaagatttggaaaaactgcgaagcaatcaagcaataaaagaagcttcagcatatttgccacgagggcaacgcttgtgcggatttgatggctaa

SEQ ID NO: 22272 - DNA, 1017 bp, Glycine max
  Peptide Sequence Number=SeqID_139050
atggcgatctttcgctccagcctgcccgtgacgcgccgggacgaggtcggacagctgattgacgccattaacggcattggcggcgggctgcaaaaaattgttctgcaggttcgcgaggcagcaggtgagatccagacggggactaacgcgctggcctccgataccggcgagatctcagagcagatcaacaagcaggccagcagcgtggaggagacctcagccagcatggagcaactggccgcgaccgtacagcaaaatgccgccaacatggagcaaacgcagcagctggtgggagaaacctcacgcgcggttcacgaggggggtgaaacggtaacccatgcggttgccacgatggatgacattcgcgaagcgtcaaaacgtatcgaagatattacccgcgtgattgagtccatcgcgtttcagaccaatattctggcgctgaatgcggcggtagaagcggcacgtgcaggcgagcacggaaaaggttttgcggtggttgcccaggaagttcgcgcgctggcgggccggagcgccaacgcggtgaaagagatagaacagctgattggcgatacgctgagaaaagtgagcgaaggtcacgcgctgtctgaacagacgcgtctggctatggattccatcatcgttcatatcgataacatcagccagctggtcaccgaaattaaccacgcatcgcgcgagcaatccgcggggattggccaggtgaatctcgccatgacccacattgtctgttccagcttaaacgctagccaaccctgcccgtggcgcgcagcagcaaatcgctttgcacctgctcgctcatcagcgtaccgccacgggtatccagcatcatgcggcaccacgcctgcgccacgggcggcgatgcgtgccgcagcatctggctcccgccccccagcaagaaaagctgctgcgcgatctcccgcccctgcgcctcctgtggtttacgcagcttttgctgaagctggcgccagctgcggtcaaagtgtctgtcctgccctttga

SEQ ID NO: 22273 - DNA, 173 bp, Glycine max
  Peptide Sequence Number=SeqID_139051
aggcaatggagctgctgggcggcgtagggtactgcgaggagagtgagctttccccgcctgtatcgcgaaatgccggtgaacagtatctgggaaggctcaggcaatatcatgtgcctggacgtgctgcgcgtgctgacgaagcagccggggatccacgacctgctggccgatga

SEQ ID NO: 22274 - DNA, 657 bp, Glycine max
  Peptide Sequence Number=SeqID_139052
atggatgtggccaaccacctgctttaccttacagatgatacccaaaaagttatagcatatgatatcctcacaagaaagaaaatactatgcaatatttcattaccaaaaagtgccatctacagaaagggggacttcttagttgcttaccgtggaaatactattgatatcttcaaacgaaaaaacaaatttgaattcattaaaacgcagtcgttttctgttggagaaccgatccatcagcttgttattgaccgtaacgacagattgtgggtatgtttagataaaggaggagttctttattacaaaaatactttacggaatgggaacctatcccggcccatgaagatcatgaatgattttgtcatgaatcatatcctcgtagacaaggataaaaacatctggttttccacgagaaacaatggtatttactttattacagataagtttttcaacaactatatccatcttcctgtaaagaataattcttcctacattaccgctatcggaaaaagtggtaaaaacattatcatgggggtcttacactttataatttcattaccggtgccaaatctgacctgtttaatgaaagagcctatacagccctacgctacgacaaagacagtgtctttgttggaagttttaaggatgtgtataaaatga

SEQ ID NO: 22275 - DNA, 240 bp, Glycine max
  Peptide Sequence Number=SeqID_139053
atggagcctgcaattaatgctcgcttgtgcgcatccggttgcataacgatcctcactgaaagggcgggatcgccagcttgtgacccccctcccatgcagcgtgcacgcggcctgtccatacttatcctcattgccactgaaggagggagacagcatgcactggcagacccataccgttttcaatcaaccggcaccgctttcaaacagcaatcttttcctctccgactgcgccctgcgtga

SEQ ID NO: 22276 - DNA, 807 bp, Glycine max
  Peptide Sequence Number=SeqID_139054
atggcgaccgtgattgccaggaacttcttccagctcgagggagaagcgggactgaccagcctgatcctcacctgggcctcgtttgctatcgcgttcttcttccgtcccctgggtgcggtggtatttggccgcatcggcgacaggattggccggaaaccgacgctgatcattgtgctggtactgatgacgctcgccaccacagccattggtcttgtgcccgtctacgccagcataggcattgccgcaccgctgatcgttacgctgctgcgcattttgcagggattgttcgcaggcggagagtacggtggtgcagtttcgttgatgacagagttcgctccacgcggcaagcgcggtctgtatggcgcgtggcagtcctttaccgtggcgctcgggctgctagcgggcgcggggattgtggcactgctctccgcccttctcacgcctgaggcattacatgactggggctggcgtattccattcttccttgcgctgccgatgggggctgtcgcgctatggctgcgtgtgagtatggaagagacgccgagctttgtgcggcagaaggaaaaaccggttgtggctcaggccagcacctccgccacgctcaaaacgattctgatgggcatttgccgggtcatggtctggtcggcggcagggtatacctacctggtgattatgccgacctatctccagtcggcgctacacaccgggtttaatcaggcactgctgatagcggtgatttcgaatatcggttttgcgctgaccatcatcccctcgggtatcctgagcgacaagattggccgccgcacg

SEQ ID NO: 22277 - DNA, 276 bp, Glycine max
  Peptide Sequence Number=SeqID_139055
atggactcattatcttatcctattaccagctgtacatcccattttttcacttcttctctccttctccaagtgaagtcttcttcttgcaaccatcaaagatgttctctaccagaacccaacccctaccccatgccaaaagagacgaaaggagttacttaccttcaatggcgacaaggaggttgcaggcgaatgggaggtgctaccgttgcaggatggttcaacttgttgcgagaatcactggagggagatgcagtgtcgtgggaaaggaagtgttag

SEQ ID NO: 22278 - DNA, 1011 bp, Glycine max
  Peptide Sequence Number=SeqID_139056
atgtcacactcaagcactctctttctcttcctcatagttctattcttcactccagcactctcagaactatgcaacccacaagacaaagaagccctccttcaaatcaagaaagagttcggtaaccctaccactctctcttcctggctcccaacctctgattgctgcaacaacaactgggtaggtgtctcatgcgccaacaagacccaatcttaccgcgtcaaccacctcgacctcaacgaccttaacctccccaaaccctaccctatccccccctccgtaggtaaccttccctacctcaattttctttccatcaccaacaccaacaacctcgttggcacaataccccctaccatcaccaaactcaccatgctccgtgaactccaaatcagattcaccaacgtgtccggcgagataccccattttttgtcccaaatcaaaaccctagaatcaatcatcttccactacaacaacttctccggcaacctccctccctggctcccttctctccccaacctctacagagtctccttagacggaaaccgcatctccggcaccatcccggactccttcggctccttctcggattcactgaagttgatgaccttctccgacaaccgcctcaccggggagattccggcgacgttggcgaagctggactttgatttcgtggacttgtctcagaacatgctggagggtgatgcgtcggtgctgttcgggtcggagaaacacacgctgcagataaatctggcgaacaactcgtttgcttttgatttcggaaaagtaagggtgtcaaagaccttgttgattttgtatcttagtcacaatcgtttatatggggcgctgcctgagggacttacgtcgcttaagaatctgggcacgtttgatgtgagctacaatgaattgtgtggcacaagtttagaagcgcctacggttaaactcaaccttcaattcgctcatccatcacctacatggaggatcgcaagccaagaagcaagcaccagtcctttctaa

SEQ ID NO: 22279 - DNA, 216 bp, Glycine max
  Peptide Sequence Number=SeqID_139057
atggttgaatactcattcattttgcacattataagtggtggtggcgacggtgcaattgcaagtgtcggccgaggagtcgaggatggacttcttcatggactgcgcgaaggtgaggttgtcgaagaagagagcgatgacggattggaggagctggttgtgggattgggagagagaggtttggcattggtgagagaagagagtcaccttgggagatag

SEQ ID NO: 22280 - DNA, 492 bp, Glycine max
  Peptide Sequence Number=SeqID_139058
atgacacaagtacacaaacttcaagtccagcttcgccagtttcgccggaatcttcccggtgaggcggttgtcggtgagcgacatcatcctgtgagcgacttcgagaaggagccggagatgcggtttgcgtcgaaggagatttcggagaagttggggagagaagggagccaggcagggaggttgccggagaaaatggggcatatggccggagagattggtgaatctgatatagagatcacgaagcttggtgagtttggtgatggtggagggtattgtgccaacgatgttgggggtgctgatgatggaaagaaattcgaggtagggaaggttacctatggaggggggtatagggtagaatttggggtggttaaggtaggagagttcgaggtcgttgacgcgcagtcggtggttgggagccatgaggagagagtggttgagtttcctagctctttcttggttttaagaaggacttttgtctcgtgggttgcataa

SEQ ID NO: 22281 - DNA, 192 bp, Glycine max
  Peptide Sequence Number=SeqID_139059
atgggtgaaaatgcctacaagattgaactaccagctgagtatgaggtttcagaaacattgaaagtttctgatctttttccttattatgagccagttttgttcggaggtgcggatagtgccgctagccctcgctttgtggtgacgagccctgactcgaggggacgtgttgtgagtcccacatcgggtgattaa

SEQ ID NO: 22282 - DNA, 1426 bp, Glycine max
  Peptide Sequence Number=SeqID_139060
atgttgcggtctagagaccggaagcaggaaagatctgtatcttgtgctaaaaatttggtaggaaacgtctcttcttgtctcttgtttccaaatagcagtagcataaggatattaactgatttagtcattaaaactcatggtggttttggcgatgtggtattgaatatgaggcaatgtgctgcttcttcttactacttggacatggacaagtcttctcacagggttgccaaattgccatccattgggaatgccacgacactatcttattctcatgcagatgacacgtgtggtgccacactctgcaacaatactgcacctacttgtgtctattcttccctcccaaagtcctaccaccgtgctgaggagaccaaagacagtgttgaatcagcagtgcaacgtgctccttctcaaagcactcatggcagcgcactcttgctgaagaaactgggactttgcttcctgagtgttgcgtatgtgtgcatggttatgattttggctctcattctggctgctgtggtgggtgttgctttggttcggttgtgggtggaggaacccgtgtctgtcaaggaaaatctgcattttgattacactgaagctcaccctacggctgtgtttttattcaatggagttagaagctttaagggtcacctcaagaaaaagcaaataagtgtcccagttggccactcgtttttcgcttctttggttcttgtgatgcctgaatctgactttaatagggagcttggcgtctttcagttgactgcagaactcatatctgtgaatggaaatgtgatagcaaaatctagccagccatgcatgttgcggtttagaagctcgccaattcgactagcccggacctttatgatgggtgtgcctctggtgcttggaatctcaggggagactcagaatattaatgtagaaatactgaggcacaaagaagactatagaagaagcaatgctattagagtaactctgcatccaagagcaggaacatcttctcttccacagctatatgaagccgatattgtgataaaatcccatttgccttggaccaaagaattggttcgaaattggaagtggacattttatgtttgggtgtccttgtatgtctacattgtactacttgtgtctctcctatgttgttataggccactcgtctttctggtgacaccagagtatttcaatgatcatagggtgagtgaacttacaagagaagaaccaggacaattaggagatgaaagtgaggtttctgagttgttgaggaaatggagaagaagcagaagtaagagaaaaaccgtcctggcacatggtggtgtgccagaaaccattgttggatcatcagcatccagcattagcatgactgctagagaagatgtaaccagtgtggttatggaggatgaggttgaggactctgaatcagtgtgcatag

SEQ ID NO: 22283 - DNA, 162 bp, Glycine max
  Peptide Sequence Number=SeqID_139061
atggtatcagggccagttctgcccagtggtgtggatagtgccgctagtccttgctttgtggtgacgagccctgtctcgagggggcgtgttgcgagtcctacatcgggtgtgacaagccctgactcgagggaacatgttgtgagtcccacatcgtgtggataa

SEQ ID NO: 22284 - DNA, 306 bp, Glycine max
  Peptide Sequence Number=SeqID_139062
atggctctatccctactcctcaaattgagaaaaagaaatttgtctcctttaagaataaaacacggatcaagcaaactatcggaaaaatctaatcataaaaacacgaatcgaaaatcacgcgatcgagcaattgagattgaagatgaaacggaaaatgaagagaaggaagagagagagagagagaggcataccgatgaagaaatagatctgaagtttgaaagagatgggaatagaaaggcgaaaggagttaaaagcgttgaggcacgagacaaagagatattctttccttctccactgcaaatataa

SEQ ID NO: 22285 - DNA, 762 bp, Glycine max
  Peptide Sequence Number=SeqID_139063
atggagaactatcaaggtgatttaagtgacataattcgtgctagtggtgcatcatatggcagttgcagcacgggaacttcatcatctgaagctgctaatcccttctctcgtaattatcacttgcagttctcttctgatcccatgattttctcttctgttttggaagggtttaatagcaactttggtgatccattttcaaacatgagagatccctttctacacgagcttgatttgcctctctctgcctattttaatagcacaagttcatctgcagaaattaagagttctggggcattggaagaagcaacttgttttggtggtggggttgttgctggtagtagtagtagtagtaatagttgtgttttggcacagaagattcttgatgaggatgatatgagaaggccatgtaacagcatattgtcaaacatgattcagatctctcccaatgataagttacccatctcgccagtggtggattctttgtcaaggccattcaagccttctggtgcggtttcaggtcacaacatgattgatgcaaagacctcttcagattattgcttggtggacaacacaaaagtgcagatctcatctccaaggaatccaggtcttaagagaagaaagagcctggcaaagaagtcgatttgtgttcctgcaccagctgcaccaaacagcagacaaagtggcgaggtagttccttctgatctgtgggcttggagaaaatatggtcagaaacccattaaaggttctccatatccaaggtaa

SEQ ID NO: 22286 - DNA, 657 bp, Glycine max
  Peptide Sequence Number=SeqID_139064
atgtcagctgccgtggccgcttccgctgccgccgctaccatgtcgggttaccaccacaactcctcctcgagacaacaacaacacatagaccatgaattggccttaacaccacaacgagtgtgtgtctctccacctctgagcagcggcgcgcacgttctggaattcctccgctacctcgaccagttcggaaaaaccaaggttcacgccgaaacctgcggatactttggaaactcccaccctccgggtccctgcgcgtgtcccctgaggcaggcgtggggcagcctcgacgcgctcattggccggctacgcgccgccttcgaggagaacggcggcgcgccggagatgaacccgttcgggacacgcgcagtgaggttgtacctcagggaagtgagggacgcgcaggccaaggcgagaggcatagcttatgagaagaagaaacggagaaaaccacaacaaagtggacatgatcatgatcatgatgcgatgatgatggtgggttctacgagtgatgtgaattattcttcagggtatagtggtggtggtggtggtgcctttgttcctcatcagcaaatgttgtctgattcgaatgggacagcttctacatctgatggggtttcttatttctcatcatcatcccagtgtggtgggtttaattga

SEQ ID NO: 22287 - DNA, 348 bp, Glycine max
  Peptide Sequence Number=SeqID_139065
gcaacaaaatttaatgatattaaatcaagcaaaggctctccatactggatggccccagaggttgttaacttaaagaatcaaggtggttatgggctagcagctgatatatggagcttagggtgtacagttttggagatgttgacaagacagcctccctattctgatttggaaggaatgcaagcattatttcggattggccggggtgaacctccacctattcctgaatatttatctaaggatgcccgggatttcatccttgaatgcttacaagttaacccaaacgatcgtccaactgcagctcagctattttatcattcttttctaaggagaacagttctatctccctga

SEQ ID NO: 22288 - DNA, 276 bp, Glycine max
  Peptide Sequence Number=SeqID_139066
atggaagaaaaggaagggaatttgaagggggagagacagagaggaataaggttctcttctagcaaaggatcgaaagcaaaggcgaaggaatcgagagggaaatggaagggcagggaagtttctctctcctcatgctctgatgggttttttagagagagaaagttgagaatcgcaaagatggagtcatttctacgctacgcacaaagagaaacacaatccctcactcctttgcttttttcatatttcacgcatgcgctccaatacgcgcatctgtag

SEQ ID NO: 22289 - DNA, 890 bp, Glycine max
  Peptide Sequence Number=SeqID_139067
ttcaagacgatgacgtttcggttcccgctgcggtttcttcttcctccccttggtcttccggggagcactacgtgggcaggggcagtgtcggtagattgaatttgagacacggcgaaaggagcgtgcttttcaccgattccgattccttcactacttcacacgacgatgacagtgatgttggtggagagagggagagagcgggtctcgcttctaattctgcagccgctgatgagttggttattccgtttaactcatccaacgagtggtttagacagactttcgcttcgtggcagaaaggtgacgtcttgggaaatgggtccttcggaactgtctatgaaggcttcaatgatgatggattcttttttgcggtaaaggaggtgtctttgctggatgaaggtggccagggaaaacagagcttttttcaacttcagcaggaaatatctcttttgagtaagtttgagcataaaaacatagttcgatattatggctcaaacaaggacctaggcaatcgacataagcatttttcaaatttgaaagcatttacatggctgaaaatcactttgttcattaagcatcttggagtttatgacatttctaacaattttttttacttactaatatgtacatgggagaaggaaatggacaaaagtaaattatatatattccttgagcttatgtcaaaagggtcattggcaagtctctatcaaaagtatcggttaaacgattctcaagtttctgcatacacaaggcagattttatgtggcttgaagtatcttcatgatcataatgtggtccacagcttgaaactggatgacaatagatacctttcaaagtgcatgactatgacatttagaaatcctgcatttgtagtttctttggagcttatttag

SEQ ID NO: 22290 - DNA, 522 bp, Glycine max
  Peptide Sequence Number=SeqID_139068
atggaggacccgacaacgttgttgaacagcgaatattcgaggctgttcggcgaagacacggacttgtacaaccgcattgtgttgggcgccctattgccgcactctgtgtggggcccactcccgcgcttcctccagacgtggcttcgcaattacctcggcggcgttctcctctacctcctctctgggctcttgtggtgcttctacatttattattggaagcgcaacgttcatgtccccaaagatgctattccctctcaaagagccatgctcttgcaaatatctgttgctatgaaagccatgccgtggtactctttacttccaactgtttcggagtacctggtagaaactggctggacaaagtgctatcctagattatataatgttgagtttggtatttattggatgcacagagagctgcacgacataaaaccactttacaaatatcttcatgctacccatcacatctacaataaacagaacactctctccccttttgctgatgttactggttttaaggcttag

SEQ ID NO: 22291 - DNA, 303 bp, Glycine max
  Peptide Sequence Number=SeqID_139069
atggcaatagttctcatggacagactcaaatttggaggagaagatgagtcaagaacaagttcaccaccatacgaagccatggataagaacttgaagcctaatttctcaaatgatcaaagttgcaaaatgcacagacaagcgatgatggtggtgcttctgacaactacaattgttggaagtgggaacaatggtggaggcggtagtggtagtcttagtggcaatggtagaggtaatggtggtagtcgtagtgatcatgatgattgcaacattggtggtctggctcccttgtgtgcatatgtgtaa

SEQ ID NO: 22292 - DNA, 531 bp, Glycine max
  Peptide Sequence Number=SeqID_139070
atgaaagtgaacatcaaagagacaatggaaaaggaagaagaggatcgtagaagagaagctgcaatcgcatcctcatcctgtctccgacccaatttcaaccctaaaggcataacccaagaccaactctcaaaatttcgtgtgggtgcccccttccattcagttcactattcattcttttctacatctcccacttccaaaaagcttgtaaattttagatttttcctacattctaaaacctgggaactacacaagaggcgcttgcaactgaagtcaaaatcgaagttcaaaatgaaatccaaagatagggccaacaaaaagtcacatggtgatgttctatcaagccaaaacggtggaactcaaggttcaaatgttgatcacaaagaatcaaacttgtggaatgattgtgaaggatttgattctagatatgaagactcaaaggatgatatacctgtgatgtctgcaccaaagaagcaaaagttacattgggggcttgacaccaagaacaggtgggagaggaaatccaacatgtag

SEQ ID NO: 22293 - DNA, 574 bp, Glycine max
  Peptide Sequence Number=SeqID_139071
aggactacacatcctcacattcagaggacaacatgtcctcaccttcaaagcgctagatgccatcgccttcagaggactacacgtcctcaccttcaaaaggttacacgcccttaccttcagaagattacatgtcctcgccttaagagggctacacgccctcgcctttagaagactacacgtcctcgccttcagaggactacacgtcctagacttcagagggctacacgccttctccttcagagaactacacgtcctcgccttcagaggaatacacgtcctcgccatcagagggctacacgccctcaccttaagaaggctgcacgtcctaacttttagagggttgcacgccctcaccttcagaggtctgaacaccctcaccatcagaggactacacgtcctcaccataaggggttgcacgccctcacctttaaagggctacatgtccttgcctatagacggctgcacgccctcacctttagagggctatgcgccctcacctttagaagactacatgtcctcgcctacagagggttgcacgccctcgccttcagagggccgcacaccctcgcattaa

SEQ ID NO: 22294 - DNA, 387 bp, Glycine max
  Peptide Sequence Number=SeqID_139072
atgacaattttcttttctttcaaaaagctgataggttcgccagatgatgccagccttggatttctacgaagtgataatgctcgtagatacgtaaaacagcttccgcagtatccaaaacaaaacttttctgctagatttcccaccatgtctcctggtgcggttgacttgctagagaagatgctcatctttgatccaaacaggcgtattacagttgacgaggcgttgagccacccatacatgtcacctctccatgacatcaatgaggaacctgtttgcaccagacctttcagttttgactttgagcaaccatcattcactgaagaagacatcaaggaactcatctggagagaatctgtgaagttcaatcctgttccaccagtctactga

SEQ ID NO: 22295 - DNA, 546 bp, Glycine max
  Peptide Sequence Number=SeqID_139073
atgtctgctgttgagtcagctgaacacaacaacatcagaggagtaccaactcatggtggacgctatgttcagtacaatatctatggcaatctcttcgaagtttccagaaagtatgtccctcctattcgccctgtcggtagaggtgcttatggtattgtttgcgctgctgtaaatgcagagacaggcgaggaagttgccattaagaagattggcaatgcattcgacaacagaatagatgccaaaaggaccttacgggaaattaaacttcttcggcacatggatcatgcaaatattatcaataatgcacaaatatcttcgttagcatttatcttgcaaagtggactgactgcttggttatcaataatttatccaatgcagattatgtccattaaagatattatacgtcctccacagaaggaaaacttcaatgatgtgtaccttgtttctgagttaatggacacagatctgcatcaaataattcgttccaatcagcaattgactgatgatcattgtcgggttagaactttaactacttttagcatatga

SEQ ID NO: 22296 - DNA, 1494 bp, Glycine max
  Peptide Sequence Number=SeqID_139074
atgttctcagtatacgacgccgctttcgtcgacacagagctctccaaacgcacttcaatcttcggcctccgcctctgggtcctcatcggcatcctcgtcggatccctcatcgtcatcaccctcttcctcctctccctctgcctcacctcccgccgccgccaccaccaccaccaccaccaccaccacaagcaccgccgtcaccccactcccccaatctccaaagaaatcctcgagatcgtccacgtccccccaccccccgacaccggccacctcccccctcctcctccactgccgccaaaacccgaccaccctcgctccgccgccatggcggcgctctactctagcggcgagagcagagcagccgcgagcgtgtgcgaaacggcgtcgtcgtcgctcggaagcgggagtgtgggccccgaagtgtcacatctcgggtggggaaggtggtacacgctccgagaactcgaatccgccactaatgggttgtgcgaagagaacgtcatcggcgaaggtggctacggaatcgtgtactgtggcttgttgcccgatggcacaaaagttgctgttaagaaccttttgaataacaagggccaagctgagagagaatttaaagtagaggtagaagcaattggtcgtgtgcggcacaagaatcttgttaggttgcttggatactgtgttgagggggaatacaggatgcttgtgtatgaatatgtcaacaatgggaatctagaacagtggcttcatggggatgctggacctgtaagcccaatgacatgggatatccgaatgaacattatattgggcacggcaaaaggattggcttatcttcatgaaggtcttgaaccaaaagttgtccaccgagatgtgaaatcaagcaacatactgattgatcgccaatggaacccaaaggtttctgattttgggcttgctaagcttttgtcagctgatcatagttatgtcactactcgagtgatggggacatttggttacgttgcaccagagtatgcatgcactggaatgctgactgagaagagtgacgtgtatagttttgggatacttattatggaaataattactggaagaagtcctgttgattatagtaaaccacaaggagaggttaatttaatagagtggttgaaaagtatggttgggaatcgaaaatctgaggaagtagttgatcctaagattgctgaaaagccatcttcaagggctcttaaacgggctttgttggttgctcttcgatgtgttgaccctgatgcggcaaagaggcctaaaataggacatgtgatccacatgctcgaggctgaggacctcttattccgtgatgatcgaaggagtggaggagaatcttcccgttcccatcgcgattatcaactagagcataaggactcaagattagataaaaggaagataggtggagagatcactgatcaaagtgaagatgatagtactactagtagtagacatcaccctcagcccactagatggagataa

SEQ ID NO: 22297 - DNA, 186 bp, Glycine max
  Peptide Sequence Number=SeqID_139075
atgaacagcaggtctcaggatcaacgctcaagacctgccaagccagccacaatccatggctgcgccctctccggcgacctcgttggactccagaggctacttcgagacaacccttctcttctcaacgagagaaaccctgttatctacttggttttgactcatgatgactttggctgccgggtgtaa

SEQ ID NO: 22298 - DNA, 255 bp, Glycine max
  Peptide Sequence Number=SeqID_139076
atgccagattttgcacaagtctacagcttcattggcagtgtattcgatccaaattcaactaatcacctacagaaactacaacagatggacccaataaatgtggaaacgagttcccaggtattgttgttgatgacaaatctctccgtcaatttaatgagtcctgaatttgaggatcatatgattgtccttggcatgcaggacaatgagagtcctgttaggtcacttttggaggctatactctgtacagtctgttga

SEQ ID NO: 22299 - DNA, 486 bp, Glycine max
  Peptide Sequence Number=SeqID_139077
atacgaagtcatgcacaaaagtattttcttaaagttcagaagaatggaacaagtgaacatgtacctcctcctcggccaaagagaaaagctgctcgcccataccctcaaaaagctcctaaaactcctactgtatcccaagttatgggcccattgcaatcttcatctgctttcattgaacctgcatacatttatagcccagattcttcatctgtgcttggaactccagttactaacatgcctttatcatcttggaattataatactacaccacaaccaggcaatgtgccacaagtgaccagagatgacatgggattgactggagctggacaagctgctcctcttaattgttgctacagcagtagtaatgagagcacccctccgacttggcctcgtagcaaaaggattaatcaaggtgaccagggcaagccaattaaaggttggaatgcttttttatctcttaatttgcacttgattctgcttgaataa

SEQ ID NO: 22300 - DNA, 426 bp, Glycine max
  Peptide Sequence Number=SeqID_139078
atggctgaaaatctatcaaaaatcattctggatatgtcgaaaatagaacctctagacggctcaaattataggagatggtctcaaaaactgttgattttgtttgaagccttagaggttgattatgtgctatttgaagatcctcccgctgatgtcaacgcttctgaatcatctactcctgaaactcctgctacccctgtcgtcattgtatatgcctatatgttcttggtagaagtaggaatagtgggggcaagatatgcggagaaacgcaaggaactggaaccagagaaatggcacgcaaaccgaggcatgattttagcgtttcaaaggtcagattttctcacttttgtgactgagtataggtcacaatcaaaagagaaagtgggccctttttgctccactcaaatggggacatgtggcagagcttga

SEQ ID NO: 22301 - DNA, 294 bp, Glycine max
  Peptide Sequence Number=SeqID_139079
ttcttattgccttccaaatgcattgatctcttagcacaaattgtcaagatatgggtagtagagataacagactcagaagttgatgattatgattctgatgggaagatggggaatggtttctactgtcaagagatgtatctcaacgaggatggacaactctcatggttcaatgctggtgttagagttggtgttggaattggccttgggatgtgtgtagggcttgggattggtgttggactgctcatgcgctcataccaaacaacaaccaggaacttcaggaggagatttttctaa

SEQ ID NO: 22302 - DNA, 573 bp, Glycine max
  Peptide Sequence Number=SeqID_139080
atggagcagattcatgagtatgagaatctagttggtgatatactaaatgaaggaatgaagatgtgtcataaagcctatgagtgcaaactgaggaaggtacaacaatctaacaactcgaaacctgctgcaccacatgctcctcaagcacatctagcagaaaatgaagaagtgatagctgctgtggtagtggaggcaaacatggtcgacaacaaggtggactggattctagataccggtgcttctaaacacctatgcgccaacaaagagctttttcaccagattgaggatgctgatgacggagaatgtgttttcatgggaaattcagctacagctggagtgcttggtaaaggaaagattatccttaaacttacttctggaaaaacattatctttgagtgatgttttgtatgttccctctctgcgttggaacctaatttctggtagttgtctaaatagagctggattaaaattggtttttgaagctgacaaagtagtaataactagaaatgatgaacgctatgttattaagttctgtgcctttacatttgcatacttcttcctctgtaacaaatga

SEQ ID NO: 22303 - DNA, 753 bp, Glycine max
  Peptide Sequence Number=SeqID_139081
atggatcaacaagacgaagaagcgattgccacgaagccctcgaattcgttgagttttccatctctaacacactccgcctgcctcgagattcgtctcttctatgtcagaatctccccctgcctcgtcgacacgctcccggaccacctcacgctctgcctcccgcgccgccacgccgccgtctcgctcgtcgtgaacgctgccccagtccccgcctccgcccccacgaccctcccccttcgccgcggccgcgtcgaccgccatgccgccgaggtcacctacgtcgccaccgacaccgtcagcctcagcggcagcgcggacttcgaggtctacgagaacgacaagctcttcctctgcggctcgctggagcgcctcgacgccgattggggagctggctcggctccggcttcggcttccgggtggggcatggactgccacgtagcggcaggctccgccgggtcggggtgctccgcgttcttcgggccgcggctcggggtttccgcaccgtcgatcgaggtctacgttgccgggtgctgctccggcgtgccggtgattctgagcaagacgattcagttgagtccgaggaagagagtgccgcggcatgccacgctggatgctatacctgaagatgaagagatgatggtgttggagaagaaccgtgtcaacgggtttgttccaaaccacaagttacagttttcaatgaattttaaacaactggagtgtgttctagcactcctcttggtcctaatgttttaa

SEQ ID NO: 22304 - DNA, 831 bp, Glycine max
  Peptide Sequence Number=SeqID_139082
atggctttcttcacctctgcttcatactctaatcaaacccaaaaacaaacctccttgttaatatttatcatcttcactttgttccacacactcttttacactgcagtgtccgtttccttcaacttttcgaccttccaaccaaactcaaataatctaatagactttgacggtgatgctttttcctcaaatggtgttcttctgctcacaaagaaccaacttgatggcagcatcacattcagcgttggtcgagcctcatatgaccaaccagtgaggctttgggatagaagaactaacaagcttacggatttcacaacccatttctcttttgtcatgaaagctgttgacccatctcggtttggtgatgggttagctttcttcattgcaccgtttgattcgtctattcccaacaactcagctggtgggtaccttggcctattcagcaatgaatccgcattcaacaccaagaaaaatcagttagtggcagttgagttcgatagcttccagaacacatgggatccgagctctgatcatgtaggaatcaatgtcaactccattcaatcagtggcaactgtcgcttggaagagcagcatcaagaatggatcagttgctgatgcttggatatggtacaactctacaaccaaaagtctgtctgtgttccttacttatgctcacaatcaaacctttagtggcaattctagtctttcgtatgccattgatttgagggacgtgttgccggagtttgttagaataggcttttctgctgccacgggttcgtggattgaaatacacaacattctgtcctggtcattcaattcaaacttgttgtcttaa

SEQ ID NO: 22305 - DNA, 216 bp, Glycine max
  Peptide Sequence Number=SeqID_139083
atggaaaaggagcatacagacacgggagaagaagacggtgtgagaattttgagagtaagaaaaatggtccaagcaagaaaactgttattatgtgagagaaatctgcagagagaacaaatattaagtgggagaagacaattattcaacgatggtctaagagatcaagaaggatggtttacagaaagggaaaactgtggagcaagagtggatagttga

SEQ ID NO: 22306 - DNA, 153 bp, Glycine max
  Peptide Sequence Number=SeqID_139084
atgaagaagtttgtactcaagttagatttgcatgatgacaaggataagcagaaggccttgaaaacagtttcaactctttcagaatcagtcaagaagacagtagtaaagggctgcacgtctcttataccgccgtcttcagtatttttgccttag

SEQ ID NO: 22307 - DNA, 183 bp, Glycine max
  Peptide Sequence Number=SeqID_139085
atgactactcgaaaacttcattcacaaccgagcgttgtcgatatttttcttgacctttgtcaacgcattgcgacgagcggcaccaacaatggaggttgcaacattgaccaaaacagggctagggcaatagtctttctggggaggcaatgcgatggaaggagaaggaatccttacatagtataa

SEQ ID NO: 22308 - DNA, 156 bp, Glycine max
  Peptide Sequence Number=SeqID_139086
atgggaatggggttattaggttgtagctttggtggcttgaaaagagagatcgaggtcaggttcaatgtgattggaactaaagatatatgggaacaaaacgtggacgcgtgcccaacacccaattctgagaagttgccaaagaaagaggatccatga

SEQ ID NO: 22309 - DNA, 498 bp, Glycine max
  Peptide Sequence Number=SeqID_139087
atggctccgaaaaagctttccacgaagaggtctagaagaaacgccgcagcggaagggtccagtgccacccccaagtttgatagccaccattttcgacgaggaggccattgcccagctgttatgcacactggggcaggatttcgcccggaccgctacagggaggcgggtgcagatcatgcgcaccagcatgaccactttgacccagacgtggatgacactgctactcagcaatgtatgccagccaccaggcaccctctggacccggataagtctaacagggccctggggtttccggcattgatcactggccttttccagtcattcgggattcccgtcacccccagtaaggtgatccgaccaccgatcacccgagccttcatcgagaagtactgcacgcctaggcaggcgcaggatgatgcgcatcaagccgcagatgcaccggcaccacctcggcaggccgatcccgctggatcactaggcatggagcgttatctatag

SEQ ID NO: 22310 - DNA, 1173 bp, Glycine max
  Peptide Sequence Number=SeqID_139088
atggatgcattccgtttatcacattcatttatgctcagcaccaacatccacagcccctcctctctctgcacccttcgttccctctccaccaatccccgcaacaggtggttcaaggtggaagccaccgccggcggcagccagaagaagaacaataacaaggccttcgacgcggcggcgttcgaggcggagcgacttgccctcgacgcagaggcccggcgaaccatggcggacgccgccgacccgaaggcctggaaatggataatccggaagagaatatgggatatgatggaagctcgcaactttgccaacaaccctcggccggttcaccaccgcattcccaatttcgttggcgcctctgttgctgctgaaaagatgagggagctagatgtgtttcaggatgcacaatgtgtaaaggttaatccagactctcctcagaaacaagtcagatggtttcacgtgcaacaaaaaagttgtgttagggacattactcaagcagtgaatggtcgtcagttattaagtgctattgcagatcagtatatcccttatggcaagaagttgttgactcctcaacctcggctgagaacaggtttcttctctgtacttgattccaatatgttaactttggataccatcaaggaagcctgcacttctgttggggttgccaagcatggacggccgattgggttagacgaaaagataaaggtggatcttattgttattggatctgttgctgttgatccaaagacaggtgctcgattgggaaagggagagactttgaacttgaatgttccttcaactaagaggattgaagtgcagggatttgcagaacttgaatatggtatgctgaggtacatgggagccatcgatgattcaacacgagttgttacatctgtgcatgactgccaattggtggatgatattccagttgaaaagctgttaatccatgatgtaccagtggatatcatttgtaccccgacacaggtcatttttacaaatacatctatcccaaagcctcaaggaatttattgggacaagttgtctcctgagaagttgggacaagttcgtatactgagggagctcaagaagaggattgaacaagagactggacagaagcttcctactggtccatcggagaaattaccccctactgctcaacgaagtagaaggggttga

SEQ ID NO: 22311 - DNA, 117 bp, Glycine max
  Peptide Sequence Number=SeqID_139089
atgcagtgttgcaccagagcggtgctgagcggcactggaccaccacaaggaggccgtagcgtcttagtttacagtgtggcagtggcagctgctatcccaaagtggcagagttggtga

SEQ ID NO: 22312 - DNA, 213 bp, Glycine max
  Peptide Sequence Number=SeqID_139090
atggcacgcagcgtgtttgctccgtgcccctattttagggacctacatgggagggagctaaaagggattttagtgataattcccaaggtggtcatatctctcttgatggtctctagaggtatcatccccttcgaagaatatattgcagcagtagggactactagcaacaatatgttatcaaagagaaaaactctagatgagggttcactgtaa

SEQ ID NO: 22313 - DNA, 171 bp, Glycine max
  Peptide Sequence Number=SeqID_139091
atgacagagctaaagctagtgcaactgagcaatggtaaaaccatgacacgatcatataacaaaaacaagtatcaactgttttgttttcattacaattcaagcatgcaagaaaactctcactcagaaactctcaacaatactctcacagcaaatcaagattcaaatggataa

SEQ ID NO: 22314 - DNA, 153 bp, Glycine max
  Peptide Sequence Number=SeqID_139092
atgcatgaagattgggcagtgttcgcacaccgggatactacttatttgtctggatgcgaaatctaccagcaagtgcactggatcgtaaagctcaagtacgaaacaccgatgtctcgtgagtttagcctaattctaattaaacttcgttcgtag

SEQ ID NO: 22315 - DNA, 683 bp, Glycine max
  Peptide Sequence Number=SeqID_139093
cactgccgcgatcggctgggctgttttgggttttggtacgctcaaagcgaagtacttaccctataagtacgtgaataattatacggtgccagtactgatcatcggacttgctatcttagcaagtgcatcccgttcctcaagtgatgaagcgagagcacataacctcggttttaaggatggtagagagttttctcacgcccgggaaaataacattaccaatactaccgattacgcaaaatatctggcagagcagaaatctaaagctgaatcaaaagcagctcaggatgctgctcttgcagcagagaaggaacaaaaggcaagagaggaagaaattgaatgcatgcgtagtgataatcccgaatgctatatatcgaagcatgaacgaggggattatgtatgtgcaaaagctgtcgaagattctgcaaagtacgattttaaatggactgatggatttactgaaccaaaattctcaaaccttagctgggcacaggctcaaaacggatttggtgcatttaaacatatagagtactcctgtacgtacaatgctgatactgttgcggctgtacctgatggtttgtcgtataatgatactgtaggactgcggttacagatcaagcgcgtggatccggggctgaatgaccgaattgccgatcttgattactactggttacaagagcggggta

SEQ ID NO: 22316 - DNA, 207 bp, Glycine max
  Peptide Sequence Number=SeqID_139094
atggggaagtcagcttttgggggtgtatattacactagaattgatattgacatggtgaaagaaagagacgaaggggagatttttttttttgctgagcaattaatggtgaaagaattttcaaggtttcaactttcattcgccttcatgcatggttgggaccatccatggactcttgaaattaatctaaacattgccaaactaccttga

SEQ ID NO: 22317 - DNA, 354 bp, Glycine max
  Peptide Sequence Number=SeqID_139095
atggccttgtcatggtctcagtttgctctcactatggtaatgcttttgaaattgcagagcatcttttccttaattgtccctttgtgcttgatatacgacagtggatttatgcaatcctcgatgactaaattcaacatccttaagttttttcttgtgaaaatttatccgtccaaagctcctgctatgaaatttgtgatgtgggaacctcctgctgatggatggattaagatcaacacaaatggagcagctccaggatctccaggaattgcagcttgtgttgtcctgtttagaaacccccttggtgactttcttggtggttttgctcatcatatgggaatttcttttgctttatag

SEQ ID NO: 22318 - DNA, 1227 bp, Glycine max
  Peptide Sequence Number=SeqID_139096
atggaaggaagtgatcattcattagtaccacaatggctgaaaggcagtggaaatgacagtagggtggctggtataaacaaccaattcacatcatcgtcatactctgatcatattacttattctggtcgccaatggagttctagtagcaaaggtcctggccactcaaggtcatatagtagttctgagagaagctggcaggatacatattgggagaaagatattggcagtgatggcctgaactcagcatcacatgatattcctatgacagttagcaaggctatgatgatgcatcggtataatgttcctacaagcacatcttctattactcttggcacaatgggcctcagtatggctgagacattggctcagggtccacctcgctctcactcaccacaattatctgctagtactcaaaagcttgaagcgttggcccttaagcaatccaggttattaatccctgtgacaccatccacaccaagatccctggtttctagctcctcagagaaatcaaaggtcaagacagggcagcagcagtattccttctcccattcacgtcgacccaatcattctttacatggtgctcatccgaacttagatatacagaaaattagttctggtaattcccttagtgtcaatacttcccgagagtggaatggtgtctcttcagctgcaaaggacaacttaagtcccaatagtagagttgtgcttagtccagttggtgccactagatccacttctctatctgctccttctaggaacttaggtaacaattcaaccccttctgcatggataacattggagaagaggcctacttttcctatccagagcaggaatgatttcttcaagaatctttcaaggaagagttccttggaaaaaccttgttctgatgttttgtctattgacatgtcttgtgccttggagaattctgaagccagcatgaggaatgtctctagttgtcccattctggagtctagagatgcttctttagtggatacctctggtttgaacatgttgactgactacggatccacaattactgagaacggcaatgctgccaatgaacctttgaaactttcaagcagcagtgagaagcaagatagcagaaacccatttccttatccagatgaggaagagattgcatttttacgttcgcttgggtgggaggaaagtgctggagaatatgatgaaggcctcactgaagaggagatacaagacttctatgagaag

SEQ ID NO: 22319 - DNA, 207 bp, Glycine max
  Peptide Sequence Number=SeqID_139097
atggagaattggcgaacaacgctagacaatgacattcacggggctccagactcgaaggtggaggacacaagaatagcgctaggcaatgacattcatggggctccgaaaaaagtggagaatggagaattggcgaacaacgcaaggcaatggtattcgcggggctctagactcgaaggtggaggaatcatgaatagcgctaggcaatga

SEQ ID NO: 22320 - DNA, 1132 bp, Glycine max
  Peptide Sequence Number=SeqID_139098
gtgatggacaaactgaggtccttaatagagttcccgaacaataccttcaaagctttgttcatactcatcaggcacgctggagcagattcctttctctaacagagtggtcatacaatacttctgttcatactgcaactggtctctctcctttccatttcatatttggaaaacctccaccttctattcctcactatctgttgggttcatctcctattgaggctgtagatcaattgctaactgaatgccaggagctgttaattgtgttgaaacgtaagttggaaaaggctaaacatcagatgaaggttcaggctgactgcaaatgccgtgatgtgtcttatgctgttcatgagttggtgtatgtcagattgtgtccttacagacaactatccgctacaggtggtccttaccataagttgtccatatggttttatggtcccttccaaattcttgagaaaattggctctgttgcttacaaacttgctctaccaaacacctctaaaatactccctgtattctattgttcacttctcaaaccccacattggtccacttcctaactccttcaaccaacttcctgcttcatctcattacaaccatcctctagtcctgcctttaactattctgaagtcgaaatgggatcattccactattcctcccacacgccatgtcttggttcaatggcttggcctacctgatgactctagctgggaaaattgggaagaaatgtgttctgtctcccaccttgaggacaatataacttgtgaagagggcaattcagacgtggccaacaacaagctaacagaggaaggaaggcccaagaggaagttaccaagcccattcgttacaaggactagcatggctcaagacaacaaatatcttcccttttatcatcctttttgtatgttgaaacagccaactgaatgtaatacatacgcagatattgatgctgcatataaatgcctaaaagagcaatacggggtgaaagatgaacaattgatattgtatggtcaatctgttgggagtggtcccacacttgatcttgcttcacggataccagaattaagaggtgttgtcttgcatagtccaattttgtctgggcttagagtactataccctgtaaaacggacatactg

SEQ ID NO: 22321 - DNA, 279 bp, Glycine max
  Peptide Sequence Number=SeqID_139099
atggcggtgttgttggaggagcgatggggaattgggattgtggtgacggtggtgtgtgaatcagtgaagtttggtggatctgggattcagatatgtgtctcacacctcgctcaaagcaagagaattagaacagagagtacacgttggaccaatcatcggaggccagtatcttggagatcgaacaaggtagaactcgttgagggcatgtccaaggcattcagcgaggagtccaagcaagttgagagcataagaatcaaagtcagcaatgccttagcctga

SEQ ID NO: 22322 - DNA, 2340 bp, Glycine max
  Peptide Sequence Number=SeqID_139100
atggcaactttgtacggaagactaagtaggagaaacatattccatcaactacctcgtatccgctattgtcatgcgtcagcttctccaacccataagtacaataactcgtcaccgttaaaccgatccaacaaaaaaatatcgaatctgattcgaagtggtagactaagcgaagcgagagcactatttgattccatgaagcaccgagacaccgttacatggaattccatgattactgggtacgtgcatcggagagagatcgccagggcgcgccaactgttcgacgaaatgccccgaagggatgttgtgtcttggaacctcattgtttcgggttacttttcgtgtcgcggaagcaggtttgtggaggaaggaagaaggctgtttgagctgatgccccagagagattgtgtctcttggaacacggtcatcagtgggtatgctaagaatggaaggatggaccaggctttgaagctctttaacgccatgccagagcgtaatgctgtgtcctccaacgctctgatcactgggttcttgctgaatggtgatgtggattcagctgttgattttttcaggacgatgcctgagcattattcaacctcactcagtgctcttatatcggggcttgttaggaatggtgaattggatatggctgctgggattctgtgtgaatgtgggaatggggatgatgatttggtgcatgcttataacaccctgattgcgggttatggccaaagagggcacgtggaagaggctcggcgcctttttgatgggattccagatgatcgcggtgatggtgatgaaggtcaaaggagattcaggcgaaatgtggtctcttggaattcgatgatgatgtgctatgtgaaagcgggagatatagtttcagccagggaactctttgataggatggtggagcaggatacgtgttcttggaacactatgatcagtggctatgttcaaatctccaacatggaagaggcttcaaagcttttcagggaaatgccaattcctgatgtactttcatggaatttgatagtatctgggtttgcacagaagggtgacttgaatcttgcaaaagatttctttgagaggatgccactcaaaaacctgatctcatggaactcgataatagctggctacgagaaaaatgaagactataagggggctattcagctattttctcgcatgcaatttgagggagagaggccagatagacacacattatcttcagttatgagtgtgtgtactgggttagtgaatctttaccttggtaagcagatacatcagcttgtcacaaagattgtcattccagattcaccaataaataattccctaattaccatgtactcgagatgtggggcaatagttgatgcatgcactgtatttaatgagataaagctttataaagatgtgatcacttggaatgcaatgattggaggctatgcatctcatggcttagctgcagaggccctagagcttttcaaactgatgaaaaggcttaaaattcatcctacctatataacctttatttcggttatgaatgcatgcgcccacgcaggattagttgaagaaggaaggaggcaattcaaatccatgattaatgactatggtattgagcgacgggttgagcactttgcctcccttgtggacatcttgggacggcaagggcagcttcaggaagctatggatttgataaataccatgccatttaaaccagataaggctgtgtggggtgcactactaagtgcttgtagagtgcataataatgtagaattggccctagtagcagctgatgctttgatccgacttgaaccagaaagttcagcaccatatgtgttgttatataatatctatgctaatttaggacaatgggatgatgccgagagtgtgagagtgttgatggaagaaaagaatgtcaagaagcaagcagggacttcaatcagcaatatatgtcagatcatgccattgttagagatgcttgcattcaacttaaccatgtttatactgtcagataggaaaaatgatcttgactggttaagtattgatatcaattcgctggtgtcaacaatacgtgatttcaaccttggatggctggaagattggagatcaaacttcaaatcccaacccatgcatcgatttagagatgcagaatgtcatggcattggaccaagaatggagtgctccgggttatcactggacactggagaatggagacagctgaagttgcccgtggagcatgagaaaaagttgcaagataactactctgtcctcgatgttatttctgggaaagtatcccgaccaaatactactattcccgtatcaatgaagtatgatgagactgaatag

SEQ ID NO: 22323 - DNA, 702 bp, Glycine max
  Peptide Sequence Number=SeqID_139101
atgcagctgtgcagcttatctaccattgctcgtgagtatttggctgtacgaactataagctgtctcccatacaaggatttaatattaaatgcagttggagagaattttggcacagaagccgagggttggaaaatcccaatccctttgaaggaatatgttgaaagtactttcaatcagtaccaacgtgaggccataacagctggtctatcatcaaaagcctttgtcttgatacaggggcccccagggactgggaagactcagaccatacttgggattctaagtaccattttgcatgctactcctacaagaatgcattcaaagacctatgagctaaggcagggaccacaattacctattgaggagaaacaaaggcattgggcactagcgtctccatggcttaatggtattaatccaagggatagtttgatgccgaaagatggcaatgatggtttttttccaaccactggaaatgaactaaaacctgaagctataacttcaaatcgcaagtatcgtgtaagagtgttagtatgcgccccatcaaactctgcccttgatgagattgtgttgagggttttcaatggaggtatacatgatgaaaatgaccatgtttattgccctaaaattgtgcggattggtctcaaagcacatcattctatcaaggctgtttccctggatgaacttgtatgtggaagattagactga

SEQ ID NO: 22324 - DNA, 438 bp, Glycine max
  Peptide Sequence Number=SeqID_139102
atggaggagtacttcgatgagaccagtttggaggaaccaccacactcagattctaccctcactcttttggaggattccaaccttaccctgaggcttagattagcctcaacgctttttcgggtcactcttctcacgaagccttacatttattgggtcacttggcccaacactcaatcacaatccttgtggatagtgggagcacacataatttcatgcaagacaaagttgcaaatgtcctacccaaacccaccccatcctcttcaccaaacactcccactcatcccaacacactcctttctgtcctcatccaccactttaaccatctattctttaccccatccacacttcctccaaaccacaccaccaaccatcaaatccatctacttcccaactcaaccccaaccaacgtttgtccttgttgttaccttcactctctga

SEQ ID NO: 22325 - DNA, 372 bp, Glycine max
  Peptide Sequence Number=SeqID_139103
atgaactgcttagcctcaacagggaagcaactaaatagattttccaaacctaagtctatggctaaaagtaggagtcaatctaagacatgtcatgatggcaaagcacgaagatttttactgaagcttggctctgaatattactcatctggacaagctatatgtggcccaaaaatgcttttagggattgaaaactgttattttgagtttcttccaagatcaaaagtggttttaacctttaaacttttgtataaagtagaaccttgctgtcagctggatgattttatccaagtagcctacacacttgaatacatcacaggtgcttgtcaaggtcaaaagcagaaaaagattgaacaatatcaaagctgcaaatag

SEQ ID NO: 22326 - DNA, 213 bp, Glycine max
  Peptide Sequence Number=SeqID_139104
atggaagtgctgcaaagattgcaagatgcagggggttgcctgaaaatagccagaatgtcggtgggttgccagaaaatgatggtttctgaagctcaaaccatgggtggacagtttctaaagctgaaaccagatggcaagtgtaacagagatgtggctatacagcatctacaactggggacagagctagaatgtttgcaactagagacaggctag

SEQ ID NO: 22327 - DNA, 153 bp, Glycine max
  Peptide Sequence Number=SeqID_139105
atggtgaaagagtcctctgagcctaaagtgactgaaggaaaacaaagtaacaccgagataaggaatgctaaccttttgagagagagaatgacatcgagagcgagagtgacagagagagtgccgatagtgagctcagagggttcgatggagtga

SEQ ID NO: 22328 - DNA, 282 bp, Glycine max
  Peptide Sequence Number=SeqID_139106
atggtgggagttccagagaaggataacacagggccaatggatgccattttcgatcaaagaaaaagaaaccctaatggagtagaggaagaggatgcatgggttggaaagaacaagctgaaacaagggctgaaacgtgcccagaagaacacgacgaggcgtttgggactggtccggcaagctttcagtggccggacggcggcgcgtggactgcacgcgtcggaactggcgcgaactggtgacggcgcgtggctgagattctggtcacgcgacttgcaggggtga

SEQ ID NO: 22329 - DNA, 477 bp, Glycine max
  Peptide Sequence Number=SeqID_139107
atgggcggagtcacctcctcgatcgccgccaagttcgccttcttcccgccgcacccgccgtcctacacggtggtcgccgccgaggttggcggcgtctcggaccctccgccggcgccgccgcgactcgaaattcctgaggtgccgagcaaggacaacgtggacgttctcaagcttcgcacgcgccgaggcaacgaaatcgtggcggtgtacgttaagtaccatagacccacctgcaccatgctctattcccacgggaatgccgcggatttgggccaaatgtttgaacttttcgtcgaattgagtaacaggcttcgcctcaatgttatgggggaaaaagtgattaaaggaaggttctgttttctttgggtaaagggtagttgcggaatcgaaatgacggcggcggaggcagcgatgttaaagaggaaggggtctgttgtagctgaactcaatgcagttgcagcttcagttactatataa

SEQ ID NO: 22330 - DNA, 516 bp, Glycine max
  Peptide Sequence Number=SeqID_139108
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaaattggctaaaaagtcatcccaatacatgattccaaaggcactgaaggagacgccaaatgcagatggcaatgacgtaaagggagctcatagtgaacaagtcgtgtgttttgcagccacagccaacagttgttatgaagaaggcataaaacaagaaagcgcgacaagcaccagcatgcatcaaaggaccaccacaacacctaagggattttatgtaaatccattctgttacaagaatactgagctgctagggagggattggctcctgaaaaatatactatcagcccttcttccccatcctgcggcaccatgcaacgctgcactccacatctcgtttttgttttattccattatcgcaaatatcccattttctgttattctctag

SEQ ID NO: 22331 - DNA, 835 bp, Glycine max
  Peptide Sequence Number=SeqID_139109
gtcgtcgaggaaaaaattcggccttctcgaaaagcacaaggactatatccagcgtgctaaagcattccacaagaaagaagacactttgcggaaacttagggaaaaagcagcgaatagaaatgaagatgaattttacttcaagatggttagaacaaaaaccgttgatggagttcataaaccagagagtgaagcgaataagtatactcaggaagagcttatgctgatgaagactcaggacatgggttacattcttcagaagattcagagtgagagaaataaaattgaaaggctaactgcctcactgcactctatcgataatcagccggcgaacaagcatgttttctttgctgaggacagacatgaaaatttgactggtttgatgataaattatgttgaatatatcattatggctattatgatacaaaagggtatgcttggagaagtagctcaatgtaaggttggtattcatagagaacagggagagagaattgtgtttatcaaattaacagaaagagaaaatgattttcattcattcatttaccagagggcattacatagggaagaggctaaagagttagaatcacgacatcaaaaaagtaaaattccacttacttctggtgatattcctgctggcattaagagaaaaacagatcggtcttaccaagagttggaagcaaggaggggtagactcagccaactagagaaaatctacatggatatgacaatgcagaaggagttgcagaaaaaaggtaggaagcgcaaactacgtgaagacgagattgtttgtccaacaactaaaccggtatacatgtggcgtgctgaaagaaagcgttga

SEQ ID NO: 22332 - DNA, 744 bp, Glycine max
  Peptide Sequence Number=SeqID_139110
atggatatgaaagagaagaaattaacagtgattggaacagttgatccggtaactgtggtgagcaaattgcgcaaaaactggaaggcagacatagtagcagttggaccagtgaaggagcctgagaagaaagaggatcccaagaaagtagaggcaaagaaagagggagaaaagaaagaggagggaaagaaggaagaagggaagaaagaagagaagaaagaggatgagaagaagaaagatccacccccagtcccagatcctgttttggaatgggtcaaggcttatagggcatataacccctacatgaccacacactactatgctccaagcatggaagagaatcccaatgcctcttccgagtccattaactcactgagtcaaacagccgagtcgagatcgcttaacatgttggacggaatactcggcagaggcttcaccgcgaaatgcaaatcgttgatcaaattgacgaacaggcgaatcgatgtgatacggaggaagagaagagcgacagagaagtttctgaagaaagatattgctgatctattgctcaacgggcttgtggttgagttaacactgtcctcttgctatggtttcgttgagaattgctgtgagtttgtgttgaagcatctccctgcgatgcagaaactgagtgtccttgccgctgccattggtctctcttcaccacgccactgcgctgccgtgccacctcgccactgcaccgccacccttagtcggccattgtgttag

SEQ ID NO: 22333 - DNA, 1401 bp, Glycine max
  Peptide Sequence Number=SeqID_139111
atggtgagccaacagcttctgtccaagattgccaccaatgacaaacatggagagaattctccatattttgatgggtggaaggcatatgatagaaacccttttcaccctacaaaaaatcctcagggtgttattcagatgggtcttgctgaaaaccagctttgctttgatttgattgaagagtggataaggaataaccccagggcttccatttgcactcctgaaggagtgcatcagttcagaaatattgctaattttcaggactatcatgggttgcgagagttcacaaatgaaatggcaaattttatgtcaaaagtgagaggaggtagggtcaaatttgatccagaccgtatattgatgagtggaggggcaacaggggcaaatgaactaatcatgttctgcttggctgatcctggagatgcttttatgattcccaccccattttatcccggaactggggtgcaaataattcctgtccactgtgatagctccaacaacttcaagataacaagagaagcacttgaagtagcctacaaaaaagccaaagaggacaacatcaacgtgaaggggttgatcataacaaacccgtctaaccctttaggcacaacattagacaaggacacgttgaagagcctagtgaatttcatcaacgaaaaaaacattcacttagtttgtgatgaaatctatgctgccactgttttcagctcccctagttatgtaagcgttgccgaagtgatccaagaaatggaacattgcaaacgtgacctaattcatgtgatttatagtttgtctaaggacatggggtttcctggcttcagggttggcatagtttactcattcaacgatgaagtggtgaattgtggaaggaaaatgtcgagtttcggattagtctctacgcaaactcaacacatgttggcttcgatgttttcggatgaaaagtttgtaactaggtttctttcggagaattctaggaggttggaacaaaggcacgaaaagttcatgaaggggcttgaagaggttaacatcactcgattcccaagcaatgcgggacttttttgttggatgaacttgaagagtttgttggaggagccatcttttgaagctgagttgaagctatggcgtgtgattattcatgaggtgaagctcaatgtttcaccgggatcttccttcaactgttctgagcctggttggtttagggtttgctttgccaacatggatgatgaaacagtggatgttgcactcaacagaattcgtgcattcgtaggtaaagaaactaagaaatcggtgggattcaaacgatggcaaccgaatcttaggctcagtttctcttcaaggatatttgatgagagtgtcatgtctcctcattcgcctattcctacttcaccacttgttggagccaattga

SEQ ID NO: 22334 - DNA, 267 bp, Glycine max
  Peptide Sequence Number=SeqID_139112
atgtggaaggctctgagcaaatgtataaacgatataaaatttttagtaagcagctggctcacctcaggagataattgcggtgcaaaattaaagggtgttgttatttttggtgcctgcgttgatctggtcctggagatgaaaaaccaagcagtgactaaactaaaatggcttataagccactttggtgaaaaactcatgttcctcatggcttctattttcaaaagagagatcatgactacgcgtgagaatcctgacgcccctagctga

SEQ ID NO: 22335 - DNA, 372 bp, Glycine max
  Peptide Sequence Number=SeqID_139113
atggaggctgagacagagactatggtggagaagagggagataatcaacaatgtgatgtgccttttgacagacccagatggaactccttttggtgctcctatgtacctacctcagaatgctggtcctcaacacctcaaccagattgttaataagcttctaaacaatgcattgcctatagtttgtcaacctcaagctattttccggatccgtcctgtgaatcgctgtacggctactatttctggtcatgctgaagctgtactaagtgttgccttcagtcctgatgggcaacaactggcaagtggttctggtgataccactgttcgattttgggacttgaccactcagacaccattgtacacttgcacagtataa

SEQ ID NO: 22336 - DNA, 1866 bp, Glycine max
  Peptide Sequence Number=SeqID_139114
atggtggactccggcagtgacttcgccggcatcatttgttcgatctgctacgaacccctcaaccccattaacgaggatcttcaatcggtctccatctgtggccacgtttttcacgagctttgtctacagcagtggttcgagtactcttcgaaagggaagaagcacacttgccccatttgcaaacagggttgcagggccagtgacgcgtgcaggctctattttcagtcagtgggagatgcgaacaatagtgtgaagccttcgaagtgctttgaacttgaggaagatgctggggttctgcgtagggaagtgaagagattggaggtgaaagtttcggggcttaattctcaggttgaagggcaaacaaaggaattagaaggactcaatgaggagaagggttctgcgcagggaagtgaagaggttggagatgtgactaagtgtgtgacacttgatgttcaaaaggggataagaaataggaagaccaattggaggaaattgctttgtacttgcaaggagcaggcaaagatagagacagctttaaagaatgaggctttaaatcaaaaagcatctatacaattccagcttcaaatgaaatcagaggagcttgagaagtcaactttggagtgttttagattaaaagaaaggaatatggctttggctaaagaacttgcagcattaaaattagtatctgatctggacattgatgaagaggaggttttgaagcttgccactttgggtaatggggccaacagtaaagacacaatagatacattgaaaagatctctggtcatgcggaataggagttacaaagaattgatggccaagtgcaatattcttggaagaggtgaggctcgttatagcaaaaagcttgagaaggctaaagagaagatcacaaaactgaaggagagggtacaagaactggagacattagctgaatcaaaagagaacaaatatctgaggtctctgaaactttcaaaaataacaaagagttcaaagaatctcgaagaaaacatcaaatctgattctgaggtattgacagcgtgcaaattttcatcaaaagaacaaagcaaacaaatttcaatacccaaatctggaatagacctgactgcaaacaacaacagtaaatcttttcaatctttcaagatagagaactccaatgttactaaaaataagactgtgaatattagtaatggaagtagaagtaccttttctcttgatataaaaagagagtatatctcaattgatgacaatgattcagaaggcactaatgctttgcaaggatgttcaaaacacaactacaaagatcaagactgggatgatattgcttttagcaagccttctcttgtgaagctagagcctgtgtctggcataaaggctgaaacatcattgcaaggaaaatgtactttggctgagtctcccagagttgatattgacattgacatggctaacatttcagctagtgctatggatgaagatgtaaccttacaagccaacattaaacaacccatggtgaacattaggaaggagtcaccattaacactttcaaattcagctccagggagcatctgcttttctggtggattgcttggtcctgatggaactcatcgatacttgggtaaatggtgcaaacgaggacagaacagtgaaccatcatctgcaaaacgatcaagtgatggggatttaattgctgttggggctgatggtagagggggaagaataaaagttctaaggacttctagccaaattctctcgggtggtaaggaaaatttactaagttcaaaaaggtcaaagttaggagttaaaacaagtggtttgcaatcgcaggggtgcctgcagatagaacacttttttgggagagtctctcagtaa

SEQ ID NO: 22337 - DNA, 450 bp, Glycine max
  Peptide Sequence Number=SeqID_139115
atgccatcgttgggaatgcaattaatcaccgaaggaaagtacatcgtatttggaagtggctcaactcaacttctcaatgctgctgtttatgccttgtctctcaactcttcaatgtccccagcaaaagtggtagccacagcaccatattactcgctctatagaggccaaaagcaattgtttaattctagggattttagttatgaaggagacacatccttgtggaaaaacaacacaaatagcagcttcagatttattgagtttgtgacttcaccaaacaatccagatggaaacttgaacaaggaagttctcaaaggctctgatgtgaaaaccatttatgatcgagcctattattggccacatttcactgctattccttcaccagctgatgatgatcttatggtgtttacaatttctaagctcacaggccatgctgggagtagatttgggtga

SEQ ID NO: 22338 - DNA, 1662 bp, Glycine max
  Peptide Sequence Number=SeqID_139116
atgtcattctcattgtcaagaaggttcagctcttttcttccaaaccccactttccctctttactttcactctcagcctccatccattgacaatgttgttgatgatgctatttcccagttcaatggcatgctccttatgcatcataccccgcccatagtcgaatttggcgagattttaggatatcttgcaaagatgaagcattattccactgccatttccctttctaaacaaatggaagtcaaaggaattgagccaaatcttgttactttgaacatccttatcaattgtttctgccacttgggccaaatgtccttttctttttctgtattgggcaaaattctaaaattaggttatcagccgaataccataaccttgactacactcatgaaaggtctgtgtctcaagggtgaggtccagaaatcagtgcactttcatgacaaggtcgtagcacaaggatttcagatgaaccaggttagttatgggaccctgctcaatggactatgtaagataggagaaacgagatgcgccatcaagtttctgcgaatgattgaagacagttcaactgggcttaatgtggtaatgtacaacaccatcattgatggtttatgcaaagataaacttgtaaatgaggcttatgatttttattctgaaatgaatgctagaggaatttttcctaatgttatcacttacactactctaataggtggtttttgccttgcgggtcagttaacgggagcattcagtttattaaatgaaatgatattgaagaacatcaacccgaatgtttatacctatgctatattgattgatgcattatgtaaagaaggaaaggtgaaagaagccaaaaatttattagctgtgatgacgaaagaaggagtaaaacctaatgttgttgcttataacactttaatgaatgggtattgtttagctggtgaagtgcagggagcaaaacagatgttccacgctgtgctccaaatgggagtaaatcctaatgtttgcagttacagtataataattaatggattatgtaagagtgaaagggtggatgaagccatgaatctcctaagagaaatgttacataaatatatggttcctgatgcagcgacatatagttctcttattgatggtttgtgtaaatcagggagaattactactgccttgagtcttatgaaggagatgcactacagaggtcaaccagctgatgtagtcacctacacttccttattagatggtttctgcaaaaatcaaaaccttgacaaggcaactgcactattcatgaaaatgaaggaatggggaattcagccaaacaagtacacatacacggcacttattgatggattatgtaaaggtggaagacttaaggatgcacaaaagctttttcaagatctcttggttaaaggctgttgtatagatgtctgcacatataacgtcatgatcggtgggctttgtaaagagggcatgcttgatgaagcattggccattaagtcaaaaatggaagacaatggttgcatccctaatgttgtaacttttgaaatcattattcgttctcttttcaagaaggatgagaatgacaaggccgagaaacttctccatgaaatgattgctaaaggcctattacgttttaggaattttcatggtgagcgatctctagatacaaattaa

SEQ ID NO: 22339 - DNA, 1008 bp, Glycine max
  Peptide Sequence Number=SeqID_139117
atggaagccgattgggatctccacgccgtcgtcagaggctgcaccaccaccacttcctccgccgccacaaccaccactaactcctcctctgtttcttcctctggctttggtgcttgtaacccaccttcaacttcaagctgttttttctctgtttacaaccctgctgaacaaggaggccatgttttgtctctttcagagaacccctttgaagcaaggagttccaattccattgaagggcttcacgagctttgcaagcctttcttcctcaaaccacagcctcagactcttcaaacctcttctccactctcttccttttcttattcttccacacccaaatcacctcacaaacagcaagaacaaaagcagtctcagcctcagtttcaccatgccggttctgccaccacgccacgatccaaaagaaggaagaatcagcttaagaaggtttgtcaagtggcagctgaaaatctctcatcagacatatgggcttggaggaaatatggccagaaacccatcaaaggctcaccatatccaaggggatactacagatgtagcagctcaaaagggtgtttagctaggaaacaagtggagaggaacagatccgacccagcaatgttcatagtcacatacactggtgaacacaaccaccctgctcctactcataaaaactctcttgccggctccacgcgccacaaacctcaaactgccactgccgaagacgccgccaccataaaaccggcttctccttccacctcagggatggaagaagaggtggcacagcacagtgcaaagtcagagagcacagaagaagaagacatggaagatctcatgaaaaatgatgaggaattaccaaacgaatttggcttaacagaaacggtggtatcagatgatttctttgaaggattagaggaactgacagggtctgccactgacccgtttacagccattagtagcaacattgatcggtggccactggccaataattctgccactgccgctggtggtagctga

SEQ ID NO: 22340 - DNA, 828 bp, Glycine max
  Peptide Sequence Number=SeqID_139118
ggaaaggaagtagaagatcctgtaggttctggtaatgttggaacaaagaaaggcacccctcgttgtgttggtggcaaagacataaatgcggaaatggttgatttggtgactcctggcccgggtttagaggaaaggagtgttgtttctgccaagaatttgaaaggtttggagattgaaaggttggagtttgaaatgaattcctccccggaaataacaaggggagattctggaatttgtggggttgaggaagacatgaaaagtggactcaatgaggaacaagttgttaacagtcagggaaatttgcattcagaaccacttgtagttgctttagaggaacttaacagccctttggtggaggaagaagttgagaaattgggtgacaaaaataatcttcttgaaggtgtttgtgagaatggaaagggaagagatgaagctgtagaacaaggcgaccacaatagccctcaagggtcaaacatgaaggatgtgaatgttttacatgtttctcaagtggaatctctttaccctatggtggaagaagatgaagctgctgaacaaggtagcctcagtagccctcaaacatcaaaaatgaaagatgtgaatgtttatgtttctcaagaggaatctggttaccttatggtggaagaatatgaagctgcaccacaaggtgaccacagtagccctcaaggattaaacatgaaagatatgaatgttttacatgtttctcatgaggaatctgtttaccctctggtggaagatgatgaagctgtggaacaaggcaaccagaatagccctcaagcatcaaacataaaagatgtgaacgttttactg

SEQ ID NO: 22341 - DNA, 330 bp, Glycine max
  Peptide Sequence Number=SeqID_139119
atgccccggtgcccacttatcatcacagtagtagcagaggcctttgtctcgtttaagggccatttcttcggtgaggttgggaatgggggtgagagttggggtggtgggggcgatggctacggcggcgatctgagagcttatcttcctgaagcttcgccagtgccatggcctgaggtcaggggccaaccccgatatgaagcagctcaacaacaggggaggagcgaggccgacgaccctattagcaaggcgctcgaattcggacagatactcgtttacagtaccgcgttgctggagtttgaagagcgccccatatggatcatcgtaatatga

SEQ ID NO: 22342 - DNA, 1482 bp, Glycine max
  Peptide Sequence Number=SeqID_139120
atggatgctgcctatccattgttgtccgtaatcactgaaaccggtgggcttcctagtggatctttagggcctgctattgggcatcatgttgttgctgttatcatgcctagtgttgcttattgggatttggttgatctgtttactcagattgatgttttgatagtcttacttaaaggaagcaaaactgaaacagggaaattcaatgcagctgtttctgaggagtttcaagtgatttctgtggttctggttcggtttattgaggatcttgagggggcttttgcagaaggctgtgactctgtgacaatgccttctacagaaaatcagggcttttcgttgtccttttcctcgtttggccgttccatatttggtgtcgggcaggagcaggttcattctgtggaagcaagtaatgaatctgattcctgtaatttagagctcgggtcattccaaaagcgtgttaccgatcgatttcaagacctttctgtagctagtgatgagcaatttctctcaattgattggattcagaagctcctcggagcatttatctgctgccaagaggaattcagagccatcctgttgaataacaaagagcaggtcacaaaacccccccttgatcgcatgatttctgaattctttgagaggtcagtgaaggcgcttgacatttgtaatgctagccgagatgggattgagaagattcgcacatggcaaaagcatctggaaattgtgttttgtgccttgggttcgagtaagagagcgttaactgaaggccatttccggagggcaagaaaggcactgatggatttagcattggcaatgcttgatgaaaaagagtctggatcagttttttctcagcgtaataggtcttttgggcgacataactctggcaaggatcatcactcctcatcagggcattcaagatcgcattcgtggagtgtctctcgttcctggtctgcagccaagcaactacaatccattgcgaataaccttgttccaccccgtgctactgaggttgctgcaacaagtgggcttgcgactcctgtttatacaatgaactgtattctcctgatagttttgtggacccttgttgcagccattccttgtcaggataggggtctaaacattcatttttcagtcccacggcaattatcctggagcactccggttacctcacttcatgaacgaatcacggaagagtcaaagaagcgagagcgccgaaactcaaatggtttgttgaaggagatatatcaagttgagataagcagccgccgcttgaccgacctgatagattcagctcagtttccgttggcagatgaccagaaaacagaagttgagcgcaatgtgatggagctgatgcgtgtttgtgaagctttcagaaatggatcggatccgttggagcgccaagtgagggaggtcttccagaagataatggcatgtcgaactgaggggctcgattatcttggcacgccaagccatacagagcaatga

SEQ ID NO: 22343 - DNA, 234 bp, Glycine max
  Peptide Sequence Number=SeqID_139121
atggctagtctattcactggacatggcaagtctattctagttgccttcaaggttcagggaaccttggcttcgaaccaagcatatacccttgacccttcgtttctgcttattgtgttgcgagacaacgacgatggcatccgtgctgcggtgagtctgacgacgacgacgacgagtgcagagacagagccgcgatgtgggtgcgtcgacggcggcgcagggagtcttgagtcttga

SEQ ID NO: 22344 - DNA, 165 bp, Glycine max
  Peptide Sequence Number=SeqID_139122
atgaagaagattgcatttgctgctgtgaatgtgatgtacaagctggccataaatgatggaatgagcatgagggtagcttctgcatatcgccttgcttttgcttcggctttcactgtccctgtggctctcgtctttgataggtccatgattattgcatgcctttag

SEQ ID NO: 22345 - DNA, 105 bp, Glycine max
  Peptide Sequence Number=SeqID_139123
atgaaggtaatgccagggataaggttgaccatggccaacataaacgttgctgacgtcaaagccatggcttcgaggtttgcatgttcaaagaagctaccatgctag

SEQ ID NO: 22346 - DNA, 1083 bp, Glycine max
  Peptide Sequence Number=SeqID_139124
atggagaatttatacaaagttgaagccacaggtaatgtgaagcctgtactgttaatgattgcggtccagacactgtatgcagtggtgaatatcatgttaaagattgtggcagatgatggaatgagcttaagtgttcttgttgcctaccggttcttctttgcttctgctttcatcgttccgcttgctctcatctttgaaaggaaaagcctgcaatatgttactgggaaagttctattccaaggtcttctttgtgggttatttgggggatccttactacaaggtttctatgttaaatccttggccttgacaactgcagtatatgtcacagccatgttgaacctcatccccgctgtcacctacatcttgtctgttactctaagacttgagaagtcaaatcttggaacagcaggtgggatgaccaagttgctggggactttaacaggaatcggtggtgccatgatcctcactttctacaaaggaagaaggctatgcctctggtcaacaaacattgccttgttgcaccgtgagccatcatcacacgatgcccccataggttctctcttgttgggctgcatactagcttttgcagccgctctgagttactctgtgtggttgataatccagacaaagatgagcgaaaagtttccgtggcactattcaattgcagctttaacctctgcaacggcctcaatcctatccgttatatttgctctttctacggagagagattggagccagtggaagcttggttgggactttaggcttctaacagcagcttctgcgggtatcttggcctctggagtgtgttacccccttttagcatggtgtgtgcgtaggaagggacctctgtttacatctgctttttgtcctctaatgttggtgatagtgaccctttccgagacattggtactagatgagtgtctcagcgttggaagtttaacaggatcagtgttaattgtggggggattgtacatgttgctgtggggtaaaagcaaggaaaaacggatggaacatagtgatatagtgtcctcaaaaggcactcttcaatgtgaagcaattcacaataccgacccatcatcttag

SEQ ID NO: 22347 - DNA, 492 bp, Glycine max
  Peptide Sequence Number=SeqID_139125
atgacttcgaaagaagcatatgtgagcttcatggcttgcttatcggcttacatagccaaaaataaaaagcaagcggctattgcggccgtcgaaaatgaaaaaatggtttctgagaccgtcgaaattgaaagaacaactactgcgaccatcgaaatcgtaaaaatggctattatgaccatagaaaagaacatgaaagatgttgatgccatcaaggaagaaaagaacatgatggatattcatgtcatcaaaaaagaaaagggagtgatggacactgacacaatcaaagtttcgagaaacaaatctcaatattctttagaagagattaacccggggactgaagaaaatcgaaagcctacttatgaatatgaagatatgtttgcactcaatagagaatttgtggaacatagattgacaacctgtgaagacaaaaaaccaatgaagcaaacaccaagaagatttgctcctaatgtcttagagactatcaatgcatag

SEQ ID NO: 22348 - DNA, 168 bp, Glycine max
  Peptide Sequence Number=SeqID_139126
atggagattggaaggaggacacgtgttgaaggggggaggggcgcgccagtagttctggcgacttcgtgcatggcggacacgtggctggacggacgcgccagcactgttagcgatttcaagcagggacgcgccactgctgttggcgctctctaccagtttctgctgtga

SEQ ID NO: 22349 - DNA, 114 bp, Glycine max
  Peptide Sequence Number=SeqID_139127
atgaaagtagtgcaagagttgaaacctgcaattctgatgaaagaacataccaaagttgacatggagggtgcttttgatgtcattcttttgcggtctattcgggtatatggttga

SEQ ID NO: 22350 - DNA, 309 bp, Glycine max
  Peptide Sequence Number=SeqID_139128
atggcggacacgtgtcgaaggggggagggacgcgccagtagttctggtgatttcagcccacgtgaagtgggaaacgccagctctgttggcgccacaatggaagcgccagtgctctttgcgattcagcctagggtaggcagcttttctgcagcagctaggacagctttgcagcaggagaaggaagaaaacgccacttcctttgcagatggtagcgctactcctcttggcgatttaggagaaggaagaaaacgccacttcctttggcattttaggagaaggaaaaaaacgctactccctttggcgatttag

SEQ ID NO: 22351 - DNA, 690 bp, Glycine max
  Peptide Sequence Number=SeqID_139129
atggctaatgctacacctaatggttcggtgccacacaaccacgtaggagcagtgcttccaacaattcccacaatcaaaattgatgagaagcaaaccctagccaccagcgaagaccacaccagcattgactatttacaaagggcacagtggcttcgtgcagccgttttaggagccaatgatgggttggtttcggtaacatcattgatgatgggtgtaggagctgttaaaaaagatgcaaaagctatgttagttgctggttttgcagggttagttgcaggggcttgtggcatggcaataggagagtttgttgctgtgtgcactcagtatgaagttgagctaggtcaaatgaagagagagatgaatatgagtgagggaggagagagagacttggagacggagaagagaacattgcctaatccattgcaagctacttgggcatctgcactctccttttctattggtgcattggtgcctctactttctgctgctttcgtagcagattacagaactagggttattgtggttgtggcaatggctagtttggctttggtggtgtttggaagtgtgggggctcagctgggaaaaactcctaagttaaaatcttgtgtaaggttccttcttggaggatggatagccatgtccatcacttttgggttaactaaattaatgggtgctagcgctttagaataa

SEQ ID NO: 22352 - DNA, 359 bp, Glycine max
  Peptide Sequence Number=SeqID_139130
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagccccgtctgatagcgctctgtgcgcgtactccgaaagggaatcgg

SEQ ID NO: 22353 - DNA, 2283 bp, Glycine max
  Peptide Sequence Number=SeqID_139131
atggctacagtggcatcatcaatggttgcatcgtcttcgccctcgagtcaacccttttgttccttttcaaaccccaactcatcatcatcatcgctctctttcaaaaccaaagctattaccaggacaagaccaagaacaaaaaccagaactagaacaacgaggttaacatggctgaatcctcaccctcgtggtgctttggttgaggcaacaccaccaccaacaagttcacctccttccccaaaagatggatctatcaaggtgcttgcgcttccagagaaccgtgctgatgacattcaagctgaggctagagccctggctcgtgctgccaatgcaactgcctacacccctcagcttgtggcctccaaatatggctcccaacccatcaaggtggtggggagggcccttcaggttctgagtgcggtgggtttgtttggattgaagcttttattggaccagaaaagtggagtgcttgatcagaataaaaggattcgtgcaattgagcttagggacacattcactcggctgggaccaacttttgtcaaattgggtcagggattgtctactaggcctgatatatgcccagctgagtatctggaggagctcactgaacttcaggtagccttgattatttctgtgctttaccaggatggattgccaacatttcctgatgaggaggcctttgcatgcattgagagggaattaggactatctattgactctatcttttctactatatctccaacggctgtagcagcagccagtttgggtcaagtttataaagcccggttgaagtactctgggaaacttgttgctgttaaggtgcaacgccctgatattgaagaagctataggaatggacttctacctaattagaggtttagggtctctcataaataaatatgtggactttatcaccagtgatgttgttgctcttattgatgaatttgcacgtagagtctttcaagagcttaactatgtgcaggttttaaatcatggttgtggtcgcgattgcagtttcgttgcaatccttgatgatgtggtaattgtggtcacggagggactaaatgcaaggaggttcaaaaaattgtatgctgacaaggaagatatctttgttcctgatgttttctgggactatacaagtgctaaagtactaacaatggattgggttgatggggtcaaactaaatgagcaagaagcaattgagagacaaggattaaaagtcttggatctggtaaatgcaggcatacagtgcagtctcagacagttactcgagtacggatattttcatgcggatcctcatcctgggaatcttttggcaacacctgagggaaagcttgcttttcttgatttcggcatgatgagcgagactccagaagaagcaagatatgccataattggtcatgttgttcacttggttaaccgagactatgaggccatggctcgtgactactatgatcttaattttttatcaagggatgttgatgtatctccaattgtgccagcacttcgaaacttttttgatgatgcacttaattatactgtgagtgagctcaactttaagacactagtggatggtctgggaaatgttttgtatcagtatccatttaatgttccagcatactacgcattaatatttaggtctctcactgttttagaaggtttagcattgtatgctgatcccaattttaaggtacttgctgcatcatacccgtattttgctaaaaggctcctaacagatccaaatccatatctaagagatgctcttattgagttgcttttcaaggatgggaagttcagatggaatagacttgaaaacctgctagatcaggggaaaaaggatagagatttttctgctaaagaggctttacaacctgtcctaaaggtattattgagtccagatggtgaagagctgaggaatctagttataaaagaggctgctcgggtatctgaagcttttacccttggcacaatgtctgaaacatacctgtatattcctgacttcattaggacccttgtcttcaacggcaatgcaaatggaccctttatgatgtcagaaagtgaaatgcaaagcatgctagagcttagagatcaagtgattagaatatggggacttcttcgatcctccagtgattttgatccagctatgctgttaccaatactacaggtccttgagcaacctgaggcacgcagacttggggggcgtgttgtgggtgggatcactcaacgactcgcagcacgctttcttcagcaagtactccgagttccaacaacagcttcagaatag

SEQ ID NO: 22354 - DNA, 681 bp, Glycine max
  Peptide Sequence Number=SeqID_139132
atggctactagtacactcagccatgcagaagaagcacttccaagtccagcaaacctaaccgatcagaagcaaacacgagctattactgaataccatagcagcattgactatttacaaagggcacagtggcttcgtgcagcggttttaggagccaatgatgggttggtttcggttacatcattaatgatgggtgtaggagctgttaagagagatgaaaaggctatgctacttgctggttttgcaggattagttgcaggaacttgtggcatggcaataggagagtttgttgctgtgtgcactcagtatgaagttgagctaggtcaaatgaagagagacatgaacatgactgtgggagaggagaaagacttggagatggggatggagaaaagagcattgcctaatccattgcaagctactttggcatctgcagtgtccttttcaattggtgcattggtgcctctactttcagctgctttcatagaaaactacaggaatagggttattgtggttgtggcaatggctagtttggctttggtggtttttggaagggtggtggctcagctgggaaaaactcataagatgaaatcttgtgtgaggttccttcttggaggatggatagccatggctattacttttgggttgaccaaattacttggtgctaaagctttagataatgaataa

SEQ ID NO: 22355 - DNA, 473 bp, Glycine max
  Peptide Sequence Number=SeqID_139133
atggagaattgcaacacaactccaatacccatgatgccaaacttgaaattaacagaagaactagatgaaaagctagttgatgcaacattgttcaaatttatgggtaatcctctagctcctcacatgaccgcaactaagcatatcctgaggtatttcaagggaacaagtgattttggtttattgtttccaatagggaatgatcaaaacagatcatgcattgaagcctggtctgattcagactggtgtggtgataaggttgagagaaaaagcacctttggatacttgtttaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcg

SEQ ID NO: 22356 - DNA, 756 bp, Glycine max
  Peptide Sequence Number=SeqID_139134
atgaagttccctagtaacgaaggcccacagcatccgcacataggcaacgggaagttgtcgttgttgctaaggatgttcatcacgtcgatgacgcaactgacgaggccttctaatagcctcaagaatcattgtttggaatggaaagatgagaaaagggaggtacaacaagcaaaaataaaggaaaaaaaagaagaaaatcagaagaagcccaagtccaacaaggcgttaagcgcaggacgcgctcaacgcgcaagaagtcaaggcgctaagcgcactacacgcgctgagcgcgacgtggcgctgagcacgaggctttgcgctcagcgagactacgaaaagcccaagcccaagtttgcacctataaataagagggaacatcctgaattgaagttatcctcccatggaaggaaggtttaccaagcaatagctgaaaggttgttgatgaagtcagtggaattacttgaagtcagtgcagatgaagccagagttgaggcagtacagtgtcatggggcatatgttacactttttttactaacaacagtgaacagacgtgcatgtggtgttcttggacgcctttcgagacctcagttagagaggaagctacgcatggggagtttctgccttagtgcatattgttggatttatgagcatttttcatctgttgctaaggctattactgctacagactatcatgaaaggaaaccacgtgtttgtcgctggacctctgcaaaggcattaccagtgtcgacatattga

SEQ ID NO: 22357 - DNA, 582 bp, Glycine max
  Peptide Sequence Number=SeqID_139135
atgtctgacgtggaagagtatcgttgtttcattggtggccttgcgtggtcaacatctgatagaaagttaaaggatacgtttgaaaagtttggcaagcttattgaggcaaaggtggttgttgacaagttctctgggcgttctcgtggttttggatttgtcacatttgatgacaagaaagcaatggacgaggctattgatgctatgaatgggatggatttagacgggcgaactattactgttgatagagctcagcctcaacaaggatcaactagaggtgatggtgatcgctaccgggatcgtggtcgtgatcgtgaccgagatcatggaggtggaggtggccgaggatctaatggtggtgaatgctttaagtgtggaaaacctggggaggaaagtatggtggtagggaaagtagatatggtggaagcagtggtggtggttatggaccagatagagcagatcgttcttcaggggggcgcagcaggggatggtggtagtcatggagattctggaagtgatcgattttatcgtgatcgttcaggaccatatgagcgagagcgacggggatcaggaggctttcgttga

SEQ ID NO: 22358 - DNA, 384 bp, Glycine max
  Peptide Sequence Number=SeqID_139136
atggatgaggaagaaggtacgttgccgctagagaatgtacggaatgcacgagggagaggggagctggtgtggcactccaactttgtttgccgcgatgatgccaccgtggaagaggagtgggagaacatggagctcatggatggaaaccaccaccatcccatcgttggtggcaatgacgccaccgccatccccgatcactgctgcaagcatgctcttatggctactgtgaatgccatacctagaaatctccctatgtttgatgggaaaggttatgaagattggtgcatgaagatggatgctattcttggattccaagaacttgatgagatcgtgagagatgggtttcaagaaccctccaataatgctttagcagaacaggattag

SEQ ID NO: 22359 - DNA, 972 bp, Glycine max
  Peptide Sequence Number=SeqID_139137
atgtggtacttgtgcgttttcttccacaggttattggattacagaaaacccgaagtggaatctctggcacaactcttcggagcaaccgaggacccccaaaacggcgacgtttcctcgcaattgcaatggaaactccctcatcactaccacgcagattcccctttccatttcgtcaacctcccttcggaacaactcgctcgaaacatcgctacccgaagcatacttgtgaaggggatgtatgagctgtggggtgaagggagtagctatgaggagttgaaggagtctgtgttgagttaccctgatgaaaggaagttgccgtacttggattctgatagcactttcaagataaccgttgattgctttgggaaggtcattagcttggaggagcaaaaggagctcattcaagggctctcttatatccctttcaagggccgagtaaagttgaaaaacccggatcacaacttctggcttatagaagttgataactatggaggtaataatggtcttcctccaattgtacaaaagagagtcttctttggtcgcgaagttggtggggcagataggaagcttttacccacatatcagttgaaaagccgtacttatcttgggccaacagccatggatgctgaaattgcttttctaatggccaatcaagcactagctacttctgggaaactagtttatgacccttttgttggaactggaagtattcttgttgcagcagctcattttggagcaatgaccatgggtgctgacattgacattagggtagtccgtgatggacgtggtcccaactgtaatgtttggagtaattttaagcagtatggattgccaatgcctgttggtcttctaagagcagacaacaaccttcctccctggcgttctacgctgaaagaggagagcatccagcttgcttctcgactcaatattttttccaatatcagcaattttactggtgtttttgctatctaa

SEQ ID NO: 22360 - DNA, 339 bp, Glycine max
  Peptide Sequence Number=SeqID_139138
atggacgattcaaagattatggagaaggtgctcagaacattaacacccaactttgatcacattgtagtagtgatcaaaatgcagaaacacacagttcaacttcccaagatcatagtcttggaagcaattcaaatgagcagcatgataattccagttctagaggaggaaactctttcagaagtcgaggtggtaaaaggcttattgacaaaagaaagatccagtgttacaattgtgataaatttgggcacttttcccatgaatgctagcagattggcaacaacaatgagcagtaaagatggatctgatttagatcaaatctcgccaccagcgtttatttga

SEQ ID NO: 22361 - DNA, 504 bp, Glycine max
  Peptide Sequence Number=SeqID_139139
atggcgcttggaatgccatccattcactcaccccagaaaacctgtgatggatgcttgattggcaaacaacccagaaaagctttcaagaccaaggcaccacaaagagccaaacaacctcttgtaatagtccatttagacgagttcaaagaattctatgaagctaaaggaattgaacatgagggaaaggactaccaaattgctactggggataaactgtcaccacaaacaacatatgttttgaatagatgtcccaccaagagacttcaatctgtaacacttgaagaagcttggattggggacaagcctatggtgaatcatctgaggatttttgggtctcttagctacatacacatcccagatgaaaggagaagaaagctatatgataagagtgaagctcttatcctaaatggatatcatccaactggtgcatacaaactttacagccccttgaagcagcaggtggtgattagcagagatgtcgtggtagatggaactgcagcctag

SEQ ID NO: 22362 - DNA, 177 bp, Glycine max
  Peptide Sequence Number=SeqID_139140
atggtatatcctttctcaagaagctaccccaagctaagtagattcttgttcattgaaggcgtgaggggggctgaaggaagggtccaacatctgaatattgagaggatttcagtgaaatttgaagagaagaagaagaaaaatgaggctgaggcgctaccgaattgcgaccataattaa

SEQ ID NO: 22363 - DNA, 366 bp, Glycine max
  Peptide Sequence Number=SeqID_139141
atggtcaagacaggtccttacacagaggaaatagctgaggcggctagggaaaaacacattgaatttaaggagaaccatgtaaaatggttagaagatggtaatcttcattctgcagttttcagtcctgctgatgctcagttaacggaggctggtgatcccaagttaattaaggatccaaagcctaaatacagaggaaaatttcagaaaaaagaaaaacagatgtctgagctccgaaagagtgttaaaaaggaagtagaaaataatctttttcatgaatcaatggagacttgtatatcagaactagtaatgatatcagaaacagaattctacttgctaatctttctatccggatcgatattagtgtga

SEQ ID NO: 22364 - DNA, 264 bp, Glycine max
  Peptide Sequence Number=SeqID_139142
atgacaatgataaagataacagatgagagtagagtaacgacagtgacgatagtaacaataatggtgatgatggtgacaacgacaatggtggtggggtggaataagggcaccatcgatggtggctatggtggtgaaatggtgatgtggagaaacgatagtggtggcgacgacaatactaatagttgtagtagtggaatggtggaggtagcaatgacgatgtggtggagacaacgacaatggtggtggcaggcgtggtggtggtga

SEQ ID NO: 22365 - DNA, 2451 bp, Glycine max
  Peptide Sequence Number=SeqID_139143
atgcttacacccaacttacaacatctaacactcggtcaaaacgaactcaagatgattttgcatggagaaattcaggggaaccatttaaacaagttaaaagttctaactctgtgctttcatgttgagtccgatgtatttccacatggatttctacaactggtgcctaatatagaggagcttgtggtgtgtgatggatccttcaaggagattttctgccttcaaagtcctaatgtggatgatactactctcctatcacaactgaaagtgttacgcttggagtcccttccagagctcgtttccattgggtcactaaatttggtaccatgcacaatgtctttctccaatctgacaaagttggaagtaaaaagttgcaatagcctgctatgtttgttcacatcctcaacagccaaaaatttagctcaactccaaataatgaagatagaattttgtgaatcaattaaagagatagtgtctaaggagggggatgaatcacatgaggatgagataatatttccgcggctcaagtgtttggaacttaaagacttaccagatctcagaagcttctacaaagggagtttaagtttcccatctttggagcaattgtcagtaatcgaatgccacgggatggaaactttatgtccgggtaccctaaaagcagacaagttgctaggagttgtattaaagaggtatgtgtacatgccattggaaattgatctcaagtctaccatacggaaggcatttctagcagagctaaccgccacagcacctccaccctcccttcttggcccgatccaactcgacaattatctaatatacctagattctgcatctgcaaagcagaagatcatgacactattagactttttagtggtagtgataattgtagtgacttctgttggtggtgacaaatcaccgatttcaaagtctgcacgccaggtatcagatcttagactcagaaataacccactgcaaaagatatggcaaggctcactaccaatcccagatttgtgcttcagtaaattgcactccttgattgtggacggctgccaatttttatcagatgcagtactacctttcaatttacttcgtttgttaactgaattggaaacattggaagttcgagactgcgattctgtgaaaaccatatttgatgtgaaatgtacaagacaagacagaataatgacaactatggaaccaaccatcttccccctcccttttcctctcaagaaattggttttacagcggctgccaaatctggagaacgtttggaatgacgaccctcatagaattctcaggatgcaacttctacagcaagtacatgttgagaaatgtgaaaaccttactagtgtgtttcctgcaacagtagccaaagatattgtgaaacttgaaaatctagttgtgcaacactgtgagggattgatggctattgttgcagaggataatgcagatcccaacggaacaaatcttgagcttacattcctctgcctgacgtcactgacgatatgtgatttgccagagttaaagtgttttttgcagtgtgacatgttgaagacattttcacatgtagaaccaaatactaaaaatcaaatctgtattgaaaaggtaccattgcttttacagcttacacccaatttgcagcacctgacactcggtgaaaatgaactgaagatgattccgcatggagaatttccaggaaacgtcttgcacaatttaaaagctcttattttgctgaacttcagcgttgagtcctatgaatttgcatatggatttctacaacaggtgcccaatattgagaagcttgaggtgtattgtagttccttcaaggagattttctgctttcaaagtcctaatgtggatgatactggactcctatcacagctgaaagtattaagcttggagtccctttcagagcttgaaaccataggttttgagaacactttgattgagccttttctcagaaatctagaaaccttggattgccatgggttggaaaacttgttcacatcctcaacagccaaaagtttgtctcggctcaaaataatggaaataagaagctgtgaatcaattaaagagatagtgtctaaggagggggatggatcaaatgaagacgagataatatttcggcagcttctttatttgaatcttgaatctttaccaaatctcacaagcttttatacagggagattgagtttcccatccttgctgcaattgtcagtaatcaattgccactgtttggaaactttatctgctggtaccatagatgcagataagttgtatggagttaagtttcagaagaaatcagaagctatcccattggatattgatctcaattctaccattcggaatgcatttcaggcaacgttagagaaccttttggatggaaagtgcatggtatttgttagcaatcatcacatttataaccttttgactaagagagttcattcacaatag

SEQ ID NO: 22366 - DNA, 338 bp, Glycine max
  Peptide Sequence Number=SeqID_139144
atgcatagggtaagaagttatccagcttcagtgagcaattccttcaaggcgttaaaactattgattaatgatcctatattagaaattcaggaatttaaagagaggcttttagatttaggtgttgaggtgagtgagttttgctacttggcgatcaagcaagctcacaagtttcaagggggagacgctgtttgtgttaccgtggggactattagcaaaatagtcatggataaccattcatggtattatccagcctgtgctcaatgtcataggaaaactgacatccaaacaggaccattcacatgtggatgtgacaaggataatcatcaacctgttctaag

SEQ ID NO: 22367 - DNA, 405 bp, Glycine max
  Peptide Sequence Number=SeqID_139145
atgcaaaacagcggggtcaccctaagggctgaatctcaacacttcgcaagtgtgcatgatgacaatccctgtgtagcttccatcccttactatatgtgttttcaaatgaccatggctactccacctgcctcacctcctcctcctgtagtagcatcagtgtttatgtccacccagaagcggacacgcaaagcaacacgactacgatccttggccactagaccacctagggcaaagagaccagtggtcaacgtcgaggatattcaggcagaatttgaaatccctgaagcttctgacagtagcacaaagaagaaaatcttcagactgtgggccagcggtggaggcaccgacaaggacgatgtggacgacactgtctgtgaaaaatacggcatcagcaaggagaaatga

SEQ ID NO: 22368 - DNA, 216 bp, Glycine max
  Peptide Sequence Number=SeqID_139146
atggcgagaggagggcctgagagcatggggggtaatggatcagattcgaagatgaatcctttcgaagagggaggaaatgacgtaggtgcacccagtccgtctaatgatcctttacatgggattggaggtcctatgacaaggttcaagactaagaggacaaagcaaacattgcaaggtctgattctaaatatcaaagagaaagaataccagcgttaa

SEQ ID NO: 22369 - DNA, 243 bp, Glycine max
  Peptide Sequence Number=SeqID_139147
atgggaaggagccttatcattagtgcatttgtggcaacttctttggcttttgcttgcttctctgcaacagctttagttggaaggcgtagggagtacctctaccttgctggtttgctttcttctgggctgtccattcttcaatttcactcttcaagtttgaggtcactagcaatgttgttctattcttttagtgtgactgataagctagaaatatatcctgcatacatgcctaactctcgttag

SEQ ID NO: 22370 - DNA, 324 bp, Glycine max
  Peptide Sequence Number=SeqID_139148
atggttgatgaaggtggaaagcttggtggagggtttatgagattatcttctgttaattataatgaattcttctcaaggggaagttttctttcagggcttataagataccctacagtggtagggcacttgggaggcacacaaaagagaaacggaaagctactactgctgctattgcatatggccttgacaagaggactaattgcgttggagagcaaaacattttcatctttgaccttggtggtggtacttctcacgatcaaggataaggtattccaagataaggctactactggaaacactcacttaaggtggagaggactttga

SEQ ID NO: 22371 - DNA, 899 bp, Glycine max
  Peptide Sequence Number=SeqID_139149
gagctgatcccaccgaccaacttcttataaaaagctattgggaaactcattccagagacatagaagcatcactttacgatgattccacgaaagcagtcgttaacattccatatccatcaccatcttacattgatgaaggcattaagtttgagggttcatgcagaggatttctactcgtaacaaccaccgtcgtgtcttccggcaaggttgtttatttcatgatatggaatccgtcaacgggtcttcggaaacgatttaacaaagtgttccccacgcttgaatatctacgtggcattgggtatgacccatcaactgatgactacgtggtagtgatgataaggttaggccaggaggtacaatgtttctccttaaggtctaattcatggagtcgctttgagggtactcttccattccggaagaatacgtctgttacccatacccatgctcttttaaatgggtcatacttgaatggagctcttcattggttggtttactcttatgattattatttcaaaatcattgcatttgatctggtggaaaggaaattattcgagattccactgccacgtcaattcgtagaacatagatgttgtttgatagtaatgggaggatgtttgtgtctcttttgtacaacttacgtgccggctcagccggctcagatgtggatgatgaaagaatacaatgtgcagtcatcttggaccagcactagtgttcctgatgctccttatggctttcatccaatttgcttcacaaaaaatggtgaaattttgggatatgagcacggagataaaatgttaatgagactttctgacaaaggcaagctgcttgacaaacgcagaagtttatgtgaaaaatttgtcctgtataaagagagtttgctatcactccctcccaactaa

SEQ ID NO: 22372 - DNA, 717 bp, Glycine max
  Peptide Sequence Number=SeqID_139150
gagcgacccgatctcaagttggtctcccatggtaggaaagtagataaatttgggagaccggatgctgagatcgaaggtgtgatagtggccaccggattggatccactgatcaggtgttctgtaatcaccattgatcctggacttatattcgcctttgttgagaggtggcatagggagacaagcagcttccacctcccagtagaggaggtgacgatcactctagacgacgtttcgtcactcctgcacattttgattactggcgcgctgcattcattcaagcagctggttacatctaacgcagtggccctgttgacgaagctacttaaggtcaccccagacgaggctacagctgagacacgtcaggcaggtgggcctcatgcattcagggacctgggtcaggcaggggcattctcttggggagcgactgctttggtccacttgtacgatcagcttaacgaggcgtcgcaggcccctacacggcagatggtcggttacatttcactacttcagtgctggaattacgaacactttccatcggtccatcggtgtgtcgttgatgatggttatgctgaggctagcccacgtgcctataggtggcatacggtgaccaacgtctgttggatgccgtatgctgagcatcggggagttcggggctatgacttgatctcctcgtacacggggcaagtcagatggggtcagatcatcgtctacatttga

SEQ ID NO: 22373 - DNA, 267 bp, Glycine max
  Peptide Sequence Number=SeqID_139151
atggttggagcattctcgcaaaacatcgtgaccctgactggtctccgtatgttcttacttagtgagagtgacctgacaaacccattgtgtggtgtgtcttgttatgtactcctaagcgccccagggtggtttttcactgacatgagggtgtcacaggtgtctccgcgcatctttcctcctttggaaagcgcacccgtgagcctcgccctcgctcgcccgcgaagggcacgctgcgacaataggtacgaattcatcttcctccattga

SEQ ID NO: 22374 - DNA, 765 bp, Glycine max
  Peptide Sequence Number=SeqID_139152
atgggagataacaatgtcaacctcccacccgggtttcgcttctaccccacagatgaagagcttgttgttcatttccttcaaagaaaggcaaatcttcttccttgccatccagatgtcatccctgatcttgaactctacccttatgatccttgggaacttcatggtagagctttggcagagggaaagcaatggtactactacagcagaaggacacaaaatagggtcactagcaatggctattggatgccaatgggaatggaagagccagtgatttcaaactctagcaacaagagagttggcatgaagaaatattatgtgttccatttgggagaagcccctgatggcaacacaaccaattggataatgcaagagtatcgtctattagattctgcttcctctagcatatcatccagaagaagatcacaacctaaaccggaccatagtaaatgggtgatatgtcgagtttatgaacgggataacgatgaagatgatggtgatggaacagagctctcttgtttggatgaacagtttttagctgccattgtaatcagtgaagtcgctatagctagatttctatatagcagcctttcaagtggggcactagatgaaattcatggccaaacaatatgcaatatgacgttatgctttcaaagatcccattcactagcagcacaggtcaatcttggaaaattctatgctctttactccttattccaacacgtggataatcacatatctagtatctattctcagccattaatatag

SEQ ID NO: 22375 - DNA, 618 bp, Glycine max
  Peptide Sequence Number=SeqID_139153
atgggaagtgacaaatgccaagagagagcacagaaagaggggagcatcctctttcattggtcaatttcttttgctgtcattcaggaaagacaaatccataagatgcctcattgccctctctttgtgcctttgtggaaactcacacttccctcaacaatggaaactttttctgcactttcattttcatcttggacagagagagggcttggagaggtaagtgttccatgcagcagtttgtcgatggtggtgacagtaagatgcgggcactgcacaaacctcctttctgttaatatgttgaaagcttcttttatccctttccacctcttagcatctcttagtcatcttgagccaaaagaaagtagtccagaagaagatgctaacaagactttgaacagtcacagtgcatccatgatgacctattctgattgtgaggaagaggatataattccaatgagtcatcatgttgtgaataaacccccagagaagagacagcgaacaccatcagcttataactgcttcatcaaggaggagattaaaaggctaaaggctgaaaatcctgaaatgacccacaaggaagcttttagtacagctgcaaaaaatgtaaagtccaatttttaa

SEQ ID NO: 22376 - DNA, 354 bp, Glycine max
  Peptide Sequence Number=SeqID_139154
atgaagttcccaaggatcataagggtagagttcaagatcagggatgacatctggatggcaaggaagaagatttgcctttctttgaaggaaatgaacaacaagctcttcatctgtggggtagaagcgaaacccgggtgggaggttgacattgttatctcccattttttggagcaaacaaggaaggaaggaaggtttggagtgaaagagcaatggaaaatgaaggtggtgggtgacaagcactcaacatcaagcaagccaaggcggcggataacggaacgtgatgtaccacttagccaaaacgagatctccaaaactatgttggagagagagagagagaaagaggcttatgtgtga

SEQ ID NO: 22377 - DNA, 429 bp, Glycine max
  Peptide Sequence Number=SeqID_139155
acggagattgctgaactaaggcagcaacgacaggggagtgattcatcggctactaggaatggagttgaaaagcttaagaaggagtatcttcagaagctgaacttgctcgaagatcaggttactgaattgaagatgaaacttggtactcggtcccagttttcaactcaaaggaaaaaagtcgatgaatcaactaaacagttgcaattcgatattcaaaatttgaaggctcaaaaggttcaactgcaatgtaagatcaaattagaatctgtgcaatttcgattatgcaaggccctacttgaaaaagaggttcttcagtggaagaccggtgaggttttacagcggaagacagaggaagcttctgctgctactaaacgtctacaagacatgataacagcacgaaaagctgtatcacatagatcaactggttag

SEQ ID NO: 22378 - DNA, 486 bp, Glycine max
  Peptide Sequence Number=SeqID_139156
atgaatgtggctttttcccatctctcatggtggttgtggaatgggaaatatcataagccaagaatctcaaatgggtctaccataaattcttctgctgattctgttatgtgggaattggatggtttgagatttcctcttgttatgcaggcaaacgtgccttcctcttcaaagaaggtgaagcacaaggggcatagcaaggaagaaatagatagggaacatgatgttgttatagtttcatctgatggtggatgtgtttctggctctgaatctgatggttctgattggtctattggctggttggagcctcatggaactgggttttcaagtgacgatgatgttgaagctcgtgaaacggataacagtttcgctgtgcttgttccctgttatggaagcaactatagtgccatggttgaggaggatactaaaagcaacttattgacccactttggatactttccaaatagttattctgatgttgtcaactga

SEQ ID NO: 22379 - DNA, 939 bp, Glycine max
  Peptide Sequence Number=SeqID_139157
atggctggagagatttcacagctgaaggaagaaaatgagatccttaggcaggaaaaattagggtctcagctacaggaggtagactgtgacagtcaggagaaagattctgatatccaagatttaaaggaacaaatgaacagtcttggttctctacttagagaattacaatcgaggaaggagaagcttgatttcaaggataagaagcagggggacctgggtctgtttcttctctctgaagagagcaatgacaagataaaaatgaatacacccgaaatgggcagtgcaagtgagaatagtgttaagagggagagaacaagtgaagggatttgctgctcatgcagtaagaagtccttgtgcaaaactaataaatgcaagtgtcgatccagtggagggagctgcggagcatcatgtggctgcacacgtttaaagtgcacaaatagggaaccaaaccaattagaaggaagtgaaccgctaaaatcaggtaatacagaatgtactcaagaggcttccgctgaagacaaagatggaagtgtgattgcttctgaatgtgctaaactactccagagtgcacttgttcagaaacctgctagttgcaaggacaatctggttcccaaaaagaagccattacgtgacattcagaactcaatggctaaattggatgatcaaaagcaaggtaagaaaaagaaagcgcggaaaccagtaattcagctaattaccaatgacccaatatcttcctctccagaaaatagcagcagtattgaaactcaggaaaataatccaacggggttggacaaggtggcaaattcaactacagagaataattctggccaaacaaatgaatttgccacatccattagtgacgcacctggatttcgtcgtctaagaaatccaacccgacaagcaaaatccgttgtcgagaaagataactgtctcatttaa

SEQ ID NO: 22380 - DNA, 2850 bp, Glycine max
  Peptide Sequence Number=SeqID_139158
atggaggatgtaatggctgaaaccctcaacatcattcataatgaaggagagtcattttcccaaagggcagaaatgtactacaggaagaggccacagctggtaggttatgtggaagaagtctttcgctcatatagagcattagcagatagatatgatcttctatcaaaagagctccaaagcgccaaccgcactattgccattgttttcccagaacaagtccgttgtagaattgatgaggatgatgttgaagaaagtttcccaggaacaaattcatcatctcaagaccacaacaatcaaacaccaaaaccaggcattcctaaagctccaaatttcccaaataaggacttaagaagcccatcaatgttgctttctaagaagggtccacttaagagggttgctagttctgcaaaatctccttcttctagtcctagttcaggtttgagtaaggctgaagcactagcaaaagttgacaagcttcagaaagaaatattggcactgcagactgagaaagagtttgtatggagcttgtatgaaaattcctatgaaaagcattgggagattgaagaccggattacagaaatgcagaaaagggtttgcagcttgcaagatgagtttggcattaatacaatgatagaagataacgatgcacgagctttgatggctgcaacagctttaaattcttgcaaagagacccttgctaagttgcaagagacacaggcacaatcatctgaagaggctaaagaatcctaccaaagggttaaggaagctcgtgacatgtttgaaaccattagaggccaattcatttctaaacttaatagtcaagaagaccaaggaactgaaccaaaaagcatagaggaagaagacatgtctagcttggaagaagaaaggcatgagcctgatgtggagttgttgagagacacgattaaggaaaagcttgagaaagattcaggtagctccctctctatgacagaaatgacagagaagattgatgagcttgtaaataaggtgattaccctggaaatcgcggtctcttctcagactggcttggtaaaaagactaagatcagaagcagataaacttcaaaaaaacatactgagcttggaagaggacaaggaagtgctgacagaagattcagaaggaaccaaaaagaagttggaagaagtggaggaggagttgaggagagttaaaattctctatcaaagtgccaataggcaagacaacagtctccaaacacattttgctgaagctagttgtgatcttgaacatctttcaggaaaattgaacgatgtgaagctagatgaggagggggagaacttgcaacttcacaaaaacaaaagtgcacatgatggagaaataaaagtggagtttgaaaaatcaggtgataacacagaacacatgaaagatgttgagacagcaaaggaagattgcagtgtaaattttggtgatgttgaaaatgaagataacaagtccaattcgaaagaaaatattgattttaggactgaagagattccagagcaaatgctgcagaataaggatgatttgtctgaggcaaggagtaatcttgacactgaatcacttgatcaggggactggtgaggaagaaaatcaatccaacaggagtcagatgatggcaagtggactagatgacggagaaaagattctgacggaattcacatcagttttaaagaactacgaggatgtaaaggacgagctcaatgatgtggtgaagaaaaaccaggacagcattttccagttggcacttcagaagttgtatacttggcactacattacctccagttctgagaatgtagatctacacttgcaggtgagggaattgagggatactgtagaaactaaagatcaagagataaacattttgcaacagatgctgacctgctcaaaaacaaatccagatgaaagtccttccacgcctctcacagattataaacatacaccacaagaagcacttcttggaactgcagctcaaggaacagaccctcaggaccctgaaaatccatcttcaaacacaaatgcaagtgcagttactacttcttatgcagggcaacaccaaaaatatgttgaaaacaaagcaaggattggcatattgatgaaggtgagatcaaaccagcttgataggacccactcactttcaaccttggaaaagaaatttcgttccaacatggatgacttgctagaggagaacttggagttctggttgaggtttagcacctcagtgcaccaggttcaaaagttccaaagttccatacaggacttaaaatttgagcttaaaacaataagggacaacatgtcccaagagaactcaagttctatacaatctgagataaaaccaatatttagacacctgagagagataagaaccgagttatcgctatggctggaacacagtgaagagttgcatgaagagttgcaatgtaggcatccatcattgtgcaccttacaagatgaaatagcaagagcagccaatccaaactctgcatcatcaaataacatggcaaaactaagtggatatcaggctgcaaagtttcaaggtgagattctcaacatgaaacaggagagtataaaggtttctagtgaactgcaagcatgtgtgagttttgtgaaggaactaaaaggtgaagttgagaagatggtagaagaactgagtcaggaagttggagttaacaatcatgaccatatgaaacactccacaagtcgtcctagaatacccttgaagtcttttctgtttggaatcaagttaaggaagcaaaagcaaacggtcctctcatgtgtaactccaacaaagaaacaacacagggatctagcattggctgaagaagatgcccctatatag

SEQ ID NO: 22381 - DNA, 903 bp, Glycine max
  Peptide Sequence Number=SeqID_139159
atggctgaatttcgttttttggttggaggaatcaagtgtcccccaattactcgggaagaaattgtaaacgcatgtggagttgaagacattcatgatggaacaaactactctaggactgcttgtgtaattgctgttgcgaaggctcgtgacacatttgaaccttttcttcatcagttggggtccagactgttgtatatactcaagagattgcttccgatctctgtttttcttcttcagaaagatagtgaatatctaagtggccatgaggtgttcctcaggcgtgttgcctctgccttcaacaactttgcagaatctactgaaaaatcatgccgtgaaaaatgtatggaggacttggtaagcaccacaagatatgtttcatggtctctccacaataagagtcgggctgggttacgtcagttcttagattcatttggtggaacagaacattccaatgcttgtaataatcctacagcaactgttctatcacaaacaagtgcacatgagaaagaagacacaaagtcacaaccggatgtaaaactcagccatgtggcctctggcactgattctagttcatccattcagacaacagaaacaaagcttgctgatcttctagatagtacactctggaataggcggcttgcaccttcatctgaaagaattgtttatggcttgttcaattgtttccttttgatgcccattgtggacaaattgcctgctcttctccgggaagacctagaatctgcttttcaagatgacctggataatgtttttgacataaccaatctgcagcactcatttgggcagcaaaagagagagacagaaattgaactgaaaaggatcaagaggctcaaagagaaatttagaatgatacatgagcagctaattcaaaatcaaaccatgtga

SEQ ID NO: 22382 - DNA, 1076 bp, Glycine max
  Peptide Sequence Number=SeqID_139160
ttataggagcttttcatgtcctgcgcagattaagaaatggggacgagatattagaagattgggaacttgaatttgcctcccataaatttaaatattctgagctccattcagctacaggaaagtttggggatagcaaccttattgggtatggaggatttggtaaagtctacagaggagtaatcgcaagcacaggactagaagtagctgtaaagcgagttgctcctgattcaaggcagggaatcagagaatttgtttcagaaataacaagcatggcacaactaaagcatagaaatttggtgcagttacatgggtggtgcaggaagaaggatgaactcctcattgtttacaactatgtaccaaacgggagcctagacaagcttctgtttgaaaatgaacatcaaaagaagaaactactaacttgggatcaaagatacacgatcattactggtgttgctcaagggctgctgtatctccatgaagaatgtgaactgcaggttgttcacagagatgtaaagccaagcaatgtccttatagatgaagatctccaaccaaagcttggcgattttggtcttgcaaggacttacgagcatggaattaatccacagacaacgaatgttgtgggaacactagggtacatggcccctgagctcacaaagactgggaaagcaagaacaagcacagatgtatatgggtacggcatactcattttggaggtagcatgtggaaggaagccaatagagccacagaaaaatcccgaggaactggtattggtagactgggttagagaactacatcaccaagggaaaatcagcagggctattgaccccagtttagatgagtatgacaaagatgaagctcggcttgtgcttagtcttgggttgttttgtgctcatcccaatcctgattacaggcctagtatgagacggattgtccagttccttctgggagaaaccagccttcctccgcttcctccggacattcactgtgaagatccaacagcaataagaaaatgcccaaacaactttgcagatgattcaggctcttcaagttctatggtgtcttcatcaaaatattga

SEQ ID NO: 22383 - DNA, 1386 bp, Glycine max
  Peptide Sequence Number=SeqID_139161
tcccaaccttctctccctgtctttgcttctgcaattactcccactctggaaatgggttcgctacccgatttagacactctcccccctctgagctcgaggatttcaacggtggttccagcaacccctcgagaagatgaaaacggtgcgtttcaactcaactacatggacctcctcgtgaagctccattacatacgacccgttttcttcttcacttccgaagccgttcaaggcctctcaatctccgacttgaagaaacccatgttcccgcttctcgacccgtattaccacgtttcgggtcgggtcagaagatccgaatccggacgcccctttattaagtgcaacgacgccggtgttcgcatcgctgagtcgcactgcgacagaaccctcgaagaatggttccgtgaaaacggaaacggcgccgttgaagggcttgtccatgatcacgtgcttggacctgatcttgccttttctcctctcgttttcgtcaagttcacttggttcaaatgtggaggattatccgtgggattaagctgggctcacgttcttggagatgccttttctgcatttaatttcctgtccaagtggagtcaaatactagcaggtcaagctccaccaaaatctcttcatgtgtcaagtttccctgaacccaaaatctcacataattccattgttgatgaccctccagtttccattaaaaagacaaatattcttggagagtattggctcgctactaattaccacgatgtggctactcactcttttcacatcacttccaaacaacttcaccatttggtaacagccacatttaatcaaaccaatgacaataccaataaggccaagaccaccacctattttgaaattatttcagcattactttggaagtgtatagcaaacataaggggccaaaaaattggaccaaatgttgtgactatatgtactagtgaatctaatcgtgcagaaaacgaattccccaccaatggcttcttagtgttaagcaaaattgaagcagatttttcgactgggaaatatgaaatttcagaattggtgaagctgattgctgagaacaagatggttgagaaccatgtaatggaaaaattggtggaggcagatgaagggaaagaggattttatagtttatggggtaaacttgacgtttgtgaatttggaagaagctaatatttatgatgggatgaatctgaatggacagaaaccaattatggcaaattgtacatttcgtggggtgagtgataaaggggttgttttggttcttccagcaccagaagatgacgaagatggtggtaatggaaggattgttactgtttctttgcctcgtgaagaactatatcagctgaaagataagctaggaggagaatggggcatacactaa

SEQ ID NO: 22384 - DNA, 1170 bp, Glycine max
  Peptide Sequence Number=SeqID_139162
atggaaaaagaggaggaggagcagcgcgagtggaggctatacgaaggctacaatgagctccacgcgctggcccaggacttgcacacgcccttcgacgcccccgccgtcttggtcgtcggccaccagaccgacggcaagagcgccctagtcgaggccctgatgggcttccagttcaaccacgtcggcggcggcaccaaaacccgccgccccatcaccctccacatgaaatacgaccctcaatgcgagtccccttcctgccacctcgtctccgactccgacccttctctttcccaccataaatccctcccccaaatccaggcatatattgaagcggaaaatgcgaggttggagcaggacacgagccaattctctgccaaagaaatcatcatcaaagttgaatacaagtactgccccaacctcaccatcatcgacactcccggcctcatcgcgccggctccgggccggaagaaccgtgctctgcaggcgcaggcgcgtgccgtggagtcgctggtgcgggaaaagatgcagcacaaggagttcatcatcctctgccttgaagattgcagcgactggagcaacgccaccacgaggcgcgtcgtcatgcaggtcgatcccgaattggccaggacagtcatcgtgtccaccaagctggacaccaggattcctcagtttgcacgtccttctgatgttgaggtcttcctctcgccgccgccgtcgacgctcgacggctgcattcttggtgattctccgttcttcacgtccgtgccttctggaagagttgggtgtggaagtggttatctccatagctccaatgatgagttcaaacaggcggtttgcttcagagagatagaagatgttgcatctttggaggagaagttgggcagggcattgtcaaagcaggaaaggagtaggataggcgtgagcaaacttaggctgtttctggaagaattgctacaaaagagcacacttgatgaagccaaactgaaggagaaaggaagagccttccatgatatgttcttgaccaagttgtcattgttgcttaaagggacagttgttgcacctcctgataagtttggtgaaacactgcaagacgaacgaattaatggaggtgcatttattggtgctgatggtgttcagttccctcacaagctaatacctaggacaggataa

SEQ ID NO: 22385 - DNA, 1149 bp, Glycine max
  Peptide Sequence Number=SeqID_139163
atggccgatgcggaacctattaatcttgatgaagctattgtaagtgagtatggaccgtatgatgaagcagaaaagaagatgaacaagcgaggaattgtatcagatggacctgatgaatgggccttttatcgggagtatgcacagaaggcggggctgcccacgcctgtctatgaaactattaaggaagggccttcccatgaaccttctttcaggtcaacagtgatagtgaacgacgttcggtatgattctttgcctggatttttcaaccgcaaggcagcagagcagtcggccgccgaagttgctttggtggagttgatcaaatctaatttagttaatcaatccatcactcaacctgttcatgaaacaggattatgcaagaatttacttcaggaatatgctcagaaaatgaactatgcaatgcctatgtatcagtgcaagaaggatgaaacaccaggccgagcatcagtattttcatgtacggttgacattggggggattctatatattgggggagcagcaaaaacaaagaaggaagcagagataaaagctgccagaactgctttattagctatccagtcaagtgcatcgcaagcttcccaagaccaggttggccatccacagttgacagtccttccatgcagaaaaagggcaacagaatctgttgccatagctgatgagaattcaaatcccccaaagcctaagaaagcgcggtttaagaggaagtcttccaagaggaaaccctctagagacaagatgggccaaattcatactgaaaacttgggcattggagcaaatatcaatcatgaggtagaaacacatgcaagtgttaatggtgaatctggcgtccttgaaaagaaatccgaaacattcacttcagaagccgccaacaattttgagaatggagtatcagttaattatcaagagaaagaaacattggctggggagagttctcttgctgtcaatagccaggaaggaatttttgagaatgggaagtcaacagaattatattccaaggagaacaatcttgtgactgttgttacagaactatcttctgtgtcaaatggaggcataccggaaacaggtgtggaggtgaacaaacagcaatacaatggagaaatggtttctgaccattgtgttgtggggggttga

SEQ ID NO: 22386 - DNA, 498 bp, Glycine max
  Peptide Sequence Number=SeqID_139164
atgaagaagagtaaagtaaggtttgcagacaatagagttatacaagctgaaggagtagggaatgtggctattagaagactagatggaagacaagcaatgatcacaaatgtactttatgttcctgggatgaagagtaacctgataagtatgggtcagctcctggagaagggattttcaatgaaaatgagtaatggatctctggaagtctatgatacaacaaaagaaatgattatgaaagtcccattagccaaaaatagaacgtttaagtcaggaaagtgcatgaagactttgaggactgatggaggaggagaattcacttctagtgagctaaaagatttttgcaaggagcatggaattgtgcatgagaaaaatctctcgcacagcttctggggagaagcagccatgactgctgcccatgtccttaatagatgtcccaccaagaggctgaactcagtggttccagaagaagcatggtctagcagcaagccctcagtctaa

SEQ ID NO: 22387 - DNA, 135 bp, Glycine max
  Peptide Sequence Number=SeqID_139165
ctgttgtgcacaacatctggataatggatttgaacatgaaagctttactgtctcctcatgatgctgaacttaggaaggatgacaactttggtgatactacattatgcttgaatggcattggctttggagaaacaa

SEQ ID NO: 22388 - DNA, 1827 bp, Glycine max
  Peptide Sequence Number=SeqID_139166
atgcacggtcggcctcgcaaagcgttgaagcaagaagatgaagccgcttcagcagccaaaactgagaagcttcgttctgtacaagctcagttcctcgccaatcaccacaatcacatgttgcttcttcttccttcaactttcttctctctctctctctctctctctctctctctctctctcgatttattcaagaattgcgcaaatctggttggctgcagatatagcaaggaagcgctagatttgagcgcgaagcttctagaagtgaatccagagtgctacacagcttggaattacagaaagctcgccgttcaacattttctctctaactccgattccgatccccactctatcttcgatgacgagctcaaactcgtggagaatgcgttgaggaagaatttcaagtcttacggcgcgtggcatcatagaaaatgggtactcaacaaggggcattcgtccatagacaacgaaatgcgccttctgaatggttttcagaagatggatcctcggaattttcatgcctggaattaccgaaggtttgttgctgaactgatgaaacgatcagatgaggatgagctgaaatacacagaggaagtgatagcgactaatttcagtaattactctgcatggcacaatcgtagtgtgcttttgtctaatttgctgaaaagaaaggctgaaggatatttccctaaagaaaaagttttggaagaggagtttgagcatgtccacaatgctatttttaccgatccagatgatcagagtggctggttttatcatctttggctcattcaacaaacagtgaaaattgatgctcctctacttgtttcatcttggccttcccatggatctaatataactctaattggggacaatgatcttcgtggttgtggtttgtctcttctgaatggtacactatcaaaccctggaacacttccaatcattctttatttcaatcaagccgtagaaggaataaactcatccacagtggctattaaatctgaacttttaaaggaggaacttatttggaaaccactttcaatgaacaattcaaatactgctcagttttgggttgtatatctaaaccttggaaattttgagcttcaaccgtcaaaaacttactctgtagagatcaacattggacattctaagggtattatatcttcaaatggaaatcactttgatgatccttcccaaatttcctgtaaagtgtttgtgcagactgcatctagtgaacctactgaaggacagggtgggaaaaggactacatggaaggatacaaatttccaaaaaattgaccattttcaggaatcagattccattcttcctgctgatcaaaatcaccatattccaacaacttccaattggtgcactgaggaaattggtgaagaaataactaaagttcgggacttattgtccgagtatgactgtaaaattggtaagcttacactagcaagacttttgagtgctcttgattcgttatcatttcaatatgatggaagaaaatctaacactgaagaagttcttcaactttacactgatctgatgaagttggatccaacacattatctatactacaaagatgagcatagtctaatatcactaaagcggataacttcaactagggattctttactaccatactgccactactataaagatgcaacagaaacaatcactggttatgtctgtctacgattacgaaatctatcattgtcacggatgggatccattgagaatttattgtgggtgcaaatgctagaccttagccacaacgaacttcaatccgttgaaggtagaacttgcatatctgattattttacagtaacttag

SEQ ID NO: 22389 - DNA, 294 bp, Glycine max
  Peptide Sequence Number=SeqID_139167
atgacaaaattgccattattggcaagtggctggaacaagcgtcacatgctggcgggacatgcatacttttggtcgaaaaagatggctgggaaatttctatatggaagcaggagctgtcgcggcgcgctcgtgtctaccaacatcgaacaaaatatatttggaggtgtaatccgctgcggtaacggtggtttcacgaccgttgatgtagttgaagtcaacgacttgacgaacgcaacgaatctacggttttggtgtaacgtgaagatccttgtcgccacaacgagggaaaattag

SEQ ID NO: 22390 - DNA, 153 bp, Glycine max
  Peptide Sequence Number=SeqID_139168
atggcggtggaaaaggatctcaagacgaagataaaattgaatctcaaatcattgctcaaggccaaatctctcgaggattcgttgcgttttgaatttgaagttcctcctgatggaaacattaatgaggatgatcatcagctatggagaatctag

SEQ ID NO: 22391 - DNA, 2595 bp, Glycine max
  Peptide Sequence Number=SeqID_139169
atgaatatcgttaagggtgttgctgacctcatcagaagaacttctgctgggcatactggcgaatcttctagtttacaagctcaaaagtactctcctcctgggcccaggattcgctttagtgatgttggcgatgaggcaattgcaaatactctttgggagcgacatgagaaagttgatgataaggtggagaaaaggaggctgcttcatgttttcatcaagcaatttgtaattgcctacaaggattgggaacctgtgaatttgggcatattattagagtctacttctgttgagagtttatcatctgccgatgatgtggttgttggttgttcagctggacatcctgttgaagtcattcgggtattaattgaagaggtcacacagttaagctcactagttactgagtgggccgtggtccaacttaaaaccataagtggtgccctttctgctgatgaaagctttatttcacatgctgatgctccaatcatctcttcaaatagttcaaaggttttgtctactgaagctaggttacattggcgtcagaaagcaattgtttctgtgatggaagctggtggcctaaattgctttgggaatgtgaacaacttgcaatttctttgtgaaaatggtagggtgcataaatttgcaaatagtttttgttcaccggcatttctgcttcaagatttgggatgggagaaggattttgctggacaggatgctgttggtatgcctggtcttgacattcaagaaaatcagaattgctcaaaacctgatccagtggtggtttctgctggccttccatcacgtgcttctttttctgatttttggaataattatgttgttatgttgagcagaggtctctgttcatttctgttagttcctgagggttcaaaatctcttcatgttcaagtatcttctggtcgacttgcattgcctatttcctcagcgtattatgaactgtcaatcaaatgggtcatgagggttttatttacaatatttccttgcatcaaaacttgctcaagtcagaatgagttgccaagctatttaagggtctttgtctcaactctacagaacacagttcttaatgcatttagaaaccttctttcttcttctcccatgtcacttgaaatttttcacgaagagggaatatgggatcttatattttcagaaaatttcttttatttcgaatcaggttcagatgaatctgctggacagatatttgcagacactgagaagtctgaaatatcatctgcttcaaggagcactggtaatacagaagaagttactggggttaatagtctacagatgcaagtaatttcatttgttgaatttgcttcaactagtgatggaaacacacagaacatgagagaattggctgctttgctggatgcacttgaacattctgcttgtaatccggaaattgcacgtgttcttgtggggagtttggttcacatcttgcagctttcccctgggagaacaattgcttcctttaagaagttgaatgcagtctctcgtgttctacatgttgcctgtgttcaagcacaagagtctagaagaccaggaagtatggagccctccaatgagaatagtggcatggaagcgttgtttatagcagctgctgaagatactaggagtttgatattacatagttttacatgcattgattacttgtttgatttattttgggtggaaggtttgagagatgatgtacttagacacatagttgatctcatgaagattatgccattttccgaggaagataaaaaagcaaagttgcagttatgctctaagtatttagaaatgtttactcatttaagagaacacgagaaaagttttgttgatctatctattgatttgttagtaggaatgagagatatgctccaggctaaccaagcatactatcagactctatttcgagatggggaatgctttttgcatgttgtatcattactgaacagcaaccttgatgaggcaaatggggagaaattggttctgaatgtgctccaaacacttacttgtctgcttgcaagtaatgatacctcaaaggcggcatttagaactcttgctggaaagggataccagacgctgcagagtctgctgttggatttttgccagtggcattcaagtgaaagccttttagatgctttgcttgatatgcttgttgatggaaaattcaatgtcaaaatgagtcctatgataaagagcagtgagtcgttgcagcatcatgggctagacatttttcagcaactgctaagagattccatttctaatagagcttcttgtgtcagagcaggaatgcttgattttcttcttaattggttttctcaagaagataatgacagcgtgatctttcagattgcacagttaattcaatctattggtgggcatagcatatcagggaaggatatccgcaaaatctttgctttacttagaagtgagaaagttgggatgaggaggcagtactgctctgttttgttaacaagtctcttgacaatgctacatgagaaggggccaactgccttttttgatcttgatgggattgattctgtaagtcctgaagccattatagatatatctctagaactccatgttcttctttag

SEQ ID NO: 22392 - DNA, 427 bp, Glycine max
  Peptide Sequence Number=SeqID_139170
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacag

SEQ ID NO: 22393 - DNA, 375 bp, Glycine max
  Peptide Sequence Number=SeqID_139171
atgcgtctaccagggaaggagagtctgctgatgaaatctcccataaccataaatgagattttggatgttagcattttgtttctaaatgaccatttagaggaaacactgggttcgacaaaaatagaagaaatccactcaaagtgtatcaatcttgcacagggtaaggattacggtgagtcaggattttggctcaaggtttgtagaatggccagacatgatacatgtcagggtttggtttggttcaaggataaaagggatgccccacattatttccatgacacaaatgcaaaaatgatgatttggaaactttatgcaaaactggtcatgcatgcacctatgcggacactcaagtgtcaaatttttatggtcatgtga

SEQ ID NO: 22394 - DNA, 297 bp, Glycine max
  Peptide Sequence Number=SeqID_139172
atggaacgagatgagaaaaggtttgagtaccgtatctgctattcttcggaagaaaatagtgtggaagaggataaggagggtggaattggtgttgtggatgcgctagtgattacaatcggtgaaatcaaaagaaaaatgaaaaagaagaagattgcaagttacgggagtcgatttgatgaagaaatgagtaagataggaaggtttgaaggtttgggaatggagggacatcgcaaggaggaagaggctgcgcaggggtttctgaaaaacgtggtatttatagaccaagacgcattgtaa

SEQ ID NO: 22395 - DNA, 410 bp, Glycine max
  Peptide Sequence Number=SeqID_139173
atggttggagcattctcgcaaaacattgtgaccttgactggtctccctatgatcttacttagtgagagtgacctgacaaacccatggtgtggggagcagatgaataggtggatgactatgaagaacctcatgctagaggacacgggaacacaacgctctgataggatgggtagagggtgtcgcacaggcccccttgaagggttgggatggaccgaactcggtctggcaggccatgaggtcgggcatctcgacctcagccaacttgatctcgaggcaaccaaagttggcctgggaaaagtccttgaccatgtactagcgaccacttgtggttttctccaccaacaaagccattgtttatgcattgagaaagaagaagaaagaaagaaagaaaaaagactaaacggtggaag

SEQ ID NO: 22396 - DNA, 201 bp, Glycine max
  Peptide Sequence Number=SeqID_139174
atgcttgagtatggtatgcagctctgtattgccaatgcaccgagggatattgttagcaatcaggaaccagaaccatcaccactggggaacaatgaagcagcagtccaaccagaggttccatcaacccaagaaggcaggcccaagagagcactatcagaccaatttatcttaatgatttcgtataggggctgcagggtgtag

SEQ ID NO: 22397 - DNA, 282 bp, Glycine max
  Peptide Sequence Number=SeqID_139175
atgacgtgcagcacgtatgcatggggacctgccgtgcttgcttttttatacagagagatgtgcagcgccaccgattacaaaattaaattaatcggaggtatgtgcatcttaatccaaatgtgggcatgggaacgatgcacgactttgacaccaaagaggactcctcccgtaatggaaaataaaccactcggacacaggtggctgcgacgtggaaatcagcatattggcaatgatgatctgatagtttttcgtcgcaaattggatatcatgaaacgacatgag

SEQ ID NO: 22398 - DNA, 234 bp, Glycine max
  Peptide Sequence Number=SeqID_139176
atggagtcagttcaggtcaggctttatgtaggccagatacctctgaatttattgaaagactgcattgctcttcagaacatatcactgcatggtaatcctatatcaatggatcaatttcagcagatggaggggtttcaagagtttgaagcaaggaggaaaaagaagtttgacaaacaaattgattcaaatgtgatgatcggttccaaaggtcttgatgagggtgttgatctatga

SEQ ID NO: 22399 - DNA, 133 bp, Glycine max
  Peptide Sequence Number=SeqID_139177
atggaagttgtattgatgttacagatattagcggagaacctcattgagagactgccagtgaatttggggaaactccaatctctgaaactgatgaacctggatggaaatcgaattacttccttgcctgatgaat

SEQ ID NO: 22400 - DNA, 354 bp, Glycine max
  Peptide Sequence Number=SeqID_139178
atgcagtgtgatgatgttatgttgtgtatgtacatggggggtgcagtgaccttgttcaatatctctggagaaaaattggaaggtgcagcaactggtgtctcgctaagcttgacccatgcgcttagcgagtatcatccgctaagcgaggcatcagcctgtttagcgagtaagaggaatcttgaagggaatcttccatgcaagcacgcgctcagcgtgttatcagctcgccccgcgagtcatttgtctcttcaggcgcttagcgcgcctggctcactaagccattgttcacttactcgcgctaagcgcgcctttgaggacagaaagccctttttaaagcctgaagtggaaaattag

SEQ ID NO: 22401 - DNA, 276 bp, Glycine max
  Peptide Sequence Number=SeqID_139179
atgactatagcacgtcaaaagggggtacataaagaaaatgagggaggagcttgccacccaactcgcccaggcaagctcagctcgcctaggcgagctaggttgcttcctccagaaggcaccgcctttttgaggaacatcctcgaaggcccaagtgagcctggttgctatttgcaccccctatttactaaatacacccctgccttttttgctgattctttttccgtaactttacggaaatttacgaattccgtaacgatacttgttttctttccgtaa

SEQ ID NO: 22402 - DNA, 696 bp, Glycine max
  Peptide Sequence Number=SeqID_139180
atggaggagttttcaactcaggtggcctggccaggagtccagccttcttcttttgggggaggtaaggcctccacagcccaggagcctaagccgaagctagaggccgctgctcagaaggctaatctagaggatattccagaggccaccccagttgctcaggaggacattgtagaggctactccagagactacttcgtatgcatcaccagtgactacacctatgctggagctctctaaggaggaggacgatgctacagatatggattatgcagatcgtgcagcagctggtgtctcactaagcctggcccatgcgcttagcgagtatcatccgctaagcaatgcatcagcccgcttagcaagtaagaggaaccttgaagggaatctaccacgcaagcatgcgctcagcgcgttatcagctcgcccagtgagtcatttgtctcttctggcgcttagcgcacccggctcgctaagccaaagttcacttactcgcgctaagcgtgaaaatggcgctaagcgcaccttcgaggacaaaaaaccctttttaaagcttgaagtggaaaatcaaagggagaggagtgtagagcgtagagagtgcgaagaacagagaacagaggtggaggagacatccccaccactgtgtaatctgttattttctctaataacccacttctcgcttgtgaaaggtgttgccttgtga

SEQ ID NO: 22403 - DNA, 282 bp, Glycine max
  Peptide Sequence Number=SeqID_139181
atggacctttctgcacacacagatcatgggcttctgaccctcgtgatgcaaaacgagcttggagggcttcaaattcaacatgacggcaactggatgcctctccacgcctttctcatcaacactggggatcacttggagatactgaccaatgggaaatacaagagctggttggtgatgataatcctgctgcataccgtgccattaaatacagagattacatacactttcagcaaagcaatgaactggacagaagggtcctgcttgcatcgtattcggatttga

SEQ ID NO: 22404 - DNA, 603 bp, Glycine max
  Peptide Sequence Number=SeqID_139182
atgatgaagagaatccttctattaataaacacgatccttctagcaacaggcacctccggtggggccctagtaatgcgtctctacttcatccacggtggcaaacgaatctggctctctagcttccttgaaactgcagccttccccataatcatccttcccataatcatttcttacattcataaacgacgtcgtcatcgctcttccgccctaatctctatcaagccccctctcttcctcgcctccgccctcatcggactcctcaccggcctcgacgactacctctacgcctgcggcgtggctcgccttccggtctccactttctctctaatccaagcctcccacctcgccttcaccgccgtcttcgccttcctcctcgtccgccacaggttcacgccctactccgtcaactccgtcgtgcttctcaccgtcgccgctgtggttctggctctgcgttccagcggggaccgccccgccggtgagtcgagtcgccagtacgtgattggttttgttatgatacttgcggctgcggcgctgtatgggttcgttttgccgttgatggagttggtgtacaaaaagagcaggcagcgtatcacgtactctctg

SEQ ID NO: 22405 - DNA, 324 bp, Glycine max
  Peptide Sequence Number=SeqID_139183
atggataaccaattgggtatctccgcctgccacctaacttcacgggttaggattaacagaaatcgtttgtgcggacaaccacttgggtatctccgcatgtcatcggacttcacgggttacgatagcaaaaaggtgcagatgaccacattggcctctgcttgtcaatcgaacttgcggtctccgaatgacgaggtgcggataaccgaaaggtgtctccgcatgctaccagactcttgggtcatgagagcaaaaggtggggtggtcgacaaaaacgagggttttgctcctacgtatcctccatttgtgatgaagaactcagactaa

SEQ ID NO: 22406 - DNA, 506 bp, Glycine max
  Peptide Sequence Number=SeqID_139184
agttagccgatgcttattccccggataccgtcattgcttcttctccgggaaaagaagtcatgacccgtaggccttctaccttcacgcggcattgctccgagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaaggtgacactctaccgctga

SEQ ID NO: 22407 - DNA, 207 bp, Glycine max
  Peptide Sequence Number=SeqID_139185
atggagaagggtagaaccgtggtggtgtccgctctgcagtttgcttgcaccgatgatatctcaacaaacgtcgccaccgccgagagttttcaaaatgtaactaaacaaggttgttcagacaaactggtggagggcggtgcaaggtacaaagcagagtgtggaattgaggaagaggttaaacaagacgaaaacagaagaaaaagatga

SEQ ID NO: 22408 - DNA, 1224 bp, Glycine max
  Peptide Sequence Number=SeqID_139186
atggtatcaaagcctggggaagagttagttggacttggtgttggtaatggtatcaaagccattggagtcattgctggaggagttgctgtgggtgctgcactgttgtttgcatccccagtaattgcacttgtttattggaatagaaggaagccactggatgattactttgatgtcgcagctgaggaggatcctgaagttagccttggtcagcttaaaaagttttcactgcctgaactgcgaattgcaacagataactttagtaacaaaaacattcttggtaaaggtggatttggcaaggtttataaaggacgtttaaccaatggtgatgatgtagcagtaaaaagacttaaccctgaaagcattcggggagacgataagcaatttcaaatagaagtggacatgatcagcatggctgtacatcgaaatttacttcgcctgattggtttctgtatgacatcttctgaacgcttgcttgtgtatcctttaatggctaatggaagtgtagaatcacgtttacgagagccttcggaatcacagccaccacttgattggccaaaacggaagaatattgctctaggagctgctagggggcttgcttatttgcatgatcattgtgacccaaagattattcatcgtgatgtcaaagctgctaatatattgttggatgaggagtttgaagctgttgtaggagattttggtttagcaaggattatggattacaaaaatactcatgttactaccgctatatgtggtacgcagggccatatagcaccagagtatatgacaactggaaggtcttcagagaagactgatgtttttggatatggtatgatgcttcttgaactaataactggacagagggcttttgatttagcacgattggccagggatgaggatgccatgttgcttgaatgggtgaaagtacttgtgaaagacaagaagttggagacactgttggatccaaatttgcttggaaatcgttatatagaggaagtagaggagttaatccaagtggccttaatatgcacacaaaaatctccttatgagagaccaaagatgtctgaggtggtgagaatgctggagggtgaaggtttggaagaaaagtgggatgaatggttgaatatgacagaggatatacaaaatttcaccttcaacctctgcactcctactcctaatgactcaaatccaaatattcaaccagatgttctgtcaggtcctagatga

SEQ ID NO: 22409 - DNA, 507 bp, Glycine max
  Peptide Sequence Number=SeqID_139187
atggggagtgtattagtgtggacgcggcaattcactttgaaagggttcggtaattcggtttacggagaaactccaatccactctgagagctggaagaaatcaacgatgcctcgccatgatgataaatatagtaatacccgcctcgacgttggacacttgtcttcgatgactcgttcccgtgacctggagcgtgtcttcagcagatatggaagagttcaaggtgtggatatgaagaattttttcgcctttgttgactttggcgatcctcgagatgctgatgatgctagatataacttggatggtcgtgaagttgaaggaaggcacgttactgtggaatttgccaaggggggtcctcgtggttcctgggaatcctcaggtcagggtcagggtccacctactggacctggacgatgttttgactgtggcttgatggtcattgggcccgagattgcaaaactggggatgggaagaacaagtgtttccttagtggggaaagaggtcatatag

SEQ ID NO: 22410 - DNA, 390 bp, Glycine max
  Peptide Sequence Number=SeqID_139188
atgcaatggtggttccaaagtcagaaaagatgcaaagacaagctgaaactaacaagaaacaagcgtagaaccatagttacctccaaggaaaacaaaagttggaagattctgcttcagtcgaagggttcctctcagtgtggagttgcaacggagaacaacgacggtttgtggtggctaatggtggctgtgggtgacggagaaagtgcttgggacgttagaaatggctttggaagaaagaaagaagaagaaatagtgttttttctaagctacacgaaagcaaaggctgaaaatgttcaagtgagaaatggtctcggacacagaaatgttgcgcacactccagacatcttctcgaagatcccaacggttagatcatggacaagtgtcttgtga

SEQ ID NO: 22411 - DNA, 2631 bp, Glycine max
  Peptide Sequence Number=SeqID_139189
atggccgaccacggaaccagaaaaaccaccaccgaccgtcttgaagaggcaattactcgtctcaccaatagccaagcctcactcacagacggatacacggacctttccggcaaggtcgattcaatcctagatcatcttcgccttcacgactccggtcgaaacgctgccaacatcgcgaatcaccaaaatcatcaacgaaactctgttaagctagacattccacgctttgatggtcgtgatcccctaggctggattttcaagatcactcagctttttcaataccagaacacgtcggaggaagagcgaatcacggaagggtttctccaagctcttgagtcgcgcttcgccccaacattttatgatgatccaaagggagcctttttcaaattaacgcagaaaggaaccgtaaacgactacctaacagaattcaaacgccttgcaaatcgtgtggtaggtcttcctcctccatttcttttaagttgtttcatttatgggttgtgtccagactttcatcgcgaggtaatgacacttcaaccaatctcgctcttgcaagctactgctcttgctaagcttcaggaagagaagcttcgagatagagctgcttcaaccccacgcaacttttaccaacctaaacctcctccacctcacactcccaaccctactacgaaagctaaaccgtcatatgatgagtcatgctcctcatcgctgatgaacaatcacctgacactgacccttcatgcgctatcaggttcaccgtcaacggaaaccttcagaatatatggcaccgttaagaatgcgcaactagccattttgattgatagcggaagcacacataacttccttcaaccgcacatcgctcagttcctgaaacatccagtacaagcaactcatcccttacaggtgttagttggtaatggctccaccttggactgcaaccaggtctgccccgagacacaagtcaccatccagggccatccatttctcgtctcgttccaccttctgcaaatcaatggagttgatgctgtcctgggaattgactggttgaagaagctaggcccaataactacggattatgcagcttgtatcatgaacttcactcatcaagcatcttcttctctcataccatcacctgttccagaccctttcacgactacttccaccacgccaagtggtccaccgtattacactaccaccttccacggccccaataaacctggcctcatacgaccctgctccagtccatactcatcgccggtactcctggtgaagaagaaagatggcacatggagactatgtgtcgactacagggcactcaatgcagtcaccattcgtgatcattttcctataccaacgattgatgagctattagatgaactaggacaggccacctggttctccaagctagatctccagcagggcttccaccaaattctgatgcatgaggcagacgtggagaaaaccacttttcggacgcataatagccactttgaatatctagtgatgcccttcgggcttagcaatgccccatcaacttttcaatccgccatgaaccacctcctgcaaccttttttacgtagattcgtcacagtatttttcgatgacattctagtctatagcagctccctgtcatcccatattcaacatctagaggctatctttgaaatgccgcaaaatggtgagttttacctcaaaaaatccaaatgtctatttgcgcaagagactatcgaatacctcgggcatgtcgtttcgagtaagggagtcaacccggaaccctcgaaaatccaagctatggtgcaatggccaactccgaggacagtcagggagttacgtgccttcttaggactcactggattctacaggaagttcataaaagggtatgccgccattgcagctcccctcacgagcttactctgcaaggatgcattcacatggacaactgaatctcaagaagctttcacccagctcaagtctgccatgacaaacgcccctgtattagccctatccaacttcttcgaaccattcgtgatcgaaattgatgcctccgcgatggctatcggcacagtccttacacaaaatgggcaccctttagcatacttcagcaagggtctcagccctcgaataacccaagcatccacgtacatttgcaaactccacgccattgttgcagctgtgcggaaatggagacaatacctcttgggtcgtccgttcacgatcctcactgaccataagagcattcgcgagctgatgacacaaataatccagactccagagcagcattattatctttccaagttattaggatatgattactccatccaatataaagcgggagcaaccaacgtggtggccgatgctctttctcgagctccaccacccacggggcaactactaatcctctcagtccctcagctggatttccttagcaatatacgaaagtcattggagtctactttggagtttcaacaactcacgcgttcgatccaatccaatccagcaaaccacccaggttatactctctgcaacaacttaatcttgtttaagggaagaatatggttgcacagtgacaaccctgcatccctagcttgttatctgaatatcatgcaactccattgggtggccatctcggcgtag

SEQ ID NO: 22412 - DNA, 1284 bp, Glycine max
  Peptide Sequence Number=SeqID_139190
ggacagtgggcggagccggcccaggctgcggcgaattggcagaattcgagcttggaccaggcgggcatgtgggagatctgggagaagaaggagtgtagcgcaacgccgacgatggaggcgcgcttggtggatttgacgccgagctggggttctaaagggggcgaaatgagtccaaccgagggtgttgaggctagggggtttgccgtttcgggatttggtctcggcggcgtagagggcgaggaggacggcttcgaacccggcgagggacggcggttcaggggagtggattcgggagaggtagaggccagagaggagggggacgaaggagaggacgacgaggcggaggtgggggtcggaggagaggaaggtgtcgtagagccagtggcagagggggtcggagtgggagccggagagggaagaggagacggcggcgtaggcagcgggggaggacaagaggagtcggaggaggaggaggggaggatggcggcgagggcgtggattcgtgaacgggctttagagacggattcccaccatgaatgcattgggtctgaagaagaggttttattgggatcggcgttgttgggtgtgggcgtggatgaagacggggacgatgatgagtcgctgcgcattgttactttcgcccatctaacatctttgcataacgataaatgcatcctagttcaaacaatgacaacaacagtctctgcactctccaacaccttcttcatctctcagatttcccagctcgagatttcagcctctggctacccatcttcaccttccattttcttacccacgtggttttcgtgttttgccattgttgctgggtaccctgcgtttccaacatcattggacatcaataagattcgtgacattctgccgcacaggtttccatttcttctagtggatagagtgattgaacacaatcctggagtttctgcagtggccataaagaatgtgacaataaatgacaacttttttcctgggcattttcctgaaagaccaatcatgcctggtgttctcctggttgaggcaatggcacaggttggtggcttggttatgttgcaacctgaaattggaggttctcgcaataatttcttctttgctggaatagacaaagtgcgatttaggaagccagtgattgcaggagacactttagttatgagaatgacacttatcaaactgcaaaagcgatttggaatagcaaagatggaagggaaggcatatgttggaggtgaagttgtgtgtgagggtgagtttctgatggcaactgggagcgaataa

SEQ ID NO: 22413 - DNA, 567 bp, Glycine max
  Peptide Sequence Number=SeqID_139191
atggcatcaaaattgaccctcattgcgttggttctcgcggtggccctgtgcgccgttgatctaacccatagcgcatcagcatcctcccctcacgcgccagcgccctccgtggactgcaccaacctcgtcctcaccatggccgactgcttgtccttcgtcaccaacggtagcaccgtcaccaagccagagggcacatgctgctccggtttgaaatctgttctcaaaactgctccggcgtgcctctgcgaggctttcaagagcagcgctcagttcggcgtcgttttgaatgtcaccaaggccacctctctccccgccgcctgcaaagtttctgctccttctgccaccaactgtggattgtctgaaacgcctgctgctgctcctgctggaggcctctctccacaagcttctccatctcctcaacaagcagatgcttcaactaatggtcctgtaaatgagatatctccagcaccagcaccagcccaagggaacacagcatcagcattattcccaatttctgctgggtccttgcttcttggcatattggtagccacattctcaggcttctga

SEQ ID NO: 22414 - DNA, 477 bp, Glycine max
  Peptide Sequence Number=SeqID_139192
atggaacgaaactcctctcagaagcctgagaatgtggctaccaatatgccaagaagcaaggacccagcagaaattgggaataatgctgatgctgtgttcccttgggctggtgctggtgctggagatatctcatttacaggaccattagttgaagcatctgcttgcggcggggagagaggtggccttggtgacattcaaaacgacgccgaactgagcgctgctcttgaaagcctcgcagaggcacgccggagcagttttgagaacagatttcaaaccggagcagcatgtgccctctggcttggtgacggtgctaccgttggtgacgaaggacaagcagtcggccatggtgaggacgaggatgctgatgcgctatgggttagatcaacggcgcacagggccaccgcgagaaccaacgcaatgagggtcaattttgatgccatttttgggttggggagagagaaagggagtgggaactga

SEQ ID NO: 22415 - DNA, 612 bp, Glycine max
  Peptide Sequence Number=SeqID_139193
atgacgagcctgaaaagcagtgaaaggaaaatgatgaaaaggggtttcatgtgccactctcgggcttcaacagctgtgtgcatgagtactcgtgaccctcgatctgtagttgtgcctaagaagcttgaaagaagagtgtttcttgatgatacaaggttgatcaactatgccaagtactccaaacttgttgagcctccaaggtctagtccagttccaaagatcaagcttagagggcaggaacaagatcaagccaataatgaacctagggaatttcagaaaaaacagacagataataatgtctttcagtttgccaccgaggaaggtatgtgtgtcttacagttatatggtcacactcacatattaaattttgaacggaataatggaatctcatattcaaatctcttaaagattgtggttgtgatgcgggttgcaattcattgtcaaggatgtgctggaaaggtgaaaaaacatctgtctaagatggaaggagttacatcatttagtatagacgtagaatctaagagggtgacagtgatggggcacatttcaccagtggaagtccttgagagtatttcaaaggtgaaaagggcagagttctggactgcttgttaa

SEQ ID NO: 22416 - DNA, 333 bp, Glycine max
  Peptide Sequence Number=SeqID_139194
atggattctctgatgaagataactgaaatttacccaaaacaactcgtcaaaaaatcagccaagtcatcatcacggtcaccctcgcagggcacaagcagcagttgcttgcagtttgcacttcatagagccaaagaggaggcagcacagcaaagagaacatagggttgctgaagtgacaagcatagaaagagatggagtcacgtatggacctatgaaggagaaaagggaattaggggtttttaaaagccaggtcaaaggggatctgaccctgaaatccaggtcttcttgccgcactggggatcatcccacaagaaaaattgcaactctattctga

SEQ ID NO: 22417 - DNA, 375 bp, Glycine max
  Peptide Sequence Number=SeqID_139195
atggaatacagggagcagtttgagcttctctctgttccattgtgcttcatagatgaagagttaatgagaagggtgtttatgaatgggttggaagaggaaattaaaactgaagttaaaatgatgggtgcaagaagcttgaatgcactaatgatgctagtgtggaaggtggaagatcaaaaatcggatttggaccttgggttttttatacagatgagaatgtccctgccggaagcggtgactaaccttcgtcgcggaccagctagcatgtgcaagggtgagaaaacaaacactcggagcagtgaagtgacaattgatgcagaattacaaacatgttgggtgcttggcctaccagaactacttttgatgcaacattaa

SEQ ID NO: 22418 - DNA, 957 bp, Glycine max
  Peptide Sequence Number=SeqID_139196
atggacgagagaaaaagaatagatccaaggagcggtttcaaccgcgcttccagaatcttccacagcctcaagccaccactccccctccctcctcccaaacgccacctttctccgccacaacctacgccctctccctccgccgcaactcgctatttcccgactccaccaccgccctcatcgatgccaccaccggccaccgcctctcccactacgaggcgacactgcgctcattctctccccaacctcatccaagttccaatcctctgcttcgcacttctttcgcttggcgtggtcgtctctcccgcgaaccctatctccacgcgctccgatctcacgcgcttcttccacctcagcaaacctgcaattgtcttcacagtaacttcagtcgttgagaaaacacaagactttcatgttagaaccgtactcctcgactcgcccgagttcgactcgctcacgaagactcggattcagatacatcctccgagtccactcgtttcccccgtgactcaatctgacgtggcagcgattttatactcgtcggggaccacggggatgatgaagggtgtggtaatgacgcaccgtaacctaacggcgttagccgcgggatacgacgccgttagagtaaacagaaagtatcccgcggtgttcttctttacgatgccgtttttccacgtgtacgggttcacgctcagttttagggcaatggtgctgtcggagacggtggtgataatggagaggttcagtttgagggggatgctgagcgccgtggagaggttcggagtgacacacctggcggtggtgccgccgctgatggtagctttgacgaaggacagcgtcaccaacgggtacgatttgaagacgctggaaggggttacgtgcggttcgtctccactgggaaaggaaaccgctgaggctttcaaagcaaagttccccaacgtcatgatcctccagatatga

SEQ ID NO: 22419 - DNA, 453 bp, Glycine max
  Peptide Sequence Number=SeqID_139197
atgtatctgaatccgagtcttcgtgagcgagtcgaactcgggcgagtcgaggagtacggttctaacatgaaagtcttgtttgctgaggtggaagaagcgcgtgagatcggagcgcgtggagatagggttcgcgggagagacgaccacgccaagcgaaagaagtgcgaagcagaggattggaacttggatgagggtttcgatgcggttgatgacctcgtagtgggagaggcggtggccggtggtggcatcgatgagggcggtggtggaggggagtggtggcttgaggctgtggaagattctggaagcgcggttgaaaccgctccttggatctattctttttctctcgtccatgggactcgccaatggagttggcaagttggacacgtggcggcgcctggtggactcgccagtggagttggcgagttgctatccacgtggcgggtcccgccactc

SEQ ID NO: 22420 - DNA, 1434 bp, Glycine max
  Peptide Sequence Number=SeqID_139198
atggaccctctagaagctttggtcgcccaaatccaagggctttcgagcactcccggcgacctcactcgcctccacagtgttctgaagcaagccgatgactcgctccgatccgagtcaactcgcctcgctccgattctcacccagctcgacccctccattcattccctcgggtttctctacatcctagaagcttcaatgaccgatccggtaaccaaaacgcaggctgagaccgtcgttccgatcgttactaggtttattggcgcttgcagcccggagcagattcgcttagcgcctgataaatttttatctgtctgtaagaggttaaaggatcaagtgatgctgctggaagctccgatacggggtgtggctcctttgttcactgctcttcggaaacttcaggtctccacagaacacttgactccactacactcagagtttcttctgctgtgcttgttggcaaagtgctacaaaactggtctatccattttggatgatgatgtttttgaacaatattgcattgtggaattccttggatgtgctattgtgactccgtccacaaatgtggctgctgtggatgtcatggctgcggttgtaactgctcccatgtctaccataaatgctatagctgttgaagcttacaaaaagtatatattggtttctctcattcgtcatggacagttctcaaccagtcttcctaagtattcttcttcgactgctcaaaggaacctgaagaacttttgtcagccttacgtcgaattggctaatagttatggcactggacaaattgaagaactagaggcatatgccagggcaaatgcagagaagtttgaatctgacaacaaccttggactggttaatcaggttgtatcatccatgtataagcggaatattcagagattgacccagacatacttgaccctttctctccatgatatagccagcacagtgcagttaaatagccccaaagaagctgaaatgcatgtgctacaaatggtggatggcgaaatatatgcaactatcaaccagaaggatggaatggtgagattcttggaggatcctgaacagtataaaacctgtgaaatgattgaacatattgattcatcaatccaaaggctggaagagagagacaaagatatgactttgatgactttgacgttccacaaaagttcaacatttaaggggctaggaatgatggaagtagatctggttatggtccatcacccgtttcctttatcttttgttattcctggttctgagagtgggggagtgttttatttcagtcccaaatggaagagtgcttgttctgaggattggatccgcttcactttaaaagcagcacagtatgctcgacttggacgtccatccatacacgtacttaaatcccgtggcatgaagctagcagctttggcgattgatggagcatttctgaagtaa

SEQ ID NO: 22421 - DNA, 294 bp, Glycine max
  Peptide Sequence Number=SeqID_139199
atgaatagcacaagttttcaagatttggaaaaccagaaaacttcagaaagcttttggtacaaagaagaagaagaagaagaagttcaaagagattcaaggcttgtaaaggattgtaagagattgattggaaaaaggtatttattagtctttgacttgttagttcgtaatactgtattattttttatcttattaatacttattattggcatgcttttgccaaaggttgctccggcagagctcgaacaatatctcctgtctcacccagaaataaatgatgccgcggttattccgtaa

SEQ ID NO: 22422 - DNA, 528 bp, Glycine max
  Peptide Sequence Number=SeqID_139200
atgtatgtctacgaaaaagggatattaggtgctaaccgagacaagattttttttctaatgtgtccaagaaacaaccaaaaaaagctaattaaagggggagcattgtcaggaattacaatgttcaagttcaacaatattgaaacaaccaaaaacaaaataaggcaagcaaacctaattaaagggggagcattgatttgtctcttacggatcaagttgatccggaagaggcttacggatcaggtgatccgtaaacagcccagcaacttctcgatagcggtttccgccatcgtcggcaacaatggtggaagaagaagaaacgcgaaggagaaacgtacctcgaagaagaagcagaaacgcgaagaagaagctttccacttgatcccggcaacaatggcggcaacgaagatgaggaagaagcagaaatgcgaagaagaagacttcacttgggaagaagaggcagaatcgcggcgcgaagaagaagaagaacgaagaagatgcagaatgaagcagaagaatgaagaagtataa

SEQ ID NO: 22423 - DNA, 1062 bp, Glycine max
  Peptide Sequence Number=SeqID_139201
atggaaagcagaggagactctgaagtagaggaaccagttcacattttagcatactacagcagtattggaccatcaaggtttgaggagctggacaagtttctatcaaatataagggatggacgttttcttcgtgcgcagaacattgtcttaaaactgaacaagctcaagttgcctcttaaatgggagcatgtttgcaggattgccggcaagggggttgcccctgggaggcttcatgtcgcccgtgccatgcttgaagctggttatgtagagaatctcagacaagccttcgctcggtatctctttgacggtggacctgcttactccacgggaagtgagcctctggcagaagaagcaataaaaatgattagtcatactgggggtgttgctgttctggctcatccatgggcattgaaaaatccagttcccattgttagaaggttaaaagaagctggtcttcatgggatggaggtctacaaaagtgatggaaggctggcagcatatagtgacttggctgatgcctatggacttctaaagattggagggtcagactatcatgggagaggagggcacaatgaatctgagctgggaagtgtgaaccttccagtgatagtgttgcatgacttccttaaggtagctcggcctatctggtgcaatgccatcagggagatattagagtgttatgctgaggagccttctgattctaacctagcaacaattactaggtttgggagaacctggagttttaagggaggttcaccctttagttgtggacaggacttgattgatcattgtttacctctctggttgtctagccaggagatggaaaatgcagagtttgaagctatcaagttaaagctttccaatgtttcagttagtcagggaggaattcagctcctcttggtagtgatagagagcaatttagtgagtttagattgccggttaggcaaccacaaatggaagttggagaagcatgtcctttgttacttttgcgctggagttgccttgtacttcatgctatcacactttcaccggcagagcaaacaagctcttagcttgtgctag

SEQ ID NO: 22424 - DNA, 204 bp, Glycine max
  Peptide Sequence Number=SeqID_139202
atggctgaaagaaaaattgggggcgagggttttcaagagagtgaaaggttgcagggacgcgccgtaatcgattacaaaaatatggtaatcgattaccagagagcaacttttccagaaataactgcttgtaatcgattacactattatggtaatcgattaccagtggttattttagccagaagacaaaaacagaaggctttctag

SEQ ID NO: 22425 - DNA, 406 bp, Glycine max
  Peptide Sequence Number=SeqID_139203
atggtggaaccatcgaaaaagaggaaaggaacctcgagtcggagtcagcggcattcagggtcacaggaagccccaattacttcctccattccctctggatcattattctcatcagaggaacagcgtatacggtacacaaacctcttttcctctcgttccattgcagacccaaaattcatagatatgaagttcttctcaaatgagaattttgaatgcttccaagcatttgaaaactccaatcttattccattcatgtctctgaaattacctgtctattctaaattagtcaaagctttctattctaatttcgaaattcatgaaggtgttctaatgtctgaaatctatgggattaagatggtcattgaccaatccctattttatgatttaacaaaattgcctagtgaag

SEQ ID NO: 22426 - DNA, 533 bp, Glycine max
  Peptide Sequence Number=SeqID_139204
aaaacaaggtagatgatcaaggagatgaaagggaagaaggaattggtgttgtgggtgctccagaagggagatatgaggttttgaagatttggaagcttggagcgctgtcaagagaggttttgggaatgaggaaggttcgtggcgacgatggccagcaacagcggtggtggaggaagatcctttgcgtttcttcgatgattctgttatttgatgaagttttaatgaatttcaatctgtgggtgaactctggaggtggtggcggtgtttttgttgccagctactgtgatgcctcgccctgtgcctgcctggggaaccgacagaggcctgtaattagagctagaaccctagggccctattggacttcttcaggtccactggatgtcttgcgggcgcgatccctgcaaatagtagatggcatcagagaccagttgagccatgtgcatacttacttatgtcatgatggcataaaccagctgacacttcggcagggggagatcggagtggtggtcgctggtaagaaggttgctaagtag

SEQ ID NO: 22427 - DNA, 650 bp, Glycine max
  Peptide Sequence Number=SeqID_139205
atggctgaagtagacgaggtgcaagagcggatgaagaccgacatgaaggccatgaaagaacagatggccacaatgatggaggccatgatgagcatgaagaagataatggaggtcaatgcgactacagttgttgctatcagcgctgtttctaggagggctacaggcgttcgccttcagagggctgcatgccctcaccttctgagggctacacgccctcgccttaagaggactgcatgtcctcaccttcagaggattgcacgtcctcgtcttcagagggctacacgcgattgccttcagagggctacaggcgctcgccttcagagggctgcatgccctcaccttctgagggctacacgccttcgccttcagagggctacacggatacacgccattgccttcagagggctgcatgccctcgccttcaaagggctacacgccctcgccttcagagtactacacgtcctcaccttcagaggactacacgtcctcaccttcagaggactacatgtcctcaccttcagaggagtacacgtcctccccttcagagggcatcaagtcctcgccttcaaaggactacaggtcctcgcattcagaggactacacgtcctcgccttcagagggctgccatcctccccttcagagggctacac

SEQ ID NO: 22428 - DNA, 159 bp, Glycine max
  Peptide Sequence Number=SeqID_139206
atgtataggaagactagtaaatgttgcactgagcttcttgggaatgaaagattgagagacccttacagaaacatggtggcagacttggacatgatgaaaagtattgtggttcatgttttggtgcagaagaggtgtcaatgtggactgacaaaactttaa

SEQ ID NO: 22429 - DNA, 264 bp, Glycine max
  Peptide Sequence Number=SeqID_139207
atgaaaaggaaaaagaagaagatgggggccatacttagctcggagaagaagagaaacagcatgacagcggcggaaacgacggtgacgacgccgccggcgagcgtgcgactttatccatcacgggcggtcgccgaagccttttggggaaatattaaagcggtaacggcgctccgtcgtggacggtggccggagaatgacgcgtggggaaggaatgggttggttgaagaattgagaaaagacccaaacaaacacgggatcatatga

SEQ ID NO: 22430 - DNA, 399 bp, Glycine max
  Peptide Sequence Number=SeqID_139208
atgactactaacaacactactgaggaagggagtgaacaagaacaaatgatatctgtaacttttattgacaaggatggtgaggagaagcatatcaaagtccctgttggaatgtctatgttagaagcagctcatgaaaacgacattgaactagaaggcaagagctttgattttagaattctattacttcgcctcaagattttggacttggaacaatacaataaattggaagatccaactgatgaggaaaatgacatgttggatctagcttttgggcttactgaaacatcacgtctgggttgccaagtgattgcaaaacctgaacttgatggaattcgtttagctattcctgctgccactcggaacttcgctgttgatggttatgtgccgaaaccacattga

SEQ ID NO: 22431 - DNA, 997 bp, Glycine max
  Peptide Sequence Number=SeqID_139209
caatagaggagtagggttcgttcgttcattcgagtcaaacacaatgagcttgtctcttattcaaggctattcttccgcagaagaggaacaagacgaagaccaaccccaaccccacaattccgacctcgaagattccgacgacgacgacgccgccgctggcaccatcaccgccgcaaaccacccttctcttggcgacagatccatcttcgaccacgttccgaatcctccttccgcctcgggtcttccttctgcattcgatgctttctccgaaattgcaggaccgccccaatttctgaacaatagtgtggaagagtacaaaccttcaagagacgctgatgagcaacaagggaagcatgccaataggaggcgccgcaagaacaagaaggatttacccacagtggtagaggcaaaacctcaactggttgggattcatgagcgagtaagaagtgacatcaatggtagccaaccaccaacatcagctgccttgggcacatcagaaggaggcaagcgggtgccgactgcaacaaatcctaatgctgaagatgctgcagaccttttaagaatgtgtttgcagtgtgggattcccaagacctactccaatgcacgcggaatggtctgccctgtatgtggtgatcgccctccaaaggatgatacaagcgcagaatccaagaagaaaggatcaactgtcaaagataaggaaaaatctaaaaggatgaagggtcaatcatcccatgcaacctggaaaagtgaaacagagatgcatctaaggcaacaaaagggtcggaatttgcatgcaacccggcgtggggttcagtggagttcttctctgctccacattcttttaccatcggtgggggtgtggaatttggggatgaaggcggagagggaagtggaggagggttggtgggagacggcgacgtttgtgggcggtggtgggtgcgtctcgacagagccaccggaggcggtggaagagtggtcggagaaggaagaaaagtaa

SEQ ID NO: 22432 - DNA, 756 bp, Glycine max
  Peptide Sequence Number=SeqID_139210
atgttccatatctatctgctatcccaaatctacaccaacaagtctgttgtcgcttctcgcaatcggagagaggatagtgatggagttgaatttgaaagtgattcatggagtgaggatagttcaagtgataacctatctagatcattaagtaacaattccagcaaagcttgggaggatgctgtttctgaggattcaagctgtgaccaggagggttcatggctaagggataacaagcttggctgcctttacttgcagtatactgagatggcttcaccttactcgagggttccacttgcggagaagatagacgagttagctcgaagtcacccggcattattaacattgaagagtgtggatctttccccagcaagttggatggctgtttcttggtacccaatttatactgtcccatgccggaacactgaaaaggacttggaagcatgcttcctcacttaccatacattgtcatcatctttcgaagattgtgcaatggagtgtgatgacattgacatagggaatgatccacattgctccatccaaggagagaaatgcaaggaaaagaacagtggccatgtctctctccttccatttgggctagcaacttacaaaatgcaaggagacatttggctaaaccctgaaccttatgacaatgaaaagatatcctatctgtacagtgcagcagactcatggttgaaacagctcaatgtccatcaccatgacttcaactttttcacattacacaacaacaccttgtaa

SEQ ID NO: 22433 - DNA, 1757 bp, Glycine max
  Peptide Sequence Number=SeqID_139211
agatgttggagaacgtgaaggatgatggggggctcgaggagctcgagatgttgctgaatgagatccctcaggcaacatcactcaatctttaccatgggaaatcgcatcatcatcatgatgttgttgttgttcatcgtggtgatgatgatcatgatcgccatcatgattcttttgttgtgtctcatggaatgtgtgatgatttcactcagattcagtatccatctgtttcatcccctgtgagtggcttttctctgcaatccgatggctcttcctcaagcttgttctcttcttctggccatgccttgtctgatactggatcaccaacccctcctccattggaggatcttaaatccaccaccatgccttcttcttctcaccctaataaccgtttcatcacacctgattcaactactcttatgaggaatgccaatggaggttttgttgatgaacttggaggcctgtgtgccaatttgagtcaaatgtacatcagcaatcagcaggagagcccttgtgatttcaaggatgcttcaatggccatgcataggcctaggcctcctccatttcctgaatgtgtttccttcactggaaatggtccaagcaataatgttcaatatcatggggattcttacagtttcaggagaggttcttttgattgtgttggtggtgttcagtcccctctttcttggactcctgtaaatcacgatgccgagataaattcggcgttaatggctaaattttttggatcaagacagtgtgccaaaatgtcttatgagacaatgctttctcaattacatgactttagtagttcaatggatcatcatcgtcattcaaggccgctgctggtggataactactatcgtggaggaagtggaaatcagccaccggagtgtactgcttctctgagcagaaacccaatggttgatgctttacttaatgcacagaggaatggaatgaatgtaactgaagaaacaggcatgtcgagatcgcctagctcttcttcccggggtattaatttaagaccttatttgggtgttcaagatttactgcagtatagccattccctgcctaattatagtgcaagagctgtgcctctttcaaatgctagaatcctacaaggaaatatagatgctattgcaagagaggagagcttcatcatacaaggtgaaggtgtaaattatgctgctagcataggtttggatcgttctatgtatcgtagtaaggctgtggtgcgagacactggcttcgccaggcatttgaagagatcagagttagacgtgccataccaggttgtaggaacttatgacaatgataggggtgctaggataggttgctcctttcctttgttacccaagtatagttccctagctgaagctcaaggttatatatatttaatgtccaaagatcagcatggctgtaggttcttgcagaaaatgtttgatgagggtacaccagaagatgttcaagtgatatttaatgagataattgatcatgtagtggaacctatggtgaatccttttggaaattaccttatgcagaagttattggatgtatgcaatgaagaacagaggatgcaaatcctactaataattactgaagaacccgggcagcttgtcagaatctctttaaacactcatggcactcgtgtggtacagaagctaatcgagactctcaaaaacaggcagcaaatttcattagctgtttcagctcttgaaccaggattcttggctctcatcaaagatctaaatggaaaccatgtg

SEQ ID NO: 22434 - DNA, 2682 bp, Glycine max
  Peptide Sequence Number=SeqID_139212
atggttcttgttttcgctttgattctcctcgggtttcttcttggggtggcggcggttgtagctgccgaagctctgggatttttgtgggtgataaagcgattgcaaagcaagatcagcaaagaccaagccaaaatcgcgtcgaaaacgcaactgggtagtgctcaaagtgatcgtccccaacaacaattgctaaaaaaggaggtggctttctggttcccaatgggcgtggtttgggttttggagcctgacaaggtttcaaaattttgggtggagaaacagtcgtcaaaggagctgaagaggaaaaaggaagtgttggaggtgactcctgttaggaagtatgggaaaatcaatgggcaatcacttgtgcttacagatgctgatggctttcacaccaccattcagcttaagggttgcttagtggaagctgtttcagctacaagtcttccttcaaaaaaatgcggggagaatggaacccacaacctttccctccctcccttctccttttaccaccaagccaaccttataaacttccaggggggtggtggtttgctgccttcttttgttgataagtgtgtttacatgttacgagctgagaaggcgaaaaagttccccatcaaagtggaagccaagacctctgtgatctaccatggaagcaagactttttgcatatatcttgagactgcatgcgagaaagaagcatggtgtaaggccctccgtctggcttcttctgataataaagaaaagcatgagtggtttgcccagttgcaagaagagtttcatagttatttgacatcattaaatactgaatatctttctctcgtgaaaccatccgtaggatcaagtgctgagacaatagaaaaggctagtaagcctgatggtagttcctcaaaggttcgtcaatttttgaaaaaacttacaaaaaaaagttcccgagttggtgtggaaaataaatcagcttggacttcattgtcaggccgtgaagaaagaaagaacactgagaagcttcgtgcttgtcaagatgcagtattagccactggtttgatgaaatctgctgcagcagcaaaccatctgaaaagtcccttgttagacaattccacaccatcatcttcaaccttacctcattcaggaagccagagtcaattctctgtctgttctgatgctgatgaaaagttaggtactgatgaaggaacactatgttggaatttgttggtttctcgactctttttcgatgtcaaaggaaatgtgcgaatgaagaaatccatccaagaaaggattcagaggacattggcaaatatgagaactcccagttatgtaggtgaagtaatctgtacagatatcaacatggggaatgttccaccctgtatcattcgaatgagggttcttccaatggaaatgagtgaggtgtgtgccttagagtttgacattgaatattctggtggtgcattattagagattgaaacaaggcttgaagtacgtgaactagagcatgaaagggggacagaggactcaaatccagagtcaagcaatgttggcgctgtcccatcagatcttcttgaaggatttgaatatttgggtgagcaattgaatcttgcagaagggatgaatgatttactagagccaaaaggagatgatatgtccaagagctttaagcacagtacatcttcctcaactcaaggatcaagatggaagtctatgttaaattctgttgccaagcaagtttcacagtgtggtagtgcttgtatgaagtgtgtttctctacattatattgtttctctccaggcatgttggcataagttcatacttcgtcccgtaaggcgatgctactctaaactggaagaaagggaggttcctctctctttggcaataaggatagcatccctcaaagggacattgcggttgcagataaagccacctccgtctgatcaattgtggtttggtttcacatttatgcctgatatagacttcagcttggaatcatttgttggagaacacaagataactaattcacacatagctttgttcctggtcaatcgactcaaggcagcgatccgggaaactttagtgctcccaaattgtgaaagcatatgcattccatggatgctagccgaaaaggatgattgggttcctaggagtgtcgctccgttcatatggatccacccagaatcggggaacgagatttcaacctcagttgataccaataatcaaccttgtggtggattgaaagctagtgcaaggaccttaagtggtgatggtccagaactcaaacaacataaaccgccaaagtgtaccaaatctagtcaggaaccagctaggaaatcagattctgtggcacttccaccaatttcctctagttcagtaacattaaggagcagcaaaagttcggaagaactgacaagacctctgttagagaatgacaaaccacaagaaactagagatttgcaagaacttagaactacttcattgcagaatgataatactaatgaagctagtgaagagaagatgggggatatttctgtgagtgaatcacctcccagaaacgtggtgatggataaacaatatagttcaattgaacaggatgattcaaggccaaggaaaattggaaaaagggaaagaattcttgatttgaaaaagaggatgagtgagaaattggaagaaagagtcggcacattgttgagaagataa

SEQ ID NO: 22435 - DNA, 270 bp, Glycine max
  Peptide Sequence Number=SeqID_139213
gttgttgagttaaaagtggagatggtttgcatacatgagaaaagactaaggaaatgcctctcaaaattaaaagggatagaaaaagtggaagtggatactaattgccagaaagtagtagtgactggatacacacacaagaacaaaatcctaaaagcagttaggagagggggtctcaaagctgacttctggtctgctcagaatgagttgctcaatgcttatgtcagctccaattatgccaactttagattcaaccccttcaacttcttctaa

SEQ ID NO: 22436 - DNA, 852 bp, Glycine max
  Peptide Sequence Number=SeqID_139214
atgcacatcaatgattgcaggaatgtccattcaggtcatacaggggaagcactggatctgtttagaagtatgataaggactgatattagaccaaatggagcaacccttgcaactcttttatcagcttgtgctgctttgggatcactcggcattgggcaagagattgaagagtacatttttctaagcgggttggaatcggaacaacaagtccaaatgtctctcatacacatgtactccaaatgtgggagcatcatgaaagctagagaagtatctgaaagggtgacaaataaagatttaactgtttggacttccatgataaatagttatgcaatccatgggatggggaatgaggctatcagcctctttcacaaaatgactactgcagaagggataatgccattgccagatgccattgtttacactagtgttttgctggcctgtagccattctggattggtagaagagcgactgaagtacttcaaaagtatgcaaaaggattttgaaatagctcctacagtagaacattgtacctgtttgatcgatcttctcggtcgagttggccagcttcacttagctttagatgcaattcagggtatgccaccagaagtccaagctcaagcttggggtccattgtttgatgcttgtgggattcatggcaatgtagagcttggggagattgcaactgttaggttattagacagtagtcttggaagttccgaaagttatgtattaatggctaacttgtatgcctctttgggcaagtggaaggaggcacatatgagaaatttgatagatggtaaaggattggttaaagaatgtggctggagccaagttgaggtcagtggtagctaa

SEQ ID NO: 22437 - DNA, 1035 bp, Glycine max
  Peptide Sequence Number=SeqID_139215
atgtctcacttcggacgttcgggtcccccagacatttccgacacttactctcttctcgttctcaacatcaccttccgtaccaccgccgacgacctattccctctcttcgacaagtacgggaaggtcgtcgacatcttcatccccaaggatcgaagaactggtgagtcaaggggttttgcattcgtgcgttacaagtatgctgatgaggctcagaaggccgttgagaggctcgacgggagaatggttgatggtcgtgaaataaccgtccagtttgcgaaatatgggcctaatgctgagaggataatggaatgcctggagaaggaagtcacaaaggaaggattattgaaacatccccgagatcaaggcgatcaaggagccgtagcccaaggaaaaggcatcgtgatgattacaaagatcgagattataggaggcgaagtcgcagcagaagttatgataggtatgaacgtgacaggcaccgtgggagagacaaagattatcgtcgcagaagcaggagccgtagtgccagtcttgattacaagggtcgtggtaggggacgctatgatgatgagcgtaatagtagaagccggagcagatcagttgatagcggctcccctgcacggcgcagtcctagtcctcgaaggagtccttcccctcagaggagcacttcccctcaaaggagtccttcccctaggaagagtccacggggtgaaagtcctgcaaatcgtagccgcgatgggcgttctcctacccctcgcagtgtctcaccacgcggtcgccctgatgcttctcgaagcccttcccctcgaaattcaaatggggatctatgttcatgaaaaattctggagacgccggactattgcacctgtagctgttttgctattgttggatcttttagtctatgtgaatgatcttatcggagtcattgaaggattttatgatctaagtgctgcgcatgttgactttgttgctgttgatgctgtttctatgtcattgatgattggtcgcgaatttgatgctggttgcaagagtatgctg

SEQ ID NO: 22438 - DNA, 2061 bp, Glycine max
  Peptide Sequence Number=SeqID_139216
atggatgttgcacagccacaagtgtcatctgctagtgtaaatttaacaacagagacagcaatagtttggcctgtatctgaagcaaaaaatgcaccaaattggcaaaagcaattaggggaggcacttgctgagcatttaactagttgtggctataattctagccttcgaggtcgtgagctagctgtttcttgggctctatgcgctgtctgccttgttggccatttctctcatttctttgcagcaaaggcaccatggatccatgtatttcattccattgggtttcatctttcgttgtctttgtttacgttgcttggtcctggccgccaacttatccttgatggcttaaaaagccttcttaaaaggacgccaaacatgaacaccttagttggtctcggggctttatcatcatttacagtcagttcatttgctgccttgctgccaaaattgggttggaaggccttctttgaggaaccaattatgctaattgcatttgtcttgttaggaaggaatctcgaacagagagctaagattaaagcagccagtgatatgacaggacttcttagtttattgccaccaaaagctcgccttcttttgaacaatggggaaacagaggttggctcggttgttgaagttccttctgacagtctttctgttggagaccaaattattgtattacctggagatcgtattccagctgatggagttgtgagatctggtagaagcactgtagacgaatcaagttttactggtgaaccactgcctgtaacaaaagtacctgggagtgaggtagcagctgggagtataaatcttaatggaactcttacaatggaagtgcagagaccaggtagtgagactgctatggcaaacattgttcgtctagttgaagaggcacaaagtagggaagctcctgtgcagcggttggctgacaaggtggctggacacttcacttatggagtgatggcaacctctgctgccacattcacattctggagtctgtatggcacacacattttacctcctgctttatatcaaggacgtgcagtttcactggctttgcagcttgcttgcagtgttctggttgttgcttgtccatgtgcacttgggttagccacacctactgcagtgctggttggaacatctttgggagctaagagaggattacttcttcgtggtggaaacattctagagaagtttgccatggtagacactgttgtgtttgacaaaacagggaccctcacggttggtagacctgttgtgacaaacattgtcattcctatttgcataaaaaatgcaatttcaagccaaactgaagaaaatgctttgtctgatgttgaagttctaaggttagcagctgcagtagaaacaaattcagtacatccagttggtaaagcgattgtggatgctgctcaggctgctaattgtcataatgctaagcaaaatttacaggtaaaagatggaacattcctggaagaacctggatctggtgctgtggcaacaatttatgacaaaaaggtttctgttgggacattagaatggattaccaggcatggagttattaacagtatacatcaagaagtggagaagagtaataatcaatcctttgtctatgttggagttgatgatactttagctggcctaatttattttgaagatgagataagggaagacgcaagagacgttgttgatagattgtcaaagcaaaatataggtgtatacatgctatcaggagacaagaggaatgctgctgagcatgttgcgtcccttgttggaattcccaaagagaaggtgctatctgaagtaaaaccagatgagaaaaagaagttcataaatgaactacagaaagataacaacattgtagcaatggttggtgatggaattaacgatgcagctgccctggcttcttcacatgttggtattgcattaggtggaggtgtcggggctgctagtgaggtgtcttctattgtattaatgcgcaaccagctctcacaggaaatctactatgtgaaaatggcatgtgaaaaatcctttcctcaatacagaaaggttgagcttttatcatga

SEQ ID NO: 22439 - DNA, 168 bp, Glycine max
  Peptide Sequence Number=SeqID_139217
atggcggaaatcaaccaaggtacacagggacggatgcaagtggggctagggtcacgaccgactgatcgttgccccttcccggcgctaaacaagcagaggacgtcgctgcaaggcagcccagtatcctttgcgttcacagtttcttttactattgtttgttttaaataa

SEQ ID NO: 22440 - DNA, 129 bp, Glycine max
  Peptide Sequence Number=SeqID_139218
atgtatcgtgggccccgtggctcgttcggtgtagaaggtcgatcgaaagtcggcccgtgcgatcataccagcactaatgcaccggatcccatcagaactccgcagttaagcgtgcttgggcgagagtag

SEQ ID NO: 22441 - DNA, 365 bp, Glycine max
  Peptide Sequence Number=SeqID_139219
gccaaggttcaaaaaagtctaaggttgtgtctcaatggggtcttttatcgtgggagcccgatcttgatatctggggcaaaacaaattcgtgggtcaaggtgtcggtctcgggccgaacttccatattgttccacaaggcacgtgcaacaatgatgatttggaaacaacatgcaaaattagtcatggccacaaccaggtgggcactcaagcatcccgttcatggcattgtgatactacggttgggaatttacacaaacagacccaacgtttccaaattatgctctgtcatcagttcaatgaattcatccattcttatcttggttattcaggaaaataaactcttagcgttagtcccttgcttctag

SEQ ID NO: 22442 - DNA, 378 bp, Glycine max
  Peptide Sequence Number=SeqID_139220
gtatttgactttgcaaataaatatcgtggatcttataataacagcgtcggtgcgggagcatgccccttctactgtgatattagtggctacatggatgagttgatttggggagcagcatggttgtataaagccagtaataagcccaattatcgggattttgtgaaagcaaacatccaatccatgggcaatcttgatgaatttggatgggactgcaagcatgctggcataaatgtgcttgtttcgcagtgggcgatggctgatgcatccagtagagatcttttcattcctaatgcagataaatttatatgctctttgttgccgagttcccctaccaaatctgtctcgtactctaaaggtgttttagtttatatgacttga

SEQ ID NO: 22443 - DNA, 243 bp, Glycine max
  Peptide Sequence Number=SeqID_139221
atgaaattctgcaaggaaaaaaatcgatttgcaagtggcagtggtgaaaatggtcacagtagggatggtggaggctgtggttgtaatggcaataatcagtggcagtggtttgggaggtggggcaaggaggtggaagcaacagtggaatcggtgatgatagtggaagtgattggtggtggcaatggtagcccttacaatgggagaggtggtggtggaggtcaccatgatagcagcaagagttaa

SEQ ID NO: 22444 - DNA, 522 bp, Glycine max
  Peptide Sequence Number=SeqID_139222
atggagttggcatgggacggggcgaaatttgggttacctaatgcctcaaatggttttttcatcacacatgcagatgtgactgaaataattttaggtgacaaatgtttaaacatatctgtactgcagctgtggatgatgtttatgaatgattggagtacaagcattggtttttctccagtgtacggtttccttgagccccagtctatacgctgcacaaaggacacatgtgaagaatgtcaaaaggcacattggcaacttcttgtgttgtgtccacgagagaacattatagtatggttctgttctgtacgaagaaagcctgatgttcacattaagtttgcagtgaacaatgcaatgaagaaaatatgcagtaatctccaaggcaaggacaatgcacctccacctccacctcaatggattgaggctaagtatttttcagatggaacaacattagacactgacaccatgacgacaatacgcaagaaatgggcagcctattttctagaagttggaaaatggatgtaa

SEQ ID NO: 22445 - DNA, 378 bp, Glycine max
  Peptide Sequence Number=SeqID_139223
atgccgatctccccctgcgaaagggtcgcgcccacaagacactcaatggacccggagaaatccaatagggccctggggtttccagctctggttacgggcctctatcagtcctacagggtgcccgtaccccccggcaagggatcgcgcccgcaggacacccagtggacccaaagaagtccaacaggttctacagagtgcccgtcacccccaacaaggtcatcaggcctcctactaactgagctttcatcaagaagtactgcgccccccagaaaggtgcagggcgagacaccacaacagcctggggatggccggcagcgggcaataaacgcaccgccgccacctctagagttcacctcagctcatccacaaaaaggttag

SEQ ID NO: 22446 - DNA, 355 bp, Glycine max
  Peptide Sequence Number=SeqID_139224
agttggtgcttcagaagtgccccaaaagaaatctcctgcaactcctcgaactgctcgtcagttgaagacaccaaactctgatgcatactctgtctcctctccaaatgctgcaaaaaagactccgaaagatagaagtccaaagaagaaacgacctagtaaggtccaggaattggaatctcagattgctcggcttcaagaagatctgaagaatgctaaggatcaacttaactcatctgagtcatggaagagaaaagctcaacaggaggctgaagaggcaaagaagcagcttgtagacttgacgaaagagctgcaggaatcccatcaacagcttttggacttttcggcttctgaagaa

SEQ ID NO: 22447 - DNA, 260 bp, Glycine max
  Peptide Sequence Number=SeqID_139225
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggacgattccaagtcccacacgtgaaccac

SEQ ID NO: 22448 - DNA, 1339 bp, Glycine max
  Peptide Sequence Number=SeqID_139226
gtggcgatctcgggtgaggcagaatctttggaagcccatgctttggcccgccaggcgattgatactgagagtcagccggaaaaacatgctgcgtgccggattttctttggcaaaaatagtagcaatacgacgcttgcaattggctctccagccaatctgagcggcgtacaaagtcaagatggcggatttatcctgaatagtgcctcaggtttcttgcctaatgccagtgcattcaactttgtcgcaggcaatgccagccgtggcctgctcagtacgctgagtatcctggaagcaaacgggtttgcctacacactggcagaaccaagcctgaccgctttttctggtcaaagcgccagcttcctggctggcggcgagtttcctattccaatccagtcaggtgccggtggattgggggctgtaaccattcgttataaggaatatggcgtgcgcctgatgcttacacccactgtgctggatgcaaacaggattttccttaaagtttcacctgaagtcagtgaagtagactttacgaatgcggtacaaagcggaggcgtagccgtccccggcctcagggtacgaagaacagataccagcgtttcgcttggaaatggcgaaagttttgtgattagcggcttggtgagccgcaacacactacaaaacgtggataaatttccaggcttgggaaacctccccattatcggtgctttttttcgctcaacacgctttgaccttgaggataaagaactactcatgatcgtaacgcctcatctggtaaggccaatcgccaaagatgccgcacaacctgaattaccgggaggaaatcttcgcgaataccgcccaagcttcagtgatttgtttttccaaaaagggaccaagccagatagtggcatccctgtcacaggggaaatcattcctgcagactcgcccacggtagagcgtatcgtacaacttgcagatgccatcggcgcctctgcaatttttgtgcagctgaatccagcggaatatcgtcaggaaaccttgctgattgaagggattatctcagcgaagcctttcttgccagttatcgtcgtggcagattccttcgatcagaatctgctccttaccgtcattcgcctgggggcgcgtgactttatcaagattggtacccgggcaagtgaagtggtggccgaagttaagcgactgactccccgcgatgccgcgagacacagcaccgaaacagatcagcgtggaaaaatcacagccgttatcagtgcgaggccaggtagtgactcccccatgctggcactacacctcgccttggcagtgcaagaaacagagccaacactcctgctagatctcg

SEQ ID NO: 22449 - DNA, 141 bp, Glycine max
  Peptide Sequence Number=SeqID_139227
atggaggaagcggcttactattatttgatatatgattacaggttgtttgaggggcttaagaagaacttggagactgatagggggaggatcgaattcttccttccatccattggatgtttgcaaccaactatgtgtttgtaa

SEQ ID NO: 22450 - DNA, 186 bp, Glycine max
  Peptide Sequence Number=SeqID_139228
aattccgatgatgcgccggagtactaccagccgatctcgtctctggatctgagcaatgttacagagaagagcaaagaagacgagaaccggcggaatgtgccgctaacgacggagaacgcgatgagagttatggaggcgatgcgcggagtgtccttcgctggagtggttcccgattgggctggttga

SEQ ID NO: 22451 - DNA, 1407 bp, Glycine max
  Peptide Sequence Number=SeqID_139229
atggttccaacgacacataggcataacaatccccatggtggcactatgcatgagaaaaaacatggacaaagaaatgaccttgattccttcactaggatcaatatcaggcccgctatgatatggatcaataacaatactcctgaagggcaccctgagcaacagtcctttgtggttgcaatttttctaggggctcttgtaatgggcttcttaactgacatgtttggcatagcaattgctaatgggccagtatttttgggcctggtaattccagatgggcctcgtgtgggagcaacaattgtacaaaagaccgaaacaattatggctgatattcttctaccattctcattcattatggtgggatcatacactgatttctatgccatgagtgcttctggttggtccagcttagaaccattgattgtcatggttattactggctacgttctcaaattcttttccacttggattgttctacatttctggcgaatgcctctcagagagggactaacccttagcctcactttgagcttaagaggccatattgaacttatattgtttgtgcattggatggacaaaaatatcttacatattccagacttcacattattggttcttatgacaacaatacttcagatgcaatgtttaccatccgattctctgcttcttcagccagctatttatgtcacaagtcttgctgctgtagagctacttcgtgcgcgtgatggaggtcagcagattattgactcagttgatgttacatgtggtttaagcctgggagaatatactgctctggcatttgctggggcttttagctttgaagatggactcaagttggtcaaactgaggggtgaggccatgcaggatgccgctgatgctgctaaaagtgctatggttagtgtgataggactggactcagagaaggtccaacaattgtgtgatgcagccaatcaggaagttcctgaagctgagaaggttcagattgccaattacctgtgcccaggaaactatgctgtctccgggggattaaaaggagtagaagtgctggaatccaaggcaaagtctttcaaggctcgaatgacggtgcgcctagctgttgctggtgctttccacactagttttatgaaaccagctgtgtcaaggttggaagcagcattggcaacaacagaaatcagaaccccaagaataccagtcatctccaatgtgaatgcacagccacatacagatcctgactcaataaagaagatattggcatgccaggttacctcacctgttcaatgggaaacaacagtgcagactcttctaaccaagggtctgaagaaaagctatgaactcggacccggaaaggttattgctggaatcatcaaaagaacggacaaaggtgctgatattgaaaatattggggcttag

SEQ ID NO: 22452 - DNA, 189 bp, Glycine max
  Peptide Sequence Number=SeqID_139230
atgggtgacaagtctcaagtattggaggctgtgttgaaggaagctgtagatttggagaacattcccattgaggaggtttttgagaatctgagatgtagcaaagagggtctcagcagtgaggctgctgaggagaggctggtcatttttggccacaacaagcttgaagagaaaaagagagcaagttcttga

SEQ ID NO: 22453 - DNA, 463 bp, Glycine max
  Peptide Sequence Number=SeqID_139231
gttacaggttgtaccatctgtggtgaggctcatgaaacaggccaatgtattcccattgaagaaaacactcaagaagttcactatatgggaaatcaacagagacaaggatatactcaaggaggattttcaggcttccaacaaggtccttataaccaacaagccaatcccacaagggcctaacatctttcagaggatgactaagctggaggagactttgactcagtttatgcagatagctgacaagtcatctaacagttttagggcgaatacagaaaagaatcccaaggaggaatgcaaagctgtgatgacaaggagtaagtggtttgtggaggcggaggatgaggatagtgttgtgtccaagaagaaagctgttgaaaagaaaggtaatgatgaaaagaaagatgatgtgagaggtgaaagcaatcaggaaaaagaaaaacaaataatggtcaagaaaaaataa

SEQ ID NO: 22454 - DNA, 243 bp, Glycine max
  Peptide Sequence Number=SeqID_139232
atgggtagaggcgcaggaacagatgaagaaagatctttatattttagaggaaacactaggttcaacaaaaataggagaaaatcactcaaagtgtatcaatctcacacagggcaaggattgacattctcaccctgggtcaaggtttatgataagttgggattttggctcaaggcttgtagaacggctggtcatgatatatgtcagggtatgccccacattatttccatgatactcatgcaataa

SEQ ID NO: 22455 - DNA, 687 bp, Glycine max
  Peptide Sequence Number=SeqID_139233
atgacccatgtcacaattattggagaaggtgctacaaagactaaattcactggcagtttaaactttgttgatggttccacaactttagagagtgctacctttgctgttaatggtgccaacttcatggccaaggatattggatttgaaaacacagcagggtcttcgaaacaacaagcagtggcacttttagtaacagcagaccaagctgtgttctacaattgtcaaatggacgggttccaagacactctttttgcccaatctcaacgccaattctaccgtgattgcaccatcagtggcaccattgactttatctttggggatgcctttgcagttttccaaaactgccaactaattgtgagaaaccccttaaagggtgcacgatgcatggtgacagctggtggcagagtcaaagctaatagtgctagtgcccttgtgtttcaaagctgccacttcactggagaacccgaattggcttctgcagaacctaagctagcattccttggaaggccatggatgccatactctaaggtggtgatcatggactctcaaattgaaaatatctttttacctgaagggtacgaggcatggacagcaaatgcaaacaaggacacatgcacatattatgagtataacaacaagggccctggtgctgacacctcaaaaagagttaaatggcaaggtgttaag

SEQ ID NO: 22456 - DNA, 1006 bp, Glycine max
  Peptide Sequence Number=SeqID_139234
atggatatagttgaacaagaaaatcagagtctcagggaggaggttgccactttacgagagggaatggataggttgacgaccatgatgagtgcactcctgtcagcccagaactctcaagctgccgccgctgctgtagagcagcctttggttgtacatggggaatgccacctccagtctgtggaaagctcccagcccgctgtatctgaagctccacctccttttgctcagcaatcagcaccggttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcaggacagcctgactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccagcgttggagggaagtggctgcccagattgtcccgccgttggaagaaagggaaatgaccaaaatatttctgaagaccctgagccagttttattacgagaaaatggttgcaagtgcaccaacagacttcactgaaatggtcaacatgggtgtgcgattagaggaaggtgtccgagagggacgtttggctgtggaaagtacccctgccgcaa

SEQ ID NO: 22457 - DNA, 1209 bp, Glycine max
  Peptide Sequence Number=SeqID_139235
atgaagacgaatcagtacatcaaggacattggaaactttgtgcagagggagcaagagagcttacctgaagcttgggaaagattgcaagaaataattagaagttgtccacatcatggtttttctcaacaaaggctagttcatattttcaatggtggagtgtcctctcacaataggacaattttagatgctacttgtgggggtaacctcatgttaaacccccttattgatgccataaagatcattaaagatatgcgctctaacccatataacaacttaggggatatggggattatgaagaatggcatcaaccaggtggagaaagatgattcccaaactgaattgggaaagcatatgcaagctctaacactaaagattaagacactcatgaaagctcaagctcaagcccccataattacacctctattcctaacctgtgatagatgtaggattgtgcatcgcccaggagaatgcactattgatgacaagctagctacaaccatggatgaaatcaactttgttaaagagggaatagttcttataatcaataccccaacaatttcaatcatggacagggcttcagagaactctaacgagaaggaaggttatttcccaaaaactgcagatggcatctttattgagaaggatgaagcacctaagaatgttgatgttcctaatgatgggaatccagtgccaaagaaggaaggggatgaaaataaggacatactgacatctccccagtctgttgacatagatgcattaatggaaggggaattcctaagtatggagatgcctaaccttctagagagagttctcactaataaggaccttgactgggagttgaactctaaagtggaggaaatactaacgttcctacactctcaacatagtctcgggtcgcccagttgtgagaggttggaatgggacaatgttctgaagctaaaacctgctgttgaagaacctcctaaattggagttgaagccctttccttccaactttaaatacatttttattaacccatcatctttccttctagttatgattgttggtttagaccccactctttgcacccacaagctcaacactaaacaagggtctctacccaaatggtcatcccaaaggaaactatttcccaacatgatggaagttgtcaaaggggaggatgctaagcccactttcaagatgaagacataccatgagggattccaacaa

SEQ ID NO: 22458 - DNA, 375 bp, Glycine max
  Peptide Sequence Number=SeqID_139236
atggtagtggtaaaatctaccatggtcatggtcgaaagtgacatcgaagctctgggatattgtggactgacaatgactttcgtggttgactgcgaccctcgagaattaaccacgactgttgttggattgttgacactattctacaaggctaggcttgagagatttgaggctgggcttaagaatctacaaaagtctatttttcttgttgtctacctaaagctaagcgtgagaaagctgaggctaggtgtaaggaccttcaagtgcacccttgatggtctttttgtgaagctggatgtgggaagaactaatgctaggtgtggaaatgctaatgtggcattagtgaggctaatacacaagcataaaacgtccaattga

SEQ ID NO: 22459 - DNA, 492 bp, Glycine max
  Peptide Sequence Number=SeqID_139237
atgacacaagggtacatctacttgggtttgactgagaacaaaagagggtacatctcttgtggatcagttctagtggagggtacatccactaggttgttcaaagagaacaagggagagtacatcccttgtggatctttgcttataaaaggatttttacaagagacctgggaagaggctttgaagtccaagctcactacaatcgagtcttccgctaaagtactccaaggagagattgagcacctcaagaaggaatcttctctcttcaaggtgaatgcaaagaagcctaaagaaaagttgaagactgatctcaacaaagttgaggccgagatcctcaaaactcatgaagttggcttctttaagactactcggcaagcaaaatacttcttacaggaagtcaacctttccctctccaatattgacaaggacgtaaatcgtgaaggggagttggttcctgaagctgaagtagattgcaccattgaagagcctatttag

SEQ ID NO: 22460 - DNA, 192 bp, Glycine max
  Peptide Sequence Number=SeqID_139238
atgcacccacgagccccgcgtcgccctcccgccgaaggaatcagtcatgggaaagttgggagagaagccccctcggttgttgctcttttggctgccaatggtaatgatgagaagaaaccttcaagaagtaaggttgatacatctgaccaagggaagagtgctgttgttgaggcccattctaaggctgcctaa

SEQ ID NO: 22461 - DNA, 387 bp, Glycine max
  Peptide Sequence Number=SeqID_139239
atggaactaaccgactctagcttggttcttgctactggggtgaaagggtatctgacttatgttactctgggctataaaagtcttctagagttgaggcggtctttgggtgatgttgatcctctaaatttgattaaggataaagatgctactttacagaaggggcaagagcatgctgatgtgctaacaagagaggttgatggtgagctccgtcaaacttatcctagagctcctggtactattaatgaagattttgttgctaaagaggttgatgatccggagacccctgatgcaaaaatggctgatgggttcatcaaaaccaaaaaaattaatgttgatgatagggcaacaggtgattttgatgttgatgtcgaccttggagggtcttag

SEQ ID NO: 22462 - DNA, 212 bp, Glycine max
  Peptide Sequence Number=SeqID_139240
ggatcgcaccggcaagatacccagtggacccggagaagtccaacagggtcctggggtttccagctctgattacgagcctctatcagttctacggagtacctgtcccccccagcaaggtcatcaagcctcctactaaccgagctttcatcaaggagtactgcacccccaggcaggcgcagggcgagacactgcagcagccaggggatggctag

SEQ ID NO: 22463 - DNA, 240 bp, Glycine max
  Peptide Sequence Number=SeqID_139241
atggagtggtttttccgcatatctcacccatttatgatacggactcaggcaggtgaccagcctagagatgcaccagccgcagaccctgaggagtacatacagtcgcccagcccccaggttccagtggcatttgacccgcctcgacatgtagtggatgattacgacggatatgaggtgattgcacagaggttggagcgtatgctcaaccttaggatggtcactgcaggcactgagttataa

SEQ ID NO: 22464 - DNA, 726 bp, Glycine max
  Peptide Sequence Number=SeqID_139242
atgaacaacgtaaatggcctgcagaccgcgccagacctgcatgacaaagacgaatccatctttcaggcgctgatgaccgcaattgtcgaacatcagttgctgccggggagcaaattgccggaagaggcgctggccgaggtgtttggcgtgagccgtaccggcatccgaaaggtgctgcaacgactcgccgctgtgcaaatggtcaccttaacgcccaaacgtggtgcacacgtcgccagcccgacggtagaagaggcgcggcacatcttccgcacccgcgcgctgctggaggtcgctaatctgccggacgtgctggcccactgccagccgccgcatctggcagcactggaggccattattcgtcaggagcagcaggcgcacgaggcctatgacggcccggcggcgatccgccactccgccaattttcacattcagctacaggccatctccggcaaccaggtgctgacggagatggtgaccggcctgagccaacgttcatcgctggtgattgccacctggggcgcgccgtggcggcagggctgtcgctgcaacgatcacgaacagctggtggatctgctgcgccagaaggcgctccagccgctcagcgaggccttaatgcaccattttgaacatatcgtcgccagcctctgcttcgagcgggcgggcgagtgtctgcctgattttgcccggctgtttgcccggccacaaggagtcgtaatgtcgtct

SEQ ID NO: 22465 - DNA, 443 bp, Glycine max
  Peptide Sequence Number=SeqID_139243
atgccaaacagtcaaaacgcgcagcagggtacggccgctgattccggtgcggtttacagcccacgtctttgcaatgaggatctggcacccacgcgtgaccagaactggagttggtacaacatcttttcattctggatgtcggacgttcacagcatggggggatatgtggtcgccgcgagcttctttacgctcgggctggcaagctggcaggtgttactctgcctgctggtggggatttgtattgtgcaactgtgtgccaacctggtcgcaaaaccgagccagatggcgggcgtgccctatgccgtgatcagccgtcaggcgttcggcgtctttggggcgaatattccggcggtgatccgcgggcttatcgcctttgcgtggtatggcatccagacctacctggccgccaacgccctgatgctggtggcactgaagttctggcc

SEQ ID NO: 22466 - DNA, 1708 bp, Glycine max
  Peptide Sequence Number=SeqID_139244
atggcgtcgcagaatgctcccggtattgccacgctgcaggcgcatggttaccggccgccggtctccgcgctcaccggctggaccggcctgatcgcgctactgctgtcgccgttcggtggcttttcggtgtgtattgcggcgatcaccgccgcgatctgcatgggcgatgatgtcgatccggacccggcgcgccgctggcgccttgccgccggtgctgatcgctacgctggccggtctggcactgctggccacgctggcgggcagcctgcagcgcgcgctggcggaacccgcgcagcgcgacagcgccatcgtggcatttctgatcaccgccagcggcatctccctgctcggcgtcggctcggcgttctggggcctgatcgggggcgtcctcacccatttgctgctcagcccgcgccggaacgcggtaatctcgacgcgttactggcactgggggagaacggccagccggtctgggcttctgccctgcaaattcgcgaaacgttacgtttgcgccgccagacgacactggccaactgcctcgcgatcccgcaggccaacgagcgcggtgaccgccttgactggtacgcgccattcagcggcaaagtgaaatcctggctggcggccagcgatcgcgaaaagcgtcaggcgctggatcagctcacccttaatcagcaggatttgcaggcgctcagcctgcgcgcccgggatgccgacaatccggcgatgcgcctgtttggggcgctgctggcaaagacgctgcagtttcccgatcagcaatacgtctatctggtggatggcaagccggtgatcaccttctggggctttgtcgacccgcaggcgcgcacgcgtgatgatgcgctggcctgcctgcgcgacagccttgatgaagaactgccgccgctggtggtgcccgcgccggagccagaaagggctgccgcgcctgaaccggttgaggcccccgttgtggcggagcccgagccggaactgctggcggaacccgaaccacagcccgaacccgcaccgctgagcgtggtcgccgacgcgcccgcgcggaagaaatccgcactgcgcccgctgctgctggtgctgcctctggccgctgccgccgcagcgggtgtggccttctggttacacaacgcgccggtccagccggcagaaaccgaaaccgcgcctgtggtcagcgccgcgcccgcgctggccccggcgatgctggcgaaagcacagacgctggccgccacgatgccgcacagcagtgcgacggtgacgcctgcgccggcaccggctgccccaccggcaccgccggaggtcgtagcggaacataccgaaccggccaaagcggacgatctggtgatgacggccgatgacgcgcgcctcggctcggtgaaatttatcaatggtacctggcgcgtgacgctgcgtcagaccaatctgccgaccggcaagccgccgagcctgcgctatcagatccgcaacggtaaaggcagcgcagtgattacccagggcgacaatattcgctgtaaagccgatgtcaccgccgccatgaccagcgccggcaccatggtagtgcgcagccgctatactgccagctgcagcgataaatcacgctatcgcatgccggagctggtgtgcaaagccggtgatggcattgccagctgtacggcgcagtatggcgccgatcaggtgttcccgttgacgattaagcgtgaga

SEQ ID NO: 22467 - DNA, 663 bp, Glycine max
  Peptide Sequence Number=SeqID_139245
atggcgcgcacaagtggtacactgcgcgcccgcttttcaggagaattcatggaaaatctgcatcaacatctcagccaggcgctgaagcagctgcgtcaggctaatggctggagcctgacgctggcggcggcgcgcaccggcgtgagtaaagccatgctcggtcagattgagcgcggcgagtcgagtccaacgatcgccacgctatggaaaatcgccaccggctttaatgtgccgttctccttttttgtgcagagcggggcgcagccgtcgggcgatgtggcgaccttcagccagcccaatgcacaaatgcaggtgaagccgctgctgccgtatgacgcgcgtttgcgcttcgatctactggaagtgacgctggcggcgggcgcgcaaagcgattcgtcagcgcacgaaagcggggtgattgagcaggtggtggtgctggaaggtttccgtgctggggtatctggtgcgcgacggcgcaatgacagtgaccgagctggccgcgcgcgaaggggtgcgcagccagtcgatgagtgctacggtcgccagcctgcagacgctgggcctggtacagggcgtggccgatgcgcaggatggccgcaaaacccgttatcagcctaccgctgcctgcctgcagctcatcgccagcaatcgcgcccagcgtga

SEQ ID NO: 22468 - DNA, 963 bp, Glycine max
  Peptide Sequence Number=SeqID_139246
gaaaatattgagaacagggccggcagtaccagccctggagggaaaagatcagttcagcagcgcgaggatttcctcagtggtgccggtttcgccgaggcgcgggaagctgcgctcaatgctgttgtggtgggtttcagcgttcaggcagctcattgcctcagtcgccagcgtgacgccacgctgctgctgcaactgctgatgcaactgctgatgcaggtcgttattgtagtagttaacgcgtgcaccaggggacgcgagagtgaatgtggcaaaactgcctttaaagaatatagtaaattcgccagcggtacatttgctggtatgactggagggacgctgggtgcatctgctggtatcggtatttgttttgctgtaggcatagccactgcaggagccggaggggttgcttgcgccgctgtaggttcattggtggcagggtctgctgccagctcagcaacccaacatccagtagcgccagacagccttcagggagcggcaaagataagggccggcagcgccagccctggagggaaaagatcagttcagcagcgcgaggatttcgtcagtggtgccggtttcgccgaggcgcgggaagatgcgctcaatgctgttgtggtgggtttcagcgttcaggcagctcatcgcatcggtcgccagcgtaacgttgtagcccagctcgtacgcctgacgcgccgtggattccacgccgatactggtggcaatcccgcacaccaccacctgcgtcacgccacgctgctgcagctgctggtgcagatcggtattgtggaacgcgccccagcaccgcccagtctgccggcagagcagcatcgtgacgcggctgctgattgcggcccggcgcgccgcccgccacgttcaccagcaccaccggcagctgtttcgcgcgaaacgcctgcgtcagctgcgtggcgcgtgcaatcacttcatccggatggcgcggcgtaa

SEQ ID NO: 22469 - DNA, 925 bp, Glycine max
  Peptide Sequence Number=SeqID_139247
atggctgaaacgggtggcgatggcaaaatcgagattgccgggattgatgtgctgaaaatagttcagggttttgtcgccgagacgggcgatcagctggccctgcgcgtcgccgaccatttcactcaacagccaggctttacccgcctgcgactgaccaaacagcgccagggtgaccggtcgcgccagctgtcgcgccagcgcgtggctctcaacgcgggcgcgacgcagctggagccgcagcgtatcggcttccagcgccagacgcggcgagtgcgcctggtggctctccacccagttcagcgcgccgtcaaccgtctcctgcagcaggcccaggcgtttagcaggtgtcgccggcgtggcttttttggcagttctcatcgtttacacacgctcccgctgtcgatccagtattgcgcattggcgttgccgttgctccagcggcacgcgcgtgccatcgtccatgcgtgcctcgctcagtaccagccgctccgggccgaggttatccggccccggttgtaccgccagcctgatgcgcagcacgctttcgcccgctacctggcgcgccagctgcggatcggtaatgctcaggctgtagagcggtgtcgccggccagcggtcgttctccagctggcggaaaccgaggcagacgttaccgcgaatgcggaagctgcttttacggtccagcgcgaagctgtggctgtcgagatcaatctcgctatagcacagattgtcatcgctcagcgtggcgttttcatccagcacgccaagatagcgaatggtcgagtagggttcaaaatcgccggcgcggaaccagaagctgctgagacgcagatcgagtgccagcagacacagcatggcaccgaccgccgcggtggatttcgggttatcaatgcgtccctgtttgttgaacggataccagtcgctg

SEQ ID NO: 22470 - DNA, 1368 bp, Glycine max
  Peptide Sequence Number=SeqID_139248
atgctggaactgcccgcaccgggcacgcccgccgaccgcgatcagcaggatgagcgcgcaaggctgcaggcgcgtgatgcgctgcgcgccagtctgctggaacagaaacgtgccctgctgccgggcttctatgccgcgcgtcagggcatcgatttaatgctgatttgtaccgccgccagccagcgtcaggatgcggatctcgccgccagcgcgctgcgcgagtggcaactgcagcagagtgcgacggccagcgcagacaagccgcgcctgatttgggcgattacgccgcacgatgcgcgctatcagcagtcgcaaattaacgtcgatgaagcggtacagcggcagattggtcagccgggccagagctggggctcaatgctggcgcgcgatcgcgccggcgtcgaccgcatgagcagctggctgcaggatgagatgcagccagaggcacggcgcgaccggctggcgctgcagctcagcacgctgcagcagaaactggtggagcgtctgcagccgtggaccgaagccagcgccacgccggaacaggccgcgcggaaacaggccatcgccgatacgctgctgaagtgtttacagcatcgcaccggcctgcacggcgagctgcttgagcgtctgcagccgtcgcgcgaggcggtgcgccagctgtggctgagtcagagccacggcagcacgccgtccaccggcggccagccagccgcggtggagcagagctattttggtattggttttgagtttgacctgtttaacgatgagccggtaaccaccgccgaaccgcgcagcagcagcggccagcgcgatcagcagtttcctcagcaggtgttcgcgctgtggctggcgcacctgcgtcagctgccggagagccagagcctgctggcgctgctcaacgttgataagccgacgctggaactgctggtggaggagctcatcaccgccagcttccgtctgcaggtgctgagcaaactgcaaagcgcgctgaacgaaacggagacgcaggccagtgcccatgaagcgcgcaccgatcgccaggtgtcgcgtgccatgacggtgctgggtgactttgtcgcctggctcggcttcctgcagcgggatgaacgtgaacggccgcagagtcgcgtcaatcgcggcagcccgattttcgcccgcccgccggcgcccagcgtcagcttttcttcaggccagcgtctgacgcggctgtctgccgcgccggctaatcacaccgcctattacatttatgactggctggtggggttaaattcgctgatcgtcgagaataacggctacaccggcggcggcgatttgtcggccagcgcacgccagacgctggcgattatgctgctgccgctgcacgcgtag

SEQ ID NO: 22471 - DNA, 830 bp, Glycine max
  Peptide Sequence Number=SeqID_139249
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgtcatacgcagtaaaagaactcattgctcacctattaaatgtgattgctgttattaaatgccactgcaataaccctgctccgggtctacaggtgcacatctggatattcaacgttaactgcgcacggcaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22472 - DNA, 615 bp, Glycine max
  Peptide Sequence Number=SeqID_139250
atgggtaaagtagaggaggtgcaagagcagatgaaggccgacatggaggccatgaaagagcaaatggccacaatgatggaggccatgatgagcatgaagaagataatggaagccaatgtggttgcagttgccgctaccaacgttgttgctaaggtgaacctgatgcccccatctggccttaaccaaatgaatcatccaacctcagatatggtaggcaaagatttgggaagtacgagcggcccccattatgcgcaaattcaaaacaaccattccttcccaccatatggcttgcctcccaactatacaccacccaatgtggcatacattcccaatgatgatgtcaataactccgctcccatgctcattaagagccgacaacctcatcatccttgcctcggatatgccactgaagggaaaactgttggtgatatacccctgcaaagcactttggagggccctcagtatcacccacaaccacacccctcacattccacagtgattaaaaaccctcatgctatggcagaaataggaaagttggatcatctaaaggaaaggctcagggccattgaaggaggtgaagattatgcctttgttaacctagaagagttgttccta

SEQ ID NO: 22473 - DNA, 853 bp, Glycine max
  Peptide Sequence Number=SeqID_139251
atggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtggcgcggcggtcgctgcaaactcaggcgcgagctcgggcgagcgtcgtcggtgcagatctggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaagagttatcttttcttgtttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 22474 - DNA, 645 bp, Glycine max
  Peptide Sequence Number=SeqID_139252
atgggatctactctcctcagcttgagcctgaataactcaggacaatcccttaaccaaatggggatgctgcgaatcaagcttgaggaagcaaagaaagagaatgaaatcttaaaggctatgctgaatcaggttaatgaacactgcactactcttcagaatcgcatactttttgagatgcagcagcatcaactatcagcttcatcatcatcacctcgcaataataataatcatcatgactcgcagggaaatgaacaagatgccgagaaaccaatgctacacactcggcagtttttgaatattggcgagtcttcaattttagacggcaacacaaaagcatgtgcaatagcagaaaacgttgaaaagaagatattaggcaaaaaccttgcaagtgatattaataagtacaatgttaaaggtgaaatcaacagtcaaataacattgaatgaagtaaaaagcacagaagatcaagcatctgaggttacttgcaggagagctagagtgtccataagagcacgatcagatttttctttggtacttaaagcttttgtttatttattaaatcagatattacatgaagttgaagggtgcaaattagtctttctaaattacaatttctattattttatatacttaataattgactga

SEQ ID NO: 22475 - DNA, 554 bp, Glycine max
  Peptide Sequence Number=SeqID_139253
acaaagcggccgccgacctcgatgcgcaactccaccatgccggaggtgccgccgcggttgaccaccacgtcgttcatggccagggcctcgaacacgcattcgccctcgcggatcacgcgggcgcacatcaggggacgcaggtcctcttcgtactcgccctgcagcatgggcgtgagcgtggcctcgaagtcctccagcgcgatgtcggtgacaaagcccaggcggccctggttcaccccgatcaggggcgttccgtattgcgccaggtgccggctcacgccgagcatggtgccgtcgccgccgacgaccaggcccaggtcgcaatgcctgcccaggccatcgacatcgagggtggggtagtctgtgagccctgcgtgcagggccgattgggtatcgagcacgacttcgcagccctggcgcctgaggaagtccgcaatgcgctcgagcgcgttgctggcattctcggacggggcgcttgcgctgggagcgtggtacttcccgatcaaggcaacgtggcgaaacgtggacgtcatttctggaaattacatcattaa

SEQ ID NO: 22476 - DNA, 201 bp, Glycine max
  Peptide Sequence Number=SeqID_139254
atgtggatatggcatggtgaagtgatagacatacagaatgggtcccaagctgaatcgtttgatgtagaaatgggagatcgcttggaggacatgattcatgaccttgaacaagagtcttttcagcaagcacacacccctgtgtatgaaggattgcagagtgattcaaagaagcctttgtataggggtgcaagaattccttaa

SEQ ID NO: 22477 - DNA, 471 bp, Glycine max
  Peptide Sequence Number=SeqID_139255
atgcagctaccgcaagagcctttgaacgagaaaccaagagggctcgcaaggaagagcatggccgagacaaattccgtggagctttgttgggcagcaacagagttagctgcttgctcaaggtccaagagaagcttgtctaaacatttatgcgagacagagaccaacatgttagccattgtcaggaagtaccaagaagaattaaatctagccacgacccacgagcacaaagtggcgggcgagtatgcccgagtgtatgcggaaaaggaggctagaggaagggtgatcgactcgttacatcaagaggcaacaatatggatggaccgatttgctcttactttgaacgggagtcaagaacttccccgattgctagcaatggccaaagcaatggcggacacctactccacccccgaggaaatccacggacttctcagctattgtgatgcaatcctaccccgcaagggcgttggttag

SEQ ID NO: 22478 - DNA, 354 bp, Glycine max
  Peptide Sequence Number=SeqID_139256
atggtgaagaaaaagcgtgaaattgcttgtgagattgaaactgccggtgagccaagttttggtggggatattaagttgggccccaccgcggttctgaaagcgctgcatgtaccaaatcgccctccgaaacgattcggtcttggatgttttcccgtctccgacgccaccgaaatcctcgatcgacaagacgaccctcctcggcagaacatcacggaagaagccgacgcaggttggtgtagttgtttgaaggggcggaagttgaaacccggaggcggaggcggccggtggagattcgagccacatggcaacatgacgattgaaaagaagaagaagatggaagagagagaatgttga

SEQ ID NO: 22479 - DNA, 240 bp, Glycine max
  Peptide Sequence Number=SeqID_139257
atgggaatgaaaaaaaagaaggtttggagcggaaaggagaagatgaaggcttggttattatgtgctagggagggtttggacgggaggagtggggtgcagcacgagagccttatgcctgagattgaaaccactcaacctaggattatggtatggtaccatccgttagaatgttacattatgggaaatataaggaaactagaccagatgatccttctatgctccgttcctgggattggctaa

SEQ ID NO: 22480 - DNA, 312 bp, Glycine max
  Peptide Sequence Number=SeqID_139258
atggtggtggcccgggtgatgttggggaatggctacgagcccggaatgggtttaggcaagaaccacggcggcagaaccagcctggtaagcgccagaggaaaccacgtgaagtttggattaggctataaacccacgcaagcagacataaggaaaagtgtcgcgggaagaaagagcagaagccagggttcacaattgggacgacaagtcaaagggggcccgccctgccacatcagtaggagctttataagtgcgggtctaggacacgaatgccctgccacatcagtaggagctgtatattatatgcgaggatga

SEQ ID NO: 22481 - DNA, 234 bp, Glycine max
  Peptide Sequence Number=SeqID_139259
atgggggtgtggcaaccaaatgctcacctcccccttaggaaggctcatactgagcccatggacccaaaatctaccctaaggctgatgagaaccctagggccttctcttgcatctttggccgaatcttcttggagtcttctatccagtgcccttgggggtaggattgcatcagatagatcacaagattggcctacaaggagccttctaaccattaggagttcaccttcttcatag

SEQ ID NO: 22482 - DNA, 657 bp, Glycine max
  Peptide Sequence Number=SeqID_139260
atgaagaggaagaggtcaaaatatgaagctcatgctttttttattaacaagttgaaggagaattttgatagaagttgggctaagaagaaggttgtatgcaaatacattgatttcttaaagatcaaggagaatgtgaatgaaccagtctacccaaggttggtgaaagctttctttggtgctactgaggtggatatcaacaacttcatactaaaggctaaattgaagggaattgggattctaatcttagaacatctcctagcaggcttgttgggagttcttactgatagctcaaggctctatgatgattggctcaagatcatggggcttagaaagaagaagattcaaaagaagttcctggaggataaagatgaagagttcaagttgaagaattcaagtctagctttgaggctgaatccccaactacgaatggagactgcctacacatgttcgaagaagaagaagcctcaacttcaaaggaccatgaatgagttctttgagagatttcttagacttgagggatggatctcaaacaagattagacctaccttgatccctgaatttgaacctatacagcatgagcctccactacctctaagagctacaactacatcttcttcatcttcatcatcagaaaactctcctaacaagcatgaataa

SEQ ID NO: 22483 - DNA, 339 bp, Glycine max
  Peptide Sequence Number=SeqID_139261
atggcccctgagttatggaaggacattgatggactgcctaatgaagggatgattgccaatgaaaagggtctcaaggatgttgggggaaacatgaagataaaatgggtgaatgttgtcatggacaacatgttgaagaccaagagaatagggactttcaaatgctcttatgttgtgctgatttcaagaattcttgatcactttaaggtggaagtaaaaactaagattaaagatcttgtggagccagaatatgagttgaagacaaaagtgttgaagcatatgggctacgttgaaggggaggatggtagtgattggattgagaagtccaaggagtctatatga

SEQ ID NO: 22484 - DNA, 2001 bp, Glycine max
  Peptide Sequence Number=SeqID_139262
atgccggcggccgggatgcggcgtacgacgagggtgttcgggatgaagggggccgagacggcccgcgttttacgctcgggccggcggctctggccggactccggcgaggtcaagaccaagcgatcccacgatggggacgagtggccgctgccgccgttgaaagcggcgaaatttgacgctgcggcgacgccacgtaaggggaagcgctccgaggaggctgctgtggttgataggaggttcggtaagggccttgtgtatcagaggagaaaaaagggtttgaagagggaagtttctagaaggaatgtggaggtttggcgctgcgtgctttccgtagctgtgaatcgctgtgccgggaatagtggaaggtttttgaggttgttggcttcggtggcgaggtatgttgccagggttagggtttccccgaggaagctgtcggggttcttcatgtcggaggctattcacggtgcttttgcgtcgaaggggatgctgtttgtgaagggtcctcctgctgtaaacactggaataggccagttctttggggtcacagggtccgtgccgtcattttctgtggacttttctgctgttcctccttgttttgagtatctgcagtctgcgatgttcttaaaatttatgtttaggtcattttttcttgtacataatccaataaatgtgcatagggatgaggataccgagtcagatgatgatttgctggaaaaccagaatgaacagcagatttcaagtgatacctttaagaggaaaccttctgatattgtaactgttacatctgatgtggttgaaatcaatgatgttttatccttgcattcttctgtcaaggttaccaccagggcagctggtcggaatggacaatataggaacatgttgaactctagaggcattcagaagaggagaagttctcttaggaaaaggaaagcccgtagtccttcaatggtgagtatacgcagaaatggggcagtagcttctgatttaacaggtggtaggaaaaacaatagccaattgcctgttgtgacctctagcaggaaacttaggagtatggccaatgatagcaccaaagggaacctgaaagaagctcgttctgccatagtggattcgaaagatagactaggctcatcttcctgttttgcaaacttattggtatcagagatagaccaatgttgcagggcagagggagcaattgttactttagagacgtcatctccaaaagaatggcttttcactgtaaagaaaggtggattaacaagatgcacattcagagcagaaaaagtgatgcgtcccttctcaacaaatcgattcacccatgcagtaatgtattcattggacaatgggtggaagctggagtttactaatcgccaagactggaatgtctttaaagacctttacaagaagtgctttgatcgtaatacccctgctactgctgccaaagttatcccagttccaggtgtgcgtgaggtttcttcctatgcagaaagtaacagttttccctatcacagaccagtcacatacatatctgcctttggtgatgagttaactagagcgatgacaagggaaactgcaaattatgacatggattctgaagatgagaaatggctgaaaaagttcaatgagtttcaagaacatgtatcagaagataattttgagttaattattgatgctatggagaaggtttattattataatccagatgagacatttgatgaaaaatctgctgccaatggttgtcaggaccttggtagcaaggaagtggtagaagctgtatataactattggatgagaaaacgaaagcaaaaaagatctttcctgcttagggttttccagggtcatcaatcaaagagagctccacttatcccgaagcccttgctgcgaaaaaggaggtcgttcaagagacaacctagtcagtttagtagaggcaatcaaccaagtgtgttgaaagttaattctgcaagagtgcagctactgtggatgtttagaataactaagctatga

SEQ ID NO: 22485 - DNA, 1044 bp, Glycine max
  Peptide Sequence Number=SeqID_139263
atggcagagatcacccccaaccaccccgactatggactcaaccagcagatccgccaaggcgtggccgcactggatgcccagcacggccgtgcgttcgaccagaccagcgagcggctgacctccagcctggccgtgctcgcccgcgagcagggcctgcagcaggtcgaccacgtgctggtctgcaacgccacggccaaccagccggcgggacacaacatcttcgtggtacagggcgacccggccaatccggcgcacctgcgggcgatgatgccgacggctttggcggcgcagacgccggtggagcagtcgatgcagaagttggggctgggtgtgccgcagccggtggaggcgcaggcgcaggaaatgcagaaccccgcgccgcggctggggtcgccaccttctggtactgtcactgttgtacgcggtcaccgtaccggcttcgcggttggtcacgtacaggcgcttgcgcggtgcatccagcaggatgcccagcgggccggcgtcggtcgggatgctggccagttccttgccggtgttgcggttcaccaccagcacgcgctggcccggatgcttgctgaccagcccgctgctcttggcctggtagccacgcaggaattccgagccctggtcggtcacgaacaggcgcttgccggccgggtccagcgcgatgttctcggctgctcggcggcgatcctgtgctgcgccaccaccttgttcgaatcggttgctggtgtagacgcgcttgttggccgcatccagcgccaggcccggcgccttggcattgcccaggccgtcgatggtgttgatcaccttcagcgtggtggtatcgatcacgaacagcacgctgctcacgtccggctggctgctgtggccggtcacgtacaggcggttggccgcgctgtcgaccaccagctcgcgcaggtcgtgggtgtaggcggccttgccgtccttgccggtcttcttctccatcagctggatggtgccgacggccttgttctgcgcggtgtcgaccacggtcaccgacaggtccacggtgttgcccac

SEQ ID NO: 22486 - DNA, 138 bp, Glycine max
  Peptide Sequence Number=SeqID_139264
atggtcgtagctgatcacccgctcggtcagccagcgcccgtccacgtgatgccagacctggatgaagcgcgcctggacagtccagtgctcgacgccctttgcatcacgctcatggaagcggtgatcgccgatctccag

SEQ ID NO: 22487 - DNA, 721 bp, Glycine max
  Peptide Sequence Number=SeqID_139265
atggccccagggaagcttgcctcaaagagatccaggaaagacaaagcggttgaagaagacaaagcggctgaaggaaccagttccgctcccgaatatgacagccatcattttaggagcgctgagcaccagcagcgcttcaagaccatcaaaggatggtcattactctgggagatacgcgtccagcttagggacgacgagtatactaacttccaggaagagatagttcgccggcagtgggcatcgctggttacccccatggccaagttcgacccagacatagtcctcgagttttatgccaatgcttggcctatagaggagggggtcaatttcgatgcggatgccctcagccagttcctgggatatcctttagtgctggaggagggccaggagtgcgagtatggccagaggaggaatcgggctaatgggtttgatgaggaggccatcgcccagttgctgtgtataccggggcaggattttgcctggaccactgccgggaggcgggtgcgaatcatgcgcaccaatatgactaccttgactcaaacatggatgacgttgctgcttagcaatatcctacccagcgatcataattccaacctccccctgccgaagtgtatgccgcctaccaggcaccctctggacccggataagtctaacagggccctgggatttccagctttgatcataggactctgccagttgttcggagtccccgtcgcaccta

SEQ ID NO: 22488 - DNA, 375 bp, Glycine max
  Peptide Sequence Number=SeqID_139266
atgtttgatctttatttcgttccctcactggaatgccagacttgcagaaggccaaaagttatgtcaagacaacatatttggacacttgaaatcacacaatcaattcttggtacaccaggaccactgagactccccaattgtgccatgacacatgtaaatgcctgcggtcaacacatgaccattctcaggagatttggacctccattacagtggaatgttgtggtggttgatggtggagttaggtgcagatatgttgtccaaccatggtatcaattccttgcagataatgatttctcccacggtgatgaagtctccttctattacaggaccattgataaaatatgggaaattgtcatccgccgaagaaagaattag

SEQ ID NO: 22489 - DNA, 258 bp, Glycine max
  Peptide Sequence Number=SeqID_139267
atggacttgcaaagactaaatcgacatgaagataatgataagaagaagaggggaatttctcttaaagcctcatcttcaatccaagaggaaagtgacatagaagactcaattgacttagatgaagatgaagatcttagcctctttgtcaaaagattcaacaaatttattagaatgagaggaaaagtcaaaagaagacaaaacttcaaacctaaaagaaggactaaagagtcatttcaaatcccaaaatgctttgagtga

SEQ ID NO: 22490 - DNA, 153 bp, Glycine max
  Peptide Sequence Number=SeqID_139268
atgcatgaaggaatgcatatgacacagatgcaatctaggaatgcgggggcccgaggaattgtctccttcttagatacaacgtctagggaggggatcaagacagaacccatgtgcgatgcatatgcaaaagatgcaatgcgggaatgtacatag

SEQ ID NO: 22491 - DNA, 447 bp, Glycine max
  Peptide Sequence Number=SeqID_139269
atgaatgaagttctttcagagttatggggcctccgcacctatgttggtgaacgattcgattccttggatggtcgctttgaaggcatggatacccgcatcacccaacttgaagaggatatgacttatcttcatcgttatattggattatatgaatgctcttgtattgtttaccacggattaaattgtcatcatcaaaaagggggagattgtagaagcaaagacttcgactttgatgttttgatgatgccatatgatcatgaaaatgcgcttctcaagtttaactcaagacaaaaatccaagaatacaagatacaacatcaaaaagatctctagtgatttaggaagggaattccaaattgaaacaacaaaaggtttggccaagaaatttaagctaaaatgtctttttcaagagatttactctctggtaatcgattaccagaggatgtaa

SEQ ID NO: 22492 - DNA, 336 bp, Glycine max
  Peptide Sequence Number=SeqID_139270
ctgactaacttgactgggggaagcattgatgtgacaattgtgaaggaattctatgcaaatctttatgtcccagatgacaagtttcccaagcaagttagggttcgagggaacctaataaaatttgatgttgattccctcaacaccttcttggagactccagtggtcgtggagcaaggggagagcttacctttttactccaggtttgctaaactgaggcctgatcctcaggagcttgcagcccggctgtgtatccctgggaggggatttgttcttaatgttgagggtctaccgtggaagctcttgaggaaatatcttaccactctggcccaaacctag

SEQ ID NO: 22493 - DNA, 183 bp, Glycine max
  Peptide Sequence Number=SeqID_139271
atggatctgaggacaaagcttgaattgattcaatctaactggggatcgaggtttagtaacttaggccacaacatagaacacaaaagcatgattgatcggtgtgctttccgaagatctactgcagatgatttgattcccattgatttggagattaacgtcacctgtagaaggcgtaattcatag

SEQ ID NO: 22494 - DNA, 642 bp, Glycine max
  Peptide Sequence Number=SeqID_139272
atgcctactgacactagagaaattgaggctgcactgtgcatacccaaccgagggtttattctaaatgctgaaggtcacccggggaagatcctcagaaaagacctaatcatccttgctcaggtctggagtgttctatcctactccaacttggctccgacctcccacacatcggatctgactatggatcgagctaggaccagaggagttgctttcgacagtcttgtctttgaacgtctgagcccgatcattaatttggcctacataaggaagaattgttggaaccctgatgatccaacaattattattaaggggaccagaagaccaagagcaagtccagctgagactccttctacatcaatggctcctcatctagcttctacatcagcagctcctcctccaactccttggccagggactcaacctcctccacacagggacgatgaggatccagccgctcaggtaccacatcagtcatcggatgagtcatcagagtcttccacccctgagccattgatcaggaagaggaggatagttgtaactcaggaagccgcaaccactcctgaaaagtctcctgaggccactccagagcctctgacaccaatggcagataccacttccccacaactggcagcagatccttaa

SEQ ID NO: 22495 - DNA, 285 bp, Glycine max
  Peptide Sequence Number=SeqID_139273
atggccatagttgtctctgcattttgttggacacgatcgagcctgggcgacgagacacagaatgaccataatttgtctctgcgtaccaccgaacacgatcgcctatggatggcgaaaagggcgcagaattcgtctatgcgcgtttatccactcagcttgctgctcttgaatgataaagggcgcagaattcgtctatgcacgtttatcacccaatttgcgaaatctgaatggcaaagggcacagaattcgtctatccgcgtttaccactcgactcgctgctcctga

SEQ ID NO: 22496 - DNA, 360 bp, Glycine max
  Peptide Sequence Number=SeqID_139274
atgaaatgttatgaccatttgaatttcgcgagagtttccgttgttcaatttcgagtgtctcgatatatcgtgggcctcaatcgtacacccgagtcaaatgttaatggccatttgattttgcctagagcttttttgttcaaatttcaagcgtgtcaatatgatgaggacatgaccaagagaaagggcaaggatccacttgaaggacttggaggacctatgacaagggatagagcaaggaaagccaaggaagctcttcaacaagtgttgtccatactatttgaatacaagcccaagtttcaaggagaaaagtccaaggttgtgagttgtatcatggcccaaaaatggaggaggactaaatga

SEQ ID NO: 22497 - DNA, 1015 bp, Glycine max
  Peptide Sequence Number=SeqID_139275
atggcgctggtagtagcggcggttgcctcggcgcttggccggctcaaggctgggaaactcggtttcccagtagcgcaggacgtgcggcttgacgtcgcacagctcgctgacttcaccgatggtgaagtagcgcttggccgggatcggcgcataagcttccaccctctccttgagcttctggcccggacggaaggtgaccaccgtacgggcggaaatcggaatttcctcgccggtcttggggttgcgacccgggcgctggttcttgcgccgcagatcgaaattaccgaagcccgacagcttcacctgacgtccctgttccaatgcttcacgcagcacatcgaaaaacgcgtcgacgaattccttggcttcccgcttgttcagaccgacttcgtcgaacagcttttccgccatctccgccttggtcaatgccattgcctgctacccccgagtgctgcccgctcagccgcggatccgggcgtggtgttcacgctcgatggcagtgaccgcctcggccaccaccgcatccacgtcgcggtccgtcagagtgcgcgacttgtcctgcaaaatcaagcccatagcgagactcttgaatcccggctcgacgccctggccgacatagcggtcgaacaggttcaggtcgcgcaacagcgggccggcggcctggcggacggtcgccgccagatcggcccaggccacctgttcaggcaccaggaacgccaggtcgcggcgcacggccgggaagcgcgacagctcgcccgcacgcggcaggcggcgggcggtcagcggttccagatccagttcgaaggcgtagacgtcggattcgatgtccatcgccttgaccaggcgcggatggacctgaccgatccagccgatcgccacgccatcgcggaacacctcggccgagcgcgccgggtggccgtaaggacgggccgacgggcggaactccagctgcgcgccactggcagcggccagcgattccaggtcgctcttcatatcgtggaagtcgaccttgcgg

SEQ ID NO: 22498 - DNA, 225 bp, Glycine max
  Peptide Sequence Number=SeqID_139276
atgcgattgcgtggccgttggggtcaggaagggttacttcgccagaaacggatagtcggtatagccttcggcgccgccgccgtagaaggtttccggcttaggttcgttcagcggagcgtgctgacggaaacgctctaccagatccgggttggcgatgtagctgcggccgaaggccaccgcgtcgatgaagcctttttcgatcaacgcttcggctttctcggcggt

SEQ ID NO: 22499 - DNA, 291 bp, Glycine max
  Peptide Sequence Number=SeqID_139277
atgatccgcgtcggtgatctgcaacgcgccatcgacttctacaccaaggtattaggcatgcgcctgctgcgcaccagcgaaaacccggagtacaaatactccctggctttcgtcggctatacggaagagagcgaaggcgcagttatcgaactgacctataactggggcaccgacagctacgacatgggcaccgccttcggccacctggcgctgggcgtggacgacgttgccgccacctgcgacagcatccgccgcgcaggcggcaggtcacccgcgaagccggcccggtga

SEQ ID NO: 22500 - DNA, 285 bp, Glycine max
  Peptide Sequence Number=SeqID_139278
atggcagaaatcaaccaaggtaagacgatgcccgttcacggttggccgcatattttgtttcctacttacaggtacatagggacggatcgagtggggctagggtcacgaccgactgatcgttgccccttcacggcgctaaacaagcagaaaacgtcgctgcaaggcagcccagttcaagttaggcaaatgctggcccgtaagggaggaggggacatggttaatgttcccctcaaaaaaaaaaaaaagtggcaggttagctcgcctgggcgagctgagctcgcctag

SEQ ID NO: 22501 - DNA, 411 bp, Glycine max
  Peptide Sequence Number=SeqID_139279
atgtcgcagaggagcaatgcatcatcatctcgaacaagagtttcatcacaagttgttcttttttgtggttgtggtagaagggctgttaggcgtgttgctggaacaaatattaacagaggaagggcgtttttcacttgttcaattaataaggatgaagttggatattgtgggtactttatttgggttgatcaattgattgaagcacttggagttgatgattcacttgggacattttccatggaacaaagaagacaatttggaagagaggaagataagacaatgtggaaggctcaagttaactcaaagcttgattgtatggggattgaaatgaagatgtttagaacaattgtctatggaatgttcttaatccaattgttgtcaatggtggtgtttgtatgtattcacaagtaa

SEQ ID NO: 22502 - DNA, 300 bp, Glycine max
  Peptide Sequence Number=SeqID_139280
atggagggcgccgtcaaggagagaggaaggaagagggttctacgcaaggagagagaaaaagttgtatttataggcaaggatgagcgagtgcagaataggatttttggacagattgattgcacttgtattgtcacaacggataggtatatgatcaagtttaaagccataatcagaaagttgttgtctcgcccaaaggatacgtgcacaacaacttccagcataaatattacgcttctacagctgataaggcaacactattttgttttttactatgccatgatactagagcagaaccaataa

SEQ ID NO: 22503 - DNA, 444 bp, Glycine max
  Peptide Sequence Number=SeqID_139281
atgacatctgtttatagtgaagtgagccttttccttaacataatgataaccccatttgatgccaatgactttcattgtattcatccagatgggcagggctatccacttgatgccatcccaaaagtttgtccaacatgcaggggctcgggtcgtgttacaatccccccatttacgtcaacatgcattacttgtaaaggatcaggccgaatcattaaggactcttgtctaacatgtggaggatctggggcggttgaaggggttaaagaggttaaagttacaataccagcaggtgtggattcaggagatacaatccatgtgccagaaggtgggaatgctgctggaagtggaggtcgacctggaagtttatacattaaaataaaggcaattttctttccaaatattctcacactaacatgtgctacctgctggcctatgaatctgtga

SEQ ID NO: 22504 - DNA, 1013 bp, Glycine max
  Peptide Sequence Number=SeqID_139282
atgggcgacttcacggttgcgttaaaccctcccaaaaccttccgcgccgatattctcctatccaccaccaacaaccgcacttccccggcggcgcgtggctttcaaaccgtactcgcgttcaaaccaccgcgcgcttttcgaggaatccgcgcttcggtgatgccaagagagggtcaacaagcgtctctcggagacgcccttgtcaacactccgcgccgaagcgacttcgttgaggccatcagaagaaccgccgcactctccagctgcctctcagaaacgagcctccacgccaccgttcccggcctcgagtccaaaacccgcggcaaagttcgagatatatacgacgctggggattacctcgttttggtgaccactgatcggcagagtgcgtttgatcggattcttgcttccattcctttcaaaggccaggttctcaatcagacgagtttgtggtggtttgaaagaactaagcatatcgtctctaatgcggttgtattggctccagataacaatgttacaatagctaggaaatgttcagttttcccagttgagtttgttgggtttgtcactggaagtactgatacatctctatggacagtctacaataaaggcgttcggaactattgtggaaatgtcattccagatggaatggtaaaaaatcagaagttgcctaaaaatatactcactccaacaaccaaggctgcagatcatgatgttcctatcactccagatgagcaagtggctttggagcatggcctcatattggtagatactaagtatgagtttgggaaggcaaatgatggttcaattatgttgattgatgaggtccatactcctgattcaagtagatattggatagccaattcttacctggagcgctttcaaaatggtcttgagcctgaaaatattgacaaggagtttttgaggctgtggtttataagtcactgcaacccttatgaagatgaggtccttcctgatgctcctgaagatcttgtctgtgaattagcctggcg

SEQ ID NO: 22505 - DNA, 165 bp, Glycine max
  Peptide Sequence Number=SeqID_139283
atggcatcaaaatctgcaatcattgttaaaagtgtgaagatgaaggacatctttggtgcttatgagcgtgcatctagtcaggcccttaatttacacaagttcgagatatttttcaacagcaatgtcaaacaacaggatcatagggagattattcaggtgctatga

SEQ ID NO: 22506 - DNA, 432 bp, Glycine max
  Peptide Sequence Number=SeqID_139284
atgggtgtcgtgcatagagatattaagcctgagaatatcttgctcaccgcggccgggaagatcaagcttgcggatttcgggctcgccatcaggatttctgagggtcagaatttgacaggtgtggctgggagccctgcatatgttgcgccagaagtgttgttgggtagatattctgagaaggtggatatatggagttctggggtgctcctgcatgctttgttggttggtggtcttccatttaaaggagattcaccggaagcagtttttgaggaaattaagaatgtcaaactagattttcaaacaggggtgtgggaatcaatatctaaacctgcacgagatcttgttgggagaatgctgacaagggatgtttcagcaaggataacagctgatgaaggcatccatggatattgttctatactgaacgcacattaa

SEQ ID NO: 22507 - DNA, 324 bp, Glycine max
  Peptide Sequence Number=SeqID_139285
atggtcgccaattcccacagagtgggttcttcctacggtggcgctgccccttaccgatcaagagatgggcttagcccccgacccgttggtgcctcagaggagatccaattacgaattgatcccttggacttggacgatgagatcactggtcttcatcgccaagttagaagattgaaacatgttgctgaggagataggaacagaagtgaagtatcagaaaaattttcttgaagaactgaagctgaatgctccctggcagaaaacgtttctcaaattagaaaaatatggtcagcttgttttaacgttaaggacttcagaagtttaa

SEQ ID NO: 22508 - DNA, 1386 bp, Glycine max
  Peptide Sequence Number=SeqID_139286
actctagaggatccccttgctgtcggcggtgaaaccgcccttggcggaggctttgacgttgaaaccgctgtggttttcgctctgcttatcgttggcctgatcgaagcgaatatcgccgccggcgttgacggtggttttaccgctgccgccgttcagcgcggtgccctgatagaccgcatcttgtttcacgttgacgttgatgccgttggccgcgtcgatcgtgccggtcaccgcctggctggcgttgctgttgctgcgctgggtgccgccttcgcccttggcgtctacggtcagatcgctgccggtggaggtgtagacgcgtacgccggcgctgccgcgggtatcgcggttctgctcttcctggcggttcgtcgcggcttcgctgcggtggctgtccgccgtcagcgtgaccgcgcctttgctcgcctgatactgcgtgccctgatcgcgcacttcgcctttggcgttgatgtcgatgctgccggctttcaccgagctgaccaccgcctgcgagctgctgctgcgtgtttcgctgctgccgccctgcgcgccgatatccaggccgacgttaggcgcgccgatgccgccaatgtcgttgatgacgccggtggcgtccagcttggccgccttgccgaccgcgcgctcaaccgggcgggtcacggcgctgtaatcgacgttggcgccgatgttcacaccgacgtcggttttggtggtggtgctgctggcggtgtcggcggcggccaaatgatcgacgctctcggcgttctctttgtaggcgccgccgacgctgtgctgcgcgccttgctgggtcagcttgtcacgggcgttgacagtcaggttgcctttgacgtcgctgccggaggtgaccgccttgctgctctgcgcctgcgttttgctgttctcgtagccggcttccacgccgctgccgagcttgtcgatgccgccggtgtaatagaaaccgccgccgatcttggtctgctcggtgttcgaggtggttttatcgtcggccgccaggaacgaaaccttgttgccgctgacgctggcgtcgcctttgtcggcgaccagtttggagccgctgaaggtcacgtccttctccgcctcgagcttcacgctgccgccgctgagggtcgaggcgcggttttcggtgcgggtggttttctcgctgtcgcgggtgtgttcgatgcgcaaaccggcgcggtattgcttgtcgccggcttctttggcgtagccgttgacggtaagcgcggtcttctgctcatcgattttttgctgctgttcggcagccttgacgttgatgctgccggtctgcgaggtgacgctcagctcgccgccgctggtgacctgactgccgatcacgtcggtatccttacggctgaccagcttcag

SEQ ID NO: 22509 - DNA, 509 bp, Glycine max
  Peptide Sequence Number=SeqID_139287
ttgtacctatcacctttagaggactacacgtcctcgccttgagaggactacgtgtcctcgccttgagaggactacacgtcctcaccaccagagggctgcacgccctcacctccagaggactacatgtcctcgccttgagagggctacacgccctcaccttggggctacacgtcctcgccttgagagggctacacgctctcaccttgggtactagttaccctcaccgtcataggactacacgtcctcgccttgagaggactacatgtcctcaccttcagagggctacatgtcctcgccttcagaggacttcatgtcctcgccatgagagggctgcacgccctcacctccgagtactagctgtcctcaccttgagaggactacacgtcctcgccttgaattatcttgagaggactacacgtcctcaccaccagagggctgcacgccctcacctccagaggactataagtcctcgccttgattgggctacacgccctcaccttgggtactag

SEQ ID NO: 22510 - DNA, 516 bp, Glycine max
  Peptide Sequence Number=SeqID_139288
atgacggtaatccgcactggatcaatgaagccgaaatattggaacaagaatccctttaaagccacagcaaaggcctttcctcttgaattccattttaaaccaatagccaacaataaaacaagaacattttatgaatacaacaaaacagaacacaacaagcaatttccatcattagagagacatgcctttcttaagcggtggaaccaatttgacacaacaaaagcagagtcggacaaggttaaaatccgattcaaagcacatccagagttccttaaagcagctgatctggagacttcattatttctcaatcagaagtccaagctagtagccttcctagcaggatctaagtctaaggaccatctaaccaagaacttaaaaaaggttctacaattacttcaaagccaagaagaaagagagtcttcgtcaaagaaagcagacgccaactctttaaactcttcagaagatttctaccagaatgaagatgactgtttttgtattaatttagctgaagattaa

SEQ ID NO: 22511 - DNA, 603 bp, Glycine max
  Peptide Sequence Number=SeqID_139289
atgggagtcatccacaatgtgaatcacaactccatcatactgccacgctgccatagcaccatcacctgctgcaatctggtggacttcagatttggaaaacagctttcaggtgagagaacattcacaatttgtgggatggcagattcactggctccagagattgttttgggaaaaggccacggtttccctgctgactggtgggcgttgggagttttaatatattttatgttacgtggtgagatgccatttggatcatggagagaaaatgaacttgatacagttgccaaaattgcaaaaaggaagctacatcttcccgagacttttagccctgaagctgttgatctcatctccaagctacttgaagtggaagaaaacactagacttggtagccaaggtcctgattctgtcaagaatcacccatggtttaatggtgttgaatgggaagggattagaaaccacacctttcccgttccacaggaaattatttctcgtataacacagcacttggaagttcattctgaggattgtagtactggttatctgggttccccattacaggaggtaaaagaacttaatgtgcctgaatggcttgaggactggtag

SEQ ID NO: 22512 - DNA, 1440 bp, Glycine max
  Peptide Sequence Number=SeqID_139290
atggaggatgagagtgggcttgagctcagcttgggtttatcttttggaggctcgtcagccaaacccaagggtaagaatggtagctcctcagatgctagagatgaagaagttggtaggggtggcaaaatggtggatgactttaagagcatgtttgataatgttcctcagaagcccgaatctattactggtacccgaacaactgattccccaaagcctgaggagaacttctttagtgacctttcaaaggccaaagaagacaatgcttctttgaatttaaatgagagaggatttctggttgctaacattaataagccggttgaaattgaggaagataaaaggtccgaggcagcaaataagcgaaaaatgccttttgatgagatacctagagcctctcatatttctataacagaggatggttcaaccgcagaaaatgaagatgtggctgactctgagactgagaaccccacctccaggcccatctcacaccacagtgatggttccaaaggattcattagagttagtgcttcttccgatgctgccaaagaggttcgtggaagtgctgactcaaatgctactgacttaagtgggcagaagaggtttactgggtcatcagaaaaagattttaagcatgccggcatgacctatggtgcttccttttctgttcaacctgtaaatatgttgaatgtaccttacccttcagtaaaagagtccagctcagttggggtaccaagccctcagatacctggagtgatgcatgtgatgcctactgctgccactggtgaacgctcaggagcccaatctgtgagtaatgggagtttgcctgtgatgtttggatattcacctgttcagcttcctatgttggagaaggacaactcatggggtttggtttctcgtcctcaacagttacacccttcctttgttggcagaggtccaactaactcagctgcactacaagtaatctcaaacaatatatccgaggccatgccttatgaaggaaggccgttagaacgaaccaaaggagacggtaaacagcgtgtcactgaagaaggctcctcctcacaatctgaagatgtgaaagcaataagcacaaaccttagggccaaagatgcatctgataaatcaacaggagaaggtgcaatcattgatttttcaaatattaagccaggtcttgctgcagatgtgaaatttggtggatgtggttcttatcctaatctgccttgggtatccacctcaggttccggtccaaatggaaggacaatttctggtgttacttataaatacggcactaaccaagtcagaattgtatgtgcatgccatggttctcacatgacccctgaggagtttgttcgccattcaaatgaagaccaggcagctgcagaggggaatacagttttggggacagtagcaaacggcaatcctgctgcctcttcccacagctaa

SEQ ID NO: 22513 - DNA, 1629 bp, Glycine max
  Peptide Sequence Number=SeqID_139291
atggcaggtggaggattttctgatgctggaacactcaagagggctcatctttaccagtacaagattactggatatttcatcttttcttgcattgttggagctcttggtggcgctctatttggctatgatcttggtgtttcaggtggagttacctccatggatgatttcctcatacaattcttcccaaaggtgtatgaaaagaagcatgcacatcttgcggagacagattattgtaaatatgatgatcagatattgacactctttacttcatctctatactttgctgcccttgtgtccacgtttggtgcttccagtgtaacaaaaaccaaaggcagaaaagctagcatcttagctggttccgtaagcttctttataggagctattctgaatgcagctgccaagagcattacaatgttgatccttgggcgtatccttcttggtgttggcattggatttggtaaccaacctctttgcatatgcaagggtaaggctgcgtacaatatccctcccccataccttcgcatagcgaagagcctctgggcaatggggtacgaagctgttcctctctatctttcagaaatggcacctgcaaaagtgagaggagcagtgaaccaactctttcagttaacaacatgcttgggaattctgattgccaaccttgtgaattatggcaccgagaagattcatccttgggggtggaggttatcccttggtttagctacagttccagcagtttttatgttcattggaggctgtttgtgtcctgaaacacccaacagccttgtggaacaaggcagattcgacgaaggacgagcggtgttggagaaggttaggggcactccaaatgttgatgctgaatttgatgatcttattgaggcaagcagagaagcaaaatccatcaagaatccattccagaaccttcttttgaggaaaaacagaccacaggtgataattggtgcctttgctattccagcattccaacagttaactggcaacaactccatcctcttctatgctcctgttatcttccaaactttgggatttggatctggggcatctctgtattcatcggttattacaagtgtagcacttgttgttgccacactcatctcaatggcttttgtagacaagtttggcaggagagctttctttttggaagccggtgctgaaatgataatctgcttggttgctatggctatagttttgtctgttgaatttggaaaaggcaaagaactgtcatatggtgttagtatatttttggttatagtgattttcctattcgtcttggcatatggaagatcttggggtcccttgggatggttggttcctagtgagctcttcccactagagataaggtcagcagcacaaagtgttgtggtgtgtgtcaacatgatcttcactgctcttgtggcacaattcttccttgtatcactttgccacctcaaatatggaatcttcttgctgtttgcagccttaattgtccttatgagctgctttgttttcttcctcttgccagaaaccaagcaagtcccaattgaggagatttatcttctgtttgagaatcattggttttggaagagagtagtaggagaagggaaaaacacatctgggtcatcatcaaatgtatga

SEQ ID NO: 22514 - DNA, 3288 bp, Glycine max
  Peptide Sequence Number=SeqID_139292
atgccatataggacgaaactgagcaatgacaagtggaacctcttcttgtccgtgctagggtttgaagacatcatcttagggttcttgaaagatggtgaagatgttaaagaggcaatttcagtgagcgtgtatgacaaaggtggccatgagtttgatatgatgctcaagaaatgggttaaggtttcaaatcattactatgtgctaaaccgaggctggttcagtttctgtgacctacagtgcttgggggagaacgatctcgtcgccttgcgcacctttcgccatgcaaaaactgacatgcgatggctgtggggaggatttagtgggattgacgcctacggtggaggaggacttaaagggagtaacttaaatgattgtgatgatattaatgatggtgggaacgtcaatgataacgacaatgaaaatattggtgatattgatgttgataatgataatgatagaattgataatcatgaccaagacaatgcaatattaggtgtggatggtgatgataatggtgatggtggctatgatgttaatgtctgcataggcgacaattgcagaggctcaagcatcaacggagaccccattatcgcccgaaacgacgtcgccgaagtcgcgaatttctccccttcctcttcggatgttgaagaaggcgaaatcagagaccaattgaaccaattgagcatcactcgagactccgaagctggaatccggagacttgctagggtttccgcgcagtttcttccacccgacggttcccgaatcgttaagattccttccggaaacttcgaattgcgatactcgttcttgtcgcaacgaggttactaccccgatgcactcgataaagctaaccaagacagtttctgcatccacacaccttttggtacgagccctaacgaccacttcttcggtgtcttcgacggccatggcgagttcggagctcagtgttctcagttcgtgaagaggaaactgtgtgagaatttgctcaggaactccaaattccgcgccgatcctgttgaggcttgtcacgcggcgtttttagcgacgaattcgcagctgcacaatgatgttgttctggatgacagcatgagcgggacgacggcgatcacggtgctggtgagagggaggacgatatacgtggcgaattccggcgattcaagggcggtgatcgcggaaaggagagggaaggaggaagaagttgtggccgttgatttgtcgattgatcagacgcctttcaggagtgatgagcttgagagggtgaaaatgtgtggggcgagggttcttactttggatcagattgaggggttgaagaaccctgatgtgcagtgttggggcactgaggaaggtgatgatggtgaccctccgaggttgtgggtgcccaatgggatgtatccggggacggcgtttacgcggagcattggtgattccattgctgagactattggggttgtggccaatcctgagattgttgtgtttgagctcacgcaggatcaccctttctttgtgctggccagtgatggggtctttgagtttctctctagccagactgtggttgaaatggttgcaaaatttaaagatcctcgtgatgcttgtgctgcaattgtggcagaatcttatcggctctggctgcagtatgaaactcgtacagatgacattacagtcatcattgtgcatgtaaatgggctaactgaatctgctgttggtcagtcagcaagttatggtgatgttttgcgaaaccctgtgcctcaagttgtagaggtgacaggttcagaatccccttccacctttggctggagcgctagaaaccatcgcgtaaggcatgaattgtcaagggcacgcctccgagcacttgaaaattccctagaaaatggtcaaacctgggttcctccatcctcagcccatagaaagacatgggaagaagaagcacacatagagcaggcgttgcatgatcattttctcttccgaaaacttactgattctcagtgtcatgttttattggattgcatgcaaagagtggaagtccaacctggggatattatagtcaaacagggtggtgaaggtgattgtttttatgttgttggtagtggagaatttgaggtctcggcgactcagactcgacaagataaaattagaaacggagctattagagagagggttggagtagcgcctattgtagagaagatggtggaaaatagacttaggtggtttgggcatgtagagagaagaccggtagactctgtagtgaggagagtagaccagatggagagaaggcaaacaattcgaggcagaggaagacccaaaaagactataagagaggttatcaagaaggatctcgaacttaatgatttggatagaagtatggcttctgtatgtgctgttacaaaaggaactctttggtctttaaaacgagaagattttcgagggattttaatgtcagaattctctaacttgtcatcattgaagttgcttcggtctgtagatctcctctcaaggttgtcaattttacaactcagtcagatttctgactccctttctgaagtttccttctcaaatgggcagacaataatagacaaaaatgaagtccttgcattgtacattatccaaaagggacgagtgaaaatcactttggattctgatttattgtcttgtccaaatgcctacagcctcaagcctgacatccaaagtgaggatgatgtacagagcggaaaagaactgtcaatagagaagcctgagggaagctattttggtgaatgggcccttcttggtgaaaatattggttccttgagtgctgttgctgtgggtgatgttgtatgtgctttactaacaaaggaaaaatttgaatctgttattggctccttacaaaagatttctcaggaagatcacaaggattattctagaaattatgaattttcatccctcgataaggtccagctctcagatttggagtggagaaagacactatattccactgactgctctgaaatagggcttgcaaattttagagattcagaaaatttgcttactttgaagagattttctaagccaaaggtgaaaaagctaggaaaggaatcacaagtctttaaagagagagatttgattatgggtatgggctctttagcctgtacaccacaggttttatgcacttgtgctgatcttatgtatgctggaatacttttaaatactcgccttgcttgccctttgtcttccatactttcaagtccttttagtgaatcagcagcgcagttttgtgcggcttctgttgttactgccttagaagacttgcacaag

SEQ ID NO: 22515 - DNA, 522 bp, Glycine max
  Peptide Sequence Number=SeqID_139293
atgacagagaactcatcatcaaattcagggaagggaaagaacattattgatgaacaacaacatgaagaaagtggaaaaagtgaagaaggcaacaacaacagattggtaaacgaaatcctatcttacaacgagtcgcagctgaagttcctgctcaacgttggcatcgtgaaagattgcgagctgagcatgccgtatatcactcaactgaccagcgacaagtggaacctgttcttgcgcacgcctcagtttgaaggtatcttcttagggttcttgaaagaaggtgaggatgttagagacggaattccagtgaacgtgtatgacaaacatggccatgagttcgagatgatgctcaagaaatttcacaaaggttccatcagttactatgtgctaaaccgagggtggctcagtttctgcaaccaacagcacttgggagagaacgatatcattgccttgcgcacgtttcgccatgcaataactgacaagttgtctttcgttgttacttacgtgagagtggcgtggtaa

SEQ ID NO: 22516 - DNA, 380 bp, Glycine max
  Peptide Sequence Number=SeqID_139294
atgctggagagtgcgagagccagagctagagagagagtgggggatgtgagagaggtattcattacaaagagaagaaatagaggtgggcggaagtatgaatttgttcgattcaaaggagtggacaatgtagggaggcttgaacaccagctggataacatgataatcgagggtttgaaactgcacgccaatcgcccagagcatgaaagggagccaacaaaaaagggtgaatctaccattgacgtgaaacacaaggtggggatagaccatacgttctggaacggcggagcactgaaacaacaacaacatccatgtcgaatacaagcaccaatctcgtatgcaacagtggtggcgaaaggaagcaacaccatggagaggagatg

SEQ ID NO: 22517 - DNA, 1329 bp, Glycine max
  Peptide Sequence Number=SeqID_139295
atgggtatctctgttgtagtcatgaaattgtgtcatgtggcaattagaaggctcttaattgttggcgtgttcgttgctgtgatagttgttttccaatgttgttggacagcgtattattctttgttggatgctggtgggagctcagtggctttgccaattaaagttttcctttctggaacttcgcaacaggagggtgtgtttagatccacagcagcaaccaatgtcatgtttaatgttacttttgcctctcattcaaaagaatatgcttctgagaaagaagctgatttggaatctgatgggggcacaagttcaagagagggtagcatccccaacaagggttttaaagtggcaagtcatcatgaggatgcaatttacagttacacacagaaaagacctaagtatgctgatttgagcacatctgatatgttgcttgctgtgaaaaaaccttcaaatgagagtataatacaaagtgtggaaatgaaatctcaaaatgagaatgcacaagtgttgaaatctcctttgtccaagtcaaatagtaaacctaagatgggtacttcatcaacgagtagtaagttggtgtggccaacttcaataacacagatgaactctttgatgcttcagagctttaatagttctgcttctatgaggccaaggtggtcttctcgacgggacagggaactcttatctgcaaaactagagattgaaaatgcccatgtcatgtcaaattcttcaggactttatgcttctattttctgggatgtttccaagttttcaaggagttatgaactgatggagcgcaagctcaaagtttttatctatagagaaggagcaaaaccaatattccaacaaccaaagatgagaggaatttatgcctcagaggggtggtttatgaagttgatggaaggaaataaaaggttcattgtgagggatccccaaaaagctcatttgttttacttaccattcagttcacaaatgctaagggttactctttctaaccggaaacagatgaagcaacatcttgagaaatatgtggagctaattgcaggaagatattgtttctggaacagaactgatggagcagatcattttcttgttgcttgtcatgattgggcctctcaaatcactaggcaaccaatgaaaggttgtattaggtctctttgcaattctaatgttgctaaaggcttccaaatagggaaggacactactctacctgttacatatgtacactctgtgatgggtccactaagacgatttgcagggattcagaaaggtctattctggcctttttctctggaagcatgcatggttatgtctgtccgatcctgctaa

SEQ ID NO: 22518 - DNA, 996 bp, Glycine max
  Peptide Sequence Number=SeqID_139296
atgtctgaattgaagggagatgaccatcttataaagaatcttcgacgagtagcaagaaatgtgaataagattgttgctgaaggacaaatatccagagcaccttctagttatccttcggacctcagcaatggtctagaagctatacccattccagttactaatgagattgatgattctcctatcacacctaacggctttacatatatcacatctagccaagttgcaaacaacgtgaaagttccatctagtgatgactatggttgtcaatgcaaaggaaatagttgtagaactaacaagaattgttgttttagacttaataacatgtatccatatgttcgtcgtcggaaatgtagcagattgatccaagctagagatattgtgtttgaatgtggtccaagatgtggatgtggtcctgattgtggcagtagagtatctcagaagggtttgcagtaccagcttgaggtttatcgtacgtctgacaaaggatgggctgttagaactaggaattttattcctgttggagctttagtttgtgaacttgttggggtactaaagagaactgaagacttggataatgattcacacaatgactacatagttgaaattgatggctgggaaactataaaagagataggtggacgaaagaaacgattgcctgacgagccattgcctgcaaaaattttccttgaaaataaggatgatgagacaaccaaaaatgatccagagttctgtatagattgtagttcttttggtaatgtggctaggttcatcaaccatagttgtgatcctaacctatttgttcaatgtgttttgaactcccattatgggatcaaacaagctcgaattgtactatttgctggaagaaacatacgtcctaaacaggaacttacttatgactatggttaccgacttgatagtgttgctgatgtcgatggaaaaatcaagcaattaccatgttactgtggtgaagctacttgtcgcaagcgtttatactag

SEQ ID NO: 22519 - DNA, 306 bp, Glycine max
  Peptide Sequence Number=SeqID_139297
atggggctgactgacacaagagctgaagaaatgtgcagggagggtgctgcgaatggaacaacattattctactcgctggagaaatggcagtcaagtatgaggactaggttattgatcttcgacgactggacaaggctcaggagacatgctacagtgcagacacttgtaaatggcggtctaggagcatggtggggtcgtcggaggaaatcagttccgatggtggggtcgacggaggaaatggagttgccattaacagcggcgtttgagttatcagtttccaaaacaacaacagcgaaaatggagtag

SEQ ID NO: 22520 - DNA, 282 bp, Glycine max
  Peptide Sequence Number=SeqID_139298
atggtagctcgcccaggcgagctgagacttactcctgaagtaactagctcacccaggcgagctggttccttcagcctaaagtcttttgagggcccaggcgagctagaggctggcctgggcgagtcagggtccataaaacttagtaaaagacccttttgcccctcctttttgatatttttcgcattcttgatcgaaacactgaatggttccttgctttgcactgtaactggcgttcaacactataagtcatctagcaaggatcaaaagatcaatgaacgatag

SEQ ID NO: 22521 - DNA, 654 bp, Glycine max
  Peptide Sequence Number=SeqID_139299
atgggaagcgatggtgtgaggaaaccgagattcctatgccttcatgggtttcgaacaagcggagaaatattgaatacacagttacataagtggccacaaacggtgtttgacaacctcgatctcgtgtttgtggatgctccttttccttgccaaggcaaatccgatgtagaaggcatttttgatcccccttactacgagtggttccagttcaacaaggaatttacagagtacaccaactttgacgagtgcctccagtacattgaggaatgcatgatcaagcacggacctattgatgggcttcttggtttttcacagggagcaatattatcagctgcgctaccgggtcttcaggagaagggcgtggcactcacgaaggttcccaaagtgaaattcctaataatagtaggaggggcaaagttgaggtcaccttcagtggcggacaaagcatattcttcttccattaggtgtccctccctacactttctcggggagacagattttttgaacaagtatggggctgaactactagaatcctgtaatgaacccgtggtgattcaccatcccaagggacacacaataccaagattagatgataagagcttgaagaccatgatggatttcatcgaaagaattaagaaagatgtctcaaaataa

SEQ ID NO: 22522 - DNA, 207 bp, Glycine max
  Peptide Sequence Number=SeqID_139300
atggagtgtataccaataatgcaaggcaatgtacagtacaatattattattctccacagaaagaaaggagggtgggcaatgtggatgaaacctggccacaccgtctcaatgaggaaagggccaggtgatggaaagtgcgatgaaaacaaccacatgtcttccttttttctgcatctttggcttccatttgggtgcatcaccccctaa

SEQ ID NO: 22523 - DNA, 1273 bp, Glycine max
  Peptide Sequence Number=SeqID_139301
attgctgagggtgcttgagcttgtggaatctgtggtggagtttgaggacgatgaggaggtggattggatttcgtgttttcccgagactcaaaccaatatggagtctcttgtgtttgattgtgttgaggttcctattaattttgaggctttggagggtttggtggctaggtcgcctcgcttgaagaagcttcgattgaaccaattcgtctccatggctcagctatatcgtctgctgcttcgagctccgcagcttactcatcttggaacgggttctttcagtgctactgaggctggggtggtcggggaccaggagccggattacgcggccgcatttgaggcttgcagatccctggtttgcctgtctggattcagagagatttgggcagattaccttcccgcgatttatccagtctgcgcaaatctgacgtcgttgaatttgagctatgctgacattaacacggatcagctgaagtcggttatttgccactgccataagctgcagatattctgggtacttgattcgatacgtgatgaggggcttcaggcggtggctgcaacttgcaaggacttgcgcgagcttcgggtttttcctatggacgcgagggaggagactgatgggcctgtttctgaggtggggtttgaagcgatttctcagggttgtaggaagttggaatcgattttgtttctctgccagaggatgactaatgcggctgtggtggctatgtcaaagaactgcccggatcttgtggtgtttcgtctatgtataattgggcggtataggccggatcctgtgactcaggaacccatggatgagggttttggtgctattgttatgaattgcaagaagctcactcggctggctgtgtctggcttgctgactgatcgtgcttttgagtacattgggacgtatgggaaattggttaggacgttgtcagttgcctttgctggggacactgatgttggccttaaatatgtgcttaaaggatgccctaatttgcaaaagcttgaaatcagggatagtccttttggggatggagctctgagatccggtttgcatcattattacaacatgagattcctctggatgtcgacttgtaaattgacgctccaagcttgccaagaggttgcacgagtattgcctaacctggtttttgaagtaattaacaacaacagtgaggagaatgcgggtgatgaagttgagacattatacatgtatcggtctcttgatgggccacgggatgatgctccaagatttgttaccatcttgcaatag

SEQ ID NO: 22524 - DNA, 318 bp, Glycine max
  Peptide Sequence Number=SeqID_139302
atggagcacgcgacacgtgacacagcgcggcgcacgaggcagcagcagggtaacgcccctgacgcgagcgcgtctggtagcgccctgccactgggcgcgactggtagtgcccagcgcgtgggcgcgactggcgcttgggtcgtgcccgcgtcaggggcactgccagtcgcgcccagcggcagggcgctaccagacgcacccgcgtcatgggggctaccctgctgctgcctcgtgcgccgcgctgtgccacgtgtcgcgtgctcaatggaagtgcctttctggagagcgctttgtaataaaaaacagacccccaggtaa

SEQ ID NO: 22525 - DNA, 669 bp, Glycine max
  Peptide Sequence Number=SeqID_139303
atggaggcaacagtcgatgcacttggatcgtgcggagattctattcttccacgtgaacaccttgatgtggttcttgatggcctactagaggagtacattccagtgatctcagtgattgaaagtaagtccaaaccactttcgattggagaagtaaaggcactattgctctcacatgagacacgcatgaaaaagtttcacaagcactttgctaattcacctttgtttaatgttgctcaaggttacaattcatcctcaaataattacaattcacaaaatcgatccaattatcctggaaatcatggtggcttcaatcatggcggtggccacagtcgtggaggcaataactttggtcgtggtggaggttgtcttggtggtggcagaggctgcgatcgttatgcaaattttcagtgtcaagtttgcttcaaatttggtcacacaacaacagtgtgtcattttggctatgattctgattttcagccgaacgtgtctcccactctgatggaactggtgtttcaaagcaattcattgaacacctttggttcagaacaacaaattgtggctcatggtggtccaagaaacaacagattgtggctagatcttccactaaagctgaatacaggagcttggctcaagtcacgaatgaagttacatggattcaaagtcttttaa

SEQ ID NO: 22526 - DNA, 914 bp, Glycine max
  Peptide Sequence Number=SeqID_139304
acatcctcgtcatcagaagactacacgtcctcgccatcagagggctacacgtcctcaccttcataggactacacgttctcacctatacacgcctacacaccctcgccttcaaaggactacacgtcctcgccttcagaggacttcacgtcctcgcctttagaggacttcacgtcctcaccttcagaggactgcacctcctcatcttaagaggactgcacctccctaccttcagagggctgcacgccctcgccattagagggctacacttcctcgccttcagagggctacacgtcttcaccttcagaggactacacgtcctcaccttcagaaggctgcatgccctcgcctttagaggactacatatccacaccttcagagggctacacgtcctcgccttcagaggactacacgtcctcgccttcaaaggactgcatgtcctcgtcttcatagaactacacgtcctcgccttcagaggaacacacatcctcgtcatcagaggactacacgtcctctccttcagaacgctacacatcccagccttcataggactacacgtcctcaccttcagagggcaacacgtgctcgccttcagaggactacacgtccacaccttcagaaaactacacgtcctcgccatcagagggttgcatggcgtcgccttcagagggctacatgtcctcaccttcataggactacacgtcctcgcattcacaggactacacgtcctcgccttcataggactacacatcctcgccatcagaagactacacgtcctcgccatcagagggctacacgtcctcaccttcataggactacacgtcctcacctatacacgcctacacgccctcgccttcaaaggactacacgtcctcgccttcagaggactacacgccctcgcctttagaggacttcac

SEQ ID NO: 22527 - DNA, 497 bp, Glycine max
  Peptide Sequence Number=SeqID_139305
atgagagacaagtcagagagccatccttcgacaaactccgaggacgaccaccgatcctcccccttgctggatctggcgtgtgccgaaatcaccgaatcctccaacagcaagacccgaacctgcggcccgtttcctggttcgggcccctccgagcctcaggctccgttcccggaccaggtcctcgagaacgtccttgagaacgtgctccacttcctcccctctcgccgcgaccgcaacgccgcctcattggtttgccgctcctggtaccgtgcggaggccctcacccgatccgagctcttcatcggcaactgctacgcgctctctcccactcgcgccaccgcccgcttcacgcgcgtcatgtccgtcaccgtcaaagggaaaccccgattcgccgacttcgatctgatgcctcccgattggggggcccacttcggaccgtgggcctctgctttggcccaggcctacccctggctcgagaagctccacctcaagcgcat

SEQ ID NO: 22528 - DNA, 1212 bp, Glycine max
  Peptide Sequence Number=SeqID_139306
atgtcttctaaagctgaaacccaatctcttttacaaggttttattaaatctgttgaaaggcaatttgatacaaaagttaaagctattcgctcagataatggtgccgaatttatcatgagtcatttctttcaagccactgcactctcagtgctaacagaaaaaagctggatcctagagccttaccttgtgcgtttttgggatttaaatcccacaagaaagcttgatgtcaataatgtgttcctacacggtgatcttaatgaagaggtgtatatagttctacctccaggtatgaaatctactaaacctggtcaagtttgtaagttacaaagatctctctatgggttaaagcaagccagtcgtcaatggtatgctcaattatctacttttcttgtggctcatggcttcaaacagtctgttactaactattctctctttactttgaaaagagaaaattcattcattgcattattgatctacgttgatgatattgttctgagtgggaatgatctctctgttatttctcatattacaaaattactggatgacacttttaagatgaaagaccttggtaatttggagtattttcttggatttgaagttgctcgtggaacctctggtattaacatttgtcaaagaaagtatgctttggatcttctcaccgatactgatatgttaaattctaagcctgtttctactccttttgattactgtaccaggttaatataccttacaaataccaaacctgatatcacctttgccgttcaacacctgagtcagttcattgcttctctcactattgctcattacatgactctttattgtattcttcaatacattaaagttgctcctagtttgggtattttctttccttctactagtgagtttcagctcaaagcctttagcgattctgattgggctggttgtattgatactagaaaatccattactgatttttctgtttatcttggttcatcacttatatcatggaaatctaagaagcaagccacagtctcgagaagttcttttgaagccgaatatcgtgcccttgctactgtaacttgtgaaattcaatggctcatatatttgcttcatgactttggtattattcaaaagcctgctttagtgttatgcgacaataaatcagctctccacattgcagctaatctgtcttccatgaaagaaccaaacatattgagattgattgtcacttga

SEQ ID NO: 22529 - DNA, 1446 bp, Glycine max
  Peptide Sequence Number=SeqID_139307
atgactgatgtaatattttgcttatctgagaagttagcagagataggcctgagagttcatgggaagatacatcttgtgttagagtactgtaaagggggagatctttccttgtacatccaacgccacggaaaggtaccagaggcaactgccaaacattttatgctgcagctggctgctggtctacaagttcttcgggacaataaccttattcatcgagacctgaaaccacagaaccttcttctctctcgaaatgatgagaagtcagtgctgaagattgctgactttggatttgcaagatctctgcaacctaggggccttgctgaaaccttgtgtggttcaccactctacatggctccagaaatcatgcaactacagaaatatgatgctaaggcagatctttggagtgttggtgcaatcctatttcagcttgttacaggaagaacgcctttcactggaaacaatcaaatacagttactacaaaatattatgaaatcaacagaattgcagtttccgtctgatagccaaagtctgagttttgaatgcaaagatttgtgtcagaaattgctacgtcggaatccagtggaacgtctaacttttgaagaattctttaaccatccattcctttctcagaagcaaacagaacaggatgagccattgaggaatagaagttctccaaggctggttggtgggttttgttctacagggtctgaccctttgagaagaactgaggaaaattatcaagaagattgtttgcctttcatgttagatgatgactctagtggcccggaggggagtccatccttttcaaggaagaagtcctcaatgaagtcgacctatggatttgatctaaatgctaaactagataaagcggagtcatcatctcctatttctaataacataaatcatacttctggatttggtagtgtgacacagagatctgaaaacactactaaaagattggacaaccataaaatttctagaaatctcactaatcctctagaatctccagaacagctattcacaagtccttatccaaaagcagcagttacggattcactggagaatattgatcaagaatatgttctggtgtctgggccccctatagatgtttcatcttcttcagtgggtgcttcaaggcccagccataccccatatcggtcaggtagtttaccccaagagtcttctagtacaatcactagactaagtgttccaatgccaatagttggtgtaccttccaatagcatatgccaaattggaagttcaggaagtcaggactctgctcctgggacatcgcttggatcaatggatactggtgatgaacagccatcagctcactgcatgacaagggtgaaatcattgcaacagtgtgcatcttccatcacggagttagttaatgaaaaggtaaatgctgctaaaagtttgctcgctactgtattcttaaagtga

SEQ ID NO: 22530 - DNA, 338 bp, Glycine max
  Peptide Sequence Number=SeqID_139308
cctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 22531 - DNA, 566 bp, Glycine max
  Peptide Sequence Number=SeqID_139309
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggccacgctttcacggttcgtatcgtactggaaatcagaatcaaacgagctttacccttttgtccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 22532 - DNA, 342 bp, Glycine max
  Peptide Sequence Number=SeqID_139310
atggtgactatccaatgctccaaaggaaaaacttcagtgggtaaagctctcattgacttaggggcacgaatcaacttaatgcctttttccatgtgcagaagactgggaaatttcaaggtggtccattctagaatgacgctgcatcttgcagattgctcaatgacgcgaccttatggtgtagttgaggatgtcttagttaagatagagcagttcaccttcccacgcacatgggcaggcttagcgcacacatattcactcgctaagcgaggcaaacttgccaagccaaacctcaactctagaacttcagtagatttatcggctgagcaagccaccataggctaa

SEQ ID NO: 22533 - DNA, 225 bp, Glycine max
  Peptide Sequence Number=SeqID_139311
atgtcggtaataaacattgaacatgttgtcaatatcctcatcgtcattgatggtaacaacatggcccatcttttgttggatttttcttttcaaggaattcaaggtcatgcctctcttcatagaaacaagtacatttttttcgctcttaaactcttcgccaatgttacaatcggctacataggcatcatagtggactacgacaaagattgtttggtttatggttga

SEQ ID NO: 22534 - DNA, 249 bp, Glycine max
  Peptide Sequence Number=SeqID_139312
atgaacgaaacagagcaaagggctaacgagaatgacaaactatgcaactcaatgtcgtggtttgaggtagagacggtagctgtaggccgcttcgctgcgcctgactttgacagacatgacatgtgcgacctcgaggttgagggtgcacgagctccacgttcagggtgcgcgacctcgacgttcagggtccgcaaggtttacgatgcgagatgttcagggtgcgcgaggtttagggtgcaggatgtttag

SEQ ID NO: 22535 - DNA, 207 bp, Glycine max
  Peptide Sequence Number=SeqID_139313
atgggatggctacaagtgagaagagaaaaggaagaaaagcaattatggatagcaataagcattattggtctagacaaagggaggcccaagttcagagaagctgaccctcgaaacatgttcaaaataattcgtgtgaagaactcaaacaagatttcgccagatctcgaggagcttcaggttaacatacagcaatatccaattaattaa

SEQ ID NO: 22536 - DNA, 225 bp, Glycine max
  Peptide Sequence Number=SeqID_139314
atgaagaaaaagaataccgaaagtagacgagatgaagatgaaaacatacaaagcaagaatgaacctccaagggtgttgaacccttcccttcagcctcccacgccctttattagccaaaataggggaggaggttgccgcctagttcatccagattacgtggcgatgaatgttaagcatcttaatttgatcagcaaggctgatcgaggccgtacccgaatcaaataa

SEQ ID NO: 22537 - DNA, 1127 bp, Glycine max
  Peptide Sequence Number=SeqID_139315
gtaaaggcagccacggcacagtctacaaggccgccttccacggcggcgctctcgtcgccgccgtcaaaataaccaaacccaaaacctcaaacgaaatcgaaattctctcccacctcaaaaaaaaccctcgtcttgttaacctaattggcttctgcaacgaccaaacccaaactaacaacattaacaacaacaaactcattgttgtcgagtacatgccaaacggttcgctccacgagcttctccactcgactaaaaaaccggttcgacccccaagctggaccgcgcgagtccggtttgcggttcaggtcgcgaaagcggttcgccttttacactcttccgaaccgccagttattcacagggacataaaatcgtccaatgtgttaatcgacgaaaagtggaacgctagactcggtgacttcgggctcgcggtgaggggacacgtggcggattctcgcgtgccaccggcggggacgttaggatacctcgacccgtgctatcttgcgccgggagatctaagttccaagagcgatgtcttcagtttcggagttttgctgctcgagatcgcgagtgggaggcacgcgctcgacgtgaggcacagtccgccgtcggtgctggactgggcggtgccgctggtccggcgcggcgagtttaaggagatttgtgacccgagaattggagcaccgccggacatggcggcgttccggcggatggcggtgctggcggcgaggtgcgtgaggagcaccccggagagaaggccgtcgatggtggaggtgttggagtgtctaacggcggtgagaaaatgttttcgcgcgccggtaatgtggaagaggattaagaggcgcgtggagatagcgcgtggggatttgtttcatgattgggacaggagtgaggaagttgtgagagtagttaagttaggaagtagtagtagtagaaggaacgggaaagtatctagtgtgtcgggtgtagagtatgagggtggacacgcgaatccagcggtgagatctagatcggttggttcgggttcgggtttggttgggtttgggttcaagaatagaaaagggaaagtgaggctaaagagatcgaggtctatggggagtccggtcaggggaaaagaaattgctggcctg

SEQ ID NO: 22538 - DNA, 690 bp, Glycine max
  Peptide Sequence Number=SeqID_139316
atggtcgagcctcctgcggcagcagcaacctcagaatcagacacaacaggaaacaccaacactccttcaccgtcttcttcatcctcgtcgtcaagttctaagaagcgagcaagagacaacaacaataatagtaacagcagcagtaacaagcattctgtgtatagaggtgtccgaatgcgcacgtgggggaaatgggtgtcggaaatccgcgagccgcgaaagaagaacagaatctggctcggaacgttcgccacagccgagatggcggcgcgtgcgcacgacgtggcggcgctgacgataaaaggctcctccgccatccttaacttccccgaactggcggccacgctgccccggccggcctccaactccccccgcgacgtgcaggccgcggccgccaaggcggcgtccatggaggcgccgccgaggacccctccctcgccggcctccacgccggcggaggatgacctcggcgagattgtggagctgccgccgctgggaacgagtttcgactcgcccatcgacccgatgagtaccgagttcgtgttcctggacatggacgacgggtggccctattctcacccatggtaccacggcatttatgatggtgggtacttgattagcgacatcaacaacatggtttcaatgcaagagtcagagagcatgcttctttccttgtggccttcaacttaa

SEQ ID NO: 22539 - DNA, 879 bp, Glycine max
  Peptide Sequence Number=SeqID_139317
agggctacacgtcctctccttaagagggctacacgcccttgccttcagaggactacacgtcctctccttcagaggactacacattcccgctttcagaggactacacatcctcaacttcagaggactacacatccacgacttcagagggctacacatcctgaccttcagaggactacacacctcgccatcaaaggactaaacatcctcaccttcagagggctacacgtcctctccttaagagggctacacgcccttgccttcagaggactacacgtcctctccatcagaggactacacattcccgctttcagaggactacacatcctcaacttcagaggactacacatccacgacttcagagggctacacatcctcaacttcagaggactacacatccacgacttcagagggctacacatcctcaacttcagaggactacacatccacgacttcagagggctacacatcctcaccttcagagggctgcacgccctcaccttcaaaggactgcacgtcaacacctttagaggactacatgtcctcaccttcagaggactacacacctcgcaatcagaggactacacgtcctcaccttcagggggctacacgtcctctccttcagagggctacacgcccttgcctttagaggactacacgtcctcacctttagaggactacacattcccactttcagacgactacaaatcctcaacttcaaaggactacacatccacgacttcagagggctacacgtcctcaccttcagagggctgcatgccctcaccttcaaatgactgcacatcctcacctttagaggactacacgtcctcacctttagaggactacacgttcccactttcagaggactacacatcctaa

SEQ ID NO: 22540 - DNA, 201 bp, Glycine max
  Peptide Sequence Number=SeqID_139318
atggaagagggatatgatgcttctgattctggacagattgagaaggtaatctgtcaggattctgggcctcaactgtttgctgtttctagggttgttgctgctgttgctgttattgcattggaggaggaatgtatggtctacttggaccaacagcattttggaaggaaggagcaggttgttgttgttgttgttgaggactag

SEQ ID NO: 22541 - DNA, 351 bp, Glycine max
  Peptide Sequence Number=SeqID_139319
atggttaaaccctatgttcctgtcaaaaatgaaccaggtacctatccttctactgaaaggtcttctagtgtgctgaaaggacttcttctagtagttccttgcccaagtctcatgtttataagtgtccaaaagggcgagggggttcaaatcggtatagtccatgcacactttccacctctccttctatttcttggtcgtgactatgttggagagccaagtgaagtagttgatctccctgataaaatgggtggccgccaatttggcgacttcttgtcgtactgctcgtcacctctcttcccccatttttcttttcctctaggccactggcttgacaactttacatatggctaa

SEQ ID NO: 22542 - DNA, 264 bp, Glycine max
  Peptide Sequence Number=SeqID_139320
atgcataggggagagactgcttgtactataatgtttggacagagggctatgaaggtggaaaacatggtaaagctaaaggaggaatttgattacaaaagcttatctaggaggtcttcgatcttcttcatcaatgaagtcatttgcttcttgaagatcatggcagcggaatggagaaggaagaaagatgataggagacgccacttcaagaggaagatgagtcaagaaaaagctcaccaccataggaagccatggataagagcttga

SEQ ID NO: 22543 - DNA, 396 bp, Glycine max
  Peptide Sequence Number=SeqID_139321
atggcgataggatacatcttgcctaacaaagttaggcatgccataactcacccgtggttattcttcaatgctatatgcaacaaagtcattgaccctctaaagttagatgacttagaattgtttgagcgatacatgaagatcttaaaatggtataccaagaatctacaccatcctaaaatatttgctattttaaggtacattgtagaagaaactattgagttttgtttagagtacattgaaaaggaaaatgactataccactgagctcccctcctctagagtcaacaccttcactgtgtacatggctcagatcattgtctgtcagacctatggctcagatcattgtctattagactcgtggctcaaatcattgtttgtcagacccgtgggaatgtag

SEQ ID NO: 22544 - DNA, 261 bp, Glycine max
  Peptide Sequence Number=SeqID_139322
atgacgttgctacttagcaacattccacccgacgaccacaatgccgatctccctcctgcggaagtatcagttggtctgtgccatcgtgacatagggatcgcacccataaggcacccagtggacccggagaagcccaacagagccctggggtttccaggtctggttatgggcctctgtcattcctacagggtgcccgtccccccaacaaagtcatgccatcgtgacataggtaagtatgcacgtggctacactgatttctga

SEQ ID NO: 22545 - DNA, 531 bp, Glycine max
  Peptide Sequence Number=SeqID_139323
atgccgctttcgctttccctcctcttccctcgtctccttccgccgtctttctcagccactagaacttccttaaataagccctcgtcggcgctctcaccggaggcactacctttgtcggttacacctcttacggtatgtagtgtagaagcaaagcttcataatgaatcaagaatgattcaaagatattttgatgataacaaaggtgatgacagaaagctcaaaggtcaatcaaagaatgagttcaagatgttcaagatagaatcaagaaagaatgagttcaagatgttcaagatagaatcaagaacacttcaagattcaaggatcaagcttctaagaatcaagatcaagattcaagaatcaagagaagacttaatcaagattcaagaatcaagagaagaattaatcaagataagtatgaaaaggttttttcaaaaactgagtagcacatggatttttctcaaaacatgtttaccaaagaatttttactctctggtaatcgattacttgattgttgtaatcgattatcagtag

SEQ ID NO: 22546 - DNA, 219 bp, Glycine max
  Peptide Sequence Number=SeqID_139324
atgaaggtggatgttgaagaaattcgagatgtcaatgctcatgttcctatacctactaaagaggataaacatgtatcaaagggactgatgatgcctattgataggctgaaacctaatgatgatctcctttaccaaatgactttgatgatcctgcaacttctcctcaaacccatgcataggtgtcatgggaagcaactatgtttggggagtgaacaatga

SEQ ID NO: 22547 - DNA, 102 bp, Glycine max
  Peptide Sequence Number=SeqID_139325
atgcattgctttctcattttccgtactttgtttgactcaagcccgcgtggtgtgccacctccaaatagtgcttgggctaagtgtaacagtgatggctcctaa

SEQ ID NO: 22548 - DNA, 246 bp, Glycine max
  Peptide Sequence Number=SeqID_139326
atgtgggtgcaagccattggtctgtttgctcaagcgacctgtgctcctgagtttggacttccaagaccattcaatcagagattactcgtcatgcacgttggtggggagagaagtgagttatcaagaataggatgttggacaaatggcctcagttaccttaagaaaaggggggttgaattaagatacaaagactattccccaattaaactttcactctctcttttcggattaacaatgcacccttaa

SEQ ID NO: 22549 - DNA, 152 bp, Glycine max
  Peptide Sequence Number=SeqID_139327
atgagcaaacctgaacaagtttgggaccaaacttggcattggatggttgatgacattgtctataattataaaaaatcatcaacaagtccggcattgcagcttgatgatagaactcttcaaaatttggtcttgcttgaaattgaacaactgat

SEQ ID NO: 22550 - DNA, 381 bp, Glycine max
  Peptide Sequence Number=SeqID_139328
atgcttgcatctagccaagtttatacgcaagtactaaacaaggagacaataaagtcgagaaaggttcagtccgctggagatttcacggtcaggctggatgaaaggtggtgtgattataaaaaaattcagaaattacacatgtcttgttctcatgttgttgttgcttgtaagcatgctcatcatgaatacaggaactacatacatctcatgcataagttggaaaatgtctccaacgtatataaaggattgtttggagaattgcgcaacgaagagtattggccaccgtgtctcgagccaatgatttgtgccggcccaaacaagaaaagaaattctaagggtcgtcttgtctcttctcgcatccctaccgaaatggatatctga

SEQ ID NO: 22551 - DNA, 339 bp, Glycine max
  Peptide Sequence Number=SeqID_139329
atggatcaatctcacccatatttgagtactcctgtagtaaagcctacctcattaacccaaccaaacgagcctaagtttacagtagagcttgacttacctaatgaagaactcgatacttttagtgaggacgaagacaaacttctacacaatcaaattcaagaggaagatgatgaggaagaagttgagtctgtttcaacaatcacaattgtaccaccatactatataccaccaaacatgcaaaattttgaagaatccaattttcaagattctgaatacagccatagcttggatagcaaaaaagtccaacatctggtggggactctctttgaagggatgtga

SEQ ID NO: 22552 - DNA, 387 bp, Glycine max
  Peptide Sequence Number=SeqID_139330
atgtgtatttcaacaattggtgttcagaagttgtggaagtgggctcatagtgaacaaaatcccaatggaaaggcaattgccagtgttgttccacaacattggcaatccaacattggtcttttgatgactaatgatgtcacgagtgtcaagcttgatgaggttgttccttgcattgcactctcaaagaatgactcatatgttatgtttgcatgtggtggaaaggtttcgttattttacatgatgacattcaagtctactggtaactttagtgctcttttcctaattgctacaactcaaattctgttgtgtctcaagttagcagaggagcttggggtgatagttccaaacccaaactatgcttatgcaagttatttcaccttctattga

SEQ ID NO: 22553 - DNA, 291 bp, Glycine max
  Peptide Sequence Number=SeqID_139331
atgaggttttggaaagataattgggtcccaaatcatggtaagctagatgaatatcagagtggacaaaccggtcacaaggagaacattttggtatgtttttatgtcaatgctaaaggagattgggatttggagcaaattattgtcaatttaccagtgaatgttgttgaaagtataaagacactgaagccgcattgcatggctattaaagatgcttatatcgaattgtctaatgctcccattcttcaagaatctatgttgtttaaaaacatttggcattgtgatggcccataa

SEQ ID NO: 22554 - DNA, 399 bp, Glycine max
  Peptide Sequence Number=SeqID_139332
atggcttttgtcgcttatggtgttgtgctccaatatgataaaggtgattttctgaaagcattttcaaggagacttgggcattgtactattctaaaggctaagctttgggccattctatttggtatgaatatggcctgtgattcgagttataaagcaattattattgagactgattttgttgaagctatcgagcttgtagaggatcctagatatcatgaagaccaatttgtagatctttcctctaagattgtgaagaccaaggaaaagtttacttcatgttccattgtccatgtattgcgccaggcaaatactatggcatgctgttttgctaaaaatgatttaaccattgatagtgatattacccattccataatgaaagggaagcgaggtgctacatga

SEQ ID NO: 22555 - DNA, 303 bp, Glycine max
  Peptide Sequence Number=SeqID_139333
atgaccctttctggggcggtgtcactatacaaccctgatttaactaaaggagcaacagaaagaggtgcttggatacaaatggcggccaacacaagaaacaatgacatttctgccaccaatgatggtcccgtgatgagacttatcaacaagtgcctcagtgccctccgcaagaagttgaatcgcatcctcgccatggaagagacatcaaacagtgatgtgttcgagaagtcccatgacgagttggactttgaattcctaggtaatgttgccgaaaaaccatggcggtttcagatgaacttgtaa

SEQ ID NO: 22556 - DNA, 1296 bp, Glycine max
  Peptide Sequence Number=SeqID_139334
atggctgtttccaagaaaccccgccttaggcttagagatgtggctctgtgccgtctgttatctgtggtgtttgttactttatgtggggttttgcttatgatatttctccttgcatcaaattcaacaccaagtgggactcatgatatcatagacaatattgatgcataccatcatgacttgaagtttgaaaagttgcatgatctcccccatcagaatgacttgtcacttagattggaaaggctaaatgggttgccaccaagaaacttggatttgtatcccacactcgcgagggatcatatcgttgttgttttgtatgttcacaaccggcctcagtatcttaaagtggttgttgagagcctttcgcgggtggtggggattagtgagaccttattaattgttagtcatgatgggtactttgaggagatgaacaagataattgatggtatcaagttttgccaagttaaacagatctatgctacctattcgccccatctgttttctgatagttttcctggtgtctcggctaatgactgcaaggagaaagatgatgccggagaaaaactttgtgaggggaatcctgatcagtatggaaaccaccgctcgccaaagattgtatcgctgaagcatcactggtggtggatgatgaacacaatatggaatgggttgagagagacaagggatcattctggtcatattcttttcattgaagaagaccacttcatatttcccaatgcgtatcacaatctacaggttctaacttcactgaagcctgaaaagtgtcctgattgttatgctgctaatttagcaccttctgatgtgaactcgagaggcgaagggtgggcaactttgattgcagagagaatggggaatgtcggttactctttcaatcgaactgtttggaagaaaatacacaataaggctagagagttttgtttctttgatgactataattgggacatcacaatgtgggcaactgtttatccttcatttggtagtcctgtttacacattacgcggtcctaggaccagtgctgttcattttgggagatgtggtttgcatcagggtcagggggagaataaggcttgcattgataatggcatggtgaacattaatgtagaagagcctgacacagtttctaacattgaattaaactgggaagttcacacctttaagaatcagcctggttataaagcagggtttaaaggttggggaggttggggggataatagagatcgtcacttatgcttgagttttgctaaaatgtaccactccataggcacagcatctccattataa

SEQ ID NO: 22557 - DNA, 2713 bp, Glycine max
  Peptide Sequence Number=SeqID_139335
ttgctactcctctcttggctgcaatgaagaagagaggcaagcacttgtcaatatcaaagaaagcttcaaagatccatcttcaaggctttcctcttgggaaggaagtgactgttgccaatggaaaggtgtagcttgcaacaatgttacaggacatgttgtcaagcttgatcttaggaatccttgctatccactaagggaccaaggatactttcaaccaaactgttccttatacaaaaatgagcttgaagctcaacatgttcatccttctatactgcagcttaaatatctcacttttttagacttgagtggaaacaactttcataatagctccataccaatgttcatccaatctttggagcatctgcaagtcctttctctctctgactctcaattttctgggaggatcccacacatttttggaaacctcacaaaattgaactttcttgatcttagcttcaattatcatctctatgctgatggctctgattggatttctcaactttcatcactccaatacctttacatgagttatgtgtatcttggtaaggcacaaaacttgcttaaggtactcagcatgcttccttctttgtcaaacatagagctggtgagttgcagtttaaacgagctgcatgctcatcaacttgttagagacacaaacgtttccagagtgcaagtactcaatctcgcagaaaatgggcttgaagctcaaattcttgatgtttttcataacatgactttcattacaaagattgacctttctcataacaacttaaattccactccattctggttgagtagctgtagcaaacttgtctctctatttcttgcaagtaatgcttttcatggctcatttccttctgcttttcaaaatattagctccttgactgaacttgaacttgcagaaaacaattttgactctgttccatcatggttaggcgggttaaagggtcttcgataccttggtctttccggaaataacataagtcatattgagggatctctagcatctattctgggaaactgttgtcatcttcaatcattgattatgtcaagaaacaagattcaaggagatgcacttggggggaatatacaacccggatgcattaggtatgatttacaacaattggatttgactaacaatgaacttgatcgtttcccagcatggttggtgcagcttgtaaacctagaacttctggatctttcagaaaactctataaatggtttgattcctcagactattggtcaactaaaaaaattgaacaccctttatcttgataaaaataatttacatggaaacattcctaatagtcttggtcagcttctaaacctgcagaacttagacatctccctaaatcatttagagagcttgatttctgacataacatggcctaagcaacttgtttacttgaacctcaccaataaccatatcactggatcacttccccaagatattggtgataggttgcccaatgttacttccttgcttctgggaaacaatcttataagtggttccattcctaactcattgtgcaaaataaacttgtacaaccttgacctatccggcaacatgttatctggtgaaattccagattgctggagagatagtcaaggacttaatgagataaatttgtcatccaacaatttatcaggtgttattccaagttcttttggtaatctttccacgttggaatggtttcatttgaacaataatagtattcatggggggtttccatcatctttgagaaatttaaagcatcttttaattttggatctaggagagaaccatttgtctgggattataccttcatggatagggaacatttcgtcctccatgcagattcttaggctaagacaaaacaagttcagtggaaaaattccttcacaactatgccaactttctgcactgcaaatcttggacctttcaaacaacgacttgatgggctcaatccctgactgcattggaaatctcacaggaatgattttaggaaagaattctgtcatccaaccaagtaatgggactacatattctgaatggtatgaacaagaagtcagacagatcatgaaaggaacagaacttgaatataccagaaatctaagactgttagtcaacatggacttgtcaaataacaatttgagtggatctattcctgaagaaataacattgctttcagcattgcaaggcctaaatgtatcatacaatcatctgtcaggacatatccctaaaagggtaggagacatgaaatcactagaatctcttgatctctctcatgaccaactttcaggcgcaattccagatagcatatcaagtttaacttcgttaagccacttgaatttgtcctacaacaacctttcaggaccaattccaaaaggaactcaattgtcaacccttgatgatccttttatttatattggcaacccatttctctgtggacctcctctaccaaatgagtgttctgctaatgattccaaacatggcaatgaagatgaagatggcaaagacgataaaatagagaaattgtggttttactttgtcgtagcacttggatttgctattggcttttgggctgtgattggaagcttattgatgaagagaagttggaggtgtgcatactttcaatacattgataagtcaaggcaaaggatgaatgcatcttgggcaatacatttagcaaatttcaaggaaagatttactggaaaccctgttgctgggtga

SEQ ID NO: 22558 - DNA, 1268 bp, Glycine max
  Peptide Sequence Number=SeqID_139336
atggcgtcaggacacatggaagctctggttgggtatccgggcaagctcacccttagggtggtcctaacatgtgtcatggcagccactggtggattaatttttggttatgatcatggggtttcaggtggagttacctccatggattctttcttgaaggaattctttccttctgtctatgaacaagagtctaccatgaaagcttcaacagatagttactgcaaattcaacagtcagatattgactttattcacttcatctttgtatctaactgctcttgtggctggtctagtggcatccagcataacacgattgatggggaggcgtgcaactatgattataggtggcatattctttgtgttaggtgcattactcaatggattagctacaggtttatggatgcttattgttgggagaatgttgcttggttttggtattggatgtgccaatcagtcggtaccaatctatgtctcagagatggccccttataagtacagaggaggtctcaacatatgcttccaattatcaatcaccataggcatcttcatagccaatctcttcaactactactttgcccatatacttgatggccaaggatggcgcttaagtttagggcttggggcagtccctgctgtcatttttgttgtaggctcaatttgtcttcctgactcgccgaactccctcgttgagcgtgaccgtcttgaggaagcaaggaaagaactccaaaaactccgtggtaccactgaagttgatgccgagttaaatgatatagttgctgctagtgaggcctccaaaaagcaattcactggcctaaatgtcatcacattctatgctcctatactattcagatcaattggctttggaagcacggcttctctcatgtctgcggttatcattggctcctttaaaccaatttcaacccttatttcaattcttgttgtagataaatttggaaggcgtagccttttccttgagggcggtgctcaaatgttgatttgtcagattactatggcaatagcaattgctgttgcatttggcactagtgggaaccctgggacgttgccaaagtggtatgcaagtgtagttgttggtgtcatatgtgtatatgtttctggttatgcttggtcttggggtccacttggatggttggtaccaagtgaaatttttcctctggagattcgacctgcagctcaaagtgtcactgtttgtgtcaacatgatcagcacttttattgtagcacaattcttcaccacaatgctttgtcacatgaa

SEQ ID NO: 22559 - DNA, 321 bp, Glycine max
  Peptide Sequence Number=SeqID_139337
atggaggtaaaatcttcaaaagggttggggaaacacttatccaagaatagcatcgagatgagctcaaaggctttaatgttatcttttggagcagtagaatccaaggaaggaaaagtctatctccaaaagtgcaacaccacaataggctctccaccaatctctgaccacaacaagctcaatgcaaagccagcagggccaaaactccaagacttaaatttcccatcatcatctaccttcaatgtgctattgaacctctttgatgaaacaagcatggacctcaaattggtctcatccacactcccttcaagaaacaactactaa

SEQ ID NO: 22560 - DNA, 303 bp, Glycine max
  Peptide Sequence Number=SeqID_139338
atgatgtgggaatgggacgattaccaagacaccatccccaaacacgacctaccccaacccgattcccacctcaaattcgatttcttctccgccctctccaggcccaaggattattacaagatactggaagtggattacgacgccacggatgacgctattcgctccaattacattcgcctcgcgctgaagtggcacccggacaagcacaaagaccagaactctgctacctcgcgattccaagacataaacgaagcttatcagggggtagatgagtcaaaccgggcactagaagctcaagcttaa

SEQ ID NO: 22561 - DNA, 345 bp, Glycine max
  Peptide Sequence Number=SeqID_139339
ttgattgtgctttacgtggttttcaagcttgacgagagttacacgccaagcaaagtttccatccgtgccggtgatggttttcacaacttgaaggagattaagactgtggaacttgtgaagccaactgggtgggtttatccatccttgtctggagttgatcctagtgtggatgagaccaatttgaggtccatgcttgtttcatcaaagaggttcaatagcacattgaaggtagatgatgatgggaaatttaagtcttggagttttggccctgctggctttgcattgagcttgttgtggtcagagattggtggagagcctattgtggtgttgcacttttggagatag

SEQ ID NO: 22562 - DNA, 165 bp, Glycine max
  Peptide Sequence Number=SeqID_139340
atgcagcagcttttgttgatggcacaagaggctcttgcagctggatgtagctcagctaaggaccgactctggaagaaacccaacaagggtggtagaggaggtggccgactatcaggacattcaaacaatactccctcacaacttgataccacatcaccatcataa

SEQ ID NO: 22563 - DNA, 833 bp, Glycine max
  Peptide Sequence Number=SeqID_139341
agtggataaaggccgacatagaggccctgaaagagcaaatggccacaatgatggaggccatgacgagcatgaagaagataatggaggtcaatgcgactgtagttgcctctaccagcgccattgttgaggtggacccgactcccccatctggcctcaaccaaataaatcatccaacctcggatatggtaggcaaagaattgggaagtatgggcgggccccattttgtacaagttcaaaataagcatgccttcccgccatatggcttgcttcccaacaatacaccacccaatgtggtgcacactcccaatgacaatgtcaataactccactcccacactcatggagagccaacaacctcaatctgatcatgcacatgtctttcaacccatgggggagacacatgaaataccccaccacaacctagacgatttcgaccctcgcctcagatatgccactgaggggcaagcagttggtgggagagtccctcctgctatggcgaaaaaagaaaagttggatcagatagaggaaatgctaagggctgttgaagaaggtgaagattatgcctttgctgacatggaagatttgtgcctagtacctgacatggccatccctcctgcttgcattgttgtatacaaagcctatgagaggtcatctaaaggactcaacatcttgcttgcccataaggttaaagccctctggtacttgtacctattggctcgtttcataggactcaaagtcctcaccttcacaggactcaaagtcctcgctttaatctttcataggactcaaagtcctcaccttgatctttcacaggactcaaaatcctcactttaa

SEQ ID NO: 22564 - DNA, 210 bp, Glycine max
  Peptide Sequence Number=SeqID_139342
atgacgatgacggtggacacaactgtgacagtggtgagtgttgccaggtttttctttctccaatgctctaagcgatatcaagctacagtattaggtttttctccgattcttgatataaggtttttctttgcgatgcatcgggatatcaagctcataggtttttcaatgctaaatgaagattacaatgggagtgaagaattgaattcatag

SEQ ID NO: 22565 - DNA, 735 bp, Glycine max
  Peptide Sequence Number=SeqID_139343
atgactgcatcaccatatcgggatgcaaatttggctaggcaacaacagcaacagtcgctagaggtacaggtagagccaaaggcacaacttgagataccacatgttgactgtatcatcggactcctatttggaggaggccctatggatttgtcggtgcttcagtcctatacggaccacatggttgggcatgtatggattgatcaacttagagaagagatgaagcttaagagtctattcgatgcgtggtacacattcgcgattaaaggcataatcaatgcctttattgagagatggttcagttatacctactctttccaccttctagttggagagatgaccatcaccttcaatgatgtgtcatgtcttttacatctgcctatctcaggcagatgttgcaacaagaaatggaaattgagtgtgtttgatttggctacgaaggcgtatttgctacgtttcctcgataataccatatttgccgacaagagcttgacacatcttatctttatgattagttgccgaatacgtgcttgtatggcagcaagtagtgggcagctatatgatgctactaatgcatgggtgtttaagcatcttcctaccattccttgccataagaaggtgttggattttgatcgcaagttacgcgagaagccgcttgcgacaaaatggttgcctttgaggggtaccggtaaagttgttgagaatagggagttgttggatctgttgcagatgactgat

SEQ ID NO: 22566 - DNA, 267 bp, Glycine max
  Peptide Sequence Number=SeqID_139344
atgggcaagcaatggagacattttaagtctgatttgacgatgaaatgggcacctacaaccggcaagggcagtgtcgatgacactgtatgtcaaaagtacgacattagcaaggagaagtggacccaattttgtcagagccatagagacccttcatgggaggatatgagaaaaaaggaacagaccattcacaaacaaaacactgcccctcacgtgttgtctcgtgggggttatgaatatctagaaaacaagttgatggaggagaagtaa

SEQ ID NO: 22567 - DNA, 534 bp, Glycine max
  Peptide Sequence Number=SeqID_139345
atggaggagaagaagaggaagaaaaagcaatgtggaaggagaaagagggctgttggaagtagaaattgtaggatgtcacaccatggctctcgaagacctggagtagctgacgcaaaaaatatgggaccagctgaaggagtcaatcatagaaaaagtgactcaactactaatgttgtccttcaaccagatgaacttgcattgcctcctgagcctgaggttggtccttcagctgctcgtgtcagcacaaaggagagttgtgttgatctcttagggaacgacccagacacggttgtgggaccggggaaacctgcagataggccagatcatgatgtcgatgatcccctatatctgatgacattgaccatcccacaactttttctaaagccgttgcagataaagcatgaagatctttttgaaatagcacacggtggtcaatgtctcagcatctttgttatacaattgtggattctgcatatgaatgagacaagtatacgagcggggaatgccgatgtctatgggttcctcgagccatag

SEQ ID NO: 22568 - DNA, 180 bp, Glycine max
  Peptide Sequence Number=SeqID_139346
atggaagtgtctgaggaagagaatgtctctagacttgaaggatgtggaggaatcatccttgcaccaatatttttaggtttgtacgatgagcatcaggacagatcttcgcttatgggttcactttcatctagcatggaccttcttgttggagtggttattccacagggcttggataaatga

SEQ ID NO: 22569 - DNA, 342 bp, Glycine max
  Peptide Sequence Number=SeqID_139347
atggttgtggagatgaagccaacactgcttagtctgattggttcacacctttttgctggaatggatcacgaagatccatacgcatatttgtctaccttcatggagttatgcagtaccatgggagcctctgacaaagatgttgaagttgcctacctcagagctttcctattctctttgacaggtaaagcaaagacatggctccaatcacatccaaacaaaacttgtaacacttgggaagaagtagaggaaaaattcactacaaggttccttcctccgtccagattcattagtgcaaaattagtcattgctacattttcccaagggtttgataaacctctatga

SEQ ID NO: 22570 - DNA, 420 bp, Glycine max
  Peptide Sequence Number=SeqID_139348
atgcttcagagagaagtgagcacaaagaggaaccatgaagacatgaagcttacctccaacccaacagcgacaatggcaatgagacaggcagtgagaacagcgagactagcagtcatgaaaggaagttgcgatgaagacgatgaacaacaagattggtgcggagttgcgatgaagattggtattaacgagaagacccataaacctgagcctcaaggttttgggttaaagtgtggtgtcaagtttccttatgtagtggctcgtgctacaccggcagtgtgtcccgcggcggtgcaagtaccgtacctagagcatgtgggctctaatggctatactcgtggagggggagcatgtggaagagactcacacttgagggggagattgttggagtacaagtgtgaggtgaagtcctacatcggatag

SEQ ID NO: 22571 - DNA, 630 bp, Glycine max
  Peptide Sequence Number=SeqID_139349
atgggtgtgaagcacaccaccaccaccaccaccacaattcttttcacttcaatgctacttcacctctccatcatagccattgccaacgatccatgcgcttctcaacacgacgacgacgactccgacatcaccatgattcccatctacggcaattgctcgcctttcaagaactactcaacctcgtgggagaacatcatcatcgacatggcctccaaggacccagaaagagtcgtgtacttgtctagcctcgacgcctcattgaggagaaagcccatttccgcagccccaatcgcttcgggccaagccttcgggattggtagctacgtggtccgagtgaaactgggttcgccgaaccaactattttttatggttctggataccagcaccgatgaggcttgggtaccgtgtaccggctgcactggttgctcttcctcctccacctattattcccctcaagcctccaccacttatggcggcgccgtagcttgctacgccccgcgttgtgcccaggctcgtggtgccctcccttgcccctacactggttctaaagcttgcacattcaaccaatcctatgcagggataaaaattgtaaaaacaaagagacatcctcaatattactgtgacagctag

SEQ ID NO: 22572 - DNA, 183 bp, Glycine max
  Peptide Sequence Number=SeqID_139350
atgccagccttgtcggcagagcccaaggagctgatccagctggaaatgcaggcggaatccagctccaaagaggtaatcaaagaccacatgattggtcaaactccaaactccaatcctgaccagtcaagaccccatgcaaatttgcttcagtggcaaggtaacattacattaaacattagataa

SEQ ID NO: 22573 - DNA, 312 bp, Glycine max
  Peptide Sequence Number=SeqID_139351
atggcttcacctatagactttggaatagacacagaatccaaagatgaggcaatgggaaattcagatgtaggcaatggtggtggacaaatgtttggagtagatgatgctggaggactagtaggtggtgctaccagtagtgcctgtgtccgtcagtggtatgtcaatagtggaggtggacttggagcaggagcaggagcaacgagtggttctggaacaacaggtggaacctctagagggacatcttcaatggtggaagaaaagaaaggagtagtctcaaagattgtaacatcagcagagaccagatatcgttga

SEQ ID NO: 22574 - DNA, 684 bp, Glycine max
  Peptide Sequence Number=SeqID_139352
atgaccaagtcttccaatgtcgaagtgattgttgacagaatgattgattacatgattagcataagtgatgatcattataaaacatatatagcatctcgatgtgtcgaacttgcagagcaatttgctcctagtaatcattggtttatacagaccatgaataaagtctttgagcatgctggagatcttgtgaatattaaggtggcccataatttaatgcgattgattggtgaaggatttggagaggatgatgatgctgcatatagtcagttgagatcatctgctgtaatctgttgggttctgggggaatatggcacagctgatggaaagtattctgcttcctatatcactgggaagctatgtgatgttgcagaggcatattcaaatgatgaaactgttaaggcatatgcggtttcagcattaacaaaaatttatgcatttgaaatagcggctgggaggaaagttgatatgctacctgagtgtctatcttttattgaagaactattagcatcccactccactgatttgcagcaacgtgcatatgaattgcaagctcttattggtttggatgcacgagctgttgaaacaataatgccccaagatgcaagttgtgaagatattgagattatagtattattcttagaagtgaaaattggagaccataccatacttcaagtcacagtttaa

SEQ ID NO: 22575 - DNA, 177 bp, Glycine max
  Peptide Sequence Number=SeqID_139353
atggggttcgataaaatctggtcacggactgccttaaggtccatagtaaagggcataagagtagaatattcctctgaaacaagtggtggcactgcacgtgagcctttgagggatttggtgagtatatctgccaatcggtcagtggagctgatgaagtcagtggtgatttccccatga

SEQ ID NO: 22576 - DNA, 852 bp, Glycine max
  Peptide Sequence Number=SeqID_139354
atgactttgcgaggatccttcgcctcaagtctcaccttcatagtcaatttcagactaaggacttgggccccctctggtaattccttggcattgaaattgcccgatcctcatctcccagcggaagttgccttagacattttaaccaagattggtatggctgattgtcgcccgagcgatactcccatggatcctaatatgaagcttcttccgagtcagggggagccatcgaaagaccccggaagatatcgtcgtctaataggcagccttaattacctcactactatcactagaccagatatcacatttgcagtcagtgtggttagccatttcatgaaggaaccatgttgcaaattaatatatggagataaaggcaatgccaaaattgtccgctattttgatgctgactgggcaggatcaccatcagataggaggtccacttgtgttctcattagagagaacttgatctcttggaggagcaagaagcagaaaacagtagctagattcaatgctaaagctgagtaccgtgctatggcagcagttgcattcgagattacatggcttaggcaacttctccaacagctaaaatttggagacactcaggatactagactgttatgtgacaatcaagttgctctccatatttcatcaaatccaatcttccatgagcggactaaacaaatagaaattgactgtcactttgtgagagagaaggtgctctcaggagaaatcatcaccgactttgtcaactccggtgaccaaattgcagacatgcttactaaatccctcaaaggttctcgtgttgacaacatatgtgacaagcttggttcatatgacatatatgttccaacttga

SEQ ID NO: 22577 - DNA, 1137 bp, Glycine max
  Peptide Sequence Number=SeqID_139355
atggagcaattgaagacgatcggtcgcgaactcgcgatgggatcgcagggcgggttcgggcaatcaaaggaatttctcgagctggtgaaatccatcggcgaatcgcgctcgaaggccgaggaggaccgcatcgtgctgcgcgagatcgaaaccctaaaacgccgcatcgcggagcccgacatcccgaagcgcaagatgaaggagtacatcatccgcctcctctacgtggagatgctcggccacgacgcgtcgttcggccacatccacgccgtcaagatgacgcacgacgacagcctcctgctgaaacgcaccggctacctcgccgtcacgctcctcttaaacgacgacgacgacctcatcatcctcatcgtcaacaccatccaaaaagacttaaaatctgacaactacctcgtcgtctgcgcggctctcagcgccgtctgccgcctcatcaatgaggagaccatccccgccgtcctgccctccgtcgtcgacctcctcgcccacccgaaagacgccgtgaggaagaaggccgtcatggcgctgcaccggttccaccacaagtcgccgtcctccgtttcacatttgatctcgaattttcggaagaagttgtgtgataatgaccctggcgtaatgggtgctaccttgtgccctctgtttgacctcattgcggttgatcctagcccttataaggatcttgtggttagctttgtgagcattcttaaacaggttgcggaacacaggttgcctaagagctatgactatcaccagatgccggcaccgttcattcagattaagttgctgaaaatacttgcgttgttagggagtggcgacaagcaggctagtgagcagatgtatacggtaattggggaaataattaggaagggcgattcatcgagtaatatagggaatgctattctttatgggtgcatatgctgtgtctcttccatatatcccaatgctaagttgttagaagcggctgcagatgtcaatgcgaagtttttgaagagtgacagtcataatcttaagtacatgggcattgatgcgcttggtcggctgataaagataagtccacatgttgcagaacagcatcaactggctgtcattgactgcttagaggtgaggatctctttgtcttga

SEQ ID NO: 22578 - DNA, 321 bp, Glycine max
  Peptide Sequence Number=SeqID_139356
atgagcttgctaaatgagacgagctcactaagcgagagctctacaattagactaacagacgtgaacgtgagagacctccaagcaacgcaaagaggagctggcaaagagatatcgatagatgatgggagtttattatctatttacaattttgataccacagttagggtcagggaacccaattatggggattttttcatgaggaaaaatacttgtacttgggggcatgtcactcggtttagaacttccttaagacttaagttgatcaccatgggagagaagttgcttgtgcacgatagggtgatctcaacacttgctgcctag

SEQ ID NO: 22579 - DNA, 330 bp, Glycine max
  Peptide Sequence Number=SeqID_139357
atgtcgagtggtggaaaccttagttgcgtgttggtagctgtggatggaagcgaggaaagcatgaacgcgctgcgttgggcactgaacaacctcaagctccgatcccctacactcgattccaccggtgctccctccttcatcatcttccacgtccaatccccgccctccatcgccactggcctccatcccggtgccatccccttcggtggtgatatcgaagttcctgctttcactgcagccattgaagctcaccagaagcgcatcaccaacgccgtactcgaccacgtcctcggaatctgctccgaattcaacctaaccagatgtttctag

SEQ ID NO: 22580 - DNA, 219 bp, Glycine max
  Peptide Sequence Number=SeqID_139358
atggctattttattgtatacaacgactcccaaatatgacaaagccctaaaatcaaagaacattgagtttgttgtagctccatatgaggcagatggtcagttagcgcacatgtctcagcttggagtaaaaaatggtggagttgcagcgatgatcacagaagatagtgatctaatagcatatgactatccaactgtaagaactcctcccatactgtcttga

SEQ ID NO: 22581 - DNA, 408 bp, Glycine max
  Peptide Sequence Number=SeqID_139359
atggcagagcccatcgagccaatgcaggcagaatccagctccaaagagctaattgaagaccgcatgattggccaaactccaacaccagccacaagtcaagacgtcatgcatgttcaaccactggcttcaagattctggttttggggtgatggatactacaacaaggcaattgtgacgctacaaccaatgaaggtgagtgttgagaaggtttctcaccaaagaagtcagcaacattatgaatcattgtccgccagagagacaaattcgccttatgccaccttgtcggaggaggactcaacagaatccaaatggttcccttttatgtgtgccttcattctcctttactcttggtgttgggtaagtcatgctgcattatttctcataaagctcgatctctttattaattaa

SEQ ID NO: 22582 - DNA, 432 bp, Glycine max
  Peptide Sequence Number=SeqID_139360
atgttggatgatctaattgtacatgtgaatttgcatgtattagtaacaattcatgtgattgcaaatattttagcttctttattttcaaaaggttttgaaatatctcctgaaaaccaggaggaagatagaagcctcaatacatctggagatacaagtgggacagacatgggaaagggtgttggattaaaggatgctgaccaaatgagccttagtgaagactctggagaagatgatgatattgatggtgaagacgaggaacttaattctgaaatgggacccagtagaccaaacaatgaagtagtgggcaagaaagttttgatgagaatgaagatgaaactcctaatgatacaagagaaaagtattatgagggtggagagccaaaattatgcaagtgcatggattcctttccctttccctactacattgttctga

SEQ ID NO: 22583 - DNA, 237 bp, Glycine max
  Peptide Sequence Number=SeqID_139361
atggttttgaattgtggtcacggtcacattaaggttttgacgataatggatattaaggattatgtgatgtggactacaatcattgtgcactcaacctccaaccccagctcctcctctgaccacatccccgctgtcatggactcacccaccaccaatcccaaccaaaacgatgacatagacgaggaggaaaagaagttcaactttgaagacaaaactggagaccacatcacttgctaa

SEQ ID NO: 22584 - DNA, 471 bp, Glycine max
  Peptide Sequence Number=SeqID_139362
atgatgatgaggggtcaaggcatctatagtagccaagaggaggctacctcttctccttcctcaagtggaagtgagggtgaagccaagggtgatgagcatattgaagaggtttacccctatgaagaaggtgatcttctaatggtgagaagcataaggttggtatctaagttgagtctcactatcatttcccacccaaagccttacaagcttcaatggctcaatgagcaaggggaaatgatagtcaatcaacaaaaagcaatccacaatggtctcaccaatgaaaaaaccctcacccatggaagcaaaaagttcaaacttgttcccttgacaccttcacaagtggttggggatcaagtacaaataaaactcaaatgggatgaggaaaagaatagaaaaagaaaagaggaacaacctttaatagttaaggaggagtgtaaggaggtaagtgtctcctccaagaggttagcttaa

SEQ ID NO: 22585 - DNA, 666 bp, Glycine max
  Peptide Sequence Number=SeqID_139363
atggaggcagagaaacttgagctagagatggatctaaccgagtgcgaaaagcagcttcaagcatcactgagtaggataaaggaagtggagttggaggtagtagagctccaaactaagttggctcttgcaaacaaatcaaacgaagaaccatacgagaaactaaaagcaactcatgaaaagaaagagatagatgagtcaaaactcagagttgctcacactgaagcagaagaattggttttgaaaatttgttcattagaggaagagattgagaaagaacgagctttgtccgctgagaatttggccaagtgtggaaagttggaggatgagctcttgagaataaagaatgaagctcaactccaaaaagacactgagatttttcatggagaaggtgttaatagtgagttaaagcagactggcaccatcaactctatcgttttcaatgtgaatattgtcaagtgcatgatgcttaaaggcttaaagctaagagaaggaactagcattggctacaattgtaaatttgctgaatgccaaaaaaccatcgaatctcttggactgcagttaaagtcccttgcaacattggaagactttctacttgattcagagagccctatggagttagcttgtgaagttacaccaggtcagttagccctatggagccctatgtaa

SEQ ID NO: 22586 - DNA, 330 bp, Glycine max
  Peptide Sequence Number=SeqID_139364
atgggagccgatacaacaggaagcaagacagggcacagtagctacaagcaaagtactacctgcaatttgcattgcaataaaggacagaggcaggatcaagcagcgcagcaacaaaagaggagttggctatggcgcaggatgtcgtctaagaaaaatctgggtgaaattgagagttctggctcaatgtcgtctcattctgaaagattttccgatgatcaggtatatcccacccaaactactccgtctccagaaggcacgtgtgaggctgcaccaaatgatgaagttaatgatgtgaagactctgacagaaagattactgctgctcttttaa

SEQ ID NO: 22587 - DNA, 2429 bp, Glycine max
  Peptide Sequence Number=SeqID_139365
atggaagaacaacagttgaaggacttgaagataaagaattatctctatcaagcaattgatagagaaattctggacactattctaaatgatgagatgtctaagaatatatgggattcaatgaagcagaagttccagggctcaacacgggtgaaacgagcgcaactacaagccttatgcaaagactttgagatgctgcaaatgaaggagggagagtcagtgaattcatactttgctcggacgttgaaaatagccaaaagtatgaaagcatgtggagaaaatatgcaagagagtgtcataattgcaaatattatgcgatctatgacaacaaagtttaactacgtggtgtgctccattgaagaatccaacaacatggatactatgacaatagacgaactgcaaagtagtctattggttcacaagcagagaatgatgtttccagcagaagaggagcgggtcatgcagatggtggctgatgagaaaagtggaagaggaaggggaagacaaacattcaacaaggctgaggttgaatgcttcaaatgccacaagcttggacactttcaatatgaatgtcctatgtgggaaaataaagcaaattatgctgagatggaggataaagaggaacaagaggatgagctcttgttaatgaccttcgtagactacaaagaagggaagaaggatgagtggtttctagactcgggatgtagcaacctcatgagtagtaacaaggaggaaacaacaccgaaatgcaatgccaaagaaaagtatatggagagcatcaaagaagctacagctgaaactctttctttcttcaaaagtttcaaagcactggtggaaaaagaggttggagaaagcattatgtgcttacgaacagacaggggaggagaatttacttccaaggcgtttgaagaattttgtagaagccatggcataaggagacaattgaccgctgcctacactccccaacagaatggggttgttgagagaaaaaatagaaccatcatgaatatggttagctcaatgctgagtgagagacaagttcccaaaaacttttggccaaaagtaacaaaatggtgtgttcacattctgaatagaagtcccacagcaacagtgcaagacaaaactcctgaagaagcatggagtggaattaagccttctgttgattattttcgagtatttggttgcctagctcatgttcatacaccagaccaacaacgggttaagttggatgacaagagtaagcaatgtgttttgtttggagtcagtgatgaatccaaggcatacaaattatttgatccagtcaacagaaagattataattagcaaaggtgtaatctttgaagaacaaaagaactggaattgggagcagaatgaaggagaaaatcaacaagacattgttgacttgggggaaaatgaagaatatgacactgaggaacagcctgaagatgaagcaaacagtgaggagcaacaacatgaaacagagacaccaaattatgaagaaggagaaggcttatcagatgatgataatacaaatgcaatgctagtaactgaagatgatccagtgacatttgaagaagctgttaagagcaagaaatggagagatgcaatggtaaaaaagatggaggcaatagaaaggaatcaaacgtgggagttgactaatttgccaaaaggagtaaagccaattggagtaaaatgggtattcaaaaccaaattcaaagagaatggagaaattgacaaatttaaagcaaggttagtagaaaaaggttatgcacaacactatggagtgaactacacagagttggatgtgaaaagcgcatttcttcatggagagctcaaagaagagatatatgtacaacagccagctggatttatgaagaagggtaaagaagaaaaggtgtacaagttgagaaaagcattgtatgggctcaaacaagcaccaagaaactggaagtatgctcaggaggtgttatctcggtttggcatgaaggattgtaatacattcaagaatccgattgttccaggaacaaagttgtcaagtaatgatgcagggactaaagtggatgctacattattcaaacaagtagttggaagccttatgtacttgactgcaacccaactagacttgatgtatggagtcagcttaataagcagattcatggctaatcccacaaaaactcacttgtttgcagccaaaagaattttgaggtacctaaaaggcactactgaatttgggatattctacaagaaaggggaaaacacaaaaatagttgcttatacagacaatgattttgctggagacatagagaataggaagatccacgatgtcggatacaatgtccaggacatcctgcccgaaaatactggagttgctgcacaatgcacaaggcaagataaaagaagtgaagctgcaggatccacgatgtcggatacgat

SEQ ID NO: 22588 - DNA, 129 bp, Glycine max
  Peptide Sequence Number=SeqID_139366
actgatccaataggagctaccccacaggtgacaccagtgccagaccagcctctttctcaggattcatcagcaggcactactgcactggacctgaatgagcatgccatggactctgcacaagattattga

SEQ ID NO: 22589 - DNA, 147 bp, Glycine max
  Peptide Sequence Number=SeqID_139367
atggaaactctagctcaaagggtggatgatagagttgtcttaacagacattattggtacacttcatgcacttggaaatgaggtagaggtacttgtgaatggcaaaccaacaaaaataaggagattgaaattgctactaaaagagtaa

SEQ ID NO: 22590 - DNA, 150 bp, Glycine max
  Peptide Sequence Number=SeqID_139368
atgtgtcacaattatgaggaaaattggggtatgaatcaagatatggtgcatggtggtagagaggcaggtattttaattttaatgaagttagaccattggaagcagagagattcaaggcacttcgcatacagtgggcacagtattatctaa

SEQ ID NO: 22591 - DNA, 2811 bp, Glycine max
  Peptide Sequence Number=SeqID_139369
atgggttctggaaagtgccaaattgttcattggcgtcaagatcacaaagataaatgccatcctcccagcccaacttgccagacggaagatctggttagtgatcttgggaagaaggtagcagaaccagactatcgtggagtccatgatgagaagtctcagattaaaagcagagagtatgcaacatcatctgacaaacccctgttgtctgatatgaggtgttctcctgatatttcatgtgcaagggatgatagtgtaagagttgagtctcttcaagagggaaatgttacaggctctaattctgaattatctagtaactcattctctggattctcagcttccactggtgctagtgaatcatctgatgattcttctgtctgtgagagtgtcacctccaatgagcatgagagatgcgagggacatatttttgtggaccccaccattgacattttttataccacttgtaatagcattggtgaatccattccattatcacctaagtttgctagtttggttgatttggttgatggtaatcctgcaatgcataaattaaatcaaattaggcctgattttagtaaacaagagagtaaactcacattaaatggtagttctggtttgtgtatgtggaaaggggcaacaattgagcctattacagtgtcttctggattctggaatacaactcttgattcaacgaggataaaagatgactctaatagtgaccctcttgcatcccactatgatgattctgctccaaagtcagttaagaataatatgccatgtgcaagatcagcatcttcagaaaatgagggtgttggttgtgctgatgctttgagcatccataatttgcaaacagttggtttgagggtatcaaatcatgttatcaacactggtagcaccttgaagtcagctcaaagtagatgtctgccacatgcatttgctgatactaagttagtttctagaaccgaagagcattcacattacagtacaaaatgtgggaataatggcatcatccaatctggcagtgcaacttcaaattcaaagaatgacctgaaaacatctgttctaaaagtttctgatcagcttagaggatcaaagttgtctaaaccctttccatcagctgttgggagtgatattactggaaaatacagtgataagggtctttttccatatgatttgtttgtcaagctttataactggaacagagtggagttgcaaccatttggtcttataaactgtggaaacagctgttatgctaatgctgtactccagtgcttggcagttacacctcccctgactgcttatttgcttcaaggacttcattctaaatcatgtgcaaataaaaaatggtgtttcacctgtgagtttgaaagtttgattttgaagtcaaaagacacaaactctcccatgtcacctctgggcattctctctcaactacagaatattgggagccaacttggtaatggaagagaagaagatgcacatgaatttctaaggcttgttgttgagacaatgcaatctgtttgccttatggaatctggggataacatgtcagattcattgaaagaggaaactaatttaatgggcctaacatttggaggttacctccaatcaaagatcaaatgcatgaaatgtggagggaaatctgagcgtcaagaaaggatgatggatctgacagttgagatagaaggggagatagcaaccctggaggaggcccttcgacagtttacaagtgctgagactctggatggagaaaacaagtaccgatgtgtcaggtgtaaatcttatgagaaggccaagaagaaaatgacagttttggaggcacctaatgttcttactattgcattaaagagatttcagtccggaaaatttgggaagctcaataaacctattcggtttcctgaaatactggacttggcacctttcatgagtgggactagtgatttgcctatatacaggctatatggggtagttgttcacctggatatcatgaatgctgctttttcgggtcattatgtgtgctatgtgaagaatttccaaagcaggtggttcaaggttgatgacagtgtggtaacagctgttgaattggaaagtgtcttggcaaaaggagcatacatgcttttttattcaagatgctcacctagagccccaagattaatcaggaacagtatagtatcttcagactcaaaatggaaactcaatggaaaaactgccacaatgaagtcaaggcgactatccacaggtgctggtgttaatttgacttccccaggtggttcagcttccttagatacactctattcgaagtttctccactcaaaaaggattttggaagaagattcatcaagtgataactcatcccttatcagcagcaattctgatgaaggttcttgcagtacagatagcacggctgattcaaccagtacagatgactttgctgattatatttttggtgatgtgggacgtggtgcaggtggcatgttgagaaattctgattccaacatctgccctgcattgccatcttttccccactctggatattttccctcttctgatatagaccaacatgattcagtagttttgccacattcgactgggttccagccgtctccttcagaagagggtcttttgtacaggaacagagtagtggatgttaaaaggagtgggggaggtgtttctcattttcatcttgacacaaatatagagcataggaagttagatacaagtagtagtagtattagttttagggagactgattctgtatttaatgatagaaattctggtgtatcatgtacaaagtctaggtacagaacggattga

SEQ ID NO: 22592 - DNA, 261 bp, Glycine max
  Peptide Sequence Number=SeqID_139370
atggacaagctcatccatgacgacaagggagccgtcaccatctccaacgacggcgccaccatcatgaagctcctcgacatcgtccacctcgctacaaaaatcctcgccgacatcgccaagtctcaggactccgaggttggcgatggaaccaccactgtggtgttgcttgcagctgagtttttaagggaggccaagccattcattgaagatggtgttcactctcaaaactttataaaattaatattttatataataaattaa

SEQ ID NO: 22593 - DNA, 537 bp, Glycine max
  Peptide Sequence Number=SeqID_139371
ggtacatcctttgtggtacaagtagagggtacatctacttgggttgttgtaactgagaacaagagagggtacatctcttgtggattagttcaagtggagtgtacacccacttggttgttcaaagagaacaagggagggtacatcccttgtggatctttgcttgtaaaggttttgacaaggttgaaaagaaatctcaaggaccgcagtcaaggccacttgatccaacacccacatggagacttttcgtacatcgagttccgatgtcgctgcaagcttgcacattactgctttatagaagaggagcaagatggtaagccgtggtaccatgacatcaagcggtacatagagtgtaaggagtatccacaaggggcttctggcaacgacaagaggatgttgcagaggttggaaactagtttctttctaagtggggcaaaatggagaagaagaagagttgagaggagacaccacttcaaggagaagatgagtctagaagaagctcaccaccataggaaggcatggataagagcttcaaggtag

SEQ ID NO: 22594 - DNA, 214 bp, Glycine max
  Peptide Sequence Number=SeqID_139372
caccgaacgaccaacgtcatcctgatactgccgaatttgttcctctcggtcgacaaaagactctatcgtctccggatggcgaaaaggtgcggaatgaccataatttgcctccgcatgtcatcgggctcgccgcctctggatggaaaaaggtgcaaaatgaccataatttgtctctgtgtgccatcggacacgatcgtctccggatggcgaaaag

SEQ ID NO: 22595 - DNA, 276 bp, Glycine max
  Peptide Sequence Number=SeqID_139373
atggaacatacgaatttggggatcccagggtcatgtggctccgcatgcccccggcctctcgggtcatgcatttcatttctaaatgaccatttagaggaaacactgggtccaacaaagataggagaaaatcactcaaagtgtatcaatctcacacaggtcaaggtttatgataagttgggattttggctcaaggcttgtagaacgactggtcatgatatatgtcagggtttggccagcggttcggggaaaaaggggatgatacacgtgcaacaatga

SEQ ID NO: 22596 - DNA, 571 bp, Glycine max
  Peptide Sequence Number=SeqID_139374
atgaattcctcctttttttatattcttgtctttgtccagctttggttgttcagcttaccatgcagagagagtgtgtgtatcccaagtgagcgtgagacacttttgaagattaagaataatctcaatgatccttcaaataggctttggtcttggaatcataatcataccaactgttgccactggtatggagtcctctgccacaacgtcacttcccatgttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcaggtatggcaattccttctttccttgggacaatgacttccttgactcacctcgacctctctcttactggattcatggggaagattccatctcagattgggaatctctccaatttggtctatcttgacctcggaggttattctgtcgagcctatgttagctgaaaatgtagaatgggtatcaa

SEQ ID NO: 22597 - DNA, 552 bp, Glycine max
  Peptide Sequence Number=SeqID_139375
gcccttagggcagaactcgagaaagcccaaacagtcaaagaaaggttcaaatcagcagctcttaagatccgaaaggagaatgccgaactgagagacggaagaacacggctgaaaaaattccgaggggctttgtgggacaataacagagagcttaagctctggagagaggaaagggaccaatcacgagtagacagtttgatcttgaaggatgggttaaaggtttgcctaaggtccaagagaagcttgtctcaatgtttatgcgagacaaagaccaacatgttagccatcatcagcaagtaccaagaagaattaaatctagccacggcccacgagcacaaagtggcggacgagtatgcccgagtgtacgcggaaaaggaggctaggggaagggtgatcgacacgttacatcaagaggcaacaatgtggctggaccaatttgctcttactttgaacgggagtcaagaacttccccgattgctggccaaggccaaagcaatggtggacacctactccgcccccgaggagatccacggacttctcagctattgttag

SEQ ID NO: 22598 - DNA, 235 bp, Glycine max
  Peptide Sequence Number=SeqID_139376
atggcacgcagcgtgtttactctgtgcccctattttagggacctacatgggaggaaactaaaagggcttttagtgataattcccaaggtggtcatatctctcttgatggtctctagagggctcacgggtgcgtcttccaagaaaggaaaatgtgtggagtcaccaccaacgtttattcgaggaaaacgttggaaaaaccggaaaaaacgtggtctacgagctttaagtgtgaaag

SEQ ID NO: 22599 - DNA, 219 bp, Glycine max
  Peptide Sequence Number=SeqID_139377
atgactccattgatgaagaagatccaaggcctacaagctccacatggagctacatcaggtggttctattagtttgcaggatcatgccactcacttctcagaggagcttggtcaatctgcatgcttagatgaggtctttcagcaaactcatttacgaaagaatattggtcaattttgttggacaagtggcctcaataacttaagaaggggggtgaattaa

SEQ ID NO: 22600 - DNA, 246 bp, Glycine max
  Peptide Sequence Number=SeqID_139378
atgacaagcagagaccaagtttggtcattctgcacccttgtatcatccagaggcggcgggcccgatgatacgcggaaatacccgagtgaggctgacacagtcttctgcaccttttgttcctccgggaacaacaagtcatttacatgcggaaatttcatggtcacccgcgactctcgtcagccgagaggagcgaaattagtgtcatacactgattttcgtccgggggacctttgcttgatgacgtga

SEQ ID NO: 22601 - DNA, 507 bp, Glycine max
  Peptide Sequence Number=SeqID_139379
atggtcatccgccacctttgtcatccagagacgacaagtccgatggcatgcggagacacatatggtcatctgccacctttgtcatctagagacggcaagttcgatggcacgcagagacaacatatggtcatccgccacctttttcatccagagttggcaagtccgatggcacgcagaaacacctcatggttatccgcacctttgtcatctagagacagcaagtctgatgacacgcagagaccaatatggtcatcttctccctttgttgaagacacgaggtctattgaccaagactactttagtctcccttcgtcgtccagagacgacaagtctgatgacacgcagagaccaatatgtttatctgctccctttgtcgaagactcaatgtctatcgaccaagactactttagtctcccttcgtcatccagagacggcaagttcgatgacacgcagagaccaatatgttcatctgctccctttgtcgaagacttgatgtctattgactga

SEQ ID NO: 22602 - DNA, 429 bp, Glycine max
  Peptide Sequence Number=SeqID_139380
atgacatgtggagaccaatcatggtcattcgccacttttgtcaacgagaggcaagcgagcccgttgacacgcagataccaacatggtcatctgcaccttttcatcaaagacccaacgtctgtcgaccgagaatactttagtctgcatcctgccatccagagacatgcaagtccgatgttccctttggtatctggagacaatcaagttcgatggcatatagagacaaacatggtcgtctgcttccctcgtcgaaagactcaacgtctgtggatcaagattaccgacgttttccctgctatctcgagacaagcgagtccgatagcatgcggagacgtcacggtcatctatttttgtcactttcaaggcaccaaggctcttgctgttgcacctgatgtcttttatgctatttcttttgacatgtttcgctaa

SEQ ID NO: 22603 - DNA, 300 bp, Glycine max
  Peptide Sequence Number=SeqID_139381
atgattggtctctacgtgtcatcggacttgccgtctctggatgatgaaggtgagactaaagtagtctccatcaacgggctcgcttgcctctggttgacgaaggtggcggatgaccatgattggtctttgtggtggatgaccatgattggtctccgcgtgtcatcggacttgtcatctctgcatgacgaaggtgagactaaagtagtcacgatcaacgggctcgcttgcctctggttgacaaaggtggttgatgaccatgattggtctccgcgtgtcattggacttgccatctctggatga

SEQ ID NO: 22604 - DNA, 1090 bp, Glycine max
  Peptide Sequence Number=SeqID_139382
atggagttagagcaactcgatgtcaaaactttctttctccatggaagattggagaataacattttgatgcaacaacttgagggttttgagaaggaaatgagccaaaaacatgaaaatgggggtgtatctagcattgggcccatctgggcccatctagaagattatgggcattttgttgcttcaggtggaagtaacccagggaaacttcatcaagaagcaaccagctcggcgagctgggcggggctcagcaccctgggtatccagaattcacttaaaattagtgagaaaaagaagaaggagaaaatcaaagccgaggagctttcgtatcgctttcgtgacgtttcggtgatcaatttcgtggacgttcttcaccgttcttcgttcattcttcatccttcgtcgatcttcaaccagttagcttttgattttgaagccttgaattcattctatgcaccctttggacacacccttggcccgcacgagaggccttttcgtgcccccaccagagggcaggttgtgacgagattgaagaggcctctttatgggctaaagcaatcaccaagacagtggtacaatagattcgatgagttcattgtctctcatggtgaatttgagataaaggacatgggagcttctgaaaagattttggacatggagatcaagaaggatcgagtccaaaatcactactcagttgagatgaaggacatgggagcttctgaaaagattttggacatagagatcaagaaggatcgagtccaaaaaatagagaaggaatacatgtctcgtgttccttatacaagtgttgtaggtagtcttaggtatggtatgggtatagttgatattggacttgtctaccatgacagattctatgctctcgttggttactcagattttgactatgctgcagatttggatgcaaagagatttatgattagtacaatctctttagccaaggatcaagttcatcataagaggactaagcacattgacatcatacaccacttcatttgttctgagaagagggtcaaagtccagaaacttgatacgagggagaatccaactgatatgttcacgaagcctgttacaagaa

SEQ ID NO: 22605 - DNA, 231 bp, Glycine max
  Peptide Sequence Number=SeqID_139383
atggtttcaaaaggtttttcttattgggttgaaggtggagttatgcagatcataggaaaagggaaccatgtgtccaatgtcttgattgataattttttgtggcatctatgtctgggccacatgagtgaaaaaagccttcatattctgagcaagcaaggcttacttgaaatcacaaggtggaacctcttcaattttgtgagcactgcgtctatggaaagcaacatcgaatga

SEQ ID NO: 22606 - DNA, 309 bp, Glycine max
  Peptide Sequence Number=SeqID_139384
atggtgctcaacataatcaagattgagaaattcacaaggaagaataactttaacctttggcacatcaagatagagcttcgactaaaggcatttgggaacgaggatgaagcctttgtgtttagagtatcgatgactgattctactaaacggcaaaagaagaagaaagacaaaggtggaaaaaagagcaaagctaatcctaaggacatttgcaattactgcaaaaaacttggtcattggaagcgagactgtccaaagaaagcaaacaaagattttgttgttgctcttgttcaaaatgactcctcatcgtaa

SEQ ID NO: 22607 - DNA, 201 bp, Glycine max
  Peptide Sequence Number=SeqID_139385
atgaccataacgagtcctaaaagcagtctttggtatatcctcagacttcactcagatcttatgattgggttcatggttcatcaattgggagaccatgccaatcaatggggaaacacatggatgcagtggagccctaaactacaagggatagataaaggaatgttcatattgagaatatggtgttggccctctgcttcatga

SEQ ID NO: 22608 - DNA, 459 bp, Glycine max
  Peptide Sequence Number=SeqID_139386
atggtgtttgatttaggacctgcaaagtgttaccgacaaattaaaaacaagtcgtactcgaaatcgcggttttgccacagtgttcctgatcctaagaccaggatttatgatgttggcatgaagaagaaaggtgtcgatgagtttcctttctgtgtgcatttggttagttgggagaaggagaatgtctcgagtgaggcgctggagggtgcattccacttgagagtcagggtgcatcccttccatgttcttaggatcaacaaaatgctaggtattattcttttggggttcaccaagtttggtcgtaatgattatttgaagtttaagtcagagtacaagattatgtcggatggtgtaatgccaagcttcttgggtgccatggaccattggctaactgccaaccaggaagagcttgtttgtctagtgatactgcatagtgtgcttgttactaagaaatattag

SEQ ID NO: 22609 - DNA, 516 bp, Glycine max
  Peptide Sequence Number=SeqID_139387
atgattacctttctaagggaaggaacatttctgattgagattgccctgaatgtttatgttctgctagcaccttccatgcctgtatggtccttggtgaggaggtttgatcagccacagaagtacaagccatttataagtagatgtgttgtaaggggaaaccttgagattgggagtctgagagaagttgatgttaaatcagggcttcctgccactacaagtacagaaagattggagctccttgatgacaatgagcatattctcagcatcaggattattggtggtgaccatagacttaggaactactcctctatcatgtccctccacccagaaattattgatggaaggccaggtacactggtaattgaatcttttgtggtggatgtacctgagggcaacaccaaagatgaaacctgctatttcgttgaagccttaattaagtgcaatctcaaatcacttgccgatgtctcagaagggcttgctgtgcaggattgcactgaaccaattgatcggatctag

SEQ ID NO: 22610 - DNA, 366 bp, Glycine max
  Peptide Sequence Number=SeqID_139388
atgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtgcgaaaagagtagcgcacggatcatctgttgcttacccgccctctgtgtttggttggtttcacacttgttccaacaagacacaagacatccatgtccgctcctga

SEQ ID NO: 22611 - DNA, 255 bp, Glycine max
  Peptide Sequence Number=SeqID_139389
atggaggctttggaggaagactatggagatggaaatgggaaaaatgaatcaaggcaatatattgagggtctaaagctactatgtcatcatggacctcatgtatcaaaagcaaatacaaatggtaatgatgctgatgttgcacctaaattttctcctttgaaaattgttcaatttggaaatccttctcaagacactgttgacccaagagatggagactttggaggaagactatggagatggaaatgggaaaaatga

SEQ ID NO: 22612 - DNA, 545 bp, Glycine max
  Peptide Sequence Number=SeqID_139390
ctggaggagaagtgttcagagtcaggcctggtgtagtcgggtcctctggtatctctaggataggagtggaggggtctgattgcaagtcgcaaggtgtgccatctgtggtggagctcatgattctggctgttgtatccccaatgaagaaccaactcatgaagtcaattatatggggaaccagccaagacacaatttcaatgcagtatggacagtggagaaatcaccctggaaatcctttcaacaaagaccagggtggaccgtccacaaggatgcaacaacaagggcctagtctctatgatcgaacaacgaagctggaagagactcttgctcaattcatgcaagtatctatgtcaaaccataagagcacagagtctgccataaagaatctggaaatccaagtggaacaactggctaaacaattggcggatcgaccatcaagcagctttagtactaacatcgagaaaaatccaaaagaggagtgcaaagctgtcatgacaaggagcagaatggcaacccatgttgatgaaggaaaagctgataagaag

SEQ ID NO: 22613 - DNA, 330 bp, Glycine max
  Peptide Sequence Number=SeqID_139391
atggatgaattaaagcgcctaagcatcccctcagaaatgcttaaattctttaaccactctagtttcccacacaagggacatccgacaaggaaaatcagcatgcaacagggacaagcagatattctcatagctaggttccttgaccctaactatggtgtcaaaatgggttcctctcggtgtggggtttcaacggaaaacaacggtggtccgtggtggccaccggtggttgtgggtggtggagaagaagcttgggatgttggaaatggttttggaagaaagaaggagaagggaatgacgtttctccaaggctacacgaaaaacaatgtctga

SEQ ID NO: 22614 - DNA, 192 bp, Glycine max
  Peptide Sequence Number=SeqID_139392
atgaataggattgggaacggaggaggaggaggaggaggattgagcaacgtggagatggagtacataagaagacaccacaggcacgagcctggtgagaatcagtgtggctctgcgctcgttaagcatataagagcaccggttcctcaggttttggaagcgaatgtttgtattaggagcgtaagttggaggtga

SEQ ID NO: 22615 - DNA, 387 bp, Glycine max
  Peptide Sequence Number=SeqID_139393
atgcctcccgtgaagcattttgttagagctgagatgctgcctagtgggtacctgatcagaccttgtgaaggaggtggttccatcatccacattgttgatcatatggatttaaagccatggagtgtgccagaggtgctacgtccattgtacgaatcatcaacagtactggctcagaagacaactatggcagtatggggttttaatgaggcactcaatgggtttactgatgagggatggacaacaattggcaatgatggtgtagatgatgttactattctagtgaattcatccccggacaagttaatgggtctgaatctttcctttgccaatggatttccatctgtcagtaatgcagtgctatgtgccaaagcatcgatgctattacag

SEQ ID NO: 22616 - DNA, 612 bp, Glycine max
  Peptide Sequence Number=SeqID_139394
atgacaaccagaactgaaaataaaatgctgaaattagtggctttggatagatatgcagttggtaaacatcattttgaagtaaagaagaggcgtgattcaaaagtcttcagctatgcatcaatcattgccatgacaaataggttctctgtagaaaacaagttaggagaagggggttttggactagtatacaagggaaaattgccaacaggagaagatatggcaataaaaaggctatcaaaaggttcagggcaaggagctatagagttcaaaaatgagttaaacctcatatctgaactccaacacatgaatgttattcagatattgggttgttgcatccatggagaagaaaggatgttaatctatgagtacatggctaacaacaacttggacttttttttatttgatcacaatagaagaatgctactagattggaagagacatttcaacataattgaaggaattgctcaaggattgctctatctccataagtattcaagattgaaagtagttcacagagatttgaaagctagtaacatacttcttgatgaaaacatgaatcctaaaatttcagattttggcacggcacgaattttcagccctcaagaatcataa

SEQ ID NO: 22617 - DNA, 333 bp, Glycine max
  Peptide Sequence Number=SeqID_139395
atgcaggacttgcatccagtgtattgggcaagtggattgttgagaaataagagatttgagcatattccagaggaagttcagctcatgtatgaatacaacattgtgtccaatgaggaagaagactcattcagctacacaaccccaaatggtgtatcacaatgggtgttatttcacaatggtcagctaaaggacacaactaggggaagtgagattgctagagctgacacattttatggctacaacaccgatggtggttgccagagatgggaacaacccacatgtaggaagaaatcatatcaaagaggtactgcaacaactcaagcaaaatcttaa

SEQ ID NO: 22618 - DNA, 201 bp, Glycine max
  Peptide Sequence Number=SeqID_139396
atggctcaagaatcatcagaaattgcattgcaaggtgaaataatctcgaaaaaacttttcatgattcaaaatcatgaagaagccattaagacaacaactaccatattgacagatccttcaatggatacaatgtgcaagttggctaacgatggagcaagatcaaagatgaagaagacaactcaagaaagtcgtatgacatag

SEQ ID NO: 22619 - DNA, 258 bp, Glycine max
  Peptide Sequence Number=SeqID_139397
atgtccgctattgattttttgcggagtcaggccaatgtttttctaaccgaggtaatgagaacatgccagtgtcggccgaaacacaacttcggttccgctcgcacgaaatgccaacgccgacctacattgctaaaggtccaattggagaaggacaaagcccccgagtggagaaggatgaaggcccaagtggagatggatgaaggcccagaggcagagacactatcaagactattaattgttgctgaaggcccaaactaa

SEQ ID NO: 22620 - DNA, 780 bp, Glycine max
  Peptide Sequence Number=SeqID_139398
atgactgattctactaaacggcaaaagaagaagaaagacaaaggtggaaaaaagagcaaagctaatcctaaggacatctgtaattactgcaaagaacttggtcattggaagcgagactgtccaaagaaagcaaacaaagattttgttgttgctctggttcaaaatgactcctcatcacattgggttgtgacatatgagaagaagtttggtagtaatgtccttttgggtaaagatgatccttgtaaatctatcagtataggttctatacaaatcagaatgcatcatggtgttgttagaaccttaattgaagttcgtcacgttccaaagcttaagaaaaatcttgtatttatgggtgccatggattcaaaaggtttttcttattgggttgaaggtggagttatgcagatcagaggaaaagggaaaaagcaacatcggatgaagttcccaaaggttgagcacacaataaaggccatgttggactatgtctattttgactgcttggggccttcgagagctccatcactaggaggggcaaggtatttcctctccatcattaatgatccttccaggatgacatggacttcaagacccctattcgcgtatggtcacaaaccttttgaatactcaatgctaaaggtgtttggatttcaggcatactatcacgcaagtgaagattttggcaaggctaaggatgtcactaagcaggtggagtttgagagctccactataaaaaatattagtgatcagaagcaatttgaagcacttgatgagactaattag

SEQ ID NO: 22621 - DNA, 430 bp, Glycine max
  Peptide Sequence Number=SeqID_139399
atggccatgaatgaaaagatggaatcccttcacaaaaatcagacttgggatctagttgagctacctgaaggcaaacaagtagtgggctatagtcagaaggaaggagtagacttcaatgagatattctctctagtcgttcaacatacctccatatgtgttttgttggacttaatggcaactctagacactgagttagagcaactcgatgtcaaaacttcctttctccatggaagactggagaatgacattttgatgcaacaacttgagggaggaagcaacccagctcgcctgggcgagctgggcggccaccacctccctcattttgctataaaatgtcataggggggctgagaggaaagggtctagcaccctgggcaagcatatttcacttaaaattagtgaaaagaaggagaaagaagaagaaaatcaag

SEQ ID NO: 22622 - DNA, 306 bp, Glycine max
  Peptide Sequence Number=SeqID_139400
atgcccttttgcgcgtttatgtccgcattgcgttatcacgcatgcgttgtattttggtcccatcatttcgtcacgggaagtcgaaaggtccgtgtcgccttcttaagtgcatacatggggcactgtgctgccaaatattgcaagaaaggatgcactttacggcacccttaccgaacacgtgctagagctagagtaatgggtgaattagacgaggtgcaagcacggataaaagtcgacttagaggccatgaaagagaaaatagccacaatgatggaggccatgatgagcatgaagaagataatggag

SEQ ID NO: 22623 - DNA, 288 bp, Glycine max
  Peptide Sequence Number=SeqID_139401
atgttgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacgcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 22624 - DNA, 219 bp, Glycine max
  Peptide Sequence Number=SeqID_139402
atgcaggttccagattttgatgatgccgaaaagaattcacttgacaatgattgtcatcacccaaaaggggaagaagaatcaaatgaggttgcttcaacaaacattcaaagattaagcattgctttaagactaatacaaggtttcttcgacaagcattcaaatattaagcattgctttaagactaatacaaggttgcttcaacaagcattcaaagtttaa

SEQ ID NO: 22625 - DNA, 826 bp, Glycine max
  Peptide Sequence Number=SeqID_139403
atgctgaatattagccgcgaactgccgcaaaacgtgacgcagcaggaagtgaaacagctggcgtggcatctgcagcagctgctggagacacagattcagtcctcgccgtacgcgaaggatgatgcgctggtaaagcgcgagcaggcgctgattaaccaaatgccgctgtcgcagcgcgtctacggacgtctgaagcgcctgctgcagcgtgacggcagcctgcaaccggtcaccctcgcggcgctgggcgggccgcagagtgagctggtgttttcacgcaaaagcggcaaatcagtcaatgacggcgtggccggcctgttcacgccagacggttactggcagcacgtcgataaacaaatcgcaccggtcacgcaggcgctgttccaggatgatgtctgggtgctgggcggcgttgcgtcgccggagaacagtcagcagaccgacctcgcggtgcgccagctttacgtgcaggattacatccgccagtgggagcagttcctcagcgatatccagctcaacagcagcgcggatttgtcgcaacgcatcaacaccgcacgtctgctgtcgggcaaccactcgccgctgcgccagctggtggttaacctcagtaagctgctgacgctgaaccgcgcacagccggatgagcaaagtgcccaggcacagccagcgacgggcaacagcgccacgcgcactttagaagcgctgttcagttcctccaaagccagcgcggcgccgggccagggcgccgcccaacaagcaccggagcatgcggtggcggtgcacttcgcgcctgtgctggagctggcacagccgctgcagcacggca

SEQ ID NO: 22626 - DNA, 159 bp, Glycine max
  Peptide Sequence Number=SeqID_139404
atgaatgaagatggagactggagttcaaggggaatggccaagcataacattgtccaagaaacaaaagataacccgacaactcggagtgatgaaaacgtagatcaaaacaacaccaacttgggccactcagccaaccaacatgcgtctaggagtgaatag

SEQ ID NO: 22627 - DNA, 387 bp, Glycine max
  Peptide Sequence Number=SeqID_139405
atgatgttggaggacgatgatttcgatgatggggaaattcaagtgataaatgtggaggtcaaggaagaagccgagaatgagggcgaattaagcgtaatgagtttacagggtttggtcgctcatcaagttagcaagttccatactatgaggttgcagggaaaagaacaaggggtccctattctattgttaattgatagtggggcaacccacaatttcatttctcataaactagtagcagcaatgggatggagtgtcgccaacaccacacctttgcaaatcaaattgggaaatgggtctaagactcaaactcaagatgggattgacatagttcttggaatggcctggctaaattcgattgggagcatgtgggtggattggcccaaatag

SEQ ID NO: 22628 - DNA, 485 bp, Glycine max
  Peptide Sequence Number=SeqID_139406
atgatagaagtgtccgttgaagcgatcgcatccctcactcaatactacgaccaatcactcagatgcttcacttttggggactttcagttggcaccaaccatagaagagtttgaagggatcttaggatgcccattagggggaagaaagtcatgcctctttgccagattctatccttctagggcaagaatagaaaaagtggtcaagatcttggaacaagagctagaccaagtgaagcaaaataggaatggagtggtagggataccaaggaagcgcttggaggagaaggcaaaagctttggcaaatcaaggggaatggacctcgttcattgacatcttagcactgttggtgtttggaactatactatttccgaatgtagatgggccagtggatctagctgcgatcaacgcctttcttgcttatcaccacagcaaggaaagccccgtcatcgctattttggcggatgcgtatgatacattcgacttgag

SEQ ID NO: 22629 - DNA, 270 bp, Glycine max
  Peptide Sequence Number=SeqID_139407
atggcatttgggaccatggcagcttgcccaggcaagctgatgcttcatcctgaagtaactggctcacttagacgagctggttccttcagccctaagcaatttgggggcctaggcgagccagaggctagcctgggcgagctagggtccaaaaaactacctaaaaagacccttttgcccctcccttttggtatctttctcatccttgaccaaaatatcaaacgatctttcatcttgcgcggtaactggtgtcgaacaacacagttcggctag

SEQ ID NO: 22630 - DNA, 417 bp, Glycine max
  Peptide Sequence Number=SeqID_139408
atgatgcaatcctaccccccgagggtattggatagaagactccaaaaggattggtctagagcaactaaagaagaccctagggttctcatgaactttggtagatttctgagtccaggggccaaggagttgctcattgaagatgatgaagatgctccaccaatcaaattttttaaagctcgaccaagacgtcttttcaaacatgagcttgaagctctcaaacaaaagattgagctcaccaatttggattggtatgccactacgagcttttacggactaaaggaatactattctggtctagaatctgatgagaagccacctgtagatgtagttcaccataaagttaggcaacactatgagactttgaaccattcttgcttcacccaagaaactgttggacaagtgaccttaataacttaa

SEQ ID NO: 22631 - DNA, 786 bp, Glycine max
  Peptide Sequence Number=SeqID_139409
atggcctccaggaagaggaaagccacaacctcccaacctcgggaaccttatgacaccactcggttcgtttctgaggttgcgtcggagcgatattcacagaatgttcactcccggaacatccttccagagagggacgttaacctctttgtgactgtgtatcatgaattcagaagagagctgatcagaagaaactggcataaggccttgactcagcacatagacgggcacattgatgtggccttggtcaaggagttctactcgaacctgtatgaccctgaagacaaatcaccaaaacaagttagagggatgctgattaagtttgatgcgacatcactgaatgcctttctggagacaccaccactcattcagccaggggagcagtacccctcttattctattttttgcaggacgcgcactgatcctcaagagcttgcctccaagctttgtattctagggcgcatgttcgttttaaatgctgaaggagcgccttggaagctcctgaggaaggatctgaatacactagcccagacttggagagcctcagccagaacctcaccggaggccactccagaggctaccccacggacttcaccaattacttcacctgttttggaggtctctaatgaggaggatggcgctgctgatgcggattatgcagctgatatgatcgtagcacagagcacctgggacccatggcctgttacaactcaggatatttctcagccagtccaagatgctccctcctcacctctggatgagcccacagctgcacaggaagagccatga

SEQ ID NO: 22632 - DNA, 720 bp, Glycine max
  Peptide Sequence Number=SeqID_139410
atggacagggtgagtttggtctatgggctcgttatgaagatggaaatggacgtgggctcgatcatctctggtcagatctcacagatggcccagtccaactcctatcggctcgaattccctgccttgatcactgctctatgcacttccagaggagtcatccctaactcgctgactttcgagtccctgagccccgccattaatttggattatatccgaaagaattgctggaacccagatgattcgacaatcacttttacggggacccataaagctcgggctcggggaccttctaacacttctacctctacccctgcatctactccaacaccagcatcagcacctgcacttgccctagctcttctagccacgacagcaccctccaacccctccacttctaccagggacgcgattgtgccgatgttgagtccagtcttctcctataggggaggtgaggcttctatagcccaagagccgcaaccagatccggaggcgacactagacgacacaccagaggagacatctgaggacacttctgccgccacacccatggaggtcaccaaggagggagatggcattgcggacatagattacgtcgcagatatgacagtagcgcagggcacttgggacccttggcctactccagcacaggatacaccgctgccagcccaagatgccccctcatcacctctggatgacccaacaccagctcaggaggagtga

SEQ ID NO: 22633 - DNA, 268 bp, Glycine max
  Peptide Sequence Number=SeqID_139411
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccactcgtgaaccac

SEQ ID NO: 22634 - DNA, 360 bp, Glycine max
  Peptide Sequence Number=SeqID_139412
atggtacatccacttggttttttcaaagagaacaaaggagggtacatcccttgtggatctttggcttgtaaaggattttacaaggttgaaagaaatctcaagaaccgccacttgatccaacaaaccagagaagcccttgctcaagccttacagtatcgtgctcatgctgaaaaggaggctcgcaagtggttcctgattggggattatttttataataaaatcactggttggaaacctctgtgtcctccaatgccttttggtactcctattcatctctcatttgattcttatgactttggtgatgagtttcttaaaaagcttaatgaggaagttcccaaacaaaagggggataaaaagtaa

SEQ ID NO: 22635 - DNA, 393 bp, Glycine max
  Peptide Sequence Number=SeqID_139413
gttgtaccatctatggtgaggctcatgaaacaggccaatgtattcatgttgaagaaaacacacaagaaattcattatatgggaaatcaacagagacaagggtatactcaaggaggattttcaggattctagcagagtccttataatcagcaaggacagtggaggtcgcacccgggcaatcagttcaacaaagaccagggtgggacaattggccaagcagatagctgacaagtcatccaacagttttgtggcaaatacagaaaagaatgccaaggaggaatacaaagctgtgatgacaaggagtaaaaggtttgtggaggatgaggaagaggagagtgttgggctcaggaagaaagctattgaaaagaaaggtactgatggtaagaaaaatgag

SEQ ID NO: 22636 - DNA, 198 bp, Glycine max
  Peptide Sequence Number=SeqID_139414
atgaaaactggtgttaagatcattcacgcaagtggtatttcgggttcaatcgcttacaattggtcttggctcaacatgaaaactggtgttaagatcattcacgcaagttggggatatattcagatgcagggtatcaacacatcaaccttaagctttgatcatgagcatgctgatgttaatttattcaagcctttctga

SEQ ID NO: 22637 - DNA, 375 bp, Glycine max
  Peptide Sequence Number=SeqID_139415
atgcgtatagctgaattattgaatgaagcaagcctaatcatttgggatgaaggtcccatggctcacaaattttgttttgaagcacttgatcaaagtctaagagatattattaaggccaagtccagtcctcataaaatctttggagcaaaacatcttccttcctgcggtttccatatgacaattttaagaagattcggccctccattgcaatggactgtcgtcacgcttgacgttggcactggtgacaagtacgttgtccaaccatggtaccaatttcttgcacaaggtgattttattcatggagacaagctctcattctactacaggcctcacgacaaaatttgggaaattgttattagaagacaaaaaaactag

SEQ ID NO: 22638 - DNA, 456 bp, Glycine max
  Peptide Sequence Number=SeqID_139416
atggatgaagatgtgctaagacaacgcgaagagatctatggaggtccagaggcaaggaaacaaatgaggatatgttcaaatgcatccctaccttcacaccagactatatcatggtgtgacaaacttgcaacggagtctagaaagaattgggactcatactcttcatccaaagatgcaacaattggagctgaaaaagctcaatctcaccaaactctggaaggcagggaatcaatgatcaaggagttccctccaagacagactattgcactcaaccctaacagcctaatcttttatcaatggcctacagacataaagatgtatccttcaggtgcaagcgagattcagttggaaacaccagaagaaagtctgaactttcaagactgggaactatcaagctatgaccttgagctaagaatgaagttatctgcctacaaagaggagatcagatcagggcaa

SEQ ID NO: 22639 - DNA, 177 bp, Glycine max
  Peptide Sequence Number=SeqID_139417
atgccgctcactccagctcctatgatggctattttagaaactgaaattggagggttatcaagggtagtggccatggttgctaaaaagctagggtatgatgaagtgaggttatcccaatatataaaacactataaggggatgaagctgcatgcagacgtcaaaagtgagagcacgtga

SEQ ID NO: 22640 - DNA, 312 bp, Glycine max
  Peptide Sequence Number=SeqID_139418
atggaaagtgacccgacgtcgcatcacaaacactcggcaatcttcaatggggatgatgccaccagggtgtatcaaaatagtgacggagtaaagcccggcgtatgcagcaaccgatggggaataaacatttcttgggagaacgtgccaatccaaaaaacatggttcattgaacacaataaccgttgttcctctctgacaaccttgaatcccactgtttggatgcttcagattcagggtctccttgacatttccattgtgcctcaaatgaacaaagatcatctcgatgcagttactttgtcttttggtccttaa

SEQ ID NO: 22641 - DNA, 285 bp, Glycine max
  Peptide Sequence Number=SeqID_139419
atgatctttgcatcaaaccctaatcctaaaaaagtgtacctcatcggaggtttgcaagtggagtttccctaccaaccatatggatctcagtttgcgtttatggctagagtgatttccacccttaatctagctcagaaagaaggccattgtcacacgttgcttgagtctccaagcggtactgcaattgtcctgcttttagtttcagaaattcccgaccatacgcaatttgagatcaacaacaagaagcagaagaaaaaggaagcccaccatatattatcctcgtag

SEQ ID NO: 22642 - DNA, 321 bp, Glycine max
  Peptide Sequence Number=SeqID_139420
atgaggtgcaaatggatattcaagaaaaaatctggatcatccactaaagaagtcatccattataaagcacgtttgtggaaactttggacgcagttagagaaactcgatgtcaaaactatctttcttgatggaagactagaggaagacattatgatcaattaccaaggcaatggtacaagagatttgatgagttcattgtttctcatgtgtacatcagaagtccctaagactcatgtgtttatcatagcaagtagtgaatttgagatgaaggacatgagagttgctgaaaagattctaggcatggagatcaagaaggattga

SEQ ID NO: 22643 - DNA, 525 bp, Glycine max
  Peptide Sequence Number=SeqID_139421
atggtccacacaattaagattgagaaattcatagggaagaatagctttaacctatggcgcatcaaaatgcaagccttgttgaaagaatatggcatctgggctcctctctcatgtcaaccgtcgaagattgataagtcggtgcttgagttatatgaggaaaaggcacattcactaattctcttatcaatgtctcatgaggtcattggaggcaagagtgtccaaagaaagcaaagaaagattttattgctactcttgttcaggataactcctcattggaaagcgatttggttgtggctcttggtgaacaactacaacaacattatgaacaatgagtattggactcaggttgttcttatcatatgtgtccacacatacattggttttgtacaaatcagaatgcaagatggtgttgttagaaccttaactatagttcatcatgtttcaaagcttaaggaaaatcttgtatctatgggagtcatggactcaaaaggtttttcttgctgggttgaaggtgaagttatgtag

SEQ ID NO: 22644 - DNA, 234 bp, Glycine max
  Peptide Sequence Number=SeqID_139422
atggactctttccaccttaaggacaaagtgtttctccaagagggtgggaatgatagtacatctattcctattgggccaatcccaaatgttacaagtactattactgatgttgggcctcatacaaatgatgatgatgcaatcaagggaaggctcaagtgcataagcaagagacctacaggatggaaagattttatccacaaagatttagattctttgaatttaggagccatgtga

SEQ ID NO: 22645 - DNA, 639 bp, Glycine max
  Peptide Sequence Number=SeqID_139423
atggttttggaagaagagaatggccttgatgataacttgtttgttgatcaaatagagactaagataatcaaagggaagccttattcttgtcctgccttacgattttttaagggtgaagaagccaaaggaaataagccttatattttttatacttctaaagcagaacaaatctttgattatttggttaaagatcagcatattcaatttcctaagggtcaaaaaatccctcatctagaagaattgaggaataaaagatattacaaagggtataatgcttacaaccattcaacaactaattgtctgacgtcagccccttttccatcgactgacattagtatggtgtcaacatctaggatgcctcccaagttcaagcaaaacggcatcaagaattcatgggaaagtaatactttacccaagaggaaacatgacacatggcaagggaaatcacctagcgaaagacaagtagccaaggttaatgttaaagaaggtgttaccaccctgaagataacaataatgaatcaagggaatgatgctcttattcctatgacagatgttggcatcctccttatggagtttactagtcaggatcagctaatggctaccataaaatgtgatgttttagccgatgaaggagaataa

SEQ ID NO: 22646 - DNA, 972 bp, Glycine max
  Peptide Sequence Number=SeqID_139424
atggagggccttgactaccttgacaccttctctcccgtagcaaagctaaccacagttcgctttcttcttgctattgccgctatgaacaactggcacctaagacaattagacgttaacaatgcatttttacatggagaattagacgaagaagtttatatgcaggttccgcctggcttgacaattcagaacccaaacttagtatgccgtttgcagcgctctctatacgggctcaaacaagcaagccgacaatggttcttgaagctttcaagtctcctgacaactcacgggttccaaaagtctcaatcagaccattcactttttttgcgttttactggatcaatcactactatactactagtatacgtggatgatatcattcttactggaaatagcagctctgaaatacaggagatcattaccatccttgatcaaacctttaagatcaaggatctcggaaatttgaagtattttctcggccttgaagtcgcgcgttcctctaatggcattcacttatctcagaggaaatataccttagatattttgtctgattcgggcatgttaggttgtcgaccaaatacgacctcgatggattactccaccaaactacataccactgcaggcactccattgtcagacgcagaatcatcctcttatcggagactagttggccggcttatatacctcaccaacacgcgtcctgacatcatgtacgcagtccaacagttgagtcaatacatgtcaagcccaaccaatatgcaccttcaagctgcctatcgggtccttcgttatcttaaaagtacacctggttctggtgtcttcttctccgctaccagcattcctcaactccgggctttcagcgactcggactgggcgggttgtcaagattccagacgctcgatcaccgggttcgtcgtatactttggttcctcccttgtttcatggcagtctaagaagcaaaacacagtttcgtga

SEQ ID NO: 22647 - DNA, 618 bp, Glycine max
  Peptide Sequence Number=SeqID_139425
atggtgtttatatctaccccaggaatacaagtaggaaaccctgcaagtaacattgttgacattataaacaagaatctaacagatcagaagcttcctcgcttgaatgacagccctggtctagggtgcatggccttacaatacgtcgaattatgcaaagggaactgcactgacaacaatgttgtaaactgcaaacctcctgaagatgacttcaccgaagtgtttgctcccaactgcggtgtagagctaccgacttttggcaccataaccggacacatagtgggctgtcaaagaaagtatctcgagccatcactagcattttctgaagttctcatcaaagatgagaaatctttgtctcttctgaaaaacaaatcacatactgaggtgggagttggcctggttggactccacaaaggacctttcttttggtgcgttttgtttagcaatggaaagacaaactctacatttgtgcttgaaaatcatggtgcgggaatccagcaaaaaaaagggtgttatagtgggagtactactccgtgcagtagggggcagaaaagtagggttgcattttttaacatctttttcatgtgttatgtctccattttgctgtttaaactttggtga

SEQ ID NO: 22648 - DNA, 297 bp, Glycine max
  Peptide Sequence Number=SeqID_139426
atggatgtggtgggagagaacaagagctggcaaaaggagacaacagcaaaggaagtgcaacaacacacagcaactgaggttgttcttcttcatcatatgctattgtataagatagggaagaaaggtgttattggtgatgggtttgcacttcaaagaggacacaaaaggactcaaaggtggtcccatgtagccgttatctcttctgtcattcaatattttttcctaaaatgctacccaatttcaacaaatgtatttcgctgggtcccatggttcctagaatattgtgattatgagtag

SEQ ID NO: 22649 - DNA, 216 bp, Glycine max
  Peptide Sequence Number=SeqID_139427
atggagggagtcccacaattcgatttgctaagctctcaaaagcagaaagtcacaatttctcacactgtcaaagatagcaacgaaatggcaaccacaaccacaaaacaatccaaagccttgcttcctacttctgaattttcagcagttctaatatttaagaagtccaatatcattttcatattaaagggacccagaatgaaagaatatcttgattag

SEQ ID NO: 22650 - DNA, 1209 bp, Glycine max
  Peptide Sequence Number=SeqID_139428
atgagtaaaaggaataaggaacttcccatagaggtcgcacctacggtcactgttcttccctcccctctccctcctccctccccctctacccgtggtcgaagaggctatataatctcgccgaggctcgtcggaatctcgctagaggccaacactaccagcaccgccaccataggaggcagcaatgctttttctatcaaagagcatcaagtcaagcctctgatcccaggatcccaggaacaacggcgaagaggatttcctcctagaacagcggcgggccctcaaagggttcctgtcggggtgaagaagaaggtcgagtctacgatactatttttttatgagatcgaggtcctagcacgtgcgatcgacatagagaataaagtaccaatcgaggtggttgttggtgattggcttctcggcggcgaggaggacgtcgatgatggccaggatctgttcgcggattgtgacaaagattgcggcggcggcgtgggggctgaggttccgcgtggcggaggtcaaggacttcaagatccgactgcagggtgcggcggaggggaggaaagggaggctggcggtcacggtggagggtcggaggtcacttttgcgacaaagacaatggaaggggaggaccagtaccccaaacagatctccaccttcatgcgtttcgtacttcgttctttgcctggttttatgtccacgccaccgtcgccgcatgttctaccatttgtgtcaccagtaactgcaaggccagtcgtcgtggtgttgtgcttctccgccgaagagccattgggagagaagccagtggtgatgcggatgaagtcccctagcggcgaatgtccacaacatctgcacattggcaacaagaagctgcacttgttgctgaggatgttcaacatgcggatcatgaagatgacaaggcctcatgacacatcagttttgatggactatgtttatcatctggcagtgaaagtttggaatggagatgaacgtcttgagctgaagttgtcctcctatggaagaaaggttgagaaattcggcaggcctactccagagattgaaggcttagtcgttgtcacaggattaagtcctatgatcgcatgttcactggaaactagaaccttccatagctttgagactcttcgtgtgaacgatgttgtcttccttttagtcgaattgcttgaagtaagttctgaagaggcaagagctgagacg

SEQ ID NO: 22651 - DNA, 1020 bp, Glycine max
  Peptide Sequence Number=SeqID_139429
atgggaacaacaactgaccttaactttgattatgttttgagtcaacgcaaagcatttgatgaaacaaaagctggtgtgaaagggcttgttgatgtaggtgttaagaatgttcctaccttcttccatcaccaaactgagaagtttgagaaggcctcaaatataggcaacaaaagccatgttattccaatcatagaccttgcagatattgacaaagatccaagtaagcgccaagggcttgttgacatagtgaagaaagcatctgaaacatggggtttctttcaggtgatcaatcatgatatccctttgagtgttcttgaggagatgaaaaatggggtaaaaaggtttcatgagatggatactgaagccaagaaagaattttattcgagagatagatcaaaatcctttctgtataatagcaattttgatctatacggctcacagccagcaatcaattggagggattcttgtaggtgtttgttgtatcctgatacccccaaaccagaagaacttcctgtagtttgcagagatatactgctggaatacaggaaacacataatgagacttgggattttgctgcttgaattgttttcagaagctttgagtttgagtccaaactatctgaaagatatgggatgtgctgatgggctattagctctttgccattattatccttcatgtcctgaaccagatttgactatgggaatcaccatgcattctgacaatgattttttcacagtgcttctccaagatcatatcggtggcctccaatttataacaaacgatagattcaagagtgctgaacacagagtgcttgcaaatgatgttggtcctagaatatctgttgcatgctttttcagtccatctgccaagacatccttaaagctttgtggacctataaaggaactattatcagaagaaaatcctcccaaatttagggacattacatttggtgactatgaagcctactatttagcaaaaggactcgatggtactagtgcccttacacgttacaggatttga

SEQ ID NO: 22652 - DNA, 306 bp, Glycine max
  Peptide Sequence Number=SeqID_139430
atgtatgagaatttgaatgatgcatcaaagagtacaactagacaacttgtaagatatatcacacttttacagacatctgcccatgcaacatgtgacacatttgttgaaccagatgttgctcagcacccggtggcagcaacgactatggatgaagcacctaaagatgcatatcctgatgaggcttgccaagaaatagctaaaaggttggaaaggctactcaacctaaggataatgaccaaaggaacagaagcatacactatcaccaaagaacgcatgaggatagcaagaggtgtcactgtgcaatga

SEQ ID NO: 22653 - DNA, 654 bp, Glycine max
  Peptide Sequence Number=SeqID_139431
atgaaacaagatgtaaacaagaatgcaaataacagaacaaggacaaaaacacaaacctggacagaatacaaagaaaaagatttggataggataaaaactgtatcaagagccgaagctctgataccagatgatgtgatcctgactaggagcggatcgcttgatacaggctacgaagatttggataatgccacttccaacgatgagccagtggtccctgcgacagaggctgacggagcttcggttgaggctgacgtatatgcaaatgagccaagggcaagaggtgatgtacatgacactggggtagacactcctacagacacaggcgcacaggctgttgaggatgagcctgagggatttctgagtggtccgagggacccatccgtgctgaccgagtatgcggatcacgttgcaagaagcgtatggacgggagagatgatgttaacgaattgtgtgttcctttatacttcaattaaggagcgtcctgagttaaagttatcctctcatgggaggaaggtccatagtttaggcaggtctgtccctgccattgaggggctagttgttgggacaggactaagtcctctgaccgcgtgttcgatagtgatcgaggccgtacccgaatcaaataaacatgaaaatgcagtaactaggaagtga

SEQ ID NO: 22654 - DNA, 219 bp, Glycine max
  Peptide Sequence Number=SeqID_139432
atggctgatgcagcatcatcaagattctcacatcaaaaagaccgatggattggcagagcacttggattgcatcatagtcccacccaccttcatttgcatgtgaatcttgatgatgctacatccgcaaacaacgactgtcaatctgtccatgcaactatagctgctgacaaagaaaggggtaaaaagacttataggttactcagagtgaagaccaattaa

SEQ ID NO: 22655 - DNA, 213 bp, Glycine max
  Peptide Sequence Number=SeqID_139433
atggttaggactcgaggattaggtcatgccttagggcacgatactggcagaggtgtgggcagaggagatcgtgatgattccgatgatgctccgcagcgtcgacggcctacgacatccgcacgccggcaatgtgatgtgatcctgactaggagcggatcgcttgatacaggctacggagatttggatgacgccacttccagtgaaggaagataa

SEQ ID NO: 22656 - DNA, 270 bp, Glycine max
  Peptide Sequence Number=SeqID_139434
atgggttctggcgcccaaactcttttgactctcactctcctttttctcatcgcggcattgcaactctcattctccctctatgactctcactctcgctctctcactgtgactcaactctttacggcgcgacgtgcccaccatgccaccaccacgttctcgctctatgactctcattctcactctcactctcgccctttggttctcgctctcactcacagctctactcactttagttctcgttctcgattacgaaaggaaaatgcttgttaa

SEQ ID NO: 22657 - DNA, 2116 bp, Glycine max
  Peptide Sequence Number=SeqID_139435
atgtatcagtggaggaagttcgagttcttcgaggagaagtacggcgcgaagtgcgcggttcctgaggccgacgaagacgacagcggcgtcatcgcagcggagaggaagatcgagtgctgttcgagcggtaggggcaaagtcgtcaccggcttcgacgacggcgtcgtttgcttcttcgatcgaggcctcaagtttaactacgctttccagcctcactcctcttccgttctctttcttcagcaactcaagcaacgcaactttctggtaacaattggggaggatgaacagcttactccccagcaaacagctttgtgcctcaaggtttttgaccttgacaagatgcaatcggagagttcgagcacgacaagtcctgattgcgttgggatattgcgaatattcactaatcagtttcctgaggcaaagattacatcatttttggttttagaagaagtgccacctatactactcatagctattggcttggacagtggttctatttactgcatcaaaggagacattgcacgggagcgtatcactcgtttcaagcttcaggtggaaaacaaccattcggacaaaactctttctgctgtaactggacttgggtttagggtggatggtcaatctctacagttatttgttgtgactccaagttcagtgagcttgttttcgttgcatgatcaaccgccaagaaggcagacccttgatcagattggatctggtgtgaacagtgttgcaatgagtgatcgatctgagttgataattggtcgaccagaggcagtatatttttatgaagttgatgggcgtggtccttgttgggcttttgagggagagaagaaattgcttggatggtttcgtggataccttttgtgtgttattgcagatcaaagaacaggaaagcatactttcaacatctatgacctgaagaatcgattaatagctcacagtgcattggttaaagaagtttctcatatgctctatgaatggggtaacatcatactcataatgaatgacaaatcagctttatgtattggagaaaaggatatggaaagcaagctagacatgttattcaagaaaaacctatatactgtagcaattaatcttgtacagactcagcaagcagatgcagcagctactgctgaagtgttaaggaaatatggggatcatctatatagcaagcaagactatgatgaagcaatggcccagtacatacatactattggtcaccttgaaccttcttatgttatacagaagtttttggatgctcaaaggatctacaacctcacaaattacttagagaagctacatgagaagggtcttgcttctaaagatcacaccacacttctattaaactgttacactaaattgaaagatgttgaaaagttaaatctatttattaaaagcgatgacagcattggggaacttaaatttgatgtggaaacagcaatcagggtttgccgtgctgccaattaccatgagcatgcaatgtatgttgcaaagaaagcagggaggcatgaatggtacttgaagatcttgcttgaagatcttggtagctatgaagaagccttggaatatatttcaagccttgaatcaagtcaggcagggatgacaataaaggagtatgggaagattctgatagagcacaagccagtggagacaattcagattctcataaggctttgcacagaagatggtgacaaaagaggacgctcaaatggagtgtacatgtctatgttgccatctcctgttgattttcttagcatcttcattcatcatcctcagtcccttatggattttcttgaaaaatataccaataaggtcaaggactcacctgctcaagttgagattcacaataccctcttagagttgtatatatccaatgaattgaactttccttcaatgtcacaagttaatgatggtggaaattaccttaatggagcatcagcaaaaaccatgattttaagtgctcaatctaatggaaacattggtgatcacaaaagttcagagcaggaaaagaaccatctcgaaagacttgaaaagggtttacgcttgcttaagactgcatggcctccagagacagaacatccacaatatgatgttgatttagctattatactat

SEQ ID NO: 22658 - DNA, 543 bp, Glycine max
  Peptide Sequence Number=SeqID_139436
taatcataagttcttatgggttgtgagagcaccaagcagtttagctcgtgatgcatattttagtacacaaaaagatgttgatcctatgcagatcttgccatctgggttcttggagaaaaccaaagagcaaggtacggttattccttcatgggcaccccaaattcaagtccttagtcacagttcagttggtggattcttgactcactgtggctggaattcaacccttgagggtgtgctaaagggtgtgccactcatcacatggccactgtttgcggagcagagaatgaatgcggttctgctatgtgagggtctcaaagtgggagtgaggccaagagttagtgaaaatggcttggtggaaagggaagaaattgtgaaggtgataaagtgtctgatggaaggggaagaaggtgggaaaatgagtggaagaatgaatgagttaaaagaagctgctactaatgcactcaaagaagatggatcttctacaaagaccctttctcaaagaagatggtctacaatgattcttggcaccaatggatgttacat

SEQ ID NO: 22659 - DNA, 1401 bp, Glycine max
  Peptide Sequence Number=SeqID_139437
atggagaaaacagtacacatagcagtagttcctggtcctggctttagccacttggtcccaattcttcagttctccaagagacttgttcagctccatccaaactttcatgtcacatgcctaattcccacactcgtgtctcccccaagtgcctcaatatccatccttcaaactcttccaccaaacatcaacactatttttcttcaaccggtgaaacctgaggacctaccacaaggggctaccatagaaactcaaattcagctcatagtggctctctctatgccctccatacatcaggccctgaagaccttaacttcaaggactcgctttgtggccttggtggctgattcttctgcctttgacgcattagattttgctaaggagttcaacatgttgtcctatatttacctccccatatcagcaacaacactttcttggtacttctatgtgcccatgttggataaggagacatcatgtgagtacagagattttcctgagcctattaaaataccaggttgtgtaccaattcatggccgggatctcaataacatagttcgagatcgatcaagtgaagtttataaaacctttctccaacgtgcttggcgattccgttttgttgatggtgtcttaatgaataccttcttagaaatggaaacaagtcctattagagcattgaaagaggagggaagagggtaccctcctgtgtatcctgttggaccaattgtccaaagtggtggtgatgatacaaaagggttggagtgtgaaacatggttggacaaacagcaagttggttctgtcttgtatgtttcttttgggagtggtggaacactctcacaagagcaaatcaatgagcttgcttgtggtttggaattgagtaattataagttcttatgggttgtgagagcaccaagcagtttagccagtgatgcatatcttagtgcacaaaaagatgttgatcctctgcatttcttgccatgtgggtttttggagagaaccaaagagaaaggtatggttgttccttcatgggcaccccaaattcaagtccttagtcacagctcagttggagggttcttgactcactgtggctggaattcaatccttgagagagtgctaaagggtgtgccattcatcacatggccactgtttgcggagcagagaatgaatgcggttctgctatgtgagggtctcaaagtgggagtgaggccaagagttagtgaaaatggcttggtgcaaagggaagaaattgtgaaggtgataaagtgtctgatggaaggggaagaaggtgggaaaatgagtggaagaatgaatgagttaaaagaagctgctactaatgcactcaaagaagatgggtcttctacaaagaccctttctctgttagcactaaagtggaaaagtttggtatag

SEQ ID NO: 22660 - DNA, 231 bp, Glycine max
  Peptide Sequence Number=SeqID_139438
atggagtcgccaactgtcgcaacctaccctttggcgggagggcgacgtgagactcacgggtgcatcttccaagggaggaaaatgcacagagtcaccaccaacgtttatttgaggaaaacgtcggaaaaaccggaaagatgtggtctacgaactttaatcgtgaaaggttctagagttgtttttatgcacggggaatgtattagcaccccacgcgtccatcacaagggatga

SEQ ID NO: 22661 - DNA, 129 bp, Glycine max
  Peptide Sequence Number=SeqID_139439
atggaagccatatccaagcagtttgaagagcttgatgtatgtggcaaaatgactctaaagagtaaattttgggaaattgcctattctgatctaaattctatgtgtactcctcctgaaaaggtatggtga

SEQ ID NO: 22662 - DNA, 552 bp, Glycine max
  Peptide Sequence Number=SeqID_139440
atggaggttcctttgtcttatcatagacaatggtccccaaattatccaaattatgtgttattcgactacgaaggagacaaacattttataaagcttcataaatatggtaaccgtttctattttggtgatggactcaaggaacttaggagaatccatggcattcacgaaagtgttctcatgcggtttgttggaagggacaaaaatactactttcagtgtggacattgtgggacctctacaccaaagggcagccccaaccataaggcaccatgtttttaccattgatgtctctgaagatatgatacaacaaaattatcaattggttctgccaccagaggcttcaatttatttaactgcatcaaaaaaatatatggttgtggatcgtggtagtggtaggcataaaaaatggatgatcaccatgaacaatggcctatcatgtgttactgacgcatggattcattatttaggtgactgtcatttgaaggctgaagatgaggtcatctttttctacaacattgaccaacatctatgggaggtcctctataggaagcag

SEQ ID NO: 22663 - DNA, 654 bp, Glycine max
  Peptide Sequence Number=SeqID_139441
atggttgtgatgatgattcatggatacaacccacaccttcagtttgcatttaggttatctcattttctgatggtttggcctctgcaatccttccatcgtccatggtctcctcagcttcaattatgcatcggattagtgtccttgcaagtcaatgataattccaccgaaagaagtctcaattgtttccctcaaggaaattgccacctgttttggtttaatttgggaacttgggaggtgcataatttggcatggcatttcatgccgaggatgctagatgctgactgttggtttttgtttcgttggatggacttcccagcgctgttaactaatttggtcagacttttggagtctcagcgatttgggaatattggtggagttttcaaagcggtgtttggagttctagctcttgaaaaaagggatgttgattatactttcatggcaaagtttgtagctgctctaatggtgagggaagggattttccactgggatggtgagaattgtttattcatcttatcaaagtcactctcaagcctaacgagtcccaagcctggggttaaaggagggagccagggaggctcaatgaggatagttctcgggagactaatgaggatggtaatcgaaaaccaaatgcacaaggcaaattatgtgaagtga

SEQ ID NO: 22664 - DNA, 384 bp, Glycine max
  Peptide Sequence Number=SeqID_139442
atggcttccaattccaaatcggagacttttctgcaacgaaatggttacgattttctgttgggatcaatcgctgctttctacgtactcaccgtgccttacactaaggtcgaagagagtttcaacgttcaggcaatgcacgatattctctatcaccggctgaatttagacaattatgatcatctggaattccctggggtggttcctcgcactttccttgttaagtgctttgcttgtgtcattaattgcagcaccgtttgtgttaactgcaaatttgctgcatttgccgaagttttatgctcttctcataggagcctgacgtacatatgccaagaagtatctagttattactcttttgtttggatgcctgagaatttgtacagataa

SEQ ID NO: 22665 - DNA, 291 bp, Glycine max
  Peptide Sequence Number=SeqID_139443
atgggtattgatgatgtgatctgtaaacagcccagcaacttcccaatggcggtttctgccatcgacgacaacaatggaggaagaagaagcaacgcgaaggagaaacgtaactccaggaagaagctaagtgtccatgatgaagcaaaaacgcggagaagaaccacacccaccgtcctatgcagaaacgcgaagaagatgccaagaagcagaaacgccaagagcagtgaagaagatggaaccgcggcggcgcacaagaagaagattgaagaaacagaaaatgaagaagattga

SEQ ID NO: 22666 - DNA, 489 bp, Glycine max
  Peptide Sequence Number=SeqID_139444
atgtatcatattgatgggttgtgttgggaaaaggattgtgcttatggttactgtggctttcataatgatacagatgaacggtgggtgcacattgatacattttcagccatgaacgggatatctcgcttttgtgaaagtgatttcccatggaggtacctttctgttcggaaggcaggtagtggaggccttgataatgttgctgaagtatgtaatctgctttctcaagtccagtattctaaagaagaacaaattagcttgcaagaatttcagcagagaaattttacttttcttataaatactttgtctgacacacataaattggataacacatgctatgtttatgatgagagatcctacagactgttgacacaaagtgttggtatcgtcaaattcgtccttgaagagtatgtgttgttggcaaggactgcatcagcatgtgttgtgtgcataatggtcattgccgtgaaccaactatcctacaagctttag

SEQ ID NO: 22667 - DNA, 1248 bp, Glycine max
  Peptide Sequence Number=SeqID_139445
atgttgcaggtatatgattggatgaacaatagaccagagcggtttagagtttctgagagtgatgcagcaattcagttagatttaatagcaaaagttcgtggactttctagtgcagaagcattctttctgagtctggaagataagttaaaagataagaagacttatggtgccctgttgaatgtatatgtgcattctagatcgaaggaaaaggcagaatctttatttgatacaatgaggagtaaagggtatgtaatacatgcactaccatttaatgtaatgatgactctgtacatgaaccttaatgaatatgctaaagttgatatcttggcttctgaaatgatggaaaaaaacatacagctagatatctatacatataatatctggttatcttcgtgtggatctcaaggatcagtagaaaagatggaacaagtgtttgaacaaatggaaaaggatccttccattatccctaactggtctacattcagcacaatggcttcaatgtacattaggatggatcagaatgaaaaagcagaagagtgcttaagaaaggttgagggtagaattaaaggtcgagatagaataccttttcattatcttctgagtttatatggaagtgttggaaagaaagacgaagtgtgtcgtgtgtggaatacatacaaatcaatttttccaagtataccaaacttgggataccatgctattatttcttctctggttaaattggatgatattgaggttgcagaaaaactctatgaggaatggatttcagtaaagtcaagttatgatcctagaattggaaaccttctcataggctggtatgttaagaaaggcgacacagataaagctttgagtttctttgagcagatgttgaatgatggttgcattccaaattcaaatacatgggagattctttctgagggccacattgcagataagaggatttctgaagccatgtcctgcttgaaagaagcttttatggctgctggtggttcaaagagttggagaccaaagccctcatacttgtctgcattccttgagctttgtcaagagcaagatgacatggaaagtgctgaggttttaattggacttctgaggcagtcaaaatttaataaaagtaaagtttatgcatctctcattggctcatctgatgaattgccaaagattgatacagctgatagaactgatgatgctgttgacagtgaaaacatggataatgacttgttgaaccaactcggtagtagctcttga

SEQ ID NO: 22668 - DNA, 120 bp, Glycine max
  Peptide Sequence Number=SeqID_139446
atggttgacattggcatggctcctttgcaggctacctacgcatgggaaccttcgaaggagggggttcagattgctgaagatgtttattcatgtccgttttgtggaagggcggaagagtga

SEQ ID NO: 22669 - DNA, 195 bp, Glycine max
  Peptide Sequence Number=SeqID_139447
atgggtgatggtggtgcggaaggagaagaagaggagaaagaagaaaggaatgagggtgcagaaaaactttatgaggaatggatttcagtaaagtcaagtcatgatcctagaataggaaacctcatcacagatcaagctttgagtttctttgagcagatgaaggagggtggtggcattccaaattcaaatacatga

SEQ ID NO: 22670 - DNA, 720 bp, Glycine max
  Peptide Sequence Number=SeqID_139448
atgacatatggcaatcatttaatgagaacacaaggaagaacctacaaaataaagaattctaacactcaaaggacatcaagcaagaagcgcaaccttgagggacaagaactggtcataaggagacgcggaaaagtttgttggcgaagtgggaaactgagaaacaacagatttgagtacattccggaggaagcacaacgcatgttgaagtacactattgtgtctaatggggatgaagactccttctctttcaactctacgaatgacaagcttacaccacggtggttttttggggaaagtgggcggttatcttgcaacggaagatatgtaaaggctgatctgtgttatggatataccaacactggagggtgccaaagatggcaagatttaccaaagtgtaggaatcctggcgatttgtttgtgaaaaagactcttgtccccgattatgaaagtgtaagttacgaaacaaatccggcttttggctacagtgattgtgaggccagttgctggagcaattgtagttgcgatggattcagagcattctggaggaatgaaactggatgtaaattctatcattggaattcatcgaaaaattatattgttgacactagtgttgctggtgtagagttttacatgctggagaacacaggcaacataaccccacataacggtaagtcgaatgtcaaatttcctgtggattttgtttttggactacttccatag

SEQ ID NO: 22671 - DNA, 558 bp, Glycine max
  Peptide Sequence Number=SeqID_139449
atgttggtgacgactccgcgcgtattcctttcgtggaacacgcatcccgcgagtcacgcgtcgccctcccgccgaagggtaggttgcgacaactatggctacatgtctccagaatatgccatggaaggaactttcgctacaaagtcggatgtctatagctttggagttctgctgctggaaattgttagtggaagaaaaaacactagcttttatgatgatgaccgtccattaaacctaataggacatgtatgggaattatggaaagatggcaaatatcttcaattagtggatccatcattaaatgagttgtttgatcgcgatgaagtgcaaaggtgcattcatgttggtctcttgtgcgttgaacactatgcaaatgatagacccacaatgtctgacattatatcaatgttgacaaacaagagtgcaacagtgtccttacctcaaagaccagcattctatgttcaaagagagatccttgatgaaaatttatcttctacagatttgtgtactacttctaccgtagaaattgctacttctttggaaataaatcagggttaa

SEQ ID NO: 22672 - DNA, 138 bp, Glycine max
  Peptide Sequence Number=SeqID_139450
atgtggaatttcaattttcttctaaaaggggaacacttagaattgcacccgtcagtcaggggaacagtcgttgctatccatcacgcgacaaaggtgctcgtcggcgcggaggaactaagtcatgctttacgtgactga

SEQ ID NO: 22673 - DNA, 1437 bp, Glycine max
  Peptide Sequence Number=SeqID_139451
atgttgtcttgcctcattggtgaaagttcaaatgatgacccttctcaccatcatggtggctttgatgctaccgatgaccaagggtctagtgttgtggttggtggcatcattgctattgctgacgttgttgccaccacccgtcccaacataagggtggacgaggccgagtcacctttgccgattccccccacaaatgtcattaacttggactcgaagactactactgtgcatgtttataatgaagtcagaagctactctactagctttttgacttatgagtcgattaccaacttcttagaagaagtcaagtttcgtctcattgatggtccaaatgtgatgatcatcgattcttgtcttaagagtgaacacatcttcatgtgttcctactcggccaagacacacttcatttctaacactgtttgtctcattttaggaattatgcccaagattgattaccaatccgtcaaaaagacacaggctgagaaagaagtagttgagaaagctaaggctgacaaaggcaagatgaatgttatggtggaagaacacgggaaaataaatgatagtgctatcattactcatcttgcgccggtatctaatcatcccgaggtgaggaaggagtatcctgagctgactgagatgtctcctgtgctgctatgggtcagggatccctgtgtggcagtaggtgagacctttggtgtagcctcacctccccccaaaggagaaggctggactcctggccagaacgtctgcgctatgcatggaggtgctggaactaatgttggagcaggaatgggagttggagctggtggtggtggagctgaagaaggagtagaagaagaaggggcagaagcgtccgatggtccccgagccctagctttgcgggtccccggaaaagtgatcgtgggatcatccggggactcgaaggtcaatgagtatggaactactcctcaggccatgcacaaggctgtgataagtgcagggaatccgagcctggaggagatcatacaggtttacataaaattccttgatcagggtcgcatctgtgtgcccatccatctacttggtcaaggatttatgccagcacctcctctcgagctcctgacggaactcatcatattcagtgacataaagaataacattcctctccggaaggatattccgggggctcctggggccgggaggcgcttagccaaacttgaccgctggaacataattggcttagcgagcaagctcgctaagaccaattccaaaatagagaagaatttgcacttagcgagacagactcgcttagcgcatgaacaaaaactcagaaaactaaattgccttgggcttagcgaggctgactcgctcagcccaggcttattcaagctacagaggcatggtggcttggcaagactgacttgcttagccaccaacaaaagaccaaaagcctcttag

SEQ ID NO: 22674 - DNA, 1553 bp, Glycine max
  Peptide Sequence Number=SeqID_139452
atggaggagacgaggaagtttgtgtgcaagtattgcagcaagaggttcccttgtgggaagtctctgggtggccacatcaggactcacatgatgagtgagtatcatcatcattcagctttagccaatgaagagaggaacaacaacaacaacaatgctgctaatgctaatgctatgttcaagtttgatggtgggagaaagaggaagagggatttggggtctgaagaaaatgggaacaacaattatggtctcagggagaaccccaagaagaccacgaggtttgtgcactccaatgccactttgcaacttgacaagttctgcaaagaatgtgggaagggttttccatcattgaaggctctttgtggccacatggcttgtcactctgagaaggacaagcgaaggtttgctactgagaagcagaaattggttatggatagtcaatctgacaccgaaacttcttctgctccaaggaggtccaagggaatgaagttcaagacccttagcaacaacaaccaacctcaatcttcttctgtgtcagaggttgagcaggagcaagaagaggtggctaggtgcttgatgatgttgtctaaagattctagctacaagggtcgctttgctttgctcacagagtcttctgacaacaactcgattgtcattacgaagtcaccttctcttgaaaccaaggttactactatgatcaatggttacggtaagaattctatgtctagtgcttatgtggagaggaagctggagctggaacagaacaaggacttgaagtttaagtctgctgaagtcggctatgattctgacaattcagattctgggtatttcagatatggtcctaagtcggatgtttcaaatgatgatgggtttttcaggaatgaggttaagtcttcgaaagttgggtacttgaatggttttgatcaggagtatgatgttgaatcgaggaaggtgctgagcaggggaagaagcaggagcagtgaatttaacgaatttgttttggaggattgggagaattatgatagagaggatggtgtggctgcaagaacatttgattcaaagaaatttaagaagtccaactatgatgattctcttggtcaaaatttaggtggggtttctactaggaagtatgagtgcttgactaatgaaatgtacaatggttgttctgatgattctgcttatgagagtgatgagaacagcactgacactgattcttatcctgctccaaaggctcacagcaacaggaacaacctcagtgtccagaaggggaagaagaagaagaaattgaagtcaaagaaaagcaaggcacatgagtgtccaatttgcaacaagattttcaggtcaggccaagccttggggggtcacaaaaggtcccattttgttggaggttctgaggaaaacacacttgtgataaggccaagtgctcctcctgctgctgttccttgcctcattgatctcaatctaccagcaccggtagctgaatgtctctggagttctgaaaatgtcttgtctttatccccatatgatgaaagcaatgacaatgtacagacaagtgg

SEQ ID NO: 22675 - DNA, 948 bp, Glycine max
  Peptide Sequence Number=SeqID_139453
atgacccttcactcagtgcaaatgcacagctcatccttcttccagattcttcctcgcgctcaaccgaggagtgttgcgctcagcggatggctcgctaagccagaagattggcttagcgagcggatgaaaatcagcacttcacaaactggcctaattaacctgaaattgagaggaaatgccctcacctttgtttcattttggcctagcatttcgggtgcgttttccctcactccttggccaaccatatttcgattttggggttttgacgaggtcgtctctatcaccaccactatagatcttaaagaaggggatgtagaagaggcgacatttaggggtgttcaccacaaacttacagaaggcctcatgggttttggagctgccaaggagggagcgctagatggaggtttcttcgacataagtgtcaggaggcctcacgaatgttggagggactctttgttcatggctatactcacttgcaatgcgcataggggacacgtagaactgcacccgccagtcaggggagtagtcgtcgctgactatcacgcgacggaggtgctcgccgagtgggtattgtgggcttcggaggaatttggattcatcacaccaagtgactctgtttcaactataagtagtataatgcctcagaaaaagaatccagatctgatggaacttgtttgtgggaagtctgctagagtcataggggatcttgttactcttctcacattgtgcaaaggacttcctcatgcttacgactgcaatttgcagaacaggtcatctcctctaaaatatgtttccagcaaaatctgtttagatttcttgaaaccttttctaagaattggtgaagagaccaaggcacaatgggaggatgatagctcaaactgcaacaagtttgaaggcaaaattaatgtggccatgtgggtcaacccgtgcaccttgttggtaggatga

SEQ ID NO: 22676 - DNA, 468 bp, Glycine max
  Peptide Sequence Number=SeqID_139454
atgcctatggtgctactttctttcttggatcaagtggttatagaaggagagagaaggaataattgtagtggtcaatatgatcaaatttgcaatgcacagttacctcgagcacttgatccctactctgttccatcagaagagctttccacttctttgggaaacatggtggaacttataaatcttgttcacaagttggctgccttggcacttcataactcaggttttgcggaaggtcaagtattaggaaaccttttgtttgagttattatcagaagcacttggactcaagcctgatcatcttaaagacatggattatgcaaagggacacttaattttttgttactactatccatcatgtcttgagcttgaactgactatgggaaccaagagccatacagatcttgatttcctcacatttttgcttcaatatcatgttggtggactacaagttttggtccataatcattga

SEQ ID NO: 22677 - DNA, 421 bp, Glycine max
  Peptide Sequence Number=SeqID_139455
gaacatggttacaaagcttcatcatagccttatctttgttgttgaaggattcacattaatggagtgggataagtcccattttggtgcttgttggtgtagtggtaatgcttatattcttatgcatgttgtgattaatggagcaaccaaggaaataggaaaggtagcagtagtggcagtgactaaggcatgtagaatagaggtagcaggaacggtggatacttgtcatattggggaaaacattagaaagggtgtcttggttgcaccaaacctttccatcggatcaatattattgcaacaacttgcgattttagcttctttccattacaacaatatcgaaattgtggaatctagggccaatgcaaatggatcaaaatggggtggctatatgatgcgtatgatgcgccatttggtatcatactga

SEQ ID NO: 22678 - DNA, 228 bp, Glycine max
  Peptide Sequence Number=SeqID_139456
atgtcagataactttatgaagtgtgaaagcaaatgggagaatggtgttgaagatttgtttgctaatggacatgatgcaaaaaaccttacatggcatgtagatggcagaaaaagtgatggattgttgcgacatctgacggattcttcacaatggaagataatcgatcgtttgtatccagattttggcaacgaggcaagaaacctaaggcttggtcttgatttcgaatga

SEQ ID NO: 22679 - DNA, 366 bp, Glycine max
  Peptide Sequence Number=SeqID_139457
atgttcaagagcaaggacaaggatccacttgaaggacttggaggacctatgacaagggctagagcaaggaaagccaaggaagctcttcaacaagtgctgtccatactatttgaatacaagcccaagtttcaaggagaaaagtccaaggttgttagtgggtcattactaaaatctgctgtaaagcttctatataagttgaaccattttatcaataaacacaagttgagttttattcagaaaattagagtttatctcttttatcttagtgagagtgattctcctaaattcttgagtgattcaagaacaccctggctgtatcaaaggactttcacaacctttgtgtgttgccctcgctggaaagagtga

SEQ ID NO: 22680 - DNA, 348 bp, Glycine max
  Peptide Sequence Number=SeqID_139458
atggatccctacggttgtcacgctctaggcctgacccccttgagcggaagggaaggtgtggttaatggctctctccctattcatagcgggacctccccacttgaaatagtgatcattatattgagtgtttatgttcgtgacaacgaagccaatatccagctgtatacttgtcaactcctaaaacttcatgatgagattaactgttctcaatatgctccacaagttgaacaacctccagctaattttgaaagtactcaaactcttaatgctgaaagtgctccttctccaactctaattaccgctcaaagtgctccaactcctaatgctacgagtgacttttacatataa

SEQ ID NO: 22681 - DNA, 237 bp, Glycine max
  Peptide Sequence Number=SeqID_139459
atgggaaaatggggcttacggcgacggcttccgaaagatccgttaggggttcttccggaacttccggaagaagctgttaagaaaccaaaggtctttcggaagaacccttcttccggaagtctcccggaacacctcttccggaaagtttccggaagaagtacttcttccgaaagaattccggaagaagggttcttacggatgacctttgagatttcaggaaagtttgtttttttttaa

SEQ ID NO: 22682 - DNA, 138 bp, Glycine max
  Peptide Sequence Number=SeqID_139460
atgggatcacttgtagctattctcattgagtcaaaggatcaatatccaccagttctaaatgacatgatccacattaatataattgggcctaaggtcaaagcttcaagcattgatcctgagagacatgacacttgttga

SEQ ID NO: 22683 - DNA, 324 bp, Glycine max
  Peptide Sequence Number=SeqID_139461
atgactgcattacaacaaaagcaagaagcaaacatgcaagcattgcgccaggaaaatgaacaagccgataacaagtcattatgtgatttcacgggccaattttcacaaattgcaattagaatccaagaactcaaacctggagtatcccttcatgccatgatggtagcactcaagccaggagcatttgcagatagtctatgtaagaagaggtcgaccatcatggataacttgagatgttgtgcaatcaattttactcaggtgaaggagttgttggagttccgtgacaaagttagaagagaccaaaagaagcctgattttcattaa

SEQ ID NO: 22684 - DNA, 795 bp, Glycine max
  Peptide Sequence Number=SeqID_139462
atgcaaagggggagggaggccggggaggggccgaaggaagaggaaggggggagggggagggggagggaggaaggaaggggagggacgaaaggaagaagaagggggaaggggagggaggaagaagggagaagggaaggggcaaaagaaagaagaagaagagttaggagagagagaggagaaaaaattgaaaaaaaaaagaagaacagagaaaatggacgttgggggaaggagaaagttgaggttgggaaaggagaaaagaacaatgaaagtggtcacttgaccattactgtgtacacaataacgttggaaaaattggatgaaggaaacgcaaacagtcggaaaaaagcatttagcacaatagaacggccagaagaaaatatgcaatacgaaattgccattgaggaaataggagggtcttcgacaaaaagaaagcatcgagttgcctttgcaattgaagaagatacacacctcattagttcatggctcaacatctcaaccgatccaattgttggtcaaggaaaagaagtgttttggttgagagtcatggaaaactacaacaaatttcgaggtgaactctgcgaaagagcagttaatcaattgaaatcacaatggcaaaaaattaatcagggcatgcaaaaattcaagggtcgttacaagcaagcagtgccattgaaggaaagtggttgcacggataatgatgtcatgcttaatacatatgctatttggaaggaagacaaagaaactaattttggtttggaacatgcttggaaacttttgaaagatcaactgaaatga

SEQ ID NO: 22685 - DNA, 411 bp, Glycine max
  Peptide Sequence Number=SeqID_139463
atgaataagcatatttcttttgaaaaagagaaagaaaatgaaaaagaggttcctgagaaggagatcccaaggattattaatgtggaaaagcctactactaagagtagagatgttgatgtgatacagccacataatattgatgagcttactactaactctgatgctgctaataagaatatggagaagccgaccacttcctcattttctccaactcctccaatccaagaccaaggtgaagagagtgttcctcaaaatactttgtctaaaagcgaagtggagcttgttaaggccattgaaagtcttaacatgaaattcaacatttcaatcaaggacttgctaaagactaataataatgtcaatgcattgaacaatcaactgactactgaagaaaagaagaagaaaaactcatga

SEQ ID NO: 22686 - DNA, 171 bp, Glycine max
  Peptide Sequence Number=SeqID_139464
atggacgtggacaacggtgactacccagagcaagacaatgcggtttcaatgaggaagggtgtctgtgctggtctccttagaggtttaatgatttcaatacaattttcaagctacaagtccatgaagctagcgaaaagagagaccaagagaggaaggattgtcgtcatttga

SEQ ID NO: 22687 - DNA, 456 bp, Glycine max
  Peptide Sequence Number=SeqID_139465
atggccattaaaatcgaccatgaaaaggcgtacgatcaccttctttgggagtttgttaaggattctttggaggatgttgggtttcccaaccatctaacccaagttatttggagttgcatttcttcgacttccatgaaagctctttggaatggggaggccttggagtctttctctccaactcgtaggttgctgcaagatgtcttttgtgctagctctggccaaagggtgagtgattccaagtcgcatgttttcttctctaaaaatgtccattcgcaacaaagaaaagacataagtgacacacctggatttcaaaggatggataatctgggaagatacttgggggtaaacatctttcattccagggttaagaaagcttcattctttgaggtgatggatagagtggctaatagacttaacgcatggaaagccaagatctctcattggtcggtagagtga

SEQ ID NO: 22688 - DNA, 234 bp, Glycine max
  Peptide Sequence Number=SeqID_139466
atggttgaggggatgaccatgttcgatgggtgtttggcttgtcttgagaatatcaactatgcttcaaggtgtttagttatgttaaggggatatgtaacattggctaaggggtcattcggtcatggatcgtgggtagcacctataatcaaggggtgttcagttaggcccatgatcgttgatgttcaacatagtcaaaggggacctatctcgatgggtaaatgtattaacaactaa

SEQ ID NO: 22689 - DNA, 594 bp, Glycine max
  Peptide Sequence Number=SeqID_139467
atgggtagcgatataaaatctgcttctgatttaggtgaaatattttgtaggagtaaaggtaaaaacaaggggcaaaagcgaatacggcagccacggtttgcatttatgaccaagagtgaagttgatcatcttgaggatggctacagatggcggaagtatggtcagaaggcagttaaaaatagtcctttccctaggagctactaccggtgcacaaacagcaaatgcacggtgaagaagagggttgaacgctcttccgaggacccaacgattgtgattactacatatgaagggcaacactgtcatcacaccgttggatttcctcgagggggaatcattagtcatgaagctgcctttgccagccagttggctccaacaatgtcacagttctattatccaattcaattacccagagataataataataataataatagtttcagctctatttctcagccatgccaagcatatgatgatgctgaaggaggattaagtgctatgatgccattgccagctgatgtatcgtcacagtcacagccttccacggatgaagggttgcttggagatattgtacccccgggaatgcgcatcagatga

SEQ ID NO: 22690 - DNA, 279 bp, Glycine max
  Peptide Sequence Number=SeqID_139468
atgtgggattaccttatggttacccgcacctttcgtcaaccaggggcaaacgtgcccattgacgcacagagactaacatcgtcttctgcaccttttgtcgtccttacccgtgaagtcaggtgccatgcggggttaccttatgtgaagtcaagtgacatgcggggttaccatatggttacccgcaccttttgtcaaccaggggcaaacgagcccgatgacgcaacgagagtaacatcgtcttctgcaccttttgtcgtcctgacccatgatgtcaggtga

SEQ ID NO: 22691 - DNA, 336 bp, Glycine max
  Peptide Sequence Number=SeqID_139469
atgtgctgtgaagtgttggagctaatggctgatgggttggagatagaaccaaggaacgtgttcagcagaatgataagggatgagagaagcgatagctgctttagaatgaaccggtacccagcatgtccagagcttagagttgaggcattgagtggacgaaatttgattgggttcggagagcacacagacccacagataatatctgtcctgagatccaacaacacatcaggactgcaaatgtgtctccgggatgggacttgggcttctatccaacctgatcacacttcctttttcgtcaatgttggtgaccttttgcaggaaagtcagaaagtgtga

SEQ ID NO: 22692 - DNA, 444 bp, Glycine max
  Peptide Sequence Number=SeqID_139470
atggttgttcattctcaccaatctgcactaaacgagttatttctcgtgaaagcatcatgcaagagcaggttcatgtgggtgcccgaggttgatctcacgcaccccgaggccaagacggtcatagtcaaggcatgtcaagagttcggtttgttcaaggtggtcaactatggtgtaccactggaattgatgacccatttggagaatgaagcactcaagttcttcatgcagtcccaatgtcaaaaagacaaggctggtcctccagacccttatgggtatggaagcaagagaattggcacaaacggtgatctgggttgggttgagtacctactcctcaacacaaaccctgatgttatctctcccaaaacactccaactttttgaacaaaacccagaagtgttcaggtgcgcggtggaggaatacataggggcagtggggatcctctag

SEQ ID NO: 22693 - DNA, 168 bp, Glycine max
  Peptide Sequence Number=SeqID_139471
atgaaaaagatccaaggcctacaagctccacatggagctacatcacaatgggttcctaacttgaagccctacacctttctattaacacctcgcacattgtgctatgatttaacaccccaggttcctaatttggaaccctatgctttccttttaacacctcgcacctaa

SEQ ID NO: 22694 - DNA, 321 bp, Glycine max
  Peptide Sequence Number=SeqID_139472
atggatgaacatcaacaaaactggaaggaaatggctaacacaatgttgaagattaacaaaaaagcagagaacatgttcaacatttttcatgttattgatcaggtgaccttgacccactatggacagagtgttttcctcctcaccatcttcaaaagcacctttgaaccaaaagcttaccctaaatggcactccttgtaccaccaagttcctaactcagtcacttttaaagtcctactaactgagtacaaagtgacttgcaacaatttggatgtgccaagtaccatgcactcatttgaacttggaagggactacagagtgtag

SEQ ID NO: 22695 - DNA, 291 bp, Glycine max
  Peptide Sequence Number=SeqID_139473
atgacaaatactatccagaagaagttcaaggtttcttccacccagcttttgtatcaatcaagtccatatcaggcagcaaccctgttaatctctggtccatatctggataaacttatgaccaaccaaaatgtatttggtttcaagtgtacaacacaagtgaacttggtaagaggctacatatcaagcaacaatgtaataaatgaggacataagtttcagaatcacatacatacctcgaaataggctactaactaaagctttgcttgcggtcacactgcagatgaatggatga

SEQ ID NO: 22696 - DNA, 516 bp, Glycine max
  Peptide Sequence Number=SeqID_139474
atgcatgctgtggacactggacagtgcttgctagtgaagggatggaaaggttcaagctggagcttccctcatggaaaaaagagcaaagacgaagaagatcatgcatgtgccattagagaagtcatggaagaaacaggttttgatgtttcaaaacttctaaacaaggatgaataccttgaagttatttttggacaacagagagttaggttttacattattgctggagtgaaagatgatacaacatttgctcctcttaccaaaaaggaaatcagtgatggtgccgagaatggttatggtgctaaagcaacaaaaattctcgatcaagttagaggaagtgctgctcttgctcaaattattttacgggagaggctacatatttttcgaattcttggttgcattttgtgtgtcgtgggatgtacaacaattgttttgcatgctcctcaagaacgggaaattgaatctctttcagaagtgtgggatcttgctatggaaccatgtagccatgttcctacttga

SEQ ID NO: 22697 - DNA, 426 bp, Glycine max
  Peptide Sequence Number=SeqID_139475
atggtattacccaaccacttcacacaaaccaaacactcagttgttcctgcaagtagatcaggtgctccaacaaggaggagagtgcacttagcaacaacaaaagcagagaccatgactactgtcatagaaaaactgggcatatgcccaattaagattgagaggaaccctcctgagtccaagctcactcaactaggaaaagatgttgttaagaaatttaagagatggggttgccctccaagtaagttcccatggacatatgaagccaaagagacttgttatcttctggaaggaaaagtgaaggtctttcctagtaggtcaaatgagtcagttgaaattgctgctggtgacttggttgtgtttcccaaagggatgagttgcacttgggatgtgtctgttggtgttgacaaacactataattttgaataa

SEQ ID NO: 22698 - DNA, 336 bp, Glycine max
  Peptide Sequence Number=SeqID_139476
atggtggagcatgtggtggttaccgatgtttggtgctacagctgtggtttatgttggttggttgcggtgatgatgggtggctatgaaagaggttcgattggcaatgggtggtgtgcgagggttgatgatgggtgcccgggttggtgtttggaaaggttatggccaaagatgataggtctagacacgtcggtgatgggtgatatcgtgatgtgtagatctagttatggtgcttggtggtggtcgaagatggtgggtttggacacactggctatagaggtcattggaagtcttagaaggctagaaggggaaggtggaaaaaggagaagtaaccattga

SEQ ID NO: 22699 - DNA, 759 bp, Glycine max
  Peptide Sequence Number=SeqID_139477
atgagcgagagtggtttcactgtgagcgaagggtggcttcagcgtcgcaagagtaagagtgacactgtgagtgagacactatcagcgacagtggtttcaatgcctgacaacgattgggctagagataaagatgatcggaaaagtaccaatggatttgtgtttttcatagggaacacaacgttcacttggatgtcaaaaaagtttccaatagtcactctttcgacttgtgaggcagaatacatagcagctgcttcatgtgttttccatgtagtttggctcaggaatttgttaaaagagttgggcatgtcacaagaagagacaaccaagatttttgtggataataagtcaaccattgctctagcaaagaatccagtgttccatgatcgaagcaaacatattgatacatgttaccactacataaggaagtgcatagcaagaaaggatgtacatatagaatatgtgaagtctcaagaccaagtagctaacatcttcaccaagctgctcaaacaagaagactttatcaatgatgatggaagaagcaagaaaaggacggctaaggtctcaagaggactaacagtggaagagaaggacttggtggataggagtaagaagaatatcgaaggagagattcatggtttctccgattttgttggggaaccgaaagatgctaaagcctcactagaagaagagacatacatggaagataagattaataaagatgagggttatgagtctgatgatacaacaattatggtgtag

SEQ ID NO: 22700 - DNA, 150 bp, Glycine max
  Peptide Sequence Number=SeqID_139478
atggaatccatatccaaggccattaacccagagttcaagaagcatgcatgtgacaacaaagacggtgtttggaatagagattatgcctttgcatatatggaaggtgacgactatgatgattatgactatgctcccgcagcatttgcttag

SEQ ID NO: 22701 - DNA, 159 bp, Glycine max
  Peptide Sequence Number=SeqID_139479
atggaactgactaaccctaatcaaccattccaggcacgagtagaagtggctatcgctgttaacggaggaagaagcgccgccacacaccttgaacagggcctgagtaggacagagttctctttgatagagcttagtgatgggtcacagagttatgggtga

SEQ ID NO: 22702 - DNA, 960 bp, Glycine max
  Peptide Sequence Number=SeqID_139480
atggcaggatggaaacataaacttcttaacagggctagtagagttactcttgtcaaaagatttatttggggatccaacactaaccactgggtcatatggccaactattacccagtctaagaagctaggtggtctcggtataaaaaggacaagagaggctaatgtggctatgcttgggaaacattcagtaaatgatattcacattaatgatgacaacaattggatatgttgctggtccaatatggtcacggatagtcctttgtggctcaagttggaggtagaaagcatattcatcaatgcagaaacccatgatgtggttgcttggggttatgctttgaatgacatttacacgatttcttttgcttatggttggctcacaaaagctcgctcatccactgtggtcaatgataggagaggatcctggtgtggcaacaatgaagaatccattcttcaccttcccaatgatttccccaaagccattatttctattagggagctcttgaacctggacatgcatgatatccctatgaacccgatagttaagcttggatcaaaaagtactcaattggtagcaatggctcactctttgcttcaacagtttggtggatttggaaggcttggaacaaagaaattttttcatcaaacaactatcccatgtttgttcttcgtagcagaattctctctctcaatgacaccattcaacatgtttttccttagtcgacagttgctcgcgctcaaagattggtctgttagtttgcatcggatcaacgtatatatgtttaagttcaacatagacgatagtgccattggtaacctaggtaaagtgggttttggtggtttagttcatgactctaatggcacttggtgttgggattgggctcttccgttgaagcataccttgaaggaggggaaccaagttgctgactctctggccaaagatggtgctcaaggaattcattag

SEQ ID NO: 22703 - DNA, 555 bp, Glycine max
  Peptide Sequence Number=SeqID_139481
atgcaaaaattcaagagttattacaagcaagcggtatcattgaagaaaagtggttgcacagataacaatgtcaagcttaatgcatatgccatttggaaggaagacgaaggaaccaattttggtttggaacatgcttggcgacttttgaaaaatcaactggaatggttatatcagtttactgaaaattgctctaaaaggatgaagatttctgcatctagggcatattcatcttcatctaatccagaaacaccgatcgaaaatgttgaagttgacacactgtctccaattttccgtttaatggggcaaaaggcaaccaaaaggaagagcaaagggaaaagagtaggaacatctaccaatcctgtggacctcattggtgtggaggaaggaatgcgggaaataaatattctcaacgccaaactagcaaccttaagggagaaagaattggaaaaggagtattacgatattctaatgaaggacacatctacaatgtttgaaactcaactcaaagaccatcaagccttttgtaaaacaattaggcataaactacgaatctag

SEQ ID NO: 22704 - DNA, 1170 bp, Glycine max
  Peptide Sequence Number=SeqID_139482
atggatccacaaagcatgcattttgtgctgtccactgattccaaaccaaggctgaaatggactcctgagcttcaccgacggttcattgaggctaccaatcagcttggaggtgcagatacttatattatttgtcactctgtggcatcatgtggcagaagcaactccaaagagtcttatgagggtgatgggaattccgggacttactttgtaccacctgaagagccatttacaggcattcattccccttttaaatatagacttgggaaaagccaagaactagaaacctgctctgacaacaaacaagaagattacatagaaaccaagagcagcagtgatggccattgcagcagggaaatcagtattggggcccagaatcaacttacggagactatgtctcatagggaaatggtatttcctagagcttttattgatcaagttctgtgtttatttaccagaaacatgcagatagctcaggcactccaaatgcaaatggaagtgcaaaggaaacttcatgaacaaattgaggtagcacatatagtgcaaaaacatttgcagctcagaattgaagctcaagggaagtatttacaatcagtgctaaagaaggcacaagaagcacttgctggatacaattcttccccagtggggatagaacttacaaaagctgaactttctcagctagttaccatcatcaacaatgcttgtccaagttctcccatctcagaactgacagaaacaagagggttgagtttaagctgtggggagaggaaaagagacagaggcactatgtgttcactggaaagttccttgacatcttctgaaagctcggggagaaaggaagagaaacagccaatggaagagattgtggagttcaaaagttccattaatgtttcacttcaattgccattgatggaaattctcactgaggataaagcatccaatggaggctcaagcaatgaggctagtgggagaaagagaagtgcaacagcagcagaatctgatgatggtagctgtgttgttgagcaaccatgtgggaaaagatgtggcaacaagttgaggaaagccaagttgtcagaaatgcttgacttgaacagccagtgtcagagtgacatggactcaacaagctcaaaaacattagacctaaattgcagtttaaacttttgggaaccatga

SEQ ID NO: 22705 - DNA, 396 bp, Glycine max
  Peptide Sequence Number=SeqID_139483
atgtctttcgaccaagactatcatagtcttctttgcctcaagactatcaagtccgttggtatgcagagacaatcaaggtcatctgcctcttttcaaagacttcaatgtctttcaaccaagactatcacaatcttctttgcctcagagactatcaagtttgttggcatgcagagacaatcaaggtcatctgcctcttttcgaagacttcaatgtctttcgaccaagactatcacagtcttctttgcctcaagactatcaagtttcattgcctgggctcccgctagtggccggtcggatgcccttgggcccactaggaagcttagggatgaagtaaccagctcgcctgggcgagttgctgtgcaacctccacccctcatttcctataaaaaggcgtga

SEQ ID NO: 22706 - DNA, 456 bp, Glycine max
  Peptide Sequence Number=SeqID_139484
ggagaatccttgaggtttcgcacttgcacatttgagaagaaaactcattcggccaagagctcatggaaaatgctcaaagacgattgtgacagtaaggatcagcccatgtcatcaagttttagcaggattgacagaccattggcatcactctatgactttaaatcaggtcacatagcaaagggtgacaatccattgccatccttcaatggggagcacggaaggaaaacgcgcggagtcgccactttgagagagtctccgaagagatttgcaaaagataggggcgaagtctgcatgcctatgcattccaagacccattgtcgcaacctacccttcggcgggagagcggcgcgagactcacgggataaaaggtttgggagcgtggctcaagggacgacagcctttaatcaagtctacaagagtgtggctcttgctcctacgtatcctcaattacgatga

SEQ ID NO: 22707 - DNA, 555 bp, Glycine max
  Peptide Sequence Number=SeqID_139485
atggcatccatgtccaaggccatgaccccagaaatcaagaagcatgcatgtgacaagaaagacggtgttttgtatcattatgatcccacagcttgcgccgaaggagatgattataacgggaatataaattatgtttttgcatatatggaaggtgatgacgatgatgatggtgtcgcaaacaaaggagaaaaagaccccattgacaagcggcacatcgtttggagctctttctactaccaacaaggatcgcggcaggatgcatggcgtctatggaacaccacgttctcgaactcggcaaccccgatctctgagaaaatgctctccatgaactctcaaggtagtacttatcttccgtcattttcccactctcgtcatttcaaggctcacacggaaatagtttcaatattccctgttatttcacctccaaaccttactccagcacaatcaactcgagtgtgcaatgctcttgctctttttcagtccatggttctaaattgctgctccaatacagttctattgtggctaggtggcagcagatgcgttgcgaaattttga

SEQ ID NO: 22708 - DNA, 357 bp, Glycine max
  Peptide Sequence Number=SeqID_139486
atgtgtaagaaggagcatgaatctttcaaagaatgcgcccaaaggtggagggatctagcagctcaagtagcgcccccaatgatggagagggagatgataacaatgataatgatgggttacatgccttcaagctttgtagatttagtgtttgctggcgaaaagattcaagtgggtctgagaagaggcaaatttgattgtcctgctttgatgaataggaagcctgaggcaaatggagagaataaggagggaggaacccatgtcgtgactgtcatttctacatggccaaatttcccactagctcaacaatatcaatactcagccagtatcatcccttctcattacccaccaccctattaa

SEQ ID NO: 22709 - DNA, 489 bp, Glycine max
  Peptide Sequence Number=SeqID_139487
atgatactctccgacacttctggaagtctaaagaaaaccaccatcaagcattcagtgccacaaaaaaaaaaatttgatggatcatgcacagtaataaggtccataatcaccgcctcaagcagtgattgccattataactcacatgttggtgcccaatttcactcacaggatggaccgcaaaaacgcaaacaaaaccaggagaagcgaagacacgggtgttcagcggttacacatatctttactcaaacctcgacgttgcccccaaaattacggtcactattaaaaatcttgatgataagttacataagagaaccatttactgaacaagcaatgtgcattcacttcaaaaagctggaatccatcagcaagaacacatatacagccttcgcggtgcgagctccactgcttcagggagacagagatttaggggctgcgggctacagtgtttggggtttgacggcactgcggggtacagtgtttggggtttaa

SEQ ID NO: 22710 - DNA, 450 bp, Glycine max
  Peptide Sequence Number=SeqID_139488
atgtataaaccccaagaggcagaattgcggatgacccgaccctctcatattgctcaaagaactcacacctcgacatgttgggattctccgtggccaccactcgaacccacgacacgatcagcttccagcatcggcgtccacagagccacgattctcagcggcgagaacccacggcggggccgaggtggcagagctggtaatcatggagatgacggagctcaacgagcgtcttctccatctcgtggacattgcgagtgcatagaggaggttgagtggggaaggacaaagaattgggaccttagtattgcatggtcaccagatggaaagtatcttgtaagtgggaccaagactggaaagtatcttgtaattgggaccttccttgtggctttgtctatagatctcacaaacaaccatcaaaaccctgagcgacccgttttccttgcgctgtaa

SEQ ID NO: 22711 - DNA, 858 bp, Glycine max
  Peptide Sequence Number=SeqID_139489
atggaggagttggttacaaaacacaactctcccaaaataacgccaacgtcatcacgttggctcggcggctcctcaccagaatcttactccctacaccctgccactgttattctgctcccacgaacaagaccacccggttgtgcacgtaacagcccccctcccataggtgatcagcctgggagcccaaaggtgttccctaccagcatgcaacagggacaggcagatatcctcatagctaggttccctgaccctaactatggtgttaaaacgattccttttcgtccttgctcgtcgattccatgcaagcctctgctataccaaaacgaaggagacttagtatggatttcagaaaacaaagctagtaacagtgctctgggtcaaacacccacatcactacatgaaagagctgagagcatttcgggttttacaaaggaacatcatttggaaattccgaccatgccaatggttcctctcggtgtggagaacaacgatggtttgtggtggctaatggtggctgaacggaagcttctagcaccctccatacatcttctcaaagatcccaacggtcagatcatggagaagtgtcttgtgaagttgcaaaccaaatttcaagaagatccaacggttaacgaaggctgggaagcgtttctaccgaggcagcttcataccaaatttagagaagatccaacggttaacaaaggctgggaagcatttttaccgaggcagcttcatgtagctttctctagaagcttcattaagaggcttcctccagaagcttcattaagaggcttcttccagaagcttcctcgtggcttctttgagaagctagatccttatctatccacacccctctattaa

SEQ ID NO: 22712 - DNA, 603 bp, Glycine max
  Peptide Sequence Number=SeqID_139490
atggaaaccgggcatcatgcacggggactttcacctggccaacatgatgttccgcaacgacggaccgcagctggcggcgatcgtggactgggagatgtccaccatcggggatccgctgctggatttgggctggatgctggccacgtggccgtccgagaccgacgacgcgtccttgggtggcgcgctggttcaggccgggggcctgcccacaccgcaggagcttgtcgcgcattacgcggaacgcacggaccgcgatctcggtgcgatggattggtacacggtgttggcgtgcttcaagctcggcatcattctggagggcacacatgcccgcgcgtgcgccgggaaagcacctgtggcggtgggggactacctgcacggactgacgttacagctgttcaagcgcgcggtagcgatcaccgggtagtccgttcgccgggctcgggggtgcgccgccgcgtcaaccgcagtatcgcgaagagcagcaggatcacgccccaggacagcaggcttgtccacagctgggtgcgggtggcgtcctggaatcccatggccaccaggatggcgacgattccgatcgcggtcagaatggtcagggcagggtag

SEQ ID NO: 22713 - DNA, 594 bp, Glycine max
  Peptide Sequence Number=SeqID_139491
atgggtgaagtagaggaggtgcaagagcagatgaaggccgacatggaggccatgaaagagcaaatggccacaatgatggaggccatggtgagcatgaagaagataatggaagccaatgcggttgcaatagccgctaccagcaccattgctgaggtagacctgactcccccatatggccttaaccaaataaatcatttaatcccaaatatgaacgagcatgccttcccgccatatggcttgcctcccaactatacaccacccaatatggcgtacactcccaatgaggatgtcaataactctactcccatactcattgagagccgacaacctcgtcatgtacatgtctctcaacccgtgggggagacacatgaaattccccaccacaatctagccaactttgagccttgcctcggatatgccactgaagggcaagcagttggtgatatacccctgcaaaacacattggagggccctcagtatcatccacaaccacacctcttgcattccacagtgggtaaaaaccctcatgctatggcggaaatgggaaagttggatcatctagaggaaaggctcagggccattaaaggaggctga

SEQ ID NO: 22714 - DNA, 490 bp, Glycine max
  Peptide Sequence Number=SeqID_139492
caattatcagacttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccacttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccgtaagattcacatcatctggtatcagagctttggctcttgatacagactttgtgtcgtaa

SEQ ID NO: 22715 - DNA, 315 bp, Glycine max
  Peptide Sequence Number=SeqID_139493
atggtaatcgattacatgttgaaaattcaaattcaaaacctttttcaacagctatttctcaaccctgtcttctgcgcttaccgaactcgtgctagagctagagtaatgggtgaagcagaggaggtgcaagagaagatgaaggccgaaatggaggccatgaaagagcaaatggccacaatgatggaggccatgatgagcatgaagaagataatggaagccaatgcgattatagttgccgctactagcgctgtcgctaaggtgaacccgatgctcccatctggcctcaagcaaatgaatcatccaacctcaaatatg

SEQ ID NO: 22716 - DNA, 367 bp, Glycine max
  Peptide Sequence Number=SeqID_139494
agctggacctattctgattctgaattatccgtcgctacgctgttcccaaggactagcaaaatcgaaatagcgaaattcttgggtcatctcaatgggttcagaaaccacacgtttctctggatcatcatagcgtacttctacatatccactcagaggaaggtagcgcatctagatagcatagctgaaagcggccttcaaaagcctagcaacggaattgccgatacctatctctatctcttcctatcggcaggagtcttacccgcggatactcttattcgagagatggaattgggaatctgtttcgagacttcgtcattgagagctactaactgccattattccgaggcttatggagacccggttcccc

SEQ ID NO: 22717 - DNA, 543 bp, Glycine max
  Peptide Sequence Number=SeqID_139495
atgaaatggaacgaagtcgctaaggtcagaatgaaggatcttggaatgactcaagaaaaattatcagaacatttaggtatcacaccaggagcagtcagccattggctcaatgcccgccgatcccctgagctagaggtgatagcaagaattcttcatattctcgatatagatgaatttaaagttgataaaaatggttcaatcttcacctcagcagactttaaaaactcatcttgcacgaccaagacgatcaactgttatcccctgttatctaaggaattaatcattaattatgttgatgacttaggttcaaatgaagcagataattttgcaaatgagtggatagagtcaggcgcggtcattcttggtaaaggtttttgcatactgtcgggcggggggagtgcaggagcacgagatcccgaagtggcaaaacccaccatcctctcagcaaacgagatggcactaaacagcgccatttcctttgttgatggaggttctaatgaaaaagcacagtgtaacgtgtccggtttgcggtctgagatttga

SEQ ID NO: 22718 - DNA, 414 bp, Glycine max
  Peptide Sequence Number=SeqID_139496
atgccaatctccccctgtagatgtatcagttgggatcgcgcccacaagacgcccaatggacccgaagaagtccaacagggccctggggtttccagcactggttacgggcctctgtcagtcctacagggtgcccgttcccccagcgaggaatcgcacccacaaagacacccagtggacccgaagaagtccaatagggccctggggggtcacgcccgcaagacactcagtggacccaaagaagtccgacaggtcttggagttgccagctctgattacgggcctctgtcagttctacggagtgcctgtcgcccccagcaaggtcatcaggccctctactaatcaagctttcatcaagatgtactgtgtccctaggcaggcacaaggcgaaataccacagcagcccggggatggctag

SEQ ID NO: 22719 - DNA, 285 bp, Glycine max
  Peptide Sequence Number=SeqID_139497
atgacgaaagagtgggcagtaaaggttcaagatgactgcagaaacaccggtgtgcggatcgatgatgtaggatttacgctgctagatctaaagaaatttgcttaccagaatgacactttgatcatggcagaacaagccaaacaggtattttatgttcaagacccttgtgatgaaagtcctttgtccacacaaatgtcgcctaacatcgtcaaagaagaagaagctgacgacgttcatgctaattgtaatgatcatgatgaagaagaattaattaacattgtctaa

SEQ ID NO: 22720 - DNA, 261 bp, Glycine max
  Peptide Sequence Number=SeqID_139498
atgagggttcatgagtcatttactcatggggaagtgattaaacgagattgcggtatcaacgattggtcaaaacttgctttaaacaaagtgtcgcaacgtgccctttgcggacgagcgagggcgaggctcacgggtgcgctttccaaaggaggaaaggggcgcggagtcgccaccaacgtttatttgtggaaaacgtcgggaaaaccgaaggaaaccggtcaaaataaaaattctaagttcgggagttgtatttacgtttga

SEQ ID NO: 22721 - DNA, 585 bp, Glycine max
  Peptide Sequence Number=SeqID_139499
atggctgaccaagaggagatacaagaacagatgaaagccgacatgtcgactttgaaagagcaaatggcttccatgatggatgccatgctaggaatgagacaactaatggagaataacgtggccaccgctgcaactgttagtttggctgccaaagcagacctaactctcccagctaccgcgcaccatcctctcccaaacatggtaggacgagaaagaagcacactggggcacatcagcaacccccatctgggacacaaccgagtggcttacccttatggattaccacttaattacacgccactagtcatgcgtgatgacacgggacatgtttcttcccccatcttgaaggggagcttcctcgacagttggacgaggttcacgaggatcgtagagagcatgcccaaggagacatcgatttctaccccccggtccccgtcgaggggccgacacctaacacactacctcggcctaacctcacgagagaacctcgaaacctcccagcacagccaatattctttttcgccgaaggaccaccccctgcagcaaaagaaaaaaggaaactcgatctcatcgaagagagattga

SEQ ID NO: 22722 - DNA, 207 bp, Glycine max
  Peptide Sequence Number=SeqID_139500
atggctaccattgcgttatcaagtagatatgggagcaagttagcatatgacaccggaatttggggtggtcttcgtcattggaataatgacattgttgggtttggtgggaaacttggccgtataggaatggccgtcacagcatgggtttctccctctttctcaccctcttcatttgccccagttttctcagtcctcctagtaggatga

SEQ ID NO: 22723 - DNA, 1497 bp, Glycine max
  Peptide Sequence Number=SeqID_139501
atgatgagcgattccaatgattctgtcttcccttattccccgaaacccagaacccgtcaagtaggttcccggttcatgtctccaaaatcgaccggttcgcctgaaccccgttcagcttctccgcttccccggttccaccggtcggcaaagcgaaactccgccactctagcggatcacattagcatcgagaggctcaaagaaagggaagaaaatcatcagaatcagaatcagacacccacaaacagaacagcctctgttttctccgctctcacgaaacagaggagctacagagagttcagaagcaacaccaatggctcagaagaaaacgatcaagatcaagacgttattggtaggtccacaaggaatggtttctctacaaaattttccgcttcgccggtgttaaagaaaccgggttctcatgttgctcccggaagactctctctggatgaaaatgcccttaagagaaactttcattgttctaagaactcaattgattctgaatcagataatacgattttggattctgtttctctgcaaagaacattctgttcgaggaaattgggtagggaggtttcatctaagtacaaggcaacaagtggcagaaaaggagaagcttctgattcagaccctttgtcttctgatgattcatggatgatgaagaagtttatgacacaaaaaacggtgaagagggctaattcgcttattgggtacatgagttcaaagtctcagtgggcattgtctcctgggagatcaggatcaccttctttgtctttggaaagtaaggataagccattgtcgttttcgagcttgaggcctcaacacaagagagtggagaagattctgagcatgggttttgatctctttaggactaagaaaccttcaacaagcgaggtggttcagcagttgcgtctgcttcataaccggttgattcaatggcaattcacaaatgctagagcaaatgctgtgaatcacaccatgtctcttcaggctgagagcaatttgacatatgctttggatggtctagccaagttgcggcattcagtgatgcaaaagaagatagagcttgagaaagaaaagcttgagatgaagctaagttttgtactgcattctcaaatgaagctgctggaaacgtggggaagtatggaaaggcaacatataactgcaattaccataatgaaagagtgtttgcagtctgttgtaagcaaagttcctctcttcgaaggtgcaaaagtggatatgcaattagtgtccattgctcagaggcatgcatctgatctagctggttccatcaagtcagtgttatgtaccttttcacccttgttgaaattcctccataaccaggctggtaagactgctgagttgctatcagagttagcaagagttgttgcacaagagaagttgctcttacaggaattaactgatatcttccacagcatgtctgcccttgagcttaaagaaaggagcctgatgtgcagtctcattcaactgaagtgttga

SEQ ID NO: 22724 - DNA, 270 bp, Glycine max
  Peptide Sequence Number=SeqID_139502
atggtttcccgcatgtcatcgggcccaccgcctctggatgacaaaagatgcagaatgaccataatttgtctctgcgtgccatcggacacgactgtgtctgaatggagaaaaggcccgctgcctctggatgacaaaagacggagaatgaccataatttgtctctgcctgtcacatgaccccagggtcagtatgacagagattgtggggcggccgacaaaagcaaggctcttgctcctacgtatcctcaatgaggaactcagacctacgtag

SEQ ID NO: 22725 - DNA, 468 bp, Glycine max
  Peptide Sequence Number=SeqID_139503
atgaagaatctccacgaaatcgcttacgaaaacgtctcaaaagtgagaaaagagggaggtggttgccgcccagcttgcccaagcgagctgggttgcttccaccagaaggcatcgccttcttttggaaccctcaagaaggccaaagtgggcttggtttctatttgcacccccattttccctaaatacaccccctttgtgtttttttctattgatttctttctgaaacgttgcggaacttttcggattacgcaacgacagctgttttccttccggaatgttgcgaaattttacggattatgtaacaatgcacatttttcctttcggaatgttgcgaaactttatggattatgcaacgatgcttgtttcgagggttctgaagggagcaaacaaggttcaaggaccgaccgcaagtactcctggacgaaattaaggtatgacacctatgatgaagttgagttgtggtgctga

SEQ ID NO: 22726 - DNA, 210 bp, Glycine max
  Peptide Sequence Number=SeqID_139504
atgggcattcgacactcccccacgcaagagcctccttcagaagcttgtcgagcttttaaaccggagtatccagccatgagccagcagcaagttaagcaataccagcgcaatcaggatgaagctgaccggcagaagatgctggagaaaacgaaggattacacattcatcagcctgatgctgaaggctatcggcatgggagagcgaaaatga

SEQ ID NO: 22727 - DNA, 264 bp, Glycine max
  Peptide Sequence Number=SeqID_139505
atggcctcctatggtgaaagcaacgatgttgaatatgagaacttctacatcagtggtgacgtaggcactgatgtagtaaggtgcactttctacatcattttacagaaagcaacaatgttgaatatgaaaacttctacatcagtggtgacaaacttctacatcagtggtgacgtaggtactgatgtagtaagctgcgctttctacatcgttttacagaaagcaacgattttgaatatgggaacttctacatcgatggtgacgtag

SEQ ID NO: 22728 - DNA, 853 bp, Glycine max
  Peptide Sequence Number=SeqID_139506
atgggaacttacatttctagagctagagcctctattgttattttcctagcctccctagtccttccattgcttctcccaaactgttattctccttctgtgttgattgcaagtgcacaaatcccagaattatcagatgctgatttgttagaatttcctctcaatttagaatacttagaggctgaatttttcttgtttagggctttcgggtatggattggatgtggctgctccaaacctaactgggggaggaccccctcccattggtgccaaaaaggttgaacttgacagccttgccaaggatgtcattttgcagtttgcttttcaggaagttggacacttaagggccataaagagcaaagtgacagggttccctaggccattgttagatctaagctcagcatcttttgccaaactaatggatagtgccgttgagaaacctttggttcctccctttgatccctatgctaattcacttaattttataattgcatcttatgtgattccctatgttggccttactgggcttctaggagtagagtctgggcaagatgcagttttgcgagagttgttgtatgaatgcaaagtgcagttggtggcacagtacaaagtgactgtggcagagttcacaaatcgcatttcaatacataggagcaagctaggaaacatgggtatgaaagatgaaggtattattgtgcctaaagagttgggtgctgaaagtagagttagaggcaacattcttgctggtgacgatgactcgctggcatattcaaggactccagaagaaatattgagaatagtatatggaagtgatcatgaagatgtttgcggtggcttctatcctaatggagcaagtg

SEQ ID NO: 22729 - DNA, 1158 bp, Glycine max
  Peptide Sequence Number=SeqID_139507
atggcggaggagaaaagagaagaggaagtagcgcaccccaacaactcatcatccaccaccatgccattttccgatgagattcccaacaacaacaacttgatgatgactttccctttccaagtaccacccaccatcttcgacgtcatgatgatgccttcgtcttcttcttccttcattgacctgctcggcgtgcaggactacaacgcgccgttattcgattgccttcccggcggcggataccgccctgcgccgtctccggcgagctccaacgtcccagactcctccgaggtgttgaacacgccggctgcgtcgcctaatttgtcgtcgatttcgtcgtcgtcgaatgaggctacggtcaataacaacgccgaacagagtttgaaacctgggaatgaccaagaagaagcagaagcagaggaagaaggtggtaatggaggcagaggagatgaccaagatcaagacaagactaagaaacagctgaaaccgaagaagaagaaccaaaagaagcaaagagaaccgagatttgcgttcatgacaaagagcgaggttgatcacctagacgatggttataagtggcgcaagtacggccaaaaagctgtgaagaacagcccttatcccagcaatagagttttcccactaattcttcattttctaaattattatttttttcttgcgggacacgcaaacggtcgtgccacgccaccgtgtaggagctactaccgttgcaccagcgcgggttgcggcgttaagaagcgcgtggagcgttcctccgacgacccttccatcgttgttacaacctacgaagggcagcacaggcacccgtgccctgcttcggcacgggctagcttcggctttgtgtccgaacccagcagcttcggatacgccggttcgtttggtccctcacactttatgctgccacatcagcaccaccagcaagcacaatcttcggctttgatgtataataactccaccacccctcctttgaatgttgttagctccagtagtactagtaactacatgaacacgacgtcgtttggtggatttgttcaggatcacgcgaaccgtcatggttttgggcatgaggctttgttgagggacaatgggcttcttcaggacattattgtgccaactcaggtgaggaaggaggagaaggattga

SEQ ID NO: 22730 - DNA, 456 bp, Glycine max
  Peptide Sequence Number=SeqID_139508
atgttatggaccgggaggaacaagctcgagcatgacccaaattctgtgagtttccgtaagccctgggaagagctgttaatttctgattgtatgagggtttctacccccagaattgttgctggtacatcacatagagataatatttcaaataaatgtattaatataatgagaactgaggatgaagatgtttgcagaataaagaacgcgatcttgggcagcggttcgatggttgttggtgtgcttgcagaaatatctgagttgtttaagcaagcaacaacccagcacttgagcgagcaacaagaacaaccaattaatggtccttttgatcttagtgcacgcaaggagtggctccacgccattttggaaacactggatgcatccaatagtatgcatgctagctgtcttttatctcctcaagatactattgggtgctgccaatacgtgattgatctgtga

SEQ ID NO: 22731 - DNA, 1257 bp, Glycine max
  Peptide Sequence Number=SeqID_139509
atggataacgattatgaaactatttcattcctgatagaggatagcgaaaacaccactgctaaagaaactaggagtggaaaggacatccaaggtataacatgggaaacagaaacatcgaattatagaagtcgtgagacatttagacaacataggtcagaaagtctcctgaatggacctgaagaacacttatcaattaaacaggccaagcaggaatgtcaatcaacagtaaaaggaggggagttttataatttttatcaatacaataattgtttaatgccaacaatacaagattgggcactcgcggattatgctggtaggctttggtccacgtcaaagcatgatttatatctctctgcaggtacccaaatttgtcactggaatgcattaacatccacgaacactgaaatcttggatttggaagggcacgttgctccgtctgaggaacatcctggagccttcatggaaggattgactgagacacggcggattgatgcaatggctgtaggccataagttgttgattgttggaggcaatgaaggacaactgatttgcaagcacttggatcgtcccgggatcagtttttgtttcagatcagatgatccaagaatgataaatgctattgagatttataagtgtcccactctcaccagtgaagttattcatttcatggtttcatatgaagagggtagtgtcagaatctttgatgtagagacatttcagttttcacattttgaatttccatggcccgtgaggcatgcttcatcaagcccagatggacgacaactcgtagttgttggagacaagccggaagggacactagtggattctcaaacaggattgatcatccaatattttggtggacattttggttactcatgttcgtctgcatggcatcctgatggacacagatttgctactggaaacagagatagaacatgtcgcatttgggatgctcgaaatttgtcaaaatctgtttttgctcttgggggcaacgtcagcactatttcttcaataagtttcacatctgatggacgctttatggcaatgagtgaaaagcaagattttgtgcatgtgtatgatgtaggggctgacttcaagagagagcaggagatcaatttttttggatatgtctctggattatgttttagtcctgacacagaatatctttttatcagtgtctccatgtttacttttccaacccttttattgtacaaccgacgcagacacgagtactactacctagattctatgccttga

SEQ ID NO: 22732 - DNA, 549 bp, Glycine max
  Peptide Sequence Number=SeqID_139510
gaagtgatgaagcaaagagatgttgcacagatggctgcaactgaggctatacaagaggctactgctgctgctgagagtttgctgcaatgtctaaggattctcaacatgtctgacttcagagatgacgcgcattccaactcatcggatcaagtgggtttcgttagggtttactcgttgtatctcgatgcgaaggttgattttgtggcttataggagaaaattaagcggcagagttgttgaatctgtggagtttagggatgagtttggttctgctgagagagaggggaatgaggttactcctgtgagggaaatgggagctgagagagttttgaagaggttgaaccatttgctgtggatgcttgatcgtgtcttgggttgtaggcccaatggtgctgccaagaacaatagcttggtgctggttgcactttaccaggttgtggatgtgagggatagttttaagctttatgtagagtctaaagacttgtcacatgggtttgcttacatggacaaagacttgccacatagacatatgactaacagtggaaattga

SEQ ID NO: 22733 - DNA, 255 bp, Glycine max
  Peptide Sequence Number=SeqID_139511
atggaaagaggaaagataaagactatcgttgttcatattgtgaaaaagtatttgattctcaagatcttcgaggaggtcaccaagtctaaccctccacgtgggaatgccgtaatgaaagctttgcctggaggtacaccaaacaatccttatgtaataaaaggaaattattatggtgacaatagccaagaaagccacaattcattgttgttgcctccaaattattattctacggaaccaagaatgcatctttggtag

SEQ ID NO: 22734 - DNA, 225 bp, Glycine max
  Peptide Sequence Number=SeqID_139512
gacttgaagatactccataaagtaaattcaaggctactgctaggtggattgttgttaaaacaaaaaggaagcattgagtgtggatattacgtcatgcactggatgtcaactataatcttaggaagtttcaagaataattgggaaacgtatttcaatgatggtagaccattggaaccaaagagattgaaggtacttcgcatggagtgggcaacctattatttaaaa

SEQ ID NO: 22735 - DNA, 324 bp, Glycine max
  Peptide Sequence Number=SeqID_139513
atggcctatatatatgtgcgtctgatttcaaaaagcaagagagagatattccaagagaacttcattgtcaaattctctctcaacaaatcttgggcaaacacttgcaaatctattgagagttcatcaggaacttcaaattgtattatccactctaaaggagagaaatttttctgttcttctcagaaattcaattgtaatcaagagactggttgtctcttgaattgtgagtttcctgaacacaagggaaagggattccttgggtgttcagaagttgcaaaagggttttttacaaagatactggaaaatctcaagtgggttgcttga

SEQ ID NO: 22736 - DNA, 567 bp, Glycine max
  Peptide Sequence Number=SeqID_139514
atgtccagtgaggttgtccatattggcaaaaggatagttatagtagatgattactcaaggttcacatggactttgtttttgaaaaccaaaaatgaagcttttgatgattttcacaaacttgccaagattattcaaaatgaaaagggtctcatcattttttcacttagaagtgatcatggaggtgaatttaaaaatgagtcttttgaaaagttttgtcaagaaaatggaattcatcataatttttctgccccaataacacctcaacataatggtgttgtggagaggaaaaatagattccttgaagaagtagccagaactcttctaaatgaaacaaagttacctaagggtcaggtgcgactgcatgagactttctaccagtgcacgcgccaccgtcagggccaggattccagcccatacacgtggcctactatggagcagtttgaggctgcagtagcatggccgggggattggcccgaggatcagacagaacccgccggtgctcttggaggtgaggacaaggttgaggatgatcagaacatagaggacccgatagatttcctcctgtga

SEQ ID NO: 22737 - DNA, 228 bp, Glycine max
  Peptide Sequence Number=SeqID_139515
atgaggtgtctccacatgtcatcggacttgccgtctctgaatgacgaagtgaatggatcttctttcttgggagatccctctattccttcctccgagggcaaggatggaaattcttatcctaggtcaaggtttatggccaatgagttgagattttggctcaaaaggcttgtagaaaggccgaacatgatgtatgtcggggcattggtttggccagtggttcagggataa

SEQ ID NO: 22738 - DNA, 2433 bp, Glycine max
  Peptide Sequence Number=SeqID_139516
atggagataatgctggtaaccagggcaaacacaatggagagccaaaaagtgcttatgctcatgatgtacactactctcttttgcttcatggccactttctctagtcaagacacagttactattactctaaatcagtctctccaatttagtgacaccctcgtttctttagacggaaccttcgaagcaggatttttcaactttgaaaattcaagacatcaatattttggtatatggtacaagagaatatcagctaggactgttgtgtgggttgccaacagagatgtcccagtacagaactcaacagcagttttgaaacttactgatcagggaaatatcgttattcttgatggctccagaggcagagtctggtcctctaactcatcaagaattgcagtgaaaccagttatgcagcttttgaaaactggaaaccttgttgtgaaagatggagagggcactaagaacatcttgtggcaaagctttgattatcctggcaacacattcctccctggaatgaaactgaaaagcaatttagttactggtccatataactatcttacatcttggagagacactgaagatccagctcaaggagagttttcgtatcgcattgacattcgtggcttgcctcaactggttactgcaaaaggagcaacaatttggtacagggccgggtcatggaatggctatcttttcactggagtttcttggcagagaatgcatagattcttgaatttctcttttgagtccactgacaaagaagtttcttatgaatatgaaacatggaacagttcaatactcactagaactgtgctctatccaacgggaagttcagagcgttctctatggtcagatgaaaaacaaaggtggctcactatagccacccgtcctgtagacgagtgtgaatattatgcagtttgtggtgttaactctaattgcaacatcaatgattttccaatatgtaagtgcctccaaggtttcataccaaaatttcaagcaaagtgggattcgtcagattggtctggtgggtgtgtcagaagaataaaattaagttgtcatggtggagatgggtttgtgaaatactcaggaatgaagttgccagacacgtcttcttcgtggtttaacaagagcttgagccttgaggaatatcagagaaggaataagaacatgaacagaaagaagcttgcagggattctagcaggacttattgcattcgttataggactaacaattcttgtgtgggccacttcctcatttataaaaaggatgaatctaggcaagccagaaattataaaaaagctaattcactggaagcacatgaaagagacggaagagaatgacatacaaacaatatttgatttttcaaccattgatattgccacaaatcacttttctgacagaaacaagttaggagaaggtggatttggaccgggaatattggaagatggacaagagattgcagtcaagaggctttctaaaacttcaagacaaggaactgaggagtttaaaaatgaagtaaagttgatggcaactcttcagcaccgtaatcttgtaaaacttcttggttgttctattcaacaagatgaaaagttgttgatctatgagttcatgcccaacagaagcttggattactttatttttggtttgagatttcacgccatcaaatttattgctttaagtttgctgttgccatcttgtagtttccatgctaacgttcaaactgatttttcagatacaatgcgaggtaaattactagattggactaggtgctttcaaattatagaaggaattgctcgtggacttctgtaccttcatcaagattctacactaagaatcatacatagagatctaaaaacaagcaatattctgcttgatatcaatatgattccaaagatatcagattttggtctagctagaacatttggaggagatcaagctgaggcaaatacaaatagagtgatgggaacatatggttatatgcctccagaatatgtagtgcatgggtctttctcaaccaaatctgatgtttttagttatggtgtcatcgtacttgagataattagtgggaggaagaatcgtggatttcgtgaccctcaccataatcatcttaaccttctaggccatgtatggagactatggactgaagaaagacccctggagttaatagatgaaatgttagatgatgatacgaccatatcttcagaaatattacggcgtattcatgtgggtctactgtgtgtacaagagaatccagaaaataggcctaacatgtcatctgtggttttgatgttaaatggtggaacgttactcccaaaaccaagacagcctgggttctacactggaaaagataatacaattgacacaggatcttgttcaaagcaccatgaaaggtgttcagtaaatgaaatttcaatctcgttgttagaggcacgatag

SEQ ID NO: 22739 - DNA, 309 bp, Glycine max
  Peptide Sequence Number=SeqID_139517
atggttttactctttctccgaggagaacgtgcaggaagagagcttgagatagcacatacaggaacatttggatgcacattatctatgttggagttggaagctggatatggtgacaacatgggagtagtactgagtgataaagtggttaaaggagcatttagatgcatgtcaccaacaacattatttgagttgtggtacaacggtataaatggttccaacaatggactaatgagtgaaacttgcgtttgcattattacctggggtagagagactagaaaatcttctctgagttctccatttccttcctaa

SEQ ID NO: 22740 - DNA, 444 bp, Glycine max
  Peptide Sequence Number=SeqID_139518
atgttatgttttgttatgctctgtttggtgggtggaaccaaaatcagacataaaatagaagaatccttttttcttttgttcttcccattcttacacatctaccacagaaagaacttgcataagttacatgtgaatgtgaacggcatattggtacacagtctggttgaatggatcagattgtatacatcttttgttatggacatgttttactctgatattaatgcaatctctgtcatgggcaaagctgagtttgcagagctgattgatttcaatccaatccatgcaacagatgtggaccttcctgttggtggaacttatgtgatagcccattctttggcagaaactgagaaagctgttacctctgctacaaattataataatagggttcttgattgcaatttagcttctgtaacaactttccaaaataagactcaatttgcttaa

SEQ ID NO: 22741 - DNA, 768 bp, Glycine max
  Peptide Sequence Number=SeqID_139519
atggacacagtcaccactcacaaaataagtttccagcacgagctgcacgaaatccacactgtcggaactgaactctccgtcaccgtcacggccaaggcctccgtcgtccgagagtggctctcctcaaggctctacttccgccagcaatacgtccgccggaaacgcctcgtcgtcggcctcggcgtccagtggaccggcggctccgattctccggcggacacgttgcagctttgcgttggccgccgttgcctcatcttccaacttgcgcacgccaaaagcgtgccgaagaaactccgcacgttcctcctcgacgcttcgcacaccttcgtcggattctggaaccacttggatcggcggaagctggagagttcggagcacggtttggagatggtgagggatcctctggatctgaggcggtacgcgaaaaccgaggacggcgatgacctaactcaagcatcggtggaggaaatcgtagagcaatgtcttggtttcgacgttgagcagaggagcgagatcagcatgagcgattggaacgatgaatatctcagcgacgatcaaattgcttatgcgacgattgatgctcgctgcgcgttcctcatcggtaggaaaagcagggcttgggaacgaacagttagtggtgtactggggttaattgtgcctactcttgaatttcaccggtttactcgtattgatgagagattgattttggttttcgtgagtggtatactccatgttagattcacctcacaaccgataagccaactctaa

SEQ ID NO: 22742 - DNA, 567 bp, Glycine max
  Peptide Sequence Number=SeqID_139520
atgaggaggatcccaaccagtgtgtctgctttagcaattcacatttttcttctagcttctatttctattcccttgacacaatcccagccctctttcccatggaaagatgggaatggcgatttggtagaccaaatatgcaaaaagacacccttttacgacctttgcagctcgatccttcactcaaaccctccgagtccaaaacctgatctcaaaggggtggccctattgatggtgaacaacattctggcaaatgcaactgacacactgagttacattgaggggctgattaagcagacctcagaccgtgagttggagcaagccttggctttttgtgctgagttgtatatcccaattgtcaaatacattctcccacaagctgctgatgccataagccagggccgttttggctttgccagttactgcatttctgatgctctcaaagaagtgagtagctgtgacaagaaattctctggtgctgcacaggcacccttaggggacagaaacgacattgtgcagaagctagtgaatgtggctgcggccatagtcaaactacttctaaagggctga

SEQ ID NO: 22743 - DNA, 840 bp, Glycine max
  Peptide Sequence Number=SeqID_139521
gtttctggtgggtttgctggaggttctgttaaaggtgatgatgggccaagtttatgctgcaatgaaccaagtttaagtgaagtatctgcagatgtgatgatagtaacaaacaagccaatgatggggagagattcggcaaaccgtgcccaacaaaccccagtgagggagaaacggaaaaaggccagtaataaaaaggctcccaaacctccaagacctccacaagctccatcattggatgcagctgacaataagctaatcagggagatatctgaacttgccatgttgaagcgcgcgaggatagagcgtatgaaagctttgaagaagatgaaagttgttaaatcatcatcaccatcatcttccaataccagcagccttttggctatggttttcactgttgtcttctttgttgtgataatattccaaggcatgtcatccggtaaaacctcagtggcaagtttccagggatcacctgtatctgcaggagaatcagagggtggtttaatttcagttcagtaccaactcaatccttctgcagttgactcaaatgctcctgcgctcttggggaaatggttatggaaacttttgagtgagagagttggtctttggagggatgttttggtaaggaaatatggtctctataacatggatgctcttgtggggagtgagtgtaaggttaaagggtctcaatggtggtgtgatattcttgtcaattgtgatatcttcgaaaatgggctagggtgctttcaagaaaaagtatctaaagttgtaagtgaggggaggttaatccataagaccatggaccttagcggcagggttggtggtgacaaaggatgcgcatag

SEQ ID NO: 22744 - DNA, 114 bp, Glycine max
  Peptide Sequence Number=SeqID_139522
atgaatgtccatgtgggaatgggtagcatgaagaaacccattagactaggcagatcattatggctgtacattccgaatcagcttcatcagagaagaaatcaagcaatggagtga

SEQ ID NO: 22745 - DNA, 171 bp, Glycine max
  Peptide Sequence Number=SeqID_139523
atgctgctcctagctaggaagtgcatttcaacccttaggaacaagctaggaaataaaggtttgaaagatgaaggtcttattgtgcctagagtgaaaggtgctgacattcttgctggtgacaaagattcattggcatatcctaggactccagaggaaatattgaggaggtga

SEQ ID NO: 22746 - DNA, 201 bp, Glycine max
  Peptide Sequence Number=SeqID_139524
atgaccaagaatagggtgttgaaagagcacagcaagactttcctaaattggtttaaagatacaatctttggtgacaataatgcttctgaaacgttaagaaagaatatggctacaccacctagcttccttcctcctcctcctcttcctgattcaacatcaccttcactgtctacgtcgaagaagacaagaaaaacaacatga

SEQ ID NO: 22747 - DNA, 399 bp, Glycine max
  Peptide Sequence Number=SeqID_139525
atgtatgcattccttgagccacagtcgttggtttgttcaaaggatagacgcagtgaatgtgaacaatatcttgaaagatggcttaaggaatatgaccaagaggtgtacattggaccttacttccatcatgtaatgacaaaattgaagaagaccttgcctcctgaaactaaggcagttgcacctaagtggattgaagtaaagagtcacgttcaaaccggctgttatgaatgtggatattacataatgcattggatctggaacatcataaccaacgacataaagagtgactggtccatgtggtttgctaatgacacaccattggacatcgacatcatcaccacaattcgaaagaaatgggcaacattttttttaaagacagcaataagtcaaaacggctaa

SEQ ID NO: 22748 - DNA, 348 bp, Glycine max
  Peptide Sequence Number=SeqID_139526
atgaaaagtaaaagggtatgttattttactacaaaacgcttacctgaggaacgcgttctaccagaacgcgacacgtggcgtgactggacaggacgatgggacaggggtggtcgtgcctgcctgccagacactaccagtagtggtcatgcctgcctgccaggcactaccagtagtggtagggccccaggcgcgaccagtagtggtgggccccaggcgcgaccactagtggtagcctgccaggcacgtccactagtggtgggcccctggcacgtccctcttccctataaaactccctgtccttcgtttcattttgacacaaaaaccttgaagctgatttggaaacgttga

SEQ ID NO: 22749 - DNA, 202 bp, Glycine max
  Peptide Sequence Number=SeqID_139527
atggcacgcagcgtgtccgctccgtgcccctattcaagggacctatatgggagggagctaacaaggcttttagtgataattcccaaggtggtcatatctctcttgaaggtctctagaggtatcatccccttcgaagaacatattgcagcagtagggactactagcaacgatatattttcaaagaggaaaactctagatgagg

SEQ ID NO: 22750 - DNA, 420 bp, Glycine max
  Peptide Sequence Number=SeqID_139528
atgaccttcatctacatttcaaaggcgacaatgtcttcaccaggaaacaattcctttatctatattttaaagacgacaatgtcttcaatcattgcacgctttcaaaaggcaacaatgaccttcatttacattttgaagacaacaatgtctttagtcattacatgccttcaaaaacccctgggcccactagatgacttaagggagaagcaaccagctcacctgggtgagcaagttgcttctagagttagccagcagctcccctgggcaaggcgggtggcaagctcctccccctattttgctgtaaataggcgtggaaggctgaggagaaagggttcagcacccttggaaagcatatttcacttaaaattagtgaaaagaaggagaaagaagaagaaaatcaaggccaaggcgcttccatga

SEQ ID NO: 22751 - DNA, 336 bp, Glycine max
  Peptide Sequence Number=SeqID_139529
atgctttgtgccataggtccttgttccattgtaggtggatcaatgctccgtgtgacttggatttctccaagatctagattcctcttatcaaaccctaattccgtccggcacaaggcccagaggtcccttagggttttgatggttgtggaagcaaagcttcatgatgaatcaacaatgattcaaagatcaagattcaagaatcaagaattcaagactcaagaagaaagcctacaaacaagtatcaagattcaagattcaagatctcaagaatcaaagatcaagattcaagaatcaagaatcaagactcaagatctcaagaatcaagatcaagattaa

SEQ ID NO: 22752 - DNA, 426 bp, Glycine max
  Peptide Sequence Number=SeqID_139530
atggttgagtctgacgattcagacaatagttttggagattccacagatgatgaagtggctctcatgtctagagggttcaagtctagcctaggattagagaaaagggcatcatcctctaagtcacagtctggctcagacaaatgtgacttctgtggaaagtctaaacattctaagttcaaatgcatccataagaaacaaatgtctaagggtactaatgctcaaggaatcaaaaatatttggttaccaaaatcttgtggaagcaatgccttccaagattattttgatgatgccaaagaatcaagagtcaagcaagttccaaagaatcaagtgtcaagcaagtttcaagaatcaagatcaagattcaagattcaagattcaagtaaagaatcaagattcaagaatcaagagaagactcaatcaagataa

SEQ ID NO: 22753 - DNA, 547 bp, Glycine max
  misc_feature (456)..(456): n is a, c, g, or t
  Peptide Sequence Number=SeqID_139531
atggaccatgttgaaaatctaaattcattcaaccccatgtcctgcataaaaattcacaatacttcaattgtgcgtcattcacatacattcgtgcttttcattggttgcattgctcattgcattctttccttgaaaaaaatgaacttaatcattgttatcaaaaggaaagaacacgttgtatggcacccttaccaaacccatgctagagctagagtaatgggtgaagtagaggaggtgcaaaagcagatgaaggccgacatggaggccatgaaagagcaaatggccacaatgatggaggccatgatgagcatgaagaagataatggaagccaatgcggttacagtttccgctaccagagttgttgctaaggtgaacccgatgcccccatctggcctcaaccaaatgaatcatccaacctcagatatggtaggcaaagatttgggaagtacagacggnccctattatgtgcaaattcaaaacaagaacgccttcccgccatatggcttgcctcccaactatacaccacccaatgttgggtacactccca

SEQ ID NO: 22754 - DNA, 315 bp, Glycine max
  Peptide Sequence Number=SeqID_139532
atggcgagtccgatgacatgtggagaagcaagcgagccagttgacacgcagaggctaacgtcgtcttctgcacctttgtcatccaaagacggcgagtccgatgacatgcgggggtaccttatggttatccgcaccatttgtcaaccagaggcaagcgagcccattgacacacagagactaacatcagatggcgagtccgatgacatgtgggggtaccttatggttatccgaacctttagtcatccagagactgcgagttcgatgatatgtgggggtaccttatggttatccgcaccttttgtcaaccagaggcaa

SEQ ID NO: 22755 - DNA, 501 bp, Glycine max
  Peptide Sequence Number=SeqID_139533
atggaggaggagaggagggtacagaggaagaatagtgttccacgagagacaagtaaagagaataaatctagagtgggtagttctatggttctggaaattaatcttatgacctttccaaatgttgttgatgctatattggccaatggcatgtttagtcattatgatcacccacatattgaacaactatgtgaaaatgatggcctattcatatggtctcttcaagttgttaatgttctattggataaccttgaaactattgatcgtgctatggagtttgctttccaggttgaagaagatgttgtttggagccaagtggctaaagcacaacttagaaaaggcttagtgagtgatgcaattgaatcattcattcatgcaaatgattcaactcatttcttagaggttataaaggttgctaaagatgcaaacatataccatgacctggtaaagtatctctttcatagggaagaaactgaagcatatgcatacatacctgtaatataa

SEQ ID NO: 22756 - DNA, 1662 bp, Glycine max
  Peptide Sequence Number=SeqID_139534
atgaagttctctaccttgatgggagaaatcgtcactgtcaagccaggcaagccttattcctccactggtggcagcagtagtcaagtcataagcattatcgaagaattcccaataacaaccctgactgtctattacacaaccaggggaagtcaagacgatacatttgacatggatcttggggtgacaccatcgacaaaggccaaacaccaatcaaagagctcatcaactgatatgccaggcatctatcctagcatcatatgccacaaattggttgttttccctcaacctaaaccagtctcacaaaagaagagaaagataggagaagaattacataaggtggttagggaaaagcttgacaagcttctcaaggcccaatttatcagagatgtcagacactcaacctggctggccaacgttgtcatggtgaagaaggctaatgggaaatggcgtaagtgcactgactacaccaacctcaacaaggtgtgcccctgggatggatatctcctgcctagcatcgacaagctcgtggatggcgtgtctggattccagttgctaagcttcctggatgcttattcaggatacaagcaaattaaaatgcatcctccagatgatgaaaaaacctccttcataacgaaagatgcccatttctattattgggtcatgccttttggactcaagaacgttggagctacataccaaatgctcatagaccgagtcttcaaatggaatataggacaaaattttgagttgtatatggatgatatggtcgtcaattctcatagcatagcccaacatgtagcagacttagaggaaatgttgggagagattcgcaagtacgacatgtacctcaatcctgaaaagtgcacctttggggggatcaaagccaaccttaacaagtgtatggcgatactggaaatgcacagccctaccaacatcgaagaagttcagaagctgaacgatagattggcgtctttgtccaggttcctctcgaagctcacaggaaaggcgaagccgttctataggatgcttaggaaaattgagtcattcctatgggacgaggcttgcgagcaagctttcttagattttaagaaaactattgcaacaccaccagttctaattcaaccaatgtcaggagcacccttagtcctttaccttttactagcaaaagaggccattggctcagtcgtcgtccaagaggatgaaaagcaccaaatacctatctattttgctagccgcgtcattcatgatgctgagaagcgataccaaatgattgagaagactcaccacacagaccaccccatcaggcaagtattgagaaagcttgatctagcaggaataatggtagtgtggtcagtagaactattagaatttgatctccaatatgagccttatgaccctatgaaaacctatttcatggcagactttctagcagagtttgttgacaatgttcaagctaactcagactatttcttcatggcccgtatgaagtggacatcgtataatttttgtgaccccctatttgaggaaatgggtgatgttgttgagcctattgagcaattcagggctcgatgcacggcaacatcaacacatcaagttgaggacatagctcgattagtgacattgcatgagcaacaacaatacgaacatgatgaggatgtgtag

SEQ ID NO: 22757 - DNA, 181 bp, Glycine max
  Peptide Sequence Number=SeqID_139535
atgtctcctccacctctagaacctcacaatcactcacaaacgcatctcaagttctcaagacggcttcttcttcaagctcaattctctataggtcttcatatagcaaaatctctcaaactctctggaacttggacctttctctctctagaaaaccctagacatgcagaagcttcaagaaaag

SEQ ID NO: 22758 - DNA, 474 bp, Glycine max
  Peptide Sequence Number=SeqID_139536
atggacgtacaggttcctctaactgataaagaaaaattggggagagacttaaaaagattaaatgataagcttgcttttacactttctaaatgcaatgctaaagatgagcagatcaagaaacaaacaaaaattgtacaagaagcagtagcaaattcatttgaaggatgggagaaagcagaagctaaaatactatctatgaagcaacatctggatgaatctatacagctgcaattagtttataaagaaagagtggcccaattggatggtgctattaaggaatgtatgcaacaattacattttgttagagaagaacaagagcaaaggattcatgattttgtgatgaaggcttctaaagaatttgaagaagcacacatagttttggaggagcagctatcagagaccaataaatggcttgctaaatctgggttgaaaattctcatcttaataagtctattattgctaaagaaaatttga

SEQ ID NO: 22759 - DNA, 885 bp, Glycine max
  Peptide Sequence Number=SeqID_139537
atgctgaagcttgacgaggatgctaagcttgtttccttggcgggtaatgtgtctgctgaaattccagatgatgacattttggaatctcttaagactttgtctgttgaggagcagaggaagagtcctgaaaaggccaccatgatggagatagatggtaagccaatgcctaaagtagttgtgcttgaatttttactacctcactctacaattgagatatggagcttgaggatattccaagttatgaagaggctatgctttaatttgacattgaagcatctctcaatgttcacggggatgatatggttgagacaaatcctagtggagatctctgaagaaacagatgcagacagactcagacgattggaagaagtatgtggtgctatggagtatgtatccatggaagatatggttatagaatcttggtgtggaaaacttgcaatagaatttggaaagagaaatatgatattgggtctcacattattcatccaaagatgcaacaagtggagcttgacaagcttaatcttacaaagctctttgaaagaaggttttctaggtattgattccttcaagtatccatcttgggatacttttcttgaagaggaggaatatgcaattggagtgtatggagaaagggaactagtgctcaagcaatttcccatcagactcattattgctcctaacccaaacagcctgatatttaagtataggccaactgcaatgaaggtttatccccttggtcccaccatttttgtctttgtgggataccctaacggaactaagggatactatttctacaacacatatgaggaaaaagtatctatcactaggattggagtgttccttgagaagcaatacatctcccatggagccaatggaggaatgtag

SEQ ID NO: 22760 - DNA, 504 bp, Glycine max
  Peptide Sequence Number=SeqID_139538
atggcacccaatagaatcaaaactgctacgattcttggaatcaacaataaggaggaggccaagaacacttttctagcagattccttcatccttggacgatgggaattgcgcaacataatgaaacaagcatcagaggcaccgtcaattgaaaaaaaagtgataatctctcttgcaaccatcgttgttgcgtctagatgtgtagaggagggtctggcttttgacaaggacttagagaaaaggataacctacaaagccttggacattatgctctatggtggcccatgcccagtcacaaacaataagaaggtgatgactagttttgttatggtgggagagaaggtgaatcttcctaaagtcatcttctattactggatgcaagccttcaaagacaagttcaacccaaagaagcatattgagaaaaaggtcaagaaggagcctaatgaggaaccacagtctgtggttggtcagacgatgggaactcaggatcaaactattgatctttag

SEQ ID NO: 22761 - DNA, 315 bp, Glycine max
  Peptide Sequence Number=SeqID_139539
atggatcaaagttggaagaaaacatcacgcattagtgacgagtatcataatgggatcattctgacttacacaaaatggatatggcatggtgaattgctagacatgccaactgtccctcaaactgagtcggttgatgaagaagtcggacatcgtatagaagacatgattcgcgaccttgggcaagacggttttcaacaagcacatggacctttgtatgacaaaatagaaaatgattcaaagaagcctttgtatttagggtgcacaaatttcacaaagttgtcagtggtgttagctttggtcaacttgaaggcatga

SEQ ID NO: 22762 - DNA, 129 bp, Glycine max
  Peptide Sequence Number=SeqID_139540
atgtgtgggacaaacaagtacatacttggaaatatggttactaataacaacaactattacaatgagggcagcggaatattccaaaagcactatggactgaagtacactgaaccaattgttaaaaattga

SEQ ID NO: 22763 - DNA, 201 bp, Glycine max
  Peptide Sequence Number=SeqID_139541
atgaagacaatattgctacttactacacgatggtcggaggcagctggaatcaatagagggaatgccctagttgtcgagatcgcaggtcacggcggagtgaaggaggtgatgacggagcttgcggcagactttggaggtcaccagaaaatgcatatatgttcaagagaagccgtagtagtcagcttagaaagtgaaaaataa

SEQ ID NO: 22764 - DNA, 285 bp, Glycine max
  Peptide Sequence Number=SeqID_139542
atggcgaaaaagctatggcacctcctgaagaaccaccaagcgaatggaatagcctcaaggacttttggtgcacttgatcctgttcaggtcacccaaatggccaagcacttggatacaatctatgtctcagggtggcaatattcagccacacacaccacgagcaacaagcccggtcctgaccttgctgattacccttatgacactgtcccaaacaaggttgggcatctcttctttgctcagcagtgccatgacaggaagcaaaaagaggatcgctcaatgaagtag

SEQ ID NO: 22765 - DNA, 171 bp, Glycine max
  Peptide Sequence Number=SeqID_139543
atggaaaatagggaaacatggcacccgaaagctgcatttgcaggcatgtatggtggtggcactttgctaaccttcctttttgtcatttttcattttaaggtagggatgctgaattggatggttttagttgttgaatgttttttcatctatagattggaccgaatgatttaa

SEQ ID NO: 22766 - DNA, 897 bp, Glycine max
  Peptide Sequence Number=SeqID_139544
atggatggaattgttggattttgctcccgcaagaacatccatgctgatgccactgacgacgaacaagaacaagaagaagaagaactcgagcactttgatgatttcactctcgcttcttcgtgggaacggtttatttctgaaatagaggcagttttacgggtttggatgtctgatgggccaaacaatttattggaaaaaggtgcagttctcttggaggatgccggtaatttgtacaaggtgaaatctgaaatgaagtatgccatgaaaagttactgcatggagttctatttcaagactgaccctgatggaaaacttgcggactggaattttgatttgcatgatctgcagttatgttttggtgtaaaggagtttttggtgattgctcctcagagtgcaagtggtgtggttcttgatgcgccagagtctagcaagctcttgagtgctattgcaattgctttgtctaattgttcaagtttatggccagcatttgttccagttcatgatccatctcggaaagcttatattggaattcagagcatgggtactgtatttactagaaggttcgaagcagatcgaattggtagtcaggttccagtaaaacttatgcatttggaggggctgtatgagttatttgtatctaagtttgcctactccacattggatctatctgttcataatttcaaagtccgatgtgcaatgaagctaacattcagaacgcttccctacgatgatgacaatataaaagatgccaaaattagcaaatctggagaaaatcttactggtgaaatgtccattgggacacaatgggatgatgattgttcttggagtgagtggtattctgcagaagatcctgttaaaggtaaattctgggatgtagggacttgtatgttgaaatag

SEQ ID NO: 22767 - DNA, 357 bp, Glycine max
  Peptide Sequence Number=SeqID_139545
atggctttgttactagatatgtcagcatttaaggcagcaaatccaggtgctatctttgaagattttattcggtggcattcacctggggattgggaagaggatgatggccctgagggaagtaaatcatcatcatccagttctcatgacattaagaagtcaaaagatagttggcctccacaagggcggctttctaagagaatgtctgagcatggaaatctatggagaaagctttggaatagtgcacctgctcttcctgcttctgaacagaagcctcttcttgatccaaatagggaaggagaaaaattgaaagactgcccaaggagtcccactgggttaactggtggccgttgtgcatag

SEQ ID NO: 22768 - DNA, 486 bp, Glycine max
  Peptide Sequence Number=SeqID_139546
atggaagtagcagaaataagaatgttaagatggatgtgtggccgcacaacggcacaagataggataggatacgaaataattgtgtacgaggagatattgcttgccatatgcattgagagaaagtgtcagctgagtgaagactatcaagattgtattggaagcttggatcaaatagattccatgagtgaggaagaaagtgtagttggggatgactctttcagtctacagacacccagtgaggaattttctgggaaagttgacagaaagcctgaagatgtggacctgttcaatgaaaaaaaatcttcagacttgaccaggagaggttctgctggtattgttgattctatgatgcttctcaagtcacatcaaagcatgcatgccccatatacacaggaagcaccacttatgacagaagacatgcatgaggagcggctaaaggctgttgaagcctttggtgattcatttgtggttgacaaagtaaagtga

SEQ ID NO: 22769 - DNA, 1583 bp, Glycine max
  Peptide Sequence Number=SeqID_139547
atgggaaatatcggccataaaggcgcgccggttgctctcgtttttctccagcgagcgcgccagctggttgaagtcgcgcgccagctggccaatttcgtcgctgctgccaacctccacccgggtggtaaatttgcccgccgccagctgatgggtgccgtctaccagccgtttcaccggcgccagcaggccgcgcgccagcagccaggtgaccagcgcggccagcagcgtggtgaggccgacaatcagccagctggtctgacgctgctgatggtcaaagttgatgtcggtgctgcgcgtcagccgctcggcgggcgaggcaatcacccagccaacaatcttgccgttgctggtgaactgggtgcgccagccgtgcggcggcagctgcgtgccgctgccaggattctgttccagcgagcgcagaatggtgaaaatcagccggtcgttgttacgcaaaaaatcccagctaccgtgctgttcgtattgatcggccagcgcatcgctcagcagcgtcaggcgctgctcgttgccctttttgatgtagtcgacaaagccatgctcaaagctgaggcgcacgccccagtgcatggtgatgatcaccagcatgcaggtggaaaaaatcgccataaacagtttggcgctgatgccgagttttaccggctgcttcatccttttctcctgcctctcaggtccacgtttttactcacatcggcgggtttgatgggtcgcggcgctgtcgctcaccgcgccatggccgaaagcgccgagcagcagaccggccacggtgacgccgatactcatcgacagctgcatgatcatcgacagcaggctgttgccgctcgaggccagctcgtccggcagctctttcagcgtcagggtattcatggacgaaaagcggatggcattgaccatgccctgcaacagcagcaccacgggcagcagccagatccagccgagcagcgccaccacgggaaacagcagcaccaccagcgccagcgccagcgtgccgcccaccagcgcgttacgatagccaaacagatttacgatgcgcaccaccacgcgtttgatgcccatgttgcccagcaccatcgggatcatcatcagcccggcgtggaacgggctaaagccgagacccacctgcagaaaaatcggcgtcataaacggcagcatgccgctgccgatgcggccggtgaagctgccgagcaggccgatggcgtaaatgcggttatcaaacagcttcaggctaaacagcgcgttatcgttgttgcggccgtgcatcaggtagaacagcagggaaaacacccccagcagaatcagcaggcacagcagcagcgcagcagcgtggcaatggcaccgatgatgccgaccggaatgttgatcaggaagatccagtgccagctggcatactccaccagaatgccgcccagcgccgggccgagcagcgggccaatctggccgggcagggtgacaaaggtcatggctgacatgtactgctcacgcggcacgatcttcatcactgtcagccggccgaccggcaccatcatcgcgccgccgatgccctggaccacgcgcgccatcaccagctg

SEQ ID NO: 22770 - DNA, 151 bp, Glycine max
  Peptide Sequence Number=SeqID_139548
atgcaggatggcgtgcgcaagctgacgcccgacgccatcagttcgctgcagagcgaagtcgcgctgctgacccagctggtggaagacctgcaccagctgtcgctctccgacgcgggcgccctcgcctaccgcaaacagccggtgggatctg

SEQ ID NO: 22771 - DNA, 348 bp, Glycine max
  Peptide Sequence Number=SeqID_139549
atggagacaattagactagtgattattgttgctagctcaaaaggttggtctgtgtgccaactagatgtgaaattttcctttctcaatggaccattggaggaagaagtgtatgtactgcaaccaccagactttgaggaaggtgcagcagctatttcctcgctaagcgaggcccatgcgcttagcgagtatcatccgttaagtgagacatcagcccgcttagcgagtaagaggaatcttaaaggggatctgccatgcaagcatgcgctcagtgtatcatcagctcgcccagcgagtcatttgtctcacccagagatcacttactcgcgcttagcgcgaaaatggcgctaa

SEQ ID NO: 22772 - DNA, 252 bp, Glycine max
  Peptide Sequence Number=SeqID_139550
atggatcccgtcaagtacatctttgaaaagcccactcttactgagagaatagctcaaaggcagaattccctaacgaggatattatggccatgtttgaggaggaggttgaagataaagacagagataagtgggttgtgtggtttgacgattttgtttcgactgcacaaacaatatggcagagtacgaggcatgcgctctagggattcgagcggtgtaacgacccgcctcatcgctacgatatcaacactctaa

SEQ ID NO: 22773 - DNA, 237 bp, Glycine max
  Peptide Sequence Number=SeqID_139551
atggttgcgtcctttggttaccgcaaagagcgtgatggctcttgggtaaaaaagggttcgatggactccaaacctatgttgctgaaaggtttgatgctttggaacaacaagtggacatgtgattcgatgcaatggactcaaggatcacaaaggattgtcatcataaaaaagggagagattgtggaagcaatgccttccaaggttattttgatgatgccaaagaatcaagagagctaa

SEQ ID NO: 22774 - DNA, 151 bp, Glycine max
  Peptide Sequence Number=SeqID_139552
atgggcgggcagcgtggcgagctgccatgtctgttgtcgggtatcccaccagcgcagctgcaccggcggcagcgtcaggctgccggcgctgtccggcagatagcgcagccgctcgcgtcgctggctgccagtgatttcaccgcgtccgctg

SEQ ID NO: 22775 - DNA, 894 bp, Glycine max
  Peptide Sequence Number=SeqID_139553
atgacattctgcctgcgcgcccggccggcagcgaacaggtgctgcgtgccgggcctgaacgcccctggcgctgatgtttgccggccatgcgtggagccgcctgtggcgtattcatgcgctgcccgatctcgttccacatcacaggagtcgccgatgaaaactgtttctatactggcgggcctcacgctgtgcctcgctagcgtcagtcaggctgacgatctctccgcctggcgtgagggtgcggcaaagcgtgccattacacagtgggtggatgacaccacccgcgccggcagcgctgactttattcctcttaaccagcgctacgtggtgttcgataatgacggcacgctatggccggaagcaccgctcacctttcagctgcagtttgcgctcgatgaagtgaaacggctggcaccgcagcatccgcggtggcagcaggatgcgctggtgcaggcggtggtcagcaacaacacggccgctattgctgccagcgggaaaaaggggctgatgcatttgctgacactgactcacagcggtatcaccaccgatgagtttgcacaacgcgtgcagaactgggtggcgacgcagcgggatacgcgttttggctgccgctacgatcgcatgggctatctgccgatgcgccagctgctggattatctgcgcgctcacggtttccgcacctggattatctccggcggcggcatcgattttatgcgcgtgctggcggaacagatgtacggcattccacccgagcaggtggttggctcgttttcccttgcggaattttcactcagcgacaacggcacgcagttgcggaaaaccatgaatggtgcattttatgatgatgaagcggccaaaccggtggccatccatctgttcatgggccatcggccg

SEQ ID NO: 22776 - DNA, 494 bp, Glycine max
  Peptide Sequence Number=SeqID_139554
gctctgcaaatcctggaatagcatgcatctccgtatttggtagtgtcagaagaaacacatggccactgtcagaacaactgcaaaacttgaaccaccattcttcttctgaatcatcctctctcattgcaatggccgcagcgttggagtgctggtcgcgccgcgccaccaccaccgtccacgaggaccacgcgcttctcatgcagcgacccgaacaggacacaacacccagagactcttcttcatcttcttcttcttccctcgtccacaagaagcttcaaaaactcacgcgcaacgtctccgaagccattgcttccctcaaaaactccctcaacagcaccatcaacgtcgaatcctccaaactcgacgggcctcgcagcctcgtgtggaccaccgtcctccgcaacctcacgcacctctaccccggttcccagctcccggagaagttagtctgcaacattcgcaagcactacgattccttgcctctcaggttctga

SEQ ID NO: 22777 - DNA, 1044 bp, Glycine max
  Peptide Sequence Number=SeqID_139555
atgaagaggctgaaaaccggtggcgtgaagctgccctttgggctttgtggatgtcaagaggagaactccaaggggagaggacttggagagattgaagaagatggaggggatgcatattgtggaaatggatttgagaatttaagccaaaatattcagcttcgtgtgccattgcctagttcatcttttcttgtagtcatagatgagtggcagactattcaatccggtggggatgagattgaaaaatggttgttgaactcagatagtcttgagtttgtagaacagattgcgcccaattcgtataaggggacgtacatggggaaaagggttggcattgagaagcttagagggtgtgagaaagggaactcttatgagtttgagctcaggaaagatctgctggcactgatgacttgtgggcatagaaatattatgcagttttgtggtgtttgtgtagatgacaaccatgggttatgtgcagtgacaaaatttgttgaaggtggatctgttcatgacttaatgttaaagaacaagaagctttcgagtaaggatgttgtaagaattgcagctgatgtagctgaggggatcaagtttatgaatgatcacggtgttgcatacggagatcttaatacgcagaggattctgttggataagcatgggaatgcttgcttgggtgatatgggcattgtcactgcctgcaagagtgtcagagaggcaatagattatgaaactgatggttatcgatggctcgcaccagagataattgctggtgatccagagagtgtgacagagacatggatgagtaatgtttatagttttggcatggtaatttgggagatggtaaccggtgaggcagcatattctgcattttcaccagttcaagcagcagttggcattgctgcttgtggcctaagacctgaaatccccaaggactgccctcaaactctaaagtctctcatgacaaagtgttggaacaacaccccttcaaaacgcccccatttttctgaaattttggccatattgctacgaccaagcaactacaataggtaa

SEQ ID NO: 22778 - DNA, 348 bp, Glycine max
  Peptide Sequence Number=SeqID_139556
atgagttgtacaggttcgctaagcgcaccgcttcatctcactaagtgcaccgctttagttcatccgctaagcgagaaaggcgcgctaagacaaaaatcactaacgtgcgctaagtggtccataaagctttgcatgtctagggtttctagagagagaaaggtccatgttccagagagttttgagagattttgctgtgtgaagatctgcaaagaccagagcttgaagcaggagccgatgcatgctttgttaaggtcattcaataatggaaactggtctgactctaaagtccttgatagtgcagggctgagttgtagtgctttcacgaggaatcagggtgcgataagttag

SEQ ID NO: 22779 - DNA, 480 bp, Glycine max
  Peptide Sequence Number=SeqID_139557
atgtgtatgatagtgtcatcaacatgcttcttaacattcaaggatggtttgaatactcatcaagatctagctgagatggtgtcaaattgccacagggatactcttcagctgaaagatccttgtgcagctgaaagatctaaatggatgtatccggttaagcgatacatgaatatcctaaaatggtatacaaagaatctacaccatcctaaagcatctattgttgaaaggtacattacagaagaagcaattgagttttgtttagagtatgttgaaaaggcaaaacctattaggctttccgagtctcagcatgacgaaaaagtgggaggtaagggttcgagaggacttcatgttatcactccaagtctagaagaattgcaacaacctcatttgtatatactgaataacaatatagatagtgaattttacataattaagctctcagatttcttcaatgactccaaagtatggcatggaagctag

SEQ ID NO: 22780 - DNA, 405 bp, Glycine max
  Peptide Sequence Number=SeqID_139558
atgaccctcacccatcttggtactaaatttgtgttgcatcctcaaacaccttcacagatagctaaggatcaagtacaaataaaactcaaatgggatgaggaaaagaatagaaaaagaaaagaagaacaacctttaatggttaaggaggtaagtgtctcctccaagaggttagctaagaaggaaagtcattttgcaataaagacaaccattaaagaaactttccttcttagacaacctccacatcttctcctttgtaaaaggacacttgttagcactgccataccttttgagcttgatgttattcttcaagtaaaggaggtgtttcatgagggagtaatcaacaagaaaatacagaaaaatgtgttaagggaagaagcccagagtttcaagaacctctggatttga

SEQ ID NO: 22781 - DNA, 420 bp, Glycine max
  Peptide Sequence Number=SeqID_139559
atggctgaagaaggagggtttcctctaagggataggctcaggctttggatagctatgagactcgagaaaacaagtaattttcaacttggccaaagagatgagaatgtcacctatctcggcaaccaactctcagatgacaacatgagtagcctacaatggatagttcaagccaatgctgacttctttgcatggtccatggatgatatgtcgggtatcggtctagaattccattgcaataaacttcccatataccaagatgcaaggcccatagctcaaagaaagagaaagatgggggaagaaaggtgtcaaccagtttggcaagaaatctccaagttgctagcaatgcggttcatccgagaagtggattacaaaacatggcttgcaaatatgttcatgataaaaaagtcaaatgaaaaatga

SEQ ID NO: 22782 - DNA, 330 bp, Glycine max
  Peptide Sequence Number=SeqID_139560
atgattgaaatttcacatatttggggcaaaggaaaaactttagagcggagtgacgaaaatcattttcgtactaaacaatatgatgtaagctccattggagcttgtaggcctaggatcttcttcatcaatggatttctttgcttcttggaagatgaatggcagcggaatggagaaaggaagagagagaggagacgccacttcaaggagaagatgggtctagaagaaactcaccatcataggaggtcatgtataagagcttggagaaagaaagagatgaatgaagggagaggaagaaaagagaacgaaattttgtgctctaaagagctttga

SEQ ID NO: 22783 - DNA, 408 bp, Glycine max
  Peptide Sequence Number=SeqID_139561
atgtggacgacaactcattcggcaaccccgacaattctggctttggtgaaattttgcgggacaatcttgggcagtggatttatgagatttagtggttcttgtggctacacaacgaacatgaatgttgaacttcatgctattctccatggtttaaacatcacatgggaagctggtcacaaagatgtaatttgcaagattgattctctgatggcgcttcaattgatatccggagatgatattcaacttcatccttatgcagcaatagtcaggaagattcaatgggaagtcaatgagtgtgctaattggcgggttggccaagaatcgagcttcttcaaccttccctatgctgacctttcagcattgttcgacccaattgaagcattttttgttattggatgcttttggtga

SEQ ID NO: 22784 - DNA, 843 bp, Glycine max
  misc_feature (52)..(52): n is a, c, g, or t
  misc_feature (123)..(123): n is a, c, g, or t
  Peptide Sequence Number=SeqID_139562
atgcaccaggagcttcaagcggtagtcgctacagcttgcagagaactgggcnatctgcgcggtcgtaaaatagatatcgaggagtttaaaatgaaggcgctggttgttggcgggagtgggctnatcggctcgaaggtctgtgacattttgaagaaagcgggtcacgaagtgattcccgcatcgcgacgcaacgggatcgataccgtgaccggcgaggggctcgctgagggcttgaagggggttgatgtcgtggtagacgtccccaactcgccctcgttcgaagaaaacgacgtattggaattcttcacgaagtcgtcgtcgaacattactcgagaagcgaagattgccggcgtcaaaagcctcgtcgccctttctgttgtggggatcgatcggctgccgtccaactcgtacttccgcgcgaaactggtgcaggaagagatcatcaagaattctggcataccgttcacgattgtccgagcaacgcagtttttggaattcttggatgctatcgcttacacgtcgacacatggcgatgtggtgaaggtttccacagcatttctgcagccgatcgcgtccgacgatgtcgcgaggttcgtaagcgaggctgcgctcgcagaaccgaaaaatcaaacggtcgacgttgccggcccggaagcgttccgaactagtgatattctgggttcgtacctgcagaagaagggtgacccacggaaggtcgtcgcggattcagaggcgctctacttcggatcgaagctcgaggccgactctcttgttcccgtcggaacacagccaaagctcggatcaatcagttttgaagcttggctcggttcaacggtcaactga

SEQ ID NO: 22785 - DNA, 252 bp, Glycine max
  Peptide Sequence Number=SeqID_139563
atgtctcctgggttgcatcagcagcgtcctcgcggtttcgaaggcgtttctggaagaaacgccgcaacttaccctcttgggtctgctgcagtttttcgatcgtcccggcgttcgtgggccgattacagaaccggcaagcgaccttccgccaatgcgaaaaggcccgagcctcgccagatcgggcccctccgtgccgccgcgccacttcgcaaacgcggcgacgccggattccatagagcaaccgctatctag

SEQ ID NO: 22786 - DNA, 557 bp, Glycine max
  Peptide Sequence Number=SeqID_139564
gcgtcgagccggtcgattttacccaaaccgcgccgcagttctggcgcgatgacagcatcccggtgagcggttcccgccgcgcacggccaggcgatctcgactcggtggtgaccgactggtcggtcgatcccgatgactggggacgctttctcatcgccgtgtttgaagagtggatctgcgtgacctcagagttctgcggcaagggcctcgccattgaaaaaaacggtgatatctatgcctgcgatcactacgtctatccggagtatcagctgggcaatattgccaacactaaactggcgcacctggcgttttccgaacggcaaaaagcgtttggcctcggaaaacgcgacaccctgcccgccgtctgcaaacgctgtccttacctcaaattatgctggggcgaatgcccgaaaaaccgcatcgtgcgcagcgcagagggtgaacccggccttaactatctctgtcccggcatcaaagcgtttttttcctatgctcagccgatcctggtaggtatcgccacgctgcttgagcgggaaaaacagggagtgacgcaatga

SEQ ID NO: 22787 - DNA, 211 bp, Glycine max
  Peptide Sequence Number=SeqID_139565
atgggtgaagtagacgaggtgcaagagtggacaaaggttgacatagaggccctgaaagagaaaatggccataatgatggaggctgtgatgagcatgaagaagatgatggaggtcaatgcgactgtagttgccgttaccagcgccgttgctgaggtggacccgactcccccatctggcactcaaccaaataagtcatccaacctcggatatg

SEQ ID NO: 22788 - DNA, 1011 bp, Glycine max
  Peptide Sequence Number=SeqID_139566
atgggcatccacacggattgccctgcaccagcaccattgtcgatgaatttggatcatgctcgtgcttgtgttcttcttcttatttttcttatgccgtctgctacggcacagttacaaaactcgccgccaccgccaccgttggatcctttcacgaggttaaggttcgacaagaccatggctgcggttttggtaatcctcgtagtggttttcttcgcgtttgggtttgtttctatctacacgcgccaatgcgcggagaggaggatcagagggaggctcgacctggcggtggcgatcgccggcgggatggagcgccggcagcaccgcggcctcgacgcggcggtggtagagacgttcccgaccttcgtgtacttcgaggttaaggcactgaagatcggaagggccacgctggaatgcgccgtgtgcctcaacgagttccgcgacgacgaaacgctgcgtttgatccccaagtgctgccacgtgttccactccgattgcatcgacgcgtggctggcgaatcactccacttgtcccgtttgccgcgccaacctcgcgcccaagcccgaggacgcgccatcttccgttgagattcagctttcagatccggcccggcccattgggcccaatgagcccggtcatgatccgaattacatcaacccggtggaggagcgcgaaggtgaacaaaacagaatcgttacggagcctccacgtgttttagatgatcccaaccgggcccgtccggttcggtctaaatcgaccgggtttggcattgcaaggctgtttccgcgatctcactcgacgggtcactcgttggttcgaccgggtgcgggaccggctcgtgcgatccgcgacgctgaaccggacgaagagttgcgggatgacatggcagctggagagcagcgagagaaggggttaccggacggggagtgtggggagtcacctaaggcaacaagggtgaaggatgaagttgacgcgggagaacgttcctctgatcgtttgttttccaaggattga

SEQ ID NO: 22789 - DNA, 276 bp, Glycine max
  Peptide Sequence Number=SeqID_139567
atggccaaatttggaatgtcttcatctggaagcatgttggctacagccaaggatggagatggtgtggatataggtatcgaggatgattcacgtgcatcaatcaggaatggggatggtgtggatgtagttggaagtggagatggtgtaggtgcaacatcggaagatctgaccggtatagatattgcagatggggatggggtagatgatgtcaaactatctctaggtgctaaggcaatccttcatggtaaacacgcgagtgcttacacactcaattga

SEQ ID NO: 22790 - DNA, 120 bp, Glycine max
  Peptide Sequence Number=SeqID_139568
atggagcgtttcatccatctaaggttgcaacaaaggatcaccaggaacaatttggtcacccttggccttcatagggagcaattccaaaagatcatcaggaagttttttccagcattttaa

SEQ ID NO: 22791 - DNA, 444 bp, Glycine max
  Peptide Sequence Number=SeqID_139569
atggagggaacaagagcaggaaccgcaacagggtcttacaagtgtggcaaacctggtcactggttacgagattgccctttctccgctcccaattccaatttcaatctcaatccaaaccctaactctatcaccgccaccactcccaatcccaatactccaaatcgttcttcgtcttctttcaagcccaaatccgccaccaaaaagcccaacatgctccctcgaacaaaacccaaactcacaccggagcttcttctctccgacgacgacctcggttacgcccttcgctatttccctcgcaagttcaaatactgtggtcgtggccacgagtttgttcacaaagtagagaaagttgctgctacaaggcgtggaaagggtcacactgttaggttaggtgtctgtatcctgcctatgttgtcttattactccctccttttggaaaattaa

SEQ ID NO: 22792 - DNA, 297 bp, Glycine max
  Peptide Sequence Number=SeqID_139570
atgcacagtagccttgccttccagaccttagctgcttcatacgttgctttaggtctcgtcatgaacaggaaccaatctcgcagaaagcactggcgagacccctacgtggagcatctcgccgttagcactggcgagatggttgatgatggtgtgtgtcgcttttactgctggcggcatcaatgcccagtcagcaagtatcgccaagaagaatggcagcaccagtgcttacgtggagatctcgcctctactgctggcgggaccttggtatcgctcttcctgctggtggcttccccttaa

SEQ ID NO: 22793 - DNA, 228 bp, Glycine max
  Peptide Sequence Number=SeqID_139571
atgctaaaactacagtgcataataaaagcaaagggaagattagggacacctacctcgaacggaaatggcgtccaaccgaaagaagcagcacctgggctcgcggtgaaggagaaggctcgcggaagagcctttcggaagtgcttggcaccgtctcgcctctcattggcttcacgctggacccacccttctcttcccccaaaacttcttgcagaaattatggcatgctag

SEQ ID NO: 22794 - DNA, 714 bp, Glycine max
  Peptide Sequence Number=SeqID_139572
atgaaacaacttaagaggaatggaggaggaaggcctaccacgcggtttgctaaacgttcgaattcagtgaggaagccgtttcatgacgtgataaatccattgctgaacatcccctggtaccagcttagggtgacactgtcgagatacagggatgcgacgctgtgtgatcttaaagatccaccccaagggatcacggccattgaatcttggtatgtcaagtttgatcgcgttacgtggatggcttggaggattcactggcgtggtagtgttgttattgccgaaatcgaggaaacacaggtgttcgaggatcgagtcaaccttgtcggaaaggtcattatatctgtcattgatggaaatctgactgttggtcaggcggacgatggcttcttcaaggtgatcggtggtcgtctttctagttccgtggtcagccatgacgatgggatgaatgtggacgaggggagggaagatgcacccttattccaggaagggaagaactcctcagacttagctgaacttttcattgattcctttattacaatgtacggtggcgtcttcctggtgcgtactggcctcgaggtggttactggtatcgacggggaagacggtgcctgtgaggtgccggtggtgctgtcggtggtgctaacagtttggaatttcaacagtgttgccggaacaaattccgcagctttactcgcagatgggagtatatgttag

SEQ ID NO: 22795 - DNA, 1641 bp, Glycine max
  Peptide Sequence Number=SeqID_139573
atggatcactcctctattcatttgttgtcccaccttcaccttcaggccttgtggacttctttgattattattgtagttttttgcataacctttctcaaaggctttggtcctcacttgtttaaaagaaccaagaaacaaaaactacccttaccccccggtcccaaaccatggcctataatcggtaaccttcctgaaatggttgcaaataggcctacgttccggtggatacaaaaattaatgaatgaaatgaacaccgaaattgcatgtatccaactaggaaatgtccatgttattcccgtgacttgtcccaccattgcttgtgaattcttgagaaaacaagatgctaattttgcttctagacccacaagcatgaccactactcttattagtcgcggatatctcaccacaacccttgtaccctttggggaacaatggaagaaaatgaggagaattgttggtaacgatttgttgtccaccacctcccaccaacgacttgaatataagagggttgaggaagccaacaaccttgtatttcacatctacaacaattgcaaaaacaatattgcgaatggtaataataatgttggccttgtgaacgtgagagatgtcgcacaacactattgttgcaatgtgatgaagaaattgaactttagtaggaggtactttggggagggtaagaaggatggagggcctggtagtgaggaagtggaacatcttgatgccattttcacaatgcttaaatacatttatgactttagagtttctgactatgtcccttgcttgaggggacttgacttagatggtcatgagggcaaggtgaagaaggccatagaaactgtgggcaagtatcatgatcccatcattgagcagcgaatcaaagaatgggatgaagggtccaaaattcatggagaggatttccttgatatccttatctcactcaaagatgccaacaataacccgatgttgactacacaggaaatcaaggcacaaatcatagaattgatgatggcaggggtggacaacccatcaaatgcagtcgaatggggtcttgcagagatgataaaccaacccaagttgcttcagcgcgcaacagaagaattggacaaggtagtggggaaagagagactggtccaagaatccgacatttcaaagctcaactacataaaagcatgtgcaagagaagcttttcgtcttcaccctattgtgcctttcaatgttccccatgtctctatcaaagacacaatagttggaaactacctaatcccaaagggtagtcacatattgttaagtagacaagaaattgggcgaaaccaaaaagtttggggtaacgaagctcacaagttcaagccagaacgtcacctgataatgaataagagtgaggttgttgttttgacggagccagatttgaagtttatttcgttcagcacgggacgacgtggttgtccagctatcatgcttggtaccacaatgactgtgatgctatttgctaggttgcttcaagccttcacttggactgcaccacccaatgtgtcacgtatcaaccttgctgagaacaatcatgatattcttcttggccacccacttgtggcactagcaaaaccaagattaacaccagagctttatgccatgcacgacaagtag

SEQ ID NO: 22796 - DNA, 1746 bp, Glycine max
  Peptide Sequence Number=SeqID_139574
atggcgctccaaccgatttcactcttacaagctactgccctagctaagctccaggaggaaaagttacgtgatagaccaactccaacaccacgaagttttccccaacctaaaccttcccctaatcataaccctaacacctccgtcaagcctaagtcatcttttgttcaacgaactccaacagaaatggctttccgacgagagaaaggactttgctacaattgtgatgagaagtggaatgcgaatcatcggtgtaaggggcgaggtgcagtcgtgactgacaatcacgaattcccatccaatgcagattgctcacatataagcctccacgctctagttggattaccctcgtcagaaaccttcaggatatatggcaccgttaagaatgctagaccaaccattctggttgatagtggaagcactcataacttcctccaacctcgaatagcgcaattccttcgtcttccaattcaagacacccacccacttcgagtaatggtggggaacggcgctatgttaacatgcgatcaggtcagcccgaaaactcaagtcaccatacagggccacccctttgtggtgtcattccatctctttccgataagcggggcggatgcagtgcttggtatagactggataaagaggttgggaccggtcaccacagattatgccgagttcttgatgcacttcaatcattcaggccaagatatatcgttaaaggcggatgttttgcacgttatgaccgcaatgcaacccgattcacccacgtctcaacaccccatccaatatgtggagcaccttcttcttcgatatgatcatctttttcagacaccctcacagcttccgccaccacgccaagtggttcatcgcatcaccctgaaaccatccacagctccggtgaacgtcagaccttaccgttatccgcatttccaaaagaatgagattgaacggcaggtctctgatcttctctctgcgggactgataaggccaagcacaagcccttactcttcaccggtgctcttagtgaagaagaaagacgacacttggcagctatgcgtagattaccgggctctcaactccgtcacggttcgagatcatttccctatccccacgatcgacgaattgcttgacgaactaggatgtgcttcctggttttctaggttggacctccggcaggggttccatcaaatattgatggatgagcacgacgtcgagaagacgacttttcgaacgcataacgggcattttgagtacctgtatacaacagctcgttgtcatctcacatacaccacctggagactatctttcgtacccttcaacaaggaaagcattgaatatatgggccatattgtctcgggcaagggagtgactccggaaccatccaaaatccaagtcatggtgaggtggccatctccgacgacggccaaggagctacatgccttcctcagactcacggggttctaccggaagtttattaagagctacgccttctttgcagccccccttacaaaactactgtgtaaggacgctttcggttggatgcatgagtctcagatggctttcgaccagctcaaatctgccatgacaaacgccccggtgttggccttaccaaatttctcagaacccttcgtgattgagacaaacgcttccggtaccgccatcggagctgtgctcatgcaaaggggacaccttctggcgtatttcagcaagagtcttggccctcgtctactccatgcatctacctacatatga

SEQ ID NO: 22797 - DNA, 423 bp, Glycine max
  Peptide Sequence Number=SeqID_139575
atggcctcccctcccctccacggccttgcggcccttctcctctatcctccttccccctccacaaccgtctacggtcacctccaaatccacacaaggcccgatcttgagcttaagatccttactcaagatctgacactaaagttgctcttaggatcctttcttatgctgttagagactaaagagccaaagaaggaaagtcttatagaggaatacgaaattagaattataaaggaatcccttgaagattgttcgaattgtttactatgcaaaggaaagtcaactgccatggtttctaattctgatgcttcaaaagacaacctacatttggatgggtttgagaaagatgatctaggggctgtttggggaggaagaaccccgtcatttgaatattcaaatttccttgccaatgggaaaaggggatga

SEQ ID NO: 22798 - DNA, 309 bp, Glycine max
  Peptide Sequence Number=SeqID_139576
atgcttaatatgctaattgactatgagaatcaagttacctatgatcttctaaaactattggatactgtttacaccaaccttatgtccataaagtgtttgttgcaagaggatctatttttagaaagggtattccttgcaggaggaagtcatggtaaaaaaattgagcttgatgaaactcaattaaccaatgaaacaactcaggactatgagatggaaactgagatacctttctttaatgttctaaagttaccacaaaggtcatcacctccaacaattgtggttcaagagccagctatagttcaagattag

SEQ ID NO: 22799 - DNA, 813 bp, Glycine max
  Peptide Sequence Number=SeqID_139577
atggatgggttggtcgaaccattcatgaatgaggagattaagtcaagttggaaagtggtggaaggaaaggtaagtgcagctattcatgaatttcatagtaacacttctctcccaaagtcaattacttctttctttatcacactaatacccaagactcaacaccctcagaatctgttagagtaccatcttatatctctaatacgtagcttacacaagatcatctccaaggtactagctgtaaggcttaagaaggtactcccttcaattatctctaggtgccagattgtgttcctcccgggtagacaaattcttgatggagtattagtgttgaatgtggaagcaatgacttccaagattattttgatgatgccaaagaatcaagagttaagcaagttccaaagaatcaggagtcaaaaagcttcaagaatcaagtttcaaagaatcaagattcaagaacaatcaagtttcaagaatcaagattcaagactcaagattcaagaatcaagagaagactcaatcaagataagtactaaaaaaagaattcaagggactaaccgcctaagaattctttgtcctaacacattggagggtacatcctttgtggtacaagtagagggtacatctacttggattgttatactgagaacaagagggtacatctcttatggatcagttcaagtggagggtacatccacttggttgttcaaagagaacaagggagggtacatcccttgtggatctttcgcttgtaaaggattttataaggttgaaagaaatctcaagaatcgttggttgcttggggactggatgtag

SEQ ID NO: 22800 - DNA, 453 bp, Glycine max
  Peptide Sequence Number=SeqID_139578
atgggatgctatgaagagcataaggttatttatgctacctacaagctgagtggggaaattgaggattggtggaaggagtttcttagggaactacttcctgaaaaagctagggaatttctggagctaaagcaagggaacatgacaatgggggaatatgcttctaagttcaacaagctaatgaataaagcgaggaaggtagagaatgataaaacatttatggttttgttttcatccatgactgaggagtttcttgatgttggaggcgtacccgtagtctacgaatttatcaaagttttcctagaagatgtgattgagttaccacctaagagggagcttgaatttgccatagacctagtgtctgggtctagtctagtgttgagagcaccatacctaatatctcttaaagaattagctaaagaaaaggagcaagtagaagatttgttgaagaaatag

SEQ ID NO: 22801 - DNA, 750 bp, Glycine max
  Peptide Sequence Number=SeqID_139579
atggctctaactatacttgggcttcaacatcaaactttggttaaagggacaagactatgtggacctcctcaccacaaacgcagaatctggtatgttggcaagctagttggccgatactatgatagccaagggaatcctactaaatatttgaaaggggttgaagtgaaggctgccagaggtgcacagcttctagaaaagcagaagattgaggaggctaaactaccttcatgcaattcaagatggagtcaagatgagggtggtgaggtatggtgtgatgttggttaccctagattggttcagaggccactagagattgctttgacaggaaagatgagtaagcgttgtgcatgctttgaagattctcagttggaccaacctggcttagagggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggtttttacaaggttgaaaagaaatctcaaggagcgcatgttgcttagagactggatgccacttgatccaacattagtgaatggtgactactcgacatttggtgcactcatttggcgcggggagctcacaggcttcactttgctattcctcactggttctgagactatgctttttgagttgggggctgaggattga

SEQ ID NO: 22802 - DNA, 141 bp, Glycine max
  Peptide Sequence Number=SeqID_139580
atggataagacttttaaaggtgatagcaagcttatggttaatctgccaaagttttccagagaggagtggccaaaagtaagatttgcagagggtcagagaatggtttataacaacaaaaaagcagaaggctttggtaacgga

SEQ ID NO: 22803 - DNA, 387 bp, Glycine max
  Peptide Sequence Number=SeqID_139581
atgtcgttgaaaacattagcaacctctcctctttcggggatcactcttttggtccttctcatcgctctccttctcagattttacatcaaattcgaaactgctgagagattgttcagtgctgaagagctatcattgttcaatggaactgatgaagggttgccaatccttctaggaattcttggggaaaatctcattatggttctagagggggatacaatcattttgctggaagggatgcttctcgtgcatttgtctctggaaatttcacagaattggggacagttaaccacaatcgatgagaactgcattttcactatcaactatcgagagatgagagaatatgtagtgttctatatgtggggccgcgaaagtgttgatttcacttaa

SEQ ID NO: 22804 - DNA, 420 bp, Glycine max
  Peptide Sequence Number=SeqID_139582
atgagacagaggagatggatggagtttctaaaggattatgactttgagttgtcataccatcccagcaaggctaacattgtggcgaatgctttgagcaagaagtccttgcatatgttcgttatgatggtgaaagaattgcaattgatcgaggattttaaagacttgaacttagcaatggaagaagcccagcaaggagatcagttctggcaagacatgacgaggttgaaggaggaagacatggagttgaaatttcgacatgatgctaataaactcatcaggtttatggagagagtatgtgtacctcaagtaaaggagataaagcatgtgattctagaacaagcacataagagtagattaagtttccatcttggatcaacaaagatgtatcaagatcttaagaggaatttcttgtggaattaa

SEQ ID NO: 22805 - DNA, 120 bp, Glycine max
  Peptide Sequence Number=SeqID_139583
atggtgaagaatgagtggtttgaaacttcaagactcaagaactcaagcaaaaaggttaaagtagaattaggacaaaaatggatgtctcactttaaccataaatggaaatcctttggttaa

SEQ ID NO: 22806 - DNA, 327 bp, Glycine max
  Peptide Sequence Number=SeqID_139584
atgatgaagattaacagaaaactagaggaaatgttcaacacggttcatattaaggatcagtcttatggtgaagtgaataggtcttttgctataagatggaaggatcaactagagcatacttggcatctgctagacagtactagaagcatgcactctattacattcaaccaagatctagtgaacccaactatactggctagatggacaaaactcaaagatttctatggactcacaggaaatcatcaagtgaccatgacccattttggacaatgttttttcctaaccatcttcaaaagtaggtttaaaccaaaagctgatcctaaatga

SEQ ID NO: 22807 - DNA, 672 bp, Glycine max
  Peptide Sequence Number=SeqID_139585
atggcgtttttgtctcctatgaagaaaacgcatgggagttgccaccaacgtttattcaaggaaaacgttagaaaaaccaaaagaggtccgcgaattttgaaaagatgggttcgagagttgtttacgcatagggaaggaaaaggccatttggtgcaggggaagctcgcccaagccagctggtttcttatagctgaaggtataagctcacccaggcgagttggttgcttaaggatgaatgcattccatggcccaggcaagccaaatgttggcctgggcgagctcagacctagaaacatccaaaaaatggccattttgacccctttccttgtgaagtgcatacaagtgtttgtggagaagaaggagtatccacttattacccttcctgaattcacatgggtagacaaggagcaacaagtgtcacgccgatatgatgagtacattgtagaatatttgacggatgaggatcttggaaacctagcttttctcaagtcactccctcggcaccttcctaccaagctcatagttaacttatttaagtctcttaatcctattagggatcttaaaggaatcatggctcaagctagttctaatatgactgcctttcttcttgctcacaagaatcgaacaccagctggtgtcgacatttccatccccactcagtcgtctatttga

SEQ ID NO: 22808 - DNA, 186 bp, Glycine max
  Peptide Sequence Number=SeqID_139586
atgggagtcgctgacttttcacctttgttaatttttcttgctttggaccgaagagcttatttttctttgctacacgtcaaggagttcaaggaggcaggttctagggttaaggatcctaccaacgaggtgttcaaggtgtcatcgaatgtcgatttgttggggtcaaattcggttatgcctatgtag

SEQ ID NO: 22809 - DNA, 1419 bp, Glycine max
  Peptide Sequence Number=SeqID_139587
atggttaagaccagaggattaggtcgtgccttaggtcaggttactggcagaggtgtgggcagaggagatcatgctgatttcgatgatgctccgcagcgtcgacgacctactgcatccgcacgaaggcagcgagtcactgtgactgcgacgcacgatgagccagtggtccctgcgccagatgttcaggatgacccgatggagccaccagctactgcagaggacattgtggtagacattcctgcagacacaggcgcagaggctgctgaggatgagcatcagggatttccgggtggtccgagcgacccatccgtgttgacccagtatgcggatcacgttgcttgcagcgtatggatggaagagaagcgtcctgaattgaagctatcctctcatgggaggaaggtccacagtttaggcaggcttgtccctgccattgagggacttattgctagtacaggactaagtcctctgatcgcgtgttcggtagacaccggcgatcggggacttttgtccgcgtttgtggagcggttgcaccgggagacgtctagtttccatctcccggtgggagagctcaccatcacgctggacgacgtctcctcgcttctccatctgcccagtctgccagggctgagacagcctagtgtcgtggaccgtacgtacgcctgcaatgggtacatgatatatatgagcgccgatgccagacaagcccttcgtgacctcagtatgacagagaggtacgcctggggagtaactgctctggttcatatgtacgaccagctgaacgatgcatctatgagccacagtcgacagcttggcgattacatcacactactgcagtgctggatttacgagcacttttcctcggtcgcggagtccaccgctgatcaggactacgacgaggcttccccgatcccttatggggagcatcgggaggtccgggacttccacgtcagatcatgctattccggtctcttgcgctgggggcctgttgttgtttattaccgaccggagagggtcgtgtggcagtttggctacacacagaccattcttgctcctcctgtcgattcatgggtctcgtatgatgatatacacgacaggtggatgcactacgaggatcatatcgttccagcaggtgaggtgtgcgttgtgtcaggccagtgttccaatgactacatggactggttcttcggcatctcccatcctctcatgacaccaggccacgcatcaaattctctgcttcatggtcacgccctgcagccccgagtcgtccctcaggccccgcagacggatatccctcacgtgccagagccaggagcatcgtcgacatctgcggaggagcctagacatgcagtggaagtttgtgatgacattgctgagaggttggagcgccatctgagtctaggggtggtcacgcctggctaa

SEQ ID NO: 22810 - DNA, 354 bp, Glycine max
  Peptide Sequence Number=SeqID_139588
atggtggagacgaagacgaagacgaagaggaacttacctcaacaatgccgacgcgaggacacagcaacaccactgtcaacacccacgaagaagaagacgaacaaaggtcacgaagaagacgaagaacacgcgattggaaggtcacgaagaagacgagcgaaggtcacgaagaagacgaagaagaagatcgtgctcaagatttttcgagaggaagaagaaggaagggtggagggcatgaataagcaggaatggcgaggaagaagcaggaatggcgaggaagaagcagaagaagcaaaaatggcgaagaacgcagaagaagcagaaatggcggaaatgaacaacttttttttttaa

SEQ ID NO: 22811 - DNA, 300 bp, Glycine max
  Peptide Sequence Number=SeqID_139589
atgatttctcagcttcattttcggtgccccatatctgtgaataaccagtgtatcaaatacaatgcaatgcatcttttagacgacgatgacgtagaaatcatgttcttcaggcttgcccgaaatccatatatccattgtgcaaaatggtacataattgaggaggccgattcacaatcccgtgcagatccttcaacttatgagcctactcaagaggatacgaattttaccaacgcaaaactgatgttgaagatgctggagcttaaaaaatataacgattcaatccgtccatactaccatcta

SEQ ID NO: 22812 - DNA, 240 bp, Glycine max
  Peptide Sequence Number=SeqID_139590
atgcagacttatgtactagagacttccagtaaaattttcgagtcaatccaacggttaacgaattcgaacgaaggaaatgttactggggccatgattattggatgtggaattacctggatgttgtggaagcttgggaggattgatggggacccggcgttgagaggaacaaggataagggctacgtgggagtacgtgagcttagttggaggtgggcaacaggggatggtgggttatacgtga

SEQ ID NO: 22813 - DNA, 315 bp, Glycine max
  Peptide Sequence Number=SeqID_139591
atggccaacaaaaacatatcatccaatgaaacatacctccccacacttattcccaaaacaattccaaagctccaaaattccttaagggtaggaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatggggcaaaacacactgaataaaatagatgatgatggctcaaattctcaccaagggtaa

SEQ ID NO: 22814 - DNA, 363 bp, Glycine max
  Peptide Sequence Number=SeqID_139592
atggcaccccctcctctggtggtcttagaggccagggaatttgccatgagttataatgcttctgcttcatactcctctcatttgcccttcaattttcgaatccgttacattggaggttcacttttagttttgatgcttcaattatatgagtgcgtgaaaaacagatatcatatcaaattccagagtttcctcaactttttgaggagaggattttatgcattggttccaacattgtacattgaaggatatatccaagccatgcgggattcactttatagacaagaataccttagagtcagagttattgacaatcaggaaatagttgagctaagtgcacataagttggtcagcttcccaaagtaa

SEQ ID NO: 22815 - DNA, 375 bp, Glycine max
  Peptide Sequence Number=SeqID_139593
atggagctcaaactccacgcatcaatggcttccattccacacgcaatcttcacccattccttttccttcgttcctttctgcacctacgcagctcccaacattagcaggcgtcgaaacggcaacaccaacagtcgttccactcacaaaattccttctttgcgtaaggagaaatatcccaatgaacaaaaattgatgctcaatcatcaaaaccaaaaccccttgaatgtggacttggtggccttgtgtgaagaaggcaagtggaggatgactggtcgatgtcgaaggggagtggaggtgggtgaaaccgcagtcacggaggaggctacggagttttggatgacgccacttccggtgaagaaagataagtcagggtag

SEQ ID NO: 22816 - DNA, 375 bp, Glycine max
  Peptide Sequence Number=SeqID_139594
atgggagaaaattccaaagccacaatcgaaaagtcacaatggaaaatggaaagcgtgaaacaatggaaaccgtggagagcaaatccaaaggggagagaaatcaaaagccacaatggaaaatggaaaaatgcaaagcgtgaaacaatggagaccgtggagacccaattggaagtcgaaaaacacaaacagtacatcctttgtggtacaagtagagggtacatctcttgtggatcagttctagtggagggtacatccactaggttgttcaaagagaacaaggaagggtacatcccttgtggatctttgcttgtaaaggaatttacaaggttgaaaataaatctcaaggaccgcaggtcgtttagggactggatgtag

SEQ ID NO: 22817 - DNA, 318 bp, Glycine max
  Peptide Sequence Number=SeqID_139595
atggaccgttgcgtggcggcacgtgaggagcacgacgagtgtggcgagttggtggaggacgaaggggaggtccccggcgccattgaagaaggcgacgaggtggagaaggtcaacgacgaagtaggcggcgttgaagtccagcacgatgttctggaatttcatgttggcagcggagaaaccgcgatccgaggcggagaagatggcggcggaggagaggagcaccaccagagtgccatggaagatggaaatgaagtagctggaggcttcgggtcaggtcttgggactccatttgcaaaatatgatgaagtagccgaagag

SEQ ID NO: 22818 - DNA, 615 bp, Glycine max
  Peptide Sequence Number=SeqID_139596
atgaagggctacaattataagagtttgagggccttggttatcgataaccaagcaaaccctgtgttggatctcagtaagcaaaagaaaagaaataaagttgaagattcctccataaccaatttgggaggagtatccaaacctcttggtggtagtgactatactacagatgatgttgttgttgttgctagtgttgatgaaagattcaaagcaatgtatgagcatttgaagaccatgaaagttgaggttagtaaaactaaacaacttggagtggctctagctaaaagctttgagtacccgagttatcacattgagaaagatgttatggatgttaatactaaacttgatgggctatcatcagagcttgctatcgaacaatacaaaatgactcaactactcagaatggaccttcccaatttggtgcaagctttccttctgagagcttcggtgttgtcaactgcattagacataatccttttaagtgagggttcaccgatctctactggaatcatggcattagtgctatacgtcagcatgaatgaagagtacagcgatagccccaaacctaccccttcatttgagggtgttcaaccaatgatgcaagatgtttcactatga

SEQ ID NO: 22819 - DNA, 385 bp, Glycine max
  Peptide Sequence Number=SeqID_139597
atgtcagcagaactccttccatctatcaagacttgtctcacgtcccaatttgtaattcgaactgtgatcaccattggatcatcctgctctggatcaactcctacaaagtcttcatctgtgaaggctattggaggaagtgattttttgcgccaaataagggactataacaatgttcgtggacttgaggtcaacacattgacgctagaaggagggcctatgtcactcttgacccttaatctcaaccagagggcttgttttgataaccacaaagtcccatattgcttaggagtcgaggataaaaccgtggtagtcattaagcacttgagtggacaactcctcggatacagggaccctaacgatgcttgtggacctgaagtcgcaacag

SEQ ID NO: 22820 - DNA, 1032 bp, Glycine max
  Peptide Sequence Number=SeqID_139598
atggaagaaagacatggctcacaatgttcaaagacaaatccttctaacattgatgaagatgaggagtgtgaaagtgaggccaatgaagagcaaagtacgcaaaaaaacaatggaggaagctcaagtaacagcacagtggaagagaatgagaaaaagataaggccttatgttagatccaagatgccaaggcttcggtggacacctgatcttcatcttcgctttgttcatgcggttcaacgacttggaggacaagagagagcaacaccaaagttggttcttcaattgatgaacgtcaaaggtttgagtattgcccatgtcaagagtcatttacagatgtttaggagcaaaaaggtggatgaccgaaatcaagtatttgctgattacaataatcttgttgaaattggagacaaaaatatttataatattagccaactttcaatgcttcaagggtataatccgagtcaaagttcatccttcagctacacaaataattatccatgttatggactcggggatgcttcttttggtgtctacgaaaaactgttacaaagacctttcgattggtctaatgcaatttctcgggaaggttcatccatttttggtgaacaaagcaaaatccgtgaaccaaaagatgagtttctctcatttggtgctcatgactctctaagcgcacgcgcacgattaagccacgttgatcacataccaccaatcaatattttgcaacaaagagcacaaaaaaataccatgcctataaatccaacaacaaatcctccagaattgaagacactgaaaaggaaggcttcagatacaaccctagatttggatctgtcactaaaactaaactcaaagattgatgatgctgaagaaggaacattaaagaaccatgaagttgatagcacaaacctatcactctcattgtgctctcaatcctcatcctctaataatcctatcagcaggttgatcaaggaagcacaacaagatcgatgtgatgaacaagggaaaatggccagtactctagatctggctatatga

SEQ ID NO: 22821 - DNA, 336 bp, Glycine max
  Peptide Sequence Number=SeqID_139599
atgggtgccaaatacctcgaagtggtcgagcgagggtcgcatcccaacaacggatggtccccggacgaaattagggaaagggagaatgagaaattttgggaatggggaattgtgttggagcgtggaggaggacgaggaggatctggacccaagcatcaggcgcgaatgcttagcggaggcacgcgacaaagttggggtcggtggatgaaaccagttttgattttgaaacactatgagattgaatgcgagagttgtgatactcaaagagctaaaagcctccttgaggagttcttgaaggagaagagagagagaagcgagaataaaggaaagaaataa

SEQ ID NO: 22822 - DNA, 576 bp, Glycine max
  Peptide Sequence Number=SeqID_139600
ttcttccggaagtacgcgtcttccggaattcttccggatgaaccacttcttccggaaagttctcggaagaggttttccggaagtcttccggaagaagtgttcttccggaagacgtttggttacttccggaagaacacttcttccggaaactttccggaaaaggttcttccggaacttccggaagaacccctaacgggtcttccggaagtctccgccgtcagcctcttttccccattttttccggcgtcctctcctctcgttttctaccctaaagttactatcctaaggggagttagggagactaacctcgttcgcggagaagaagaagacgaggttcgcgcttgccttgctggagaagaagaagcagttcgcggagaagggagaacaagcttcgcggaaggaatgagcaacagcataaaacaatattgctgggtgcacctagcatctcccgaggttgaggagggagaaggatttaatgatgagctcacacacgacaaaggtggagttattgcagcggttgcaggtgtcatggaggtgggcaaaatagggtggtgtcggtggtgttgggaagggtga

SEQ ID NO: 22823 - DNA, 282 bp, Glycine max
  Peptide Sequence Number=SeqID_139601
atgtatgtcaggcaggcaaactggttgtattccgctagatatcgactccggaagcaagccaggttacaaaatctgaaaaacctggctgagtcccatgaagcggaagtttcaatgaatcaatctcaactgcatttctggaaaactgcccgcgacgaactagttgaagagaatgcaatgatgaaagcacaatacgacattgctagtaagctggttgctgagaaggaagctctgaattgggctctgatggaagagatacagaggttgaggaacaacttgatttag

SEQ ID NO: 22824 - DNA, 1125 bp, Glycine max
  Peptide Sequence Number=SeqID_139602
gatgaggaggtggtggagaagttcctgaagaagtactttccggagtctaagaccgttgagggtaaggtagaaatctcatccttccagcaacaccctaacaaatcacttagtgatgctcttgaccacttccatgggttgctccgaaagactcctacacataggtttagcgagctagtccagctcaacatcttcattgatggtttacgaccccagtccaagcagctccttgatgcctcggtcggtgggaagatcaagcaaaagactctagaagaagtcatggagctaatagagaatatggcatccggtgatcatgccattatccgtgatcgagcctacatgcttacaaagaaaatcctttttgaactcctttctcaagatgctatgttggctcaaaacaagctcctgaccaagaccttggagactgttacagccactctgagtaatctttcccagcaactacatgcagtgcaagctcctccaaccatgcatactagaggatgcaacatttgtgggtgtgctcatgagtcaggctcatgcatggttcaagatgacacaactaatgaggtcaactacacaggaattcagaattgtcaaggattccatcaaggaggaacaccgagattctaccaaagagtacagttcatccaaaggatcgagtcacatcagaagagtattgatgcaacaatcaggaatctagagaagccagaagctgacaaagtgttgcaagatgcaagcaaagaggaagaagaggataatgaggggaagaagaagattgacgagaagagagatgccaccgacctcaccaaagaaggcaccgtaccctctggtgccattaaagaaggacaaggagcgctacttcaagcgttcctaaagcacctcctcacaaaaaagggaaagtatatcaatagtgaaaccattgtggtgggaggcaattatagtgcagtgatccagaagctgccttctaagttcaaagatctaagaagcgtcaccatcccatgttctattagggatgtattcgtaggtaaggctcttgttgatttaggagcaagtatcaatttaatgtcgctttccatgtgcaagagaatagggaacctgaaggttgaccctataaggatgacattctag

SEQ ID NO: 22825 - DNA, 201 bp, Glycine max
  Peptide Sequence Number=SeqID_139603
atgtcgtcgacgtgggtgagttcggcgaccaacacggatttagcgatgagagaagagaactttcgagaagcttcttcacagaaagaggtgagttcggaaggttggagcgttttggaaggcgaggtggtgccattggatgacaatgagggttttagtttgaagaaggtatacaattggtcattgcaacccaacccggcctag

SEQ ID NO: 22826 - DNA, 219 bp, Glycine max
  Peptide Sequence Number=SeqID_139604
atgccaagcttcactaagacaattggagtgtgtctaaacattcgtctgcctcacatgcttggaactaggttccattgcattgctactcccaacactcagtacaagttagcagttaataggaaggcaataggctacacctttccaaagaagactactacaatagatgttgattctgatatagatttagacttatctatggagatccttgttggtttttga

SEQ ID NO: 22827 - DNA, 165 bp, Glycine max
  Peptide Sequence Number=SeqID_139605
atgagaaatatagtgaggtatgggatgagtgagagcaacatgtggtgtcatcaggtgaggttattccacatggggctccatgagcctatactatggactacatgccttggattgattccagattatgccaatgcagagattgttggacatgagagttgcacctga

SEQ ID NO: 22828 - DNA, 579 bp, Glycine max
  Peptide Sequence Number=SeqID_139606
atggcggatggtggagtatggcagaaggccaaaattctgccatataaaaatgccattgcagcctatgacgctgccatagaaggcctcccttcaaaaattgcctatgatggttggcaaaatatcgggcacaccattccaccatggcagccattgcaatgtcattttacaacattgaagaaagtcatggcaatgaaccatgccaggtctattagacacattcttaccaccaaagaggtagttggggttgcatgccaacgaactttcgccaccggtaaagcaaagaaaggatctaaagggggtgcagctgctgatgcacccaaagcatcaactcttagcaaggaagtcaagtcaagtacagttgtaggtgccagcattctcaaggaaggaactgatccaaaaatccagcctgattcagaataccctgactggttgtggcatctgcttgataaatgccctgcacttagtgaattgcgtaggaggaatattgatacactatcttatgaagatctaaaacgttttgttaagctggatacccgagcaaggatcaaggagaataactctgtcaaggcaaagaactga

SEQ ID NO: 22829 - DNA, 672 bp, Glycine max
  Peptide Sequence Number=SeqID_139607
atgcctcctacatactttcctcttcgttgggagagcactggggaccagtggtggtatgcatcaccgatagattgggctgctgctaatggccactatgacttggttcgtgagctgctcagaatggatagtaatcatcttttcaagctcacttccttgcgccgaatccgtcgtctagaagtggtatgggatgatgaagaacagttcaatgatattgcgaagtttcgtagtgaggtggcacagaagctgcttcttgaatctgagtccaagagagggaagaactctctcatccgtgccggctacggtggatggctaatgtacactgctgcctcggcgggagacttgggttttgttcaagtccttcttgagaggaaccctttgctggtttttggtgagggagagtatggtgttactgacatactttatgctgctgcaaggagcaagaattgtgaggtttttaggctgctatttgattttgctgtttcaccaaggtttttgagtggcaaaggtgggataatggaggagaatgttggggacattccttctgtttacaggtgggaattgaccaatagggctgttcatgctgctgctagaggaggaaatctgaagattttggaggagcttcttgccaattgctctgatgttttggcttatagagatgctgatggatctact

SEQ ID NO: 22830 - DNA, 399 bp, Glycine max
  Peptide Sequence Number=SeqID_139608
atggaggaagtcgttattgttgtgtattatgatggtgatatgagaccacattttaaggggctattgtttgaatgtcctaatggtcttaaatttagtaaaattagtgaggaaatgccacttgcttctttggggaaagcagttacgaatgccatcagaggggatggttgtgttgagtacgactatatggagcttaatgacaaccacgatgtggggaaaatgtttctcatttttttgcaatttagttctaaaggatcaatcgagttgtatgcaatgattggccaatctcgagaagaaacccttgccttgttgtgtaaaccaaaatctgtcaaagagatcattactctgatgcgtggatcaatgacaacaacaagctctagtgaagttgataactttgtgtag

SEQ ID NO: 22831 - DNA, 1293 bp, Glycine max
  Peptide Sequence Number=SeqID_139609
atgttgcctgagaggaaggtggagctctatcacactgagctagatgattttaagactgaattggagaggtgtaatttccataaacgcctcaccaatttggttgatgggagcatagacttggctttggtgaaagagttctatgcaaacttataccgctctgagggcccttcaccaaagcaatctagagttagaggccacctaatgaagattgatgctgacaacctcaacacattcttagagacacatgtggtgttgacagagggtgagactttgcccacatactctagatactgcatgctgcccacagattacagagagattgaggttgccttatgcataccaggccgagggttcatcttgaacactaatggccatcctgggaagattctcaagaaggatttgactactctagctcaggtgtggagtgttctctcatactccaacctggctcccacatcacatacctctgatttgacagtggacagagctaggctgatctttggcctagtctcttgcatggacatgaacataggagctcttatttctggccagatgacttctatagcccagtctaacacttctagacttgggtttcctactttgatcaccgcactatgtagagccataggggttgtctctgacagccttacttttgagcgcctgagcccagatctaataatttctatccgaggggctacaactgagcttccttccacatttgcagctcctactccaacatccacatcagcagctccttctgtcccagctcagacatattctcaacactttaaagccatgcttcagagcattcatcagggacagatcattttattacagagtttacaggtggtggcgactccaggatctaatcctttagttgagcagttcagggagatgatagcctggccccggactcaaccttctcttcatagggaagataaaggtcccacagcccaggtaccaaagcatatggaggatgaatcatctgaggccaccattctagagccatttgttctaggggaggaggaaggtgagacacaggtgagacaggtagttgctgtcactcccgagagatctcttgaggccacttcagagcctcctgcaccattagtggacctaccctcacctcagcgtacaacaaacccctccactcctattctagagatgccagaggaccaaaccacactagtcctgactatggacacttctcctccagctactccagtacttcatctgacaaatgaggaggatgttcagacacaagatactcaagaccagtcacaggaattctaa

SEQ ID NO: 22832 - DNA, 210 bp, Glycine max
  Peptide Sequence Number=SeqID_139610
atggaattttgcaataaaggaaaatcgggatgcaagtgttgggttcctcttatttgtttgcctttaaaggttgaacatgttgtcaaagaaggggaggttgtgcaaatcaacgtgactggtgaacggcaaagacccaacgatcttgactcaggtggtgttgtcgaggctgagacaatggagcacgatgaccttgtggtcgacattgtctaa

SEQ ID NO: 22833 - DNA, 837 bp, Glycine max
  Peptide Sequence Number=SeqID_139611
atggtggatgagtgggtcaaggccactactaccacagctatcacaggttcagaagaaggtacaccggattcagtgaatccatctgttgtagatgatgatgaagaagaaggacttccatcacctcccttggatgaaggggctttctttgtcactcaggctggttcaatggaactgtcacagttctttgatggcatggacgacgacggaaatcctcgaccaactgggccattcagcaagaaccgtgagaatggcagaaagccggttttcgacagccatgttgtagagaagaggaagtcgcaggcttcccatgacacagccatcattgaccgggatgttaagagtcagcagcaagcaaagaaaaatgaggctgttgtgcctgagaggccaaataaaccagtaacagctgattccgggcctggcagacccccaaaatcaaatatgcagagaaaaagtaatatggagccaaagatgcagcaaaaaatggagaacaattcaatcacaaggaggcctccaaccggtcagctagataaatccaagcgttcagatgactcggcagtccaagtgaagctagaagccaccaagaggaaacttcaggagagctatcaacaagctgaaaacgccaagaggcagaggacaatacaagttatggaaataaacgatcttcccaagcaagaagaaaatagaatagcatataagaataagagggtgaagatgacccttgatggatggcattggacaaattgctcaggcaaggttcaagtaaccaatcctattcagtattcactcattcatgcttgtgcgatttccgtgtatcacaaaactcaacaccgctcttag

SEQ ID NO: 22834 - DNA, 558 bp, Glycine max
  Peptide Sequence Number=SeqID_139612
atgatggaggggtcaaaaggatttttcatgcggggtgtccccgatttggcaaaattcgattggattaatgtgcggcaaaacggaagtggattcgataaacaacaacaacaacaacagaaacatgaaccaacacacacacacacacacaaaaaaacgcgtatgttaataaatgacaagaaacaacatcgtcgtgtttttgcgttgttgggatgttgtttcaagattctggagttacagaccaaaacctcagggaaaaaaagaaaagaaagacccttttcttcggttgttgtaaaacgaaaaattggaaacccgggaaataatcaaaagaatctgaatgtttctttctttctagctattgcagtgtgggtacgtaatgttgcaccgaggagacagacaaataccgcgtgtttaaggaactggttcttgtttgagcaagcgaaaaaccacttgtgttgtgttgaaagggagagaagaggttgcgaatggtggtctttttgggtgtgttttgactttgatcaaacagaagcaatggttgagggaaaagaaaagttgggatga

SEQ ID NO: 22835 - DNA, 213 bp, Glycine max
  Peptide Sequence Number=SeqID_139613
atgcaacatcgatgctacaatattaatgacactggagtctttggagtggtagctgcatttgaaatcaccaaggtacgtagtttcatcattgttacaacaaagtggttctatggatcaccaacacctcaagaagggaaagcaatgatattccttacttccataaactggtcgctgtctatgcatcgacatgcaaaacattatattcgagcttga

SEQ ID NO: 22836 - DNA, 315 bp, Glycine max
  Peptide Sequence Number=SeqID_139614
atggctaacaactatgtgtttatgacttttcttatagatggggattctaatggggcaatagatcaagaggagttgaaaaagtgtttcaataagttggaaatttctttttccgaggagggaataaatgatctttttgaagcatgtgatattaaggaggatatgagaatgaagttcaatgagtttattgtacttctttgtgttgtctaccttcaactatgtgtttttgaagcatgtgatattaaggatgaccctgcaactcttcagtgttttatattgatgatactgaaagctaatgatggatggaatttggcgtaa

SEQ ID NO: 22837 - DNA, 381 bp, Glycine max
  Peptide Sequence Number=SeqID_139615
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgtgctttttagcggctatttggcattgggggtggcttgttttggttttggcgcatttcatgtaa

SEQ ID NO: 22838 - DNA, 294 bp, Glycine max
  Peptide Sequence Number=SeqID_139616
atgggctcatacttagctcatgggcccgaaatctaccccaaggctcctgagaaccctagggccttttcctacatctctggtctaatctttttggagtcttctatccaatgtccttggggggtaggattgcatcatctagcttgtgataggcctttaacccctaacctatcaaagtaccccatcacctatgatggggcagggcccaagtccactccatcagctataaaaaaggagtcaagccaaggagaaaacactccgagtctcagagcactctcactactacccaaagcttga

SEQ ID NO: 22839 - DNA, 276 bp, Glycine max
  Peptide Sequence Number=SeqID_139617
atgttcgtggcatttgtcaagttaaggaggaaattcccatatgccgagaggccttataaagtgcctgttgggaaaaccggagctatattgatgtgtgtgcttccaacactgctgatatttgtggccttagctcttgcttctttcaaggtcttaattgtaagcttctcaactatgatcatagggcttgtattaaggccttgtttgaaatatatggagtggagaagatggcttagattctctattaatcctgatcttccagatatttatgctacttag

SEQ ID NO: 22840 - DNA, 432 bp, Glycine max
  Peptide Sequence Number=SeqID_139618
atggagttgcattgcatcagctgtttgtttacaacacttgaagttgaatggcttgaggccagtaagggcaaagacaataggcattcaatgcacatctttacaagggctgaagccaaaacgggtgttttagaatctttcctagttgagaacaacaatgcacggaaagtcaatgtgtggagtgatatactaaaggaaacacagtctgcaatatccttaggtgttgattcaactccgcaggtctatgctttacaaactgctcctactattcaaagggccatgatgatctatgtgaagctttcttttcctataaccgggcaaaaggaatcctctatgatgattgctagagcatttggtgcctcgaatataattgatgtggatgtacgggatgaaaagctacagaaagcaaagacattaggtattactacattgtaa

SEQ ID NO: 22841 - DNA, 375 bp, Glycine max
  Peptide Sequence Number=SeqID_139619
atgaagggagaggaagagaagagaaaagagcaatgtgaagggggagaggggaaaagagaaaagagaaaagaaagaggggaggaggaaacaaaattctacatacacatagaggctttttcaacaaagaagtgcattgcagcaattcgtatattgacatacggatcacttgtcggtactgtcaatgagtatgttagaattatcaaatgcactgcaattgaatacttagaagattttgtaaagggtgtgaatgagatatttagggatgagtacttgagaagcccaaacaacaatgacatcaatcgcctgctacaaattggagaggcacacgggtttcaagatatgttgggttctattgattgcatgcattgggaatag

SEQ ID NO: 22842 - DNA, 1749 bp, Glycine max
  Peptide Sequence Number=SeqID_139620
atggattcttgtgggaaatcgagctttttggttcctcaggagaagggttcgtgcccctcaattgggtcagtgtttgatggctatttgatcaagaattgtagtcgtttaggaaattctttcagcctgtgtggtttcaatgagaatttagatgaagagacatgttttgagatgatcaatgctttgttaggtgatttggatgattcagaggaagtggtaattgatgatgatgttcttgatcggttgccaatggatccctttggaatgaacataacggcattctcagattggattggggattttgaatggggtttccgacctgaggatgttgagtttggggtggatgagacgcatgaaaagattggtgatcatgatcatcttcactttttgggtctgagttgggcttggaatggccctgagaatttacagcctcataaggttaatgctaaggggaatgatatgtcagtttctggtgatgttttaaatggatatcaaaattttgatgtggtgtttgatgagggcattgtggtcgatggaagcacaagggggtttctgagtgttagtcatggggactatagggttcaaagcagggaagtggaggaattgcgaaactgcactgaaattgaatgtgatgctgaaggaggtgttccacatgatgctttgttttttgtgttgggttatctaggtgtcagggaccttctctctgttgaaggggtttgcagatccttgtgtgacgctgttagaggcgatcctttgttatggaggaccatgcacattgatcagccattaaatgagaggattacggatgatacactagtaaagttaaccaacagggctcaaggtactcttcaacatctggccctagtgaactgcttatggatcactgacagtggtcttcggcgagttttacaaagtaacccaagattgacgaagctaagtgtgccagattgtattagactcacaattgagggcatcttattccacctaagggctctaaaatcatctggaaaacttggtataaagcacttgcgaattggtggacttgctggtgtgtgtcatgtgactgaccagcagttcgatgagttgaaggaattactggatgcaagcaagtatttgcaacagggagaccagaagccacaattctttggagagtattcacatatcatatgtgaagatgaccgtgcaattgacatagaggtatgtccaagatgcaagaaactgagacctgtttatgattgccctgccgagagctgtcaacagaaacatcaggcttctcagctgtgtaggggttgcacaatatgcatagcacgttgcatccattgtggaagatgcattaaggactttgattatgaagagacattttgtttggacttgctttgtttgaattgttggaatcagttcctgcattgtccggagaaaggagggaaggaagctacaaagagtgcccctgatctgcatgatgatcttttgacatacattggatcagaatctgcacatttggctgtctggtttttgatgtgcaaaactgagctgagtgtgcatggtataacatttggttgtggaggtattgaatttactcaactgctgagcttgagttggataattggtgatgctgaagaagggctgttggtgcttgcggtggatcttttttctgctgttcgttgcattgaggaaaatgtagccattgagaataatttaaggtttttctgcagctgtaaaatggctaaagcaatttcaaccattctacgatga

SEQ ID NO: 22843 - DNA, 441 bp, Glycine max
  Peptide Sequence Number=SeqID_139621
gtggcatccttagaggtagaggtcgccaagtggagggttgctgctcggactctatggcaagtggaccgccctaaggtggccaatgccaccgttgcttttactaacattgtaagggcaaaccgccaactatctcctaaggttaagaagataaacctaggtggcaaagtggagagtatggcggctgagaatgacagacttgccaagagaattactgagttggagaccccgcttagggagtcgaagtccagattggaggagtccgagcagtgtgcttccaaggaaagggaggccaacaaggagcttgaagaagagctaatcatgtacaagaaggaggatgtgaaggagggtgtcttgcttgatgaggaggagattgatgcgaaggaggaggttgtgggtgaagggcagggtgttgcggagcaaggcgatgatgcttgtgtctag

SEQ ID NO: 22844 - DNA, 937 bp, Glycine max
  Peptide Sequence Number=SeqID_139622
atgggggacacatcaacaaggtcatctgccatcaactctgctacatatgatttcttgaatgatttggagcctttaggatggatgcatactcaactaaatgaacttcctcagttgatgcctcaggatctcacttcacatgccaagatcctagagaacaataaccaatgggatgaggagaagtgtattatcttcacttgcagctttacgcccgtggcatttctcttggtgttggcgttgagcaatgaagtcagagttaatggtgatggtggtggtagacaatgtgagattaatccagctctaaagccaagaccgcacaatgtctccatcttgaagtttggtgcggttggggatgtccttaacttcaaaaacagtggtgctcagttatatgtgccaccgggaacatggttgactcaaagtttcaatcttactagccatctcacacttttgttggaaaaaggagttgaagttcctgggggaagatatcagagtttgattaacggatacatgttacatgatgtggtgataacaggtaatgatggaaacattgatggcatggtattggcttggtgggaattgtttagctctcattccctgaactacagtcgtccacttctgattgaattagtggcatctgatcacgtggtagtttcaaatcttacattcttcaatgctcctgcatatagcattcacccagtttattgcaggggaattgtgcacgtagtatctgcctatggctatttgatgcttgatttgacttgttgtcagttcatctctcatgcaacaatgtctattatagcagactgttgtccaaaccttgtctgtctgaagctagaatgttgtgatatggtgactgagaattttctttatcaacttggattaaattgctcgcttctcgaagagcttgatcttactgattgctctagtgttgatggcatag

SEQ ID NO: 22845 - DNA, 177 bp, Glycine max
  Peptide Sequence Number=SeqID_139623
atggtgcatatgggagaggctcagatcatctacaatgttgcctgtgcatcagggtgtgattcctcttggatgcattcaggcaagagtgtctgtgtttgtcataactgtcggatgaggatgggagtctgtgaagggggtctcacgtttgatgctagatcgagtgctaaccatggatga

SEQ ID NO: 22846 - DNA, 506 bp, Glycine max
  Peptide Sequence Number=SeqID_139624
atgtatgtgactaggcctttgtctctgtataagaagtctgcaaatggtctcccattgcctccacctgagggtcccaattctggtattttggtgatccaagatcaagatttggagccaacctcatgttttgggttgggagaagaataccatgaggtgaaggagttgcctttccctcaaaatctaaaccttgagttgttctatagatcaggcatttcactgaacagaaccactcatcaccaccatgttgccttcattcctgttcttaaccagcccttgccttccaacaaatactatgtgataaatctcagtgggaaaaaaagaggggagccctccaaggtggataccctccaaggtttgagtagaaggtggaaagtgagtgcttcaacttcaagtgattatagcctacgacaagcatcgggtgtgagtgaagccctccgtgccatcaagccagagttcaaattctccttagcaaagaagagttcagaaagtgtagttgtaggaaaatg

SEQ ID NO: 22847 - DNA, 201 bp, Glycine max
  Peptide Sequence Number=SeqID_139625
atgaaattccttctcctcctcaattccattcgctccgaaggagtctgtggtgtgatgtcacagcaaccaccaggtggtcgtagcatccaagagaaagatcgagagttgcgacaagaggagagagaagacggaggaggaagagtagccacgttcggcgagctaatttccaccaccgcgtacggtgtggtccaagagatctga

SEQ ID NO: 22848 - DNA, 1416 bp, Glycine max
  Peptide Sequence Number=SeqID_139626
atggggtggatcgccaagctaatcgacggcagcaaggcaacagaggcactgggcgaggacgacgagacgtttgaacagtggaagctggagaagatgaagtgggctagggagatgaagattagggattatgacaaactcctccatctgaagaaagccatgagggagaggaacaaaggtgtggaagatcagtcttacaccaatgacatggattgctactactactccacctctgaattcacaccatgtaagaaacacccttcttcttcttcttcttctgttggtatatgtgcttattgtctcaaggaccgtttggtcaagcttgtgtgttctgattgtggggagcaaaggctttcttcatgtccttgctctgatgagatggcctcttcgcaccgcaactcatgcactgttgaggtggggagtgttgggagggtctcattcctcattgagaatgagaataacaatgagagtaccccagtggttcttcagcgtttgaatcacaataacaaggccgaggaggataataataatgacgaggatgaggttgtggtgctgaggaggagcagcagcagctgtgttgagatcaagaggcatcatcatggtggtgatgggttttggagaattgggaagctttttcggaagaaaaaggatcagaagggttgtcgcagaagtgttgttgggtttgacgagaggaatagtgagatgtgggtggtggatcatcaagggggggtgtctaggtcaaggtcactatgcagcttcaggggtggagggctatttggatctgaggatggtggtgattcagtgttgtcaggtgctagaagctcaatttctgcagctaggagttctggtgttaatatgttggaatctggaagaagaagtggatacagtgaagctgagccaagaaggagtggttttgatggagtagagaggagggatttcttgtttgatagttatgaaagtggaaatgatctcaaaggtggtgtgaaaaagggtggactaatggatggtggtggagatggtggtggattctacggtggggtaaataggcgtgtgttttcactcagagagagtgatttcaaaggcatggatgagtcaagctttattgacttgaagcttgattactcatcagaatcaaagcacgagttttctgctgcaaagatgagcaacaatatggggggtgatactttctcttctttcagaaatgggaatttcatgccacatgatgttggtggaggttcttatggagggttggtaggggatggagttttaaccaatggagggtcatgtagactcactgtgaatgacagaggaatcaagaggggaaggaaaagcatgaagggttggaggtggattttcagataccattcaaattggggaagctcaaggaaaagagatgaagactttatgttcaaagcatga

SEQ ID NO: 22849 - DNA, 357 bp, Glycine max
  Peptide Sequence Number=SeqID_139627
atgcggatgatacacatctcattggttcatggctcaacatgtcacacgatccaattgtgggtgacgatcaaacctcagaagtccaaaggccattacaagcaagctattgaactgaagaaaaatagttgttcgaagaacgatgccatggcatgcttgatgcatatgcaatttggaaagacaccgattgaagtttcaaaaactggcacaccatcacaaatccctcgcccaataggacaaaaggcgaccaaaaggaagagcaaggggaaaggagctacaacatcttctcaaattgtggacttaactggcatggaaaatgcaatcaaggaaaaagctcttgtcaacacaaaaatagcatag

SEQ ID NO: 22850 - DNA, 210 bp, Glycine max
  Peptide Sequence Number=SeqID_139628
atgaagtgggagcaagagagagtagggtggaatggagaagagaagcaaatcagagttaagaaagtggaagaatttaaatgcacaaatgggtggaagaaatttggatgccgtgtgtttgttgagacttttgtactaaaaacattggagggaagcatagtattaacctatgctttcaggcatcatgatcaactttggagtaaatgggaatga

SEQ ID NO: 22851 - DNA, 294 bp, Glycine max
  Peptide Sequence Number=SeqID_139629
atgtccctcagtggcatttttgtaaataacggttttgcacacattctgcacgacgctgcgaagctcaaaacctcgaaggaccttgaagcgaacatcccccgtgccatatcaacgttgtcgcagtaccgccttgccgtaggctgccccgctgtggttgtcagctgtgtcgtggttggctgtttggtgttgacgtcaattgtagtgtcgtgcgcgccccgctgtgccctgctgtggaaggtaggtgtgttgttcattagcgtatttgtacatgaaagtggagttatggggtcttag

SEQ ID NO: 22852 - DNA, 360 bp, Glycine max
  Peptide Sequence Number=SeqID_139630
aacaagaaccctttctctgaatcacgaaatgaaggagaaaaagaaccacctaaactcgacagctacgacctcatggaactcaagttcggtcgattactcggagaggaccctaagctcacccttgccaagagcaagacgcgcgtgagtgaggatgcaagaattgaaggaaaaggggtggaattcagggtggagagaagccaaaagagcagtccgcggggcgcgcacgacactacaattgacgtcaacaccaaacagccaaccacgacacagctgacaaccacagcggggcagcctacggcaaggcggtactgcgacaacgttgatatggcacgggggatgttcgcttcaaggtccttcgag

SEQ ID NO: 22853 - DNA, 141 bp, Glycine max
  Peptide Sequence Number=SeqID_139631
atgatagttacaaccactaccacaaataaggctttctgcaccggcattttgaaagttcaccttccacaagcttggcctcaccatcagcagtactgcaggcacaaggtcatatcctccagatcaagaaacttaaatgcatag

SEQ ID NO: 22854 - DNA, 201 bp, Glycine max
  Peptide Sequence Number=SeqID_139632
atggactataaagcgaagatacacaacatgagggcgaccagagccaccaataatcgcaccattaataaggagtatccaacctatgtggcatggccagcaggctctgggacaatgtcaatgttggccaggttggaagagaagaagctatggaggaggacgtcatgcatgatggcaatggagatgagggccattgagccctaa

SEQ ID NO: 22855 - DNA, 405 bp, Glycine max
  Peptide Sequence Number=SeqID_139633
atgacgatggacagagagaaggagagagagatagagctggagagtgcaatgtacacgaattgcttgttgttgggtctggatccggcgatcatcggagtcggagcctccaacgcgactcctcgggtcgggcatttccgtcactcgaaccctaaattgggggaacagcttctctacttcatcctttcctctctcagaggcccaattcaatccgcaaaagatttcgataaggtctggccgattttcgattccgcgcagtcgcgtgattttcgtaaggttgttcaggggattattagcgagcttgagtcgcagggcgcacttccgaggagcaattcgagggtttcttcacttgctacgtgctgtggacctagggaaatcatggacaattgtaatctgctgaaactttaa

SEQ ID NO: 22856 - DNA, 546 bp, Glycine max
  Peptide Sequence Number=SeqID_139634
atggacatgttaattttcctggaccatgatgatcccttattagtaaaatcttttataaacaacaaagaagtacattggttgctggtcgacattggtagctctatcgatataatgctttatgatttctttaagaatcttagaatcccacagtcagagttgcttccctacaacaaggacctcataggtttctcttggaagttgtacgtgaattttgggaaggcaccaataaccaaaaccatcattgtcaagttcattgtagtaaagctacaatcatcctgcaatgccatattggggaggccgaccttgaatacgttgagatttgttatctcaatagtttatttaaccatgaagttcttcaaagatgagatgcaagtcataacattaaatgaagatcagaagaaggcttgtgagtgctataaggagtcattaaagcaaaaagatacaaacaaaatagaagaaatggattatgagcctagggccaaaattcaatccaaggtaatgctcactgagttagatggcgtagaggatatcaagaaagggacgtga

SEQ ID NO: 22857 - DNA, 795 bp, Glycine max
  Peptide Sequence Number=SeqID_139635
atggacggtgcagacgcgtggcgcgtggccgcgtgtgccaacaccaacgtcaacagaataatgctccgctttcgcccgatcgcgccgaaaccggtcgccggaagttccgccgtctccagagccaccggcgctggcgacggaagccagagtagccacgtgtcagttctagggaagagaccgaagaggaagtacgttaggattcggaggaacggtggatacgtgcgaaagaataacggaaacagtaaccgaaaaagtaattgtaactgtaacgatgagtcttccgacgtggcggttgtgacgttgcagttgatgccggagaaggacgcgccggaaggagacgtcactctcgcgggagattcgtggtgtaagaacgttgatcttgacctaactgtggagaagattcagatcgtagagaatcggagtgttccgccgccacgcttggtggtggaggaaggcgagggtgccaagggttcagatcttgttccggcggcgaaggcggcggagtcgtgggtgacggtggagagcgtgacaggcacgtgcatgggggagggagagggagggagagggttattaagttgtacggacgaggagagggtgaagagcctagaaactgacacgtgtccggggtttgtctgtgacggaagccttagggtgcggtgggtgaatgatgcgtacaagaggatggtgctggaggggcgcaagggtgagggtgaggatatcatggtgtggctgaaggtgaaggatagtgcctgcgctgcgtggtggtgctattctcacccagcgttcacctgcggg

SEQ ID NO: 22858 - DNA, 150 bp, Glycine max
  Peptide Sequence Number=SeqID_139636
atggagaactgcaacgacagagggtggtggtgcatgtggtgcaaaagcaagtacgagttgctaaccatgaaaacaacgttcgtctcttgcaataacaacattcattattggccactgctagggtgcttttatgtgtgggtctcattataa

SEQ ID NO: 22859 - DNA, 195 bp, Glycine max
  Peptide Sequence Number=SeqID_139637
atggtagaaaacaagacagggttgaagatcaaaaagcttagatctaacaatggtggtgaatacgtagacactagatttaaaaagttttgctatgagcatgggatcagaatggaaaggaccgtgctagggcattggatagaagactccaagaagattgagccagagatgcaagagaaggccttaggattctcatga

SEQ ID NO: 22860 - DNA, 816 bp, Glycine max
  Peptide Sequence Number=SeqID_139638
atggctacagaagatgtaaaggtgaaaactgaaaagttcgatggtgcgaactttagcttttggaagatgcaaatagaagattatttgtatttgaaaaaaatggatcaacctctctcaagaaataaacctgaggaaagttggaatgctattgtcacaattatgagtagctcgtcgggaagcaataagttaaaattcaatgatgttcatgatttggttcttagtgaagaaattcgacggagagagtcggtgcaagagtgcaccaaagaatcaagaggcgagggtagaggcaatgttgcctccacctctagagaagtacatgatgctttaatatgttctttaaagagcaaggaagagtcttgggtattagactctagagcatcctttcacaccacttctcagaaagaattctttgagaattatgtccttggaaaccttggtaaattttatcttggtaatggacaatcttgtgagattgtgggtaaaggcgcaatgaagattaagttaaacaggtctatatggggattgaaaaataatagacatattctcaacttgacgaagaacttaatctctatagtccaattggccagtgatggctacacaacaatcttctatggcaatcaatggaagatttcaaaaggtgaaatggcagttgctcatggtaataagagtggaactctttgcatgacagatgaagcatgtcatttgattgcagctgttgcaacaaaaattcccaatctatggcaccagagacttgtccatatgagcgagaaagggatgaaaatcatgcacctaaagaataaattactagctctttag

SEQ ID NO: 22861 - DNA, 771 bp, Glycine max
  Peptide Sequence Number=SeqID_139639
atgatcttcaagaagcaaaggactccattgatgaagaaaatcaaaggcctacaagctccacatggacctacatcacttaacataatggtagaagcagtcaacacatcaacttacttaatgaaccgaggtccagtagtaccattggatcacaaaatactagatgaggtatacagcggaaaaaaggttgatcccaattcaaagaagtgcactttcatcagttatggtgaagatgagtttggctactgcttatgggataatgaaaataaaaagatgatctatagtagagatgtgatcttcaatgaaagagtaatgtacaaggatacgaacaacacaaacactagcaactcagaacaaagtagttcagtgtacgcagaggtggatgatgtcccaaaaacccttatgattgagacttctcagttagaggaatcaattgaatataatagccagcaacaagttgacacaccagagccacaaaaggaaggagttgactacattgaaattttttctcttgttgtgaaacttaatactattaggtctgtcttaagcattgttgccaatgaagagctctaccttgagcaattggatgtgaagactgtatttcttcatgcagacttagatgaagagatttacatgcaccaacctgaaggtttctcagaagaagggaaaaagaatatggtgtgtagattgaagaagatcttgtatggtctaaaacaagccccaagacaatggtacaagaagtttgaaagctttatgcttaagaaaaatttctag

SEQ ID NO: 22862 - DNA, 786 bp, Glycine max
  Peptide Sequence Number=SeqID_139640
atggatgtcactattgaggctaggtcgattatgggatttgatgatggtgcggatagagttgcaccaacatttaataaaagtggagggttgctttggatttggagaaaggatatcattaaggtaagtaatactttcatgggaagtggttatttagggatccaaggtgtttggaaacaaggagacatccctaatgttgtattggatgtgtatgctccttttggagacttcaatttggtgagatgtttggaggaatggagaaatggaagcaatgaagctataggagggaatgatatggattctttcaatggctttattgagaatatggaattggaagatatccctatggggagcgctgaatatgggttggatagaagcttttcagatcactgccctttgctattgatgaattctatcattgattggggccctaaaccttttagggtcctaaattgttggtttatggaaaattctttcaaggagatggtggagcaatcttggaattcttttcaggtgcaaggaagggcctcttttgtttttaaagaaaagttaaagctggtaaagaaggaattgaaaaaagtggaacaattaaaggatgagttggatgatttgaataaagaagaaatgcaaacgaggagggtttgtttgggggagttttggaagatatcaaggtttcaagcttctctcactcaacaaaaagctagggtgtcatggctcaaagagggtgatgagaaaataaattatgtcgttctaggattaaatggagaagaagaaagcaagatactatag

SEQ ID NO: 22863 - DNA, 378 bp, Glycine max
  Peptide Sequence Number=SeqID_139641
atggaaatgccttcatcttcacataatcttcatgaatgtcatgtgatcacatggtggaacacactacatgaaactccttcagattcttgtgtggatcttcacctgggatacatgttggacatcaagttgcgcagccaaactccacaagacagttcacttctgcaacacactacacaatgccactacactactactttgttctactgctactctgctctaatgctcaatccttccatgatcatcaccaatggaaaagccatgaaatttgtgctagagaaaggaaaaaacaaaagtgaaaagaggaagaagaatgaagagaaaatgagagaaaaagagaaaaaagagtttgatcctaaagcttgcacaagaagtaactaa

SEQ ID NO: 22864 - DNA, 1407 bp, Glycine max
  Peptide Sequence Number=SeqID_139642
atgggaaacgtacagcacctagctaacttcaacagtttggtgcagaagatcgagcaagtggttaaatgcatcactgattggaagaagatgattactgtggagtataacgtaaaggatgtgccttctttgacggacactttgcacttgattcctgttcttgcatactggacaatcagcacctcttggtcacttgtacctgccacattgatttccagggccctaacaagtaagggtcagttgcaattgcttggattcaggggttacagatacgacttatccaaatttgactataggcttgatttcattctcaaaaatttcaaggaccatcaagacaatgattcccaggattcaagaccatcggtgtataatggccttacaggaccacaggctgcattaggagagtttaagaataagcatgtcttactgttcatttcgggccttgaccacattgacaatgagattcagcttttaaaatcgatccatgtgaaattgaaagaggaaccaaaggagctagagaaggtattcaattacaaaggtaaccccattatcatgctcataagccctgagggtaaagtggaaaactctgatgcaaagcagattatttccaaatgggatattgatggcttccctttcagaacctctgatcaaaccagactcactcagcaatggaactggttttggaatgaaatgatcaccctcagtccaataataagagaattgatcaaaagggactcttacatcttcatctatggaggcaccaacactaagtggatccaagatttcaccacagctgtggagaaattggaaaagaatgaaactctgacccaagaggaagaaaccacaattgagtcctattcattgggaagggacaaccccaagattgttccacgcttcaggatcgccatagacaacttgcttgctagcaggaaactaacaaaaaggggtggtgaacaagtgcaagattctacaacaagagagattcagaaattgatgttcctcaaacaagatccacttggatgggccattcttacaaaagggtctcatgtgaagcttctaggtcatggtgatgctatgcttaaaactgtctcagacttttatgcttggaaagggacattgaacaatgaagtgggctttgatgtagctttcaaggactactatgagaagtttaagtttaaaagtgttcctcacaaatgtgaacatagggaatttgctaactaccccgctgacattctagctcacataccatgtccaaataagtgtggacatgaaatggaagtttcttctgttaaatacatgtgttgccttggtcgtgaaaccagtgacattgcccaagacaaatgcatgaaacaactgctacatgctcagaggtttcatttcatgcatgagacttctttaagtttggtttaa

SEQ ID NO: 22865 - DNA, 402 bp, Glycine max
  Peptide Sequence Number=SeqID_139643
atggtaattgttcccactcccaaacctctcttctataacttcgtaccccattgcccagaggctcttcgctatgcgaaggatgttttcgaggaaaaatggaacatattagaaccagcaggagcacttgcactaactggagctgaggcatactgcaagcattatgagctccagggggaaaatattgtagtaataaccagtggagcaaacatgaattttgataaacttcgggttgtaactaaacttgctaatattggtcataaacaagaggttgcgttggcaactgttatggcagaggagcttggaagtttcaaacaattttatgaattggtggggcagatgaacgtcacaaaattcaaatatagatgtaactcgaatgagaaggcagttgtcctttacaagtga

SEQ ID NO: 22866 - DNA, 1062 bp, Glycine max
  Peptide Sequence Number=SeqID_139644
atggctaatataaaaataataggaaaacgaaaacaaaattatcactcattgagattccactggcttggtaatggtaggacccagcacgtcgtgaaaggacgaaagaatcacaaacttgtagttgtggaagctgatggaaattatgttacaccatttgcggttgatgatattgacatctactctggtgagagctactcagtgctccttcgcacggaccaagatccaaacaaaaattattggctttcaattggggtgagaggaagaaagcccaatacccctcaaggcctaacgattctaaactataagcctatatctgcttcagtttttccaacttttccaccacccatcacacctctttggaatgattttgagcgtagcaaagcattcaccaagaaaatcattgccaaaatggggaccccacaacctccaaaacggtccgaccgtacaattttcctccttaacacccaaaatcgggttgatgggttcaccaaatgggccattaacaatgtgtccctaacattgccaccaaccccttacttgggttctatcaagttcaaaataaagaatgcctttgacaaaacacccccaccagttaccttcccacaagattatgacatctttaaccctcccgtgaaccctaatgcatctattggcaatggggtgtacatgttcaaccttaatgaagttgttgatgtgatcttgcaaaatgcaaaccaattatctgggagtggtagtgagattcacccttggcacttgcatgggcatgacttttggattttggggtatggagaagggaaattcaaatcaggtgatgagaagaaattcaatttgacacatgcaccgctgagaaacactgcagtaatatttccatatggttggactgctttgaggtttaaggctgataacccaggagtttgggctttccattgccacattgaaccccatttgcacatgggaatgggtgtgatttttgctgaggctgttcaaaaagttgggaaaatcccaagagatgcactaacttgcgggcttacaggaaagatgctaggaaatagacactattga

SEQ ID NO: 22867 - DNA, 357 bp, Glycine max
  Peptide Sequence Number=SeqID_139645
atggggaaggtgagaaaagagaggatgcagagtatgggagggctcagggaacggggtgtggaagtagggtttgtaccagagagagatgatgacgggtatgagagaaagaataaaatagtggaaatgagagtgcagaaggtgcagaagaagatagaagagagagattgttatttatctctgaaccgaccaacaacaacaacaatatccagcagatcactcccccaaggtagcccccacagtcacatgacatatgtcagagcaacactgggagataaatcaatccaccactgcaatgcaagccttgaggcttacctacgtcaccgtcggaaagggccgcaaaggcagagatcaagataa

SEQ ID NO: 22868 - DNA, 585 bp, Glycine max
  Peptide Sequence Number=SeqID_139646
atggttaacgagtccagaatcgtagttttaccaggactgatttgggtgtatgcgggaaaaagagaaggttttggagaggaaaaagggaaaatgaatttgagaggaagagaaagtttagacacaagtcataaatataaaaactggcctaatatgtctttatttatagctaggaacttcatatgggaagtgttccatgttcttggaatcactttcccatctagtttgtgtagtttgtacgggcttgttgtgaccctgaatgggccttccaattgggaccaagctttcccatttggagatctttcgagcttcgcctcaaaatctccacatgaggtcaccgagttggaaggcttgtggttaaacctgggatccactcgaattcatcaaagaaagaatggatcccggaccgaagaagcaatgtcactcaatccttatcagaccaactgcaatctttttctgtacgtgaggatcccatcagtgcgccttctacttctaacaagccttgtctcactccactcacttcgacacgatcaacctctttgcacctttctcacttcgtatgtgtcactcctcctctatcagcattga

SEQ ID NO: 22869 - DNA, 450 bp, Glycine max
  Peptide Sequence Number=SeqID_139647
atgggtgtcattgaattgtgcgttgaagtagatgttgctagtgcttccacgttgaatgtgaaaaattcactactatcatgtgggaataatatagctgacaatgaatcaaaagttcaaagatttacaataaatttagatgatgattcttacgatgatgattacatgatatctaattcatatgttgaggactcgttggatgaggaggaagatatcgatgatatatctgacacagatgaaaaatgtgaaagtgggactgcattttggaaatctgcttctaattatagtaacattaattggagtcatccggatgaagaagacatttgtggtttcgatatgggatcaaccttcaatattggccaagaattatttgttggcatggaatttgaaagcaaaaattcagtaaaaaaatgcactacaacaatatgttatgaaggtgcaccaaacttttaa

SEQ ID NO: 22870 - DNA, 891 bp, Glycine max
  Peptide Sequence Number=SeqID_139648
atggagaatagcccaatattactggtagatagagatcttgaaaaaacaagtgctcacatccacctagtggaaaaaggcttttgttattgttatagtagtctcatatggtttgttgagcttctatggcaactttctttgcatgctttacgagaggttcatcgacggacatttactgctgacatatcttctaacccattgcctgcgccattgactgatgtagccttctcacatgcggctactctacttccagttacaaaggcaagaatagcgcttgaaagaagaaagtttcttaaaaatgcagaaatggctgtacagcggcaggctatgtggtctaatttggctcatgaaatgactgctgaatttcgtggtttatgtgctgaagaggcttatttgcaacaagaattggaaaaactgcatgacttgaggaataaagtgaagttggaaggagagctctgggatgatcttgtatctagttcaagtcaaaattcccatttagtttcaaaggctactcggctatgggagtctttattagctcgtaaaagtcaacatgaagttcttgcatctggtcctattgaggacttgatagctcatcgagaacataggtatcgaatctctggatcatctttgcttgcagcaatggaccagagttcacaagctccttattcagatgtattatctgctcagtctggggatttgcctgcaatggataacaaagaagagaatgatggatcacatttcagcaatgagacattgacaagattggatgacagaactggaagagcccaccaaactgttgatgtagctgaggttatacggcgatggacccatgccttgcaacgtatccacaaacaatcacttcatttggtatgctctttgcaagcttttctttaa

SEQ ID NO: 22871 - DNA, 1015 bp, Glycine max
  Peptide Sequence Number=SeqID_139649
atgtcctgtacgaatgatggagagggtccagatatattacgcagtgcacaggaaggtgattcaagtggccatgctgagtctttagcagcaacccttgcagagcatcagcagcatttggctagcttccaggtgcttattaaccaactcaaggatgttgctccaaccatacagaagtccatatctgagtgtacagaaaaggttaactgtataacctccaatttacctccaacgaacagacctaatggtcggtcaacgtcacctatccagacacagagtagtgggaggatggacaatagcaatgatgatgttagcgatgtgacttctagaatatctaatattcagcttgacaaggtttctgttagtcctcccactttaaagcttcctcaattatttagcttgactccatcttctggaaaatctggaaatgtccaaaggcggcacaataatgctcctcaaaccagccaaacagagaacctctctgatagaaaatcactggatcctccttcaaataacgaagtagaaagttcagctgaagatagtgatagttgctatgtccacaatttgaagaggtcggtaagagaagcagcactgtcattgcggtcatgtaattcagaatcgtcacgggatagtcaatctgatggaagttctgagcacttctttgtccctctttcagaaactggcttttctaatttagatgcagacaaaaggggagcttcattaaggagcaaaagattatttgtatcccaaatggatgattctttgcttgagagtcatgcatctggtgggcatggggagagcaagtttgatgaatttccagatatgttgaatgatttggaaaggctttctgtctctgattacaacaatgttaatggttttctatcatatactggttcaaattcaacatctgatgctcagcggtcattttttgactttgaggattcccaggatcaagtcttctcaccacctttgctaatggactcatcacttttgacagatccatttgaagacttgctgg

SEQ ID NO: 22872 - DNA, 1812 bp, Glycine max
  Peptide Sequence Number=SeqID_139650
atgagaggtgagagaaacaggggatgggagagagttaggctcagaggtgaggcattcgagagggaaagagcgaggttcagagcgggttttcaaaagacacaaaccaggacaagggatgggcaacaacaatactataacctgacaaactggagggatcgaaatgagatatcatccttctatttcacgcgtttctccgacgacatcaccgagaaggacttgtggtgccaattcaaaaagtggggagacgtcagggaggtattcatatccaggcaaagaaataagaacggcagaaggtatgggttcgttcgtttcaaaggagtaaacgacgaacacatgttggagaggcaactggacagtattgtcattggaagaatgaagttatatgtcaatcttccacgtttcaggagacacaagggaggaaagataacttcagacgataaacagcacgagcaaaggaatatgaatgagaatgaggtttctcgtcatatccaaggaggagcaagaacaaaccaagcatcctacgcggaggtggtagcaaggaaaagacatgcagtacacagctgtgaaaggaggctatcatcagtacaccttgagccctctgcagaaattttgaagtggcttagtgacgcatgggtagggagattgacgaacccagcgacttttgacgaggtggaagatgaactgaggttggatttcggagtggatatttcaaccaagtacctgggggatgacatggtcttgctatttgggctaaacaatgcaacagcaggaaaattgattcaagaagatggccacggcaccgtccctttgttctactcgttgcaaaaatggacaccaagcctgcgtccgagctacagactagcctgggttcagtgctgggaaatctcagtcatagcatgggatgtggtgtctatcaagaagatagtgggggtaatgggagagctggtggaggttgacgatgatgccgaggaacgacggcggatggatagagcacgggtgctcgtgaaaacaccatggcaacctgacatccagcacactgtagaagttcacataggtgcagaggtgtataaggtatgcatactagaggaatgtggctacaataccgacacgtggcagcggagaagaagcagcattacgctgtcctcggaagaaatcgactccgacggaagcttcatggggtcgtcggcgtcggagaaaacacatgtgacagagttcaatggtggcacgtgggtagcggagacacagccaaacactgctggctcgcgacggaccaccaccagctcagggggtgtgggtgtcgaagaacggagctcgccgttatccaatggtccacctgaatcacaagcaccaaagggtaagggtattgacctgcagacaaaaggggcgatcctggataacaacgcagaggacgaggtaggagggtgtcaggtgtcgggagggataaggacacagcagaccaatgtagcagcaacaaagtataaccaccccacaccaacagcagctctcggacagagaagaggaaggacagggacacgtggagggggaaatgagaagcaagaagcaacaatgatatgggaactcgcaaaacaattgggggcaacgggagttgaagaccaggggaggatagcggagaaattcatgacaatggaggatagagacaggaaagaggcaaagaaagaaaccaagaaggatacaatagacaaatcaatgtgccaagcaatgtggggggatccagcagtttcatgggaggagagtaatatcaaagagtttaatgaatggattgatgaactggaggtggaggaagcaccatgg

SEQ ID NO: 22873 - DNA, 723 bp, Glycine max
  Peptide Sequence Number=SeqID_139651
atgcgaccctatggtttgcttgatattgcttctgtttcactagctaattcattgactctcttcccatacattgatgaaatatttgagaagctggactatataggcataaactactatgggcaggaagtggtttcaggtgcaggcttgaagttggtggaaaatgttgagtacagtgagtctggtcatggggtataccctgatgacttataccacatgctgcttcagtaccatgaaagatacaaacatctaaatatttccttcatcattactgaaaatggggtttcagatgagacagatttgatccgtcggccatatctcttggagcatttgcttgctatttatgctgccatgatcatgggtgtacgtgtacttggttacctgttctggactatttctaataactgggagtgggttgatggatatggtcccaagtttggacttgttgcggttgaccgggaaaataatcttgcacggatccctcgcccctcttaccatctattttctaagattgtgaatacaagcaaagttacacatgaagatcgtgaaagagcatgggacgaacttcaaagagctgcgaaagagaagaaaacaaggccattttatcgagctgtggataaacaccgtttaatgtatgcagtgtctaacaagtcttcttggctctcatcacgggtggacttgacgaacctgaacaacgaccttacattgaacgagattggtggttga

SEQ ID NO: 22874 - DNA, 1098 bp, Glycine max
  Peptide Sequence Number=SeqID_139652
atgggtattctgtccgaacgtggcagcttcagctatgtcatgttcactttggaactcgacagagatataatagggtcacgttttatggtttacaagatgcagaactcaaaacctgtgaacgcaagagcgttgaaggaacgtccaacgtgggagtcggtgtcacacctggaaacaaagagattgctatggcttattggcattacatttgcagtgatcttaactttccagtacctcgagtttccatatggaactgttctactctctctattctctgctgagaagataccaacaccaggaagtagtacattcaaggcttcagatgcaccgtctatttccgaattggttaacaatgttacgcttttcaatccagcaaactctactggtgaccatgcctttgagatagctaataaaacaaagtctggggaaaatgacaccattccaagaattggcttggtcttggaaccaggaagcacaccaaacaactctctaggattagatggctctgaccaaagttccaaaacgaaaagtattaatagatcagaaaatgtagctgaaacaccgcagggaggagatcctggaccaatcagttttaacaatactattgatttgagtttctctgcaaaccagttccaagaagacaacatttcatcaactgaacagaaatctggaagtcaatatgcttcttcgacaaatgtgagcacaaacattgtaactgcagtgttatcaaatgattcctccatatctttatttcagaaagacaacacaactaactccataaaggaagagagtattaggtcatcacaaaatgatgccaaggtaagtgtgcctaatgagaagaaagattcccatacaccaattccagaagttacaacagtatctgaaatgaacaagttattacttcaaagccataattcatatcgttctatgagaccaagctggttttcagctgttgatcaagagctactacaggccagatcagagattgaaaatgcaccaattgtaaagaaggatccaaatttttatgctcacatttatcataatgtttccatgttcaagaggtattatttgattaatccccctcctaaaagcaagttttag

SEQ ID NO: 22875 - DNA, 285 bp, Glycine max
  Peptide Sequence Number=SeqID_139653
atgaagattaaagccaacaaaacaagaaatgaattgaaagtctcggattcaaaaacttaccagttgaagaacgaagaacggatgaagaacggcgaagaacgacagaaaagcttcatgaaaatgttcacgaaaatgtctcagaagcgttacggaagcacctcggcttggattttcttcacagaaacatggttatgggaattttacggaagccctataagccttggaagccatttttttaacaaaatgggggaggaggttgcctcccagctcgcccaggcgagttag

SEQ ID NO: 22876 - DNA, 477 bp, Glycine max
  Peptide Sequence Number=SeqID_139654
atgcaatcacaaggactcacactgcctcctaaggctaaggttggtccttttgctgctcgtgtcagcacaaaggaaagttgtgtcggtccctcgaggcaagacccagaaataggtgacttagacaaatgtgggttagtttataagggcttgacgaccgtccacaatgttccattaggcaatgatcaagtgaaggtcagtattgaggaagttcgagatgctgatgctcatgttcttgtacccactcaagaggataaacaagaagttgagggaccgacaaaacctatagataggcctgatcctaatgttgatcccttgtacttgatgacattgaccatcccgcggcttttcctcaagccgttgcaggtgccatgggatgctatcgtatttggggtgtataatgataacttccccttgcatatgactgagacaagtatgcaagcggggaatgtctctgtgcatggattcctcaagccatag

SEQ ID NO: 22877 - DNA, 228 bp, Glycine max
  Peptide Sequence Number=SeqID_139655
gataaacaagaagttgagggaccgacaaaacctatagataggcctgatcctaatgttgatcccttgtacttgatgacattgaccatcccgcggcttttcctcaagccgttgcaggtgccatgggatgctatcgtatttggggtgtataatgataacttccccttgcatatgactgagacaagtatgcaagcggggaatgtctctgtgcatggattcctcaagccatag

SEQ ID NO: 22878 - DNA, 765 bp, Glycine max
  Peptide Sequence Number=SeqID_139656
atgtctttaaagttgcctcattatcctaaactagttagagtcttttacaataacttaagaattcaggatagcacactttactctgaggtgcatggtattcctattgtcattgatcaatatttgtttttctcattgactaaattacccagtcaaggtgttccttttgagggcactgtttttgatgactggaagttcgattattcgagtcatgatgctcaccgtatggtctataatgaccaggctgatatgaccggcagattgcttgtcgggtcattaacctttgattactgcatcatgcattgcatcattatcgattgggcccacttggttaagtaccatatgcataaggcattacggaccaatgcacctcttccgtatcctcagttagtcactctttttcttcgtcactttcaaattcctctagatgatgaaccttttgttcaagtcaagagatctttggcaattggtgctggagtggtaacttctttcgggtaccgtaagtatattgatggacaatggattaggaaacaagatttaccaccatcgattcctgatgagcgtactccatctcctccgccacaaagagatgcttcctctactcttatgaatgaagtcctttctgaactacgtggtcttcgagcgttcgtaggtgaccgtttggatgccatggatgctcattttgaaggcatgggtacacggattactcagcttgaagacgacatgggtttcattcgccgttgcttcgatccaccggctgccccatag

SEQ ID NO: 22879 - DNA, 225 bp, Glycine max
  Peptide Sequence Number=SeqID_139657
atggcacgtgaggttgttgatgagacaagtagtggagctctaccccaaccaaatctcatcgacatggccgcctgtatagatttgcgttgtcatgctagatctaaacttgttgcgatggatgtgcttcaaccgcggattgaaagagaacgatgtcatttggaagggctttgcacatgtgaggatgctgatgttgcgcacaggtctgaggaagatttagatttttaa

SEQ ID NO: 22880 - DNA, 252 bp, Glycine max
  Peptide Sequence Number=SeqID_139658
atgtttggcgaaggaaccgatcgggaaaataacaaaaacccatatttcccagccactggaggctccgcgctcgataacggaggacacatgaacagcgctaggcaatcaattcatggggctccgaataggatggtggaggatacacgaacaacgctaggcaatcaattcgtggggctccgaactcatggtggaggatgcatgaatgacaatcaattcatggggatctggataagatttgagggtggaggatag

SEQ ID NO: 22881 - DNA, 219 bp, Glycine max
  Peptide Sequence Number=SeqID_139659
atggcaactcacccaggcgagctgagacttagccatgaagcaactggctcgcccaagcgtgctagttacttaacatggaagtctttgggtagcctaggtgagctagaggctagcatgggcgagctaggggtcaggaaattcaatgaaaagacccttttgccctcttcttttggtgtcggaccacgtagtttgactagcaagaatcaaaaacatcaatga

SEQ ID NO: 22882 - DNA, 303 bp, Glycine max
  Peptide Sequence Number=SeqID_139660
atgaagtgggcattggtgaagggagttgtgggaccggcgaaacctgcagataggctggatcatgatgttgacgatcccctatatctgatgacattgaccatcccacaactttttttgaagcctttgcaggtgttgcaacatgcccttcgcaggcgagcgagggcgaggctcacgggtgcgcttaccaaaggaggaaagatgcgcggagtcgccaccaacgtttatttgtgggaaacgtcggaaaaaccgaaggaaaccggtcaaaatgaaaattctaagttcgggagttgtatttacgcttga

SEQ ID NO: 22883 - DNA, 258 bp, Glycine max
  Peptide Sequence Number=SeqID_139661
atgtcaggatttacacgcgattctcctcaaatttcagccagcccgcatcaattagaccttgcaccttacgcttcagagccctacaatgctcaatggaacaccctggggcttctccatgacaagcacacgttgcgttcgagtcgtattctcggggaaatggaggctttctcgttgcataattcatttcttggttggtgtttctggtttgtgccaaaggtggtgttcatcattggaagtgcggcggtgggtaaggataag

SEQ ID NO: 22884 - DNA, 456 bp, Glycine max
  Peptide Sequence Number=SeqID_139662
atgtggagtttggctgcgcaacttggtgtcaaatgtttatcctacattatgagcaaaagtaactccattggggttagctcaaaatcaggtgacttgcatccatattgtcgcaacctacccttcggcgggagggcgacgcgagactcacgggtgcgtctttcaagaaaggaaaacgcgcgaagtcgccaccaacgtttatttgaggaaaacgtcggaaaaaccggaaaaaccggaaaaagacgtggtctacgaactttaagtgtgaaaggtttgagagttgtatttacgcacggggaaggtattagcaccccacgagtccgtcacaagggacggcagcctttaatcaagtgtgcaaatgcttttgaacggtccatgttaaccgataaaagcaaaaaggaccgtttaaggcgttggaccttaaaacggtttttagtgatttttgcggacaaagcttga

SEQ ID NO: 22885 - DNA, 327 bp, Glycine max
  Peptide Sequence Number=SeqID_139663
atgttagaagtcgaaaggaagcattgttgcgcaatccgtaaagttccgcaacattctagatgtcaaagaagggattgttgcgcaatccgtaaggtttcgcgacattacggaaagaaaacaatgttttttcgaagcaggattgcttcaggaggaagcaacccagcttgcctgggcaagctgagcggcaacctcctcccttttttccctataaataggcaaaagggggttgttctaaggatccctgagccccttggctatgcatctcagctgttttgggtgaaaaaagttgttttcgtaaagaaaatccatgccaaggtgctttcgtaa

SEQ ID NO: 22886 - DNA, 420 bp, Glycine max
  Peptide Sequence Number=SeqID_139664
atgaagatcaatcacaattccttatttgaatatgcaagaacccagaaattcagggctaggagatctgaggccccacctacattagctacccctgctccccctacatcagctccttccacctctcctctccctccaccaccaacagctctagttcttccaggtcccttcgctcatagctcaaagccttccttgtctatgctgcaaagcctgcatcagggccagctcctaatcatgcagagtttgcaagatgtggtccagcagcggccagttatgagcatcgaggagtttcttcagaaggcctctatagcccaggagcctcagcaggaccaggaggacgacattctagaggcctcagagcccactccacctgagcctttcatttttgagactgatccagttattgttcaggaggatgttgca

SEQ ID NO: 22887 - DNA, 129 bp, Glycine max
  Peptide Sequence Number=SeqID_139665
atggagaagtctttcattggagcaactgcttctaaagtggcaagtagcgtgcctatgcctgacattactaaaaaggagacaagtttctcagaggctaaagcattcaagcatgttaaggttgaagattga

SEQ ID NO: 22888 - DNA, 153 bp, Glycine max
  Peptide Sequence Number=SeqID_139666
atgaatacgattaaccaagcagatagcaaagagatgaacagtgaaaaggaaagtgggggcagagtcctaggtgaaagtgaagatggtgtggttattggtggattaaaccccatatcgaggatggatatttataagcttgttccttcctactga

SEQ ID NO: 22889 - DNA, 1230 bp, Glycine max
  Peptide Sequence Number=SeqID_139667
atgtatacaaaaaagaaacaacacaacacaaaacagaacaaaactttccctgatccagaaccccatcttccccctctcatgaaaagagagagcaagtttgagagaaagcatgtacataacgctacagaattgaagcttcttctcgcaactctactcctcctttgcagtgttgcaactctccttcagttcatccctttacgtttcaccaatatctcaccctctaatctccacttgtgcatctcaagtgtatcccaacaacccccaccaccctttacatcacattctacactctcaccatcttcctcatccaatacaccactttctacaccctcttcaacccaactccttcccaatggcaccatcaagcgtgccttcatcccttacggctctgcggcctacaacttcattaccatgggagcataccgaggaggaaccaataccttcgccatcgttggtctttcttctaagcctctccatgtctatggaaaacccacctacgagtgtgagtggatccctttctcttctccaaaacccatcattacaatgggctacaagataatccccgacatttggggctatgatcatgtctacactgctgtggttgtcaactgtaccttcaaccacaccatcatcaatggtgacaacaacggtggcaagttggtgctctatgcctccacctcaggagctggtgacaccaacttcaatctcactgataggatagaggttctccaagaagcaccaaatactttagatgtttcactctttgtatcagagcctaagtatgactatttctattgtggctctcctctgtatggggacttgagccctcaaagggtaagggagtggatcacttaccatgtgtggttgtttggcccaaggtcacattttgtgatttatgatgctggtggggtgcatgaggaggtgctagaggtgctgaagccatggatggaactagggtttgtgaccttgcaagatattagggaccaagaaaggtttgatgggtatcttcataaccagttcatggtggtgaatgattgtctgcatagatacaagttcatggccaagtggatgttcttttttgatgttgatgagtacatttatgtgccacctaacaataccatcaagactgtggttgactcgctttcgaaatacgaccagttcatctttaatatgatgcctatgaacaacaagatttgcctctatgaggattatggcaaaacttgcaggtaa

SEQ ID NO: 22890 - DNA, 348 bp, Glycine max
  Peptide Sequence Number=SeqID_139668
atgccaaaaccagataaggttatgattgttgaaagagtaattgagtccttaggacttcaggcagtgagggattcccttgttgggacagtagagaagagaggtatatctagagggcaacgaaagcgtgtaaatgtagggatggagatggttatggagccttcattattaatcttagatgagcctataactagcctagacagtgcatcttccactttactacttaaagcacttcgtcgcgaagcacttgaaggtgtaaatatatgcatggtacttcgccaacctgaagtagctccatcggagtttgtaggccttggatcttcttcatcaatggagtcatttgcttcttga

SEQ ID NO: 22891 - DNA, 294 bp, Glycine max
  Peptide Sequence Number=SeqID_139669
atgaccgttttaagttcacgatcagtgacaagttcaactcctagcattaggcctcttcctctgacatcaccaattactgcagaagaaaccaagtttggttataaaattggatacactggtcacgtgatgacatttgaggttggtgcggtgcttgaggatgcaaattggcaggctccagtgtattgttttgatgagaatgacaaggaaaagaatatccccattttgggatctgctgttcgtggtggttctcttgggagtttgatgagagagatacccactggggaaactatgtaa

SEQ ID NO: 22892 - DNA, 210 bp, Glycine max
  Peptide Sequence Number=SeqID_139670
atggcttgtggcgcttccaggtatgctgatacaaatcctgaagcagaaaagaaagagtatattgatcacattgaaataattgttcagtggatgggttggaaaccattcaagattacttacacaagtgattacttccaagaattgtacgaattagcagtggagctcataaaaaagggtcatgcttatgttgatcatcaggttggtatctaa

SEQ ID NO: 22893 - DNA, 447 bp, Glycine max
  Peptide Sequence Number=SeqID_139671
atgagcaacagtacagacagtgtcatgtgctccttgtcctcaacgaaagcgacctcagaggaatattttgtaaataccttctattctcttctattatgtgatttccttaaattttcaaatatctccctctgtcaccacgatcatgtgctcgaacgcgaacaagagaagcgtattgcaggtgaggactgtgacctcctccccgaaaaccttgtggttaggctacatgtgatcgaaaaggtagcatcatcgttcgcctctacctctctctcgtttttgcctcctccacccagcgataacattggtggcaacatcacccacaacaccattgtggagataaactctcctaacctcggaaccgtgccacaacagctttattgcacttcatctgcactatcgtgcccccacaaacccaccgcacctccatggcaccaccatactgaaagctag

SEQ ID NO: 22894 - DNA, 369 bp, Glycine max
  Peptide Sequence Number=SeqID_139672
atggatatgaacttctcccaccagatctctctaattgcacaacatgatacatccagacttggattccctgccttgatcacaactctatgcaaggctagaggagtccagtcagactctagatccttggagaacttgagccctacaattaacttggaatatattaagaagaactgttggaatcttgatgatccaacagtgacatttagagggccaaggaaggccagggatgctgcactccatgctctagagcatccacagggggcagtccatcatcatgcagagcctttagggcttgggcttgccatccattatgactggccaggagcccaaccttctccttctggagggggtggggcctccgtagcctag

SEQ ID NO: 22895 - DNA, 291 bp, Glycine max
  Peptide Sequence Number=SeqID_139673
atgaatgagttttatgcgaacctctatgaccccgaggataaatcacctaagcaggtgagggtgagaggtcacttagtgaagtttgatgaagatactcttaatacatttctgaagaccccaataattttggaggagggagagaacttgtgtacatattccagatttgcactcctgaggcctgatcctcaggagttggccgctaagctttgtatcccagggaggggattcaagcttaatgctgataggcagccattgaagattctgaggaagaacatgaccactctagcttag

SEQ ID NO: 22896 - DNA, 1141 bp, Glycine max
  Peptide Sequence Number=SeqID_139674
agtagattgggaccaacacttggctgggataggaggcagaacaaccaactggtttacacgatggaaggaaggaaatgagggagttctcttctcatgtggggactacccaaacatcccgttgataggaacgaggggttgctttaactacaatcctgcacttgctataagacagttagggtacctcatgaggggagcaccgacgaaagagagcctctttcctttccttgtgagagatttcgacgcgcaaagtttcaaggttatacaaagagtccataaggcatgggaaagcccgttagggaaagataaagaatttaggggcatccgtaatggcatcatcggtggttatcatgaatggctgaaagatgaagaagttcgagctctaaaaaccgaactaggaaaagcaagacttgccaaagaaaaattcaaggctcgcaaggaagagcatggccgagacaaattccgtggagctttgtggggtagcaatagtgagctcaagcttcgaagggaagagagagaccaatcacgagcacatagcatggtcttaaaagaggagttatctgcttgctcaaggtccaagagaagcttgtctcagcgtttatgtgagacagagaccaacatgttagccatcgtcagcaagtaccaagaagaattaaatctagccaccgcacaccatcctctcccaaatgcggtaggacgagaaaggagcacactggggcacaccagcaacccccatttgggatacaaccgggtggcttacccttatggattaacacctaattacacgccaccagtcatgcgtgatgacgcgggtcatgtcccttccactgtccttgaaggggaacctcctcgacaatcggatgaggttcacgaggatcatagagagtatgcccaaggagacgtcaatttctaccacccggtccccgtcgaggggccgacacccaacatattgcctcagaccaaactcccagcacaaccaatattcttgtccacagaaggaccacccttggcggtggaagaaagaaggaaaatcgatctcatcgaagagagattgagagctgttgaaggctttggcgactatctgttcgcggacatggtggatctttgcttggtaccgaacgttgtcatccccccaaaattcaag

SEQ ID NO: 22897 - DNA, 324 bp, Glycine max
  Peptide Sequence Number=SeqID_139675
atggatatgggtccaacattgagtaccaagtctatggaaaactttatatctctctcaagtggtaaatcggatatatccttaaggaacacatcaggaaattctctgaccacagggaggtcacccatggaaacctttgtctctacttctagagcatattttacaaaacaccttctgtccctttttctttttctgatgcccaagaaccctaacaaagcaaccggaggaggaactctagagagcaccagaaacgtcacaattgctaatggagaacatttgagcgactatatcgaggtaagggatgagttactcacacttgaggattag

SEQ ID NO: 22898 - DNA, 258 bp, Glycine max
  Peptide Sequence Number=SeqID_139676
atggaatactttggaaatcaagtcaagttgaagcagcaactattaactattatcaagcagaacatagagctcaagtatacttttaatcaagcattagcaagcaaaagcatgctacaacaacaccataaagaaggcctcaaactgggagaggagcatgagctaccctctaggttcatctgtgtggccatgtccctccttgaaagagcaggagatacattggtgtctgcatctttgaaaccatcaaactttcccctataa

SEQ ID NO: 22899 - DNA, 726 bp, Glycine max
  Peptide Sequence Number=SeqID_139677
atggataatgcagatattggacaactaatgaagaaagcacaatcaattaaggccacaagaggaaaggattgcaagaaactagcaagccaagcgtccaaggtgaggaagaatgatggatccttatttgttggagcattttgccaatcaaatgttggagatgtgtcaccaaatgttctaggagcattttgcatcgacagtggaaaaccttgtgacttcaaccgttcttcatgccatggcaatgaccaactttgtgtaggcaggggacccgggtacccagacgaaatattaagcacaaagattataggtgaaaggcaattcaaaactgctgtgaaactgtttgagtctacttcagaggaactgtctgggaagattgactaccgccatgtgtacctgaacttcacagacattgaagttgaattggacagcaacaaggtggttaaaacatgccctgcagcacttggtcctggttttgcagcaggcactacagatgggccaggtctttttgggtttcaacaaggtgatacaaagatcaatccattttggaagaatgtgagagattttctgacaaaaccaagtcaatatcaagtggactgccaaaacccaaagccagttctgttgagcaccggcgaaatgttttatccttatccttgggcgccagcaattcttccaatccaaatcctaaggctgggaaagttgatcattctttctgtaccaggaggtttgtaa

SEQ ID NO: 22900 - DNA, 213 bp, Glycine max
  Peptide Sequence Number=SeqID_139678
atggaggccatgatgagcgtgaagaagataatggaagccaatgcggttgcaattgccgctaccagcattattgctaaggcaaagatttgggaagtacgggcggcccccattatgcgcaaagtcaaaacaagcacgccttcatcctttggaaagacacccgtgagcctcgccttcgctcgccagcaaaagggcacgttgcgacacagaccataa

SEQ ID NO: 22901 - DNA, 341 bp, Glycine max
  Peptide Sequence Number=SeqID_139679
gagatgtgaaggatgcaggtataaacaggagtccaagtgcatatctgcaaaaccctgcagatgagagagcaagatatcccacaaatgttgacacacaaatgacccttatgaggtttgtggatggagcaagtggtaaaaatattggagcattcagctggtttccaacacatggaacctccatgagcaatcaaaacaagcttattagcggagataacaagggtgttgctgctagactctttgaagattggtttgcttctcaaaacaattctactaacaccaattcaacagtaccaggtatcttaaaattttgggctcatttcattaacctctctcaaggttga

SEQ ID NO: 22902 - DNA, 714 bp, Glycine max
  Peptide Sequence Number=SeqID_139680
atggctggcagaaggctaagggaggcagtgaaggagacattaatatccagcagcaatggagaattcgatgatgaaacacatgtggttatagcaggactgacaaatacttactcacaatatattgctacttttgaagagtaccagcaacaacggtatgaggctgcttcaacattgtatggtcctcacacattatcagcatacatccaagaatttaagaaactagcacaagcaatggctgaaggagagaacatcactataaaaggtccttctccgccagatctctcatctgtacaaataagcttcttacttgatccccttggagaatcacctccaaaaggagtcaaatttggtgacataaaggaagacgtggcgtttcctaaaagaggctactttactaagggagatacaccaagtgctacattctggagtgccaatccaagatatgaccttctgacagaaggcacatttgctgcagtggagaggcttcaaggggaaagatggatttctgtatatgatgatgatgatttaagcttgtttttcaagtggaaagtagataatagttccttgcatgggttagctaccatagaatgggaaataccaaatgatgctgtttctggagtatacagattaaaacactttggagcaactaggaccaccattatctcccctattaattactttactggtgcttcaagtgcatttgcagtgcaatag

SEQ ID NO: 22903 - DNA, 453 bp, Glycine max
  Peptide Sequence Number=SeqID_139681
agtccaacagaggccctaggatttcccgccttgatcacgggactctgccagtcgttcggcgtccccgtcacgcctagcaagagacaggtccagggtgatgcaccacaggccgcggacgcgccgccacctcatcaggctggcccagccagattgtttgatacagagcagtatttgcggcatttggttcgccagcaggcggccaaccaccgggcacatgtacagactcatgattgtctgtatcagatgagtctcagcctgcagagtcagggctttacttcttttccgtgccctaccccggaccagtttagggcagaggtcgcgtggcctggggattggcctgaggcccaggcaggagaggcaccagcagaggctcccgaggaggcagatgaggcccgcgaggacgaagagatgacagagttacttgatttcttaggagggagcggagctgcgtga

SEQ ID NO: 22904 - DNA, 318 bp, Glycine max
  Peptide Sequence Number=SeqID_139682
atgagagaccaatatggtcatctgctccctttgtcgaagactcgatgtctattgaccccgactactttagtctccaccccaccatccagagacgacatgtccgatgacacgtggagacacctcatggttatccgcaccttcgtcaaccaaagagatgacaagtctgatgacaaacagaaacacctcatggttatctacacgttcgtcaaccagaggcaagcaagtccgttgacatgcggagacaaatcatggtcattcgcacctttgtcatccatagacaacaatcaaacatccgagtcaaaagttatggcaatttga

SEQ ID NO: 22905 - DNA, 1437 bp, Glycine max
  Peptide Sequence Number=SeqID_139683
atggcgcataggttgctgagagaccacgaggccgacggctgggagcgctcagatttccccatcatctgcgaatcctgcctcggcgacagcccctacgttcgaatgacaaaagcagagtatgacaaggagtgcaagatttgtacacggccattcactgtttttagatggagacctggtcgagatgcaagatataagaaaactgagatctgtcagacatgtagtaagttgaaaaatgtctgtcaagtgtgccttctggatcttgaatatggactaccagttcaagttcgagactcggctcttagtattgattccaatgatgccattccaaagagtgatgttaatagggagtattttgctgaagagcatgaccgtaaggctagagctggtatagattatgaatcctcttatggtaaagtacgcccaaatgatactatcctgaagcttcaaaggacaactccatattacaaaagaaatcgagcgcatatttgcagtttctacataaggggtgaatgtactagaggagctgagtgcccttatagacatgagatgccagtaactggggaattgtctcaacaaaatattaaagatcgttattatggggtgaatgatccagtggctttgaagctacttggcaaggcaggagagatgtccactctggaggctcctgaggatgagagcattaaaactctttatgttggtggacttgatgctagggtcactgagcaggatttgcgggatcacttctatgcccatggagaaattgaatccatcaaaatggttctccaacgggcttgtgcttttgtaacatatacaaccagagaaggtgcagaaaaggcagcagaagaactctccaacaaattggttattaagggcctaaggctaaagctgatgtggggcaggcctcagacaacgaaacccgagtctgacggttctgatcaagcaaggcagcaggcatctgtagctcatagtggattgttgcctcgggcagttatatcacagaagcaaagccaggaccaaacccaaggaatgctttactataacaatctaccacctcctcagcaggaaagaagctactacccatcaatggatcctcgaagaatgggagctcttgtttcatcccaagatgctcctggtgggccttctgggtcagaggagaacaaccccggtttggagaagcagcaaatgcaacattatgcccatccaatgatgcctcctccacctggtcaatatcatcagtattatccaccatatggttatatgccaccacctccgccttatcatcaatacccacaacctccatacaatgctgcagcggctccatcccagccacctgctgcggctccatcccagccaccagctgcaaatcatccttatccacattctatgcagccagcatttggtaaagatgttcaattaattttatataccatcaagtag

SEQ ID NO: 22906 - DNA, 120 bp, Glycine max
  Peptide Sequence Number=SeqID_139684
atgggtgctagtaaaaaggagctaattttttggagtgccaaagtggttgtcgcgctaagcgaactcagtgggcttagtgcgtatccatcgctaagcacagcttcagcacgcttagcatga

SEQ ID NO: 22907 - DNA, 600 bp, Glycine max
  Peptide Sequence Number=SeqID_139685
atggctcagaattatgtaattgttgcattgggtttggtggtgtatgcttggacatggatgcaaggtgcacatggtgagtacttgattggggttgggagttatgacatgactggtccagctgctgatgtgaacatgatgggttatgccaaccctttacagaacactgctggtattcatttccggctaagagctagaactttcattgtggccgagagccttcaaggccctaggtttgtttttgtcaaccttgacgctggaatggcatcccagcttcttactataaaggtgcttgaaagacttaattcaaggtttggaaatttgtatactgaagaaaatgtagcaatcagtgggactcatacacatgctggtcctggcggttacctgcaatatgtggtttactctgtgacttctctgggttttgtgaaacaatcctttgatgccattgcgaatgcaatagaacaaagcattattcaagctcacaacaacctcaagcctggttccatttttatgaatacaggtaacatgtctgtgtctccatgctatatgaactcaacgtcttacctaggaagactttggtacttgttattttgccatggataa

SEQ ID NO: 22908 - DNA, 759 bp, Glycine max
  Peptide Sequence Number=SeqID_139686
atggttctgatggccaattttgctacaataaacaataatggcatcactgttttagtggatgatgcggaaaagggtagtgacattgatccacaacaagcactagaaactcttcatttccttacaatagttgatcataaatgcctctctagcttcaaaatcattcacctgccacctacctttcagtcttcacatgccacaatgaatgctccacactccctaagccactcaactagccgccagttacaacgcttcggaaaagctagtcatcatgtttttattaactgctacctcaatccaattgcacatgccaaaatcaaacttttcggtgatactccgtttccggtgttcaacacaatactgttgcttatcgaaaacacttcttctcctcgccattaccaacatgagctcacaatcatcaactgcttccagcactataagtccttcataaggcatacacttatcagatcacccatcatctacaagtttgttgttgcgttccacaacgacaaggacgtcattgaaatactgtccttttaccaccgacagtggacaccacactatccgcaatttgtccacttcaaatacaatggaggcactcaccaaatcaaagtcaggcaacaccacgacaaatttttctttgctaatggactcaaggactttagaatggacttaaatatttatgaatccactaccatcaattgttatgcttgcgaccaaaactggatatttaacttgcacttcaccccaaccctagaatag

SEQ ID NO: 22909 - DNA, 2733 bp, Glycine max
  Peptide Sequence Number=SeqID_139687
atggatgagcagaatatgataagggctgttgcttcttcctctaactcttcttctatggtatcttctaaaaaatatgatgtttttctaagctttcgaggcgaggacactcgtaagaacttcacaagccatctttatgaagctttgaagcaaaagaagattgaaacctatatagactaccgccttgaaaagggagatgaaatctcggcagcgctcatcaaagccatcgaagattctcatgtatctgttgtcatcttctcagagaactatgcttcctcaaagtggtgcttgggtgaactgggcaagattatggaatgcaagaaagaaagaggacagattgtgataccagtattctataatattgatccatcccatgtgaggaagcaaactgggagctacgagcaatcctttgcgaaacatacgggagaacccaggtgcagcaaatggaaagctgctctcactgaagcagccaatttagctgcatgggactctcaaatttacaggactgaatctgaattccttaaggatattgttaaagatgttttgcgaaaattggctcctagatacccaaaccaccggaaagaactggtaggagttgaggaaaactatgaaaagatcgagtcattactaaaaattgggtcaagcaaagttagaattctgggaatatggggcatgggtggaataggtaagaccaccctcgctagtgctttatatgacaaattgtctcctgaatttgaaggttgttgcttcctcgcaaatgtaagggaagaatcagacaagcatggatttaaagctttacgtaataaacttttttctgagttgttagagaatgaaaatctttgttttgatgcatcatcctttttagtgtcccattttgttttgagtaggcttggacgcaaaaaagttttcatagtcttggatgatgtggatacctcagagcaactagaaaatctaattgaagattttgatttcttgggacttggaagtagagtcattgttacaacaagaaataagcaaatatttagccaagttgataaaatatataaggtcaaggaattgagcattcatcactctcttaagcttttctgcttatctgtatttcgagaaaaacaacctaaacatggatatgaagatctatcaagaagtgcaatttcctattgcaaaggtattcctttggctttaaaagttcttggtgcaagtcttcgttcaagaagtaaacaagcatgggagtgtgaattgagaaaactccaaaagtttccaaatatggaaattcataatgtattaaaattaagttatgatggcttagattattctcaaaaggagatatttctagacattgcatgcttcttaagaggaaaacaaagagaccatgtaacaagcatattggaagcttttgattttcctgcagcatcagggatagaagttcttttggataaagctctcataacaatttcaggtggcattcaaatagaaatgcatgacttgatacaggaaatgggttggaaaattgttcatcaggaacatatcaaagatcctggaagacgaagtcggttatggaaacatgaggaagtgcatgatgtcttgaaatataataagggaactgaagttgttgaaggcgtaattttagatttgtctaaattaaccgaggatctatacttgagctttgatttccttgcaaagatgactaacgtgaggtttcttaaaatccatagttggtccaagtttaccatatttaatgtataccttcctaatggtcttgactcattgtcttataaactgaggtaccttcactgggatggattctgtcttgagtctttgccatctaggttttgtgctgaacagcttgtagaactttgcatgcattgtagcaagcttaaaaagctttgggatggggttcagaatcttgtgaatttgaagacaattgacctttggggatcccgagacctggttgagatccctgacttatccaaggcagaaaaacttgaaagtgtttctctttgttattgtgaaagcctatgccagctccaagttcattcaaaatctcttggtgtacttaacctctatggttgttcatcacttagggaattcttagtgacatcagaggaattgacagaactgaacttggcttttactgctatatgtgcattgccatcatcaatttggcaaaaaagaaaactcagatctctttacctaagaggttgtcacaatctcaacaagttatcagatgaacccagattttgtggttcttacaagcactccatcacaacattggcctctaatgttaagagattgcctgtgaacattgaaaatctttcgatgatgacaatgatttggttagatgattgcaggaaactcgtgtctttgccggagcttccgctgttccttgaaaagttaagtgcctgcaactgcacttctttggacacaaagatcactcagcagcaagtgttacaacacatgttacggagtcgcataccctacttacgcaaacactatcttaagtgttatgatgaagaatatttcttcccgggggatcatgtgattgatgagtgtaggtttcacacgacacagaattcaataaccattccttatcttcagaaacctgaattgtgtggtttcatttattgcatcattctctctatgggaccactcttagagtgtgatgtttcctgctctgtctatcaagatggcataagggttggctggctcgaaaaggttgttggaattacgaaaatttga

SEQ ID NO: 22910 - DNA, 207 bp, Glycine max
  Peptide Sequence Number=SeqID_139688
atggttggatggaatgatcgtgcaatagtagatgctctccaagacttagctcaggctatggggaatcagaataggggagatgctactggagctgctgagtatcaacggggtagaaggttgcttttggtacatatactctggtggaagaagctgagtattggtgggagagcacttgccaatgcttggaggctgaaggtcaagttgtga

SEQ ID NO: 22911 - DNA, 219 bp, Glycine max
  Peptide Sequence Number=SeqID_139689
atggctaatcttataactcatgacaaggcattgaaactcatggtgaaaaagaggcgaagttatgaagtgctaaaagtgacagttgagcttagctcatcaattttacagcacaccatagtgcctatttcgggaaaagagctctggaggcagcaagaggagcaacttttgcagagatacctaggttttgtaatctcattatcattagggtttcttctataa

SEQ ID NO: 22912 - DNA, 256 bp, Glycine max
  Peptide Sequence Number=SeqID_139690
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggagcgcccccggcggccctcgcacatccggaggaccgagtgcctcccacgcccg

SEQ ID NO: 22913 - DNA, 353 bp, Glycine max
  Peptide Sequence Number=SeqID_139691
atgtccttcggtctaaagaatgtcagagcaacctatcgaaggttgatggacaaagtgttttgggcccaaattagtataaactttgaggcatatgttgatgacatggtcgtcaaatcagaaaacattgtgttgcatgttaaagacctaatggagatattcagccatctccaaaaaacacaacatacgccaaaacccggagaaatgtgtatccactctcacccatacaaccaacattttttagatagaaccaatgatgtggttcgactatcgaagatggaatggaaaggctatgatattgccaaggataaggatggacatgatgaacaagagaagttatggtgtattattcatat

SEQ ID NO: 22914 - DNA, 991 bp, Glycine max
  Peptide Sequence Number=SeqID_139692
tgaagaaacaaacttggagaaaaagacaatcaaaggtcatgcacaaggggtggagaaaaaagagagaggggtgcaatacgagtgcacatttgagttgccatcagatttcgggaatgtgggtgctgttctggttcagcatgagcatcacaaggagatgtttctaaggagtattgtccttcatgatgtcccttatggcccagtacacttcacctgcaactcatgggttcagcccaagcatgattgtcctgtcaagagagtcttcttcagtgacaagtcttatttgccatcacaaacaccatgtgggttgagaagacttagagaagtggagctaatgctattgagaggaaatggagaaggagaacgtaagagttatgaaagaatctatgattatgatgtttacaatgatcttggagatcctgatttcagcattgatctcaaaagaccaattcttgggtgcagtgaacatccatatccaagacgttgtcgtactggacgagagcactcaattgcagatgaggaatttgctagggagactttgtcaggtgtcaacccgtatagcatccaattggtcaaggaatggcctttgagaagtaaacttgatcccgaaatctatggtccaccagaatcagccatcactagggaaatcattgagtcacagataattggttatcgtacagttgaagaggccattgtagagaaaaagttgttcatgctagactaccatgatttattcttaccatatgtgagcaaagtgagagaaattaagggaacaacattatatggttctcgtacactgttctttctcaccaaacaaggcacattgaagccactagctattgagctaactcgaccaattatggatgggaagccacaatggaagcaagtcttcacacctgcatctcattcaactgatctctggctttggaggcttgccaaagctcatgttcttgcccatgattctggttatcatgaacttgtaaaccattggtga

SEQ ID NO: 22915 - DNA, 1012 bp, Glycine max
  Peptide Sequence Number=SeqID_139693
cgccggtctccactcgcgcctgctggtattagaagacaagcagaccgcaccggcagcgggcgccagcgccaccacccagctgcatattctgtttggttcccagaccggtaacgccgaagcgctggcgcagaccgcagccaaggcggcgcgcgctaaaggcctggtgccggtagtgcaggcgctgggtgaagtggatctggatgtgttcgccaccatgcgtcatgtactgattgtcacctccacctacggcgaaggcgaaatgccggataacgcacagctgttctggcaggccatctcagccagcaccgcgccgcgtctggagcagatgcactttgccgtgctggcaatcggcgataccggctacgacggtttctgccaggccggtaagttcattgatatgcgcctggagcagctgggggcgaaacgcgtggtggatcgtatcgactgcgacatcgattacgaagagccttccagcgagtggattggcagcgccatgccacagtttgccgccagcgcgggcagcagcggcacggtgctggagagcgcgccggaagcgccggtgatcccgggcagcaacaagcaaaacccgtacgcggcggcgctggtgaccaataagcgtctgtccggcgagcagtccgccaaagatatccgtcacttcgaatttgacctgagcgacagcggcctgaaatacgaagccggtgatgcgctgggcgtgatcccggtgaacgatgccggtctggtgagcctgctgctgagcgagctgaaagccgactacgaaaccccggtgccgggctttgaccgtaacctcggcgatctgctgacctatcagttcgagatttctgagccgtcgcgcaagctgattgagtgggtcggacagcacaccaccaaccaggagctgctgcacgtcctgcagcacgacgataaagacacgctggctaactggctgtggggcaaagatacgctggatctgctgcagctcgaactgaagcgtaatctgtcggtgccggagctg

SEQ ID NO: 22916 - DNA, 576 bp, Glycine max
  Peptide Sequence Number=SeqID_139694
atggttacttatggtatggtgatattcgggtattaccaaatgattgtgttaaccatttttagcaacacaaagggtccatcaaaggaaagaaggcaagtttggcgtggggggctgtatgggcttcggtggtgtgagggatttggctacacagaaatgagatcagattcaatgctaagtgtgtcgatacagacagagcatggtcatgggggagtggtcactccacaaacagaaggaagcttgagggctttgttcaaatcaatcttgatgccaatagagtcaggttttcctagcaactcacacaagcaaatggggttgctatcaatcaaccctgccaactcagggcaacaccctttgtcaggctttgccaacttactcccatcctccacatatgtcaggcaatctgacatgtttgttagtgccatcaagcacccgttgctctccggggctggtgctgctgccggtgattgcgcggatgtgacacaacatactagtgcaaggactaaagtgatcacaactagcattctagtggcgacaacagtgctattggtggcaattgaagtcattttgttgttgtga

SEQ ID NO: 22917 - DNA, 1179 bp, Glycine max
  Peptide Sequence Number=SeqID_139695
atgggtcatgaacttgatgggttttattggaattaccggggcagagatggtccactagtgcacaatagcgttggggttgtgtgggttctttttgaagaagttgacgctgctgttgaaggttatttgcccaaagatcagaataagctatccattcttagcatatctgcaggattaaattataggttatattttcaaggggcaaagagtcaaacaccaatcctcaactcaaatgtaactttcatctgtaggcacccaggagaggctttaatgaatggcggttctgcatctagtaacttaagggcagctctctcccattgcgtacaacaagtgcgaagttatgattatcatcactatctttgccttctcgagctgcctccgtctatgcggaaggctgcatttgcactccgtgccttgaatgttgaaacagcgagggctatggatgttgcctcagatcccaggatcggccttatgcgccttgtttggtggcaggaagccatagacaaaatgttcgccaataaactgattgaacacccaacagcacaggccctgtcatctgtgatagctgagaccaaactcagcaagatatggttgaaacgatctgttgatgctcggatcaatgatgcaagaagagaggttactgacatgcccaaaactattggagagttggagaaatatgccgaggacactgtatcaactatgctgtacctaacacttcaagctggtggtatcaagtctaccgcagctgaccatgcagcctcacatattggcaaggctagtggcattctcttgctccttaaatcattgccctatcatgcgtctcacaaccggcatttttcttacataccaactgcaatagcatccaagcatgggctaatagttaagcagggaggtggagaagagagatgggtggattctcgcgaaggcctttgtgaagcagtttatgaaatggcatcagtagccaatgcacacttagagaaggcccggaagttaaccgaaagtgtacctcctgaggctcttccagtgctccttccagcagtgcctgctcaggttctcttggattccctaagaaaggtccaatttgatgtgtttgactcaaagctaacaagaggggtgctgggaatacctcctttgtggtaccagcttaagctcaagtggacgtcatggagaaggaaatactaa

SEQ ID NO: 22918 - DNA, 714 bp, Glycine max
  Peptide Sequence Number=SeqID_139696
gcaagggttcgaccaactgatgttccttcttcttctactccaccagctccttccacttctactactcatataccaactcctccaggcctatctgctcaggactctcaacgctttaagtccatgcttcagagtcttcatcaaggacagattttgttaatgcagagtttgcaggttgtagctcctctaggatctattctgacagtggaacaattcatagagaaggtatcctggccaggaaccctaccttctctcgagagagaaggtgggggtccaagtgctcaggtacctcggcaggtacaagatgcatcttctgaggccaccatccctgagccattcatttttgaagcagatgagacacagccagcagaccctcctacaccagtgcatgagatgccagcagacctgtctacaccattacttgatgttccagaggacccttttaaaccagtcctgggattgactaccactcctctgcccactcttgtgctacatcttacaaataaggaggacactcaggatgaggatactcagtcatgggacctgtcacaggtgtcgcaacctacccttcgacgggaaggcgacgcggggctcacgggtgcgtcttccaaggaaggaaggcgcgcagagtcgctaccaacggaaggtattagcaccccacgcgtctgtcacaagggacgacagccttcaatcaaagtgtgcatatatgacttctaa

SEQ ID NO: 22919 - DNA, 477 bp, Glycine max
  Peptide Sequence Number=SeqID_139697
atggcggtgtgtctattgcccgctaccgaccatccccaggctgctgtggtgtttcgccctgcgcctgtctggggcgcaatacttcttgatgaaagctcgattagtagggggcctgatgcccttgctggaggttacagaatgttgctaagtagcaatgtcatctatatctgtgtaagagtggtcatgttggtgcgcatgatccgcactggtctctttgcagcggcacagatgaaatctcgccccagtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcaaaggcgagggagtgtagtcctatgacgggcaggacgtgcaatcctctgaag

SEQ ID NO: 22920 - DNA, 333 bp, Glycine max
  Peptide Sequence Number=SeqID_139698
ggcagagcctcaccttgctgtaggaaggtcttcgttgctgggacgggttcaaactggactgaagggaggaggaatgaaagactccgatcttactggggattcatcactggctagggcgaatcaaagcatgggcatctgcaagttccttattccggttgttaagcggaagaagagggagaaagaatgggcacagccccacgcccgcgttttcgacccgaaaggaattgaaaatgaaacaagaatctgtgttcactatctatggagcggagtgactatccttaatctcctcttccctatctcccccttgcctttttttctttttctcgccggcag

SEQ ID NO: 22921 - DNA, 366 bp, Glycine max
  Peptide Sequence Number=SeqID_139699
atggcctctggtaatcgattaccaatggtttacatgtgcaaaagctgtgtaactcgagtttgggcactggaacccgcacgcacactacaacaacctgtggagtggatactacctacacctactccatatcggctagtggagccagttcaattgatagaggtgtcatcctctgaagaagatcttgaggaggacccagagaagttacctcctgaacctgctgtggatgatcttgacttacccgaggatgatgaggacccactccctgatgtggattctctagaggatatcatgtcagcatctcaggcagactctacagaggatagcggccctggagggacagcgaatagtaaagactcttcatcatag

SEQ ID NO: 22922 - DNA, 456 bp, Glycine max
  Peptide Sequence Number=SeqID_139700
atgtcgatctccccctgcgaaagtatcggttggtctgtgccatcccgacataggggtcgtgcccacaagacacccaatggacccggaggagcccaacagggccctggggtttccagctcgggttatgggcctctggatcacccccgcaagacacccagtggacccaaagaagtccaacagggtcttggagttgccagctctaattacgggcctctgttagttctacggagtgtctgtcgcccccagcaagtactacgcccccccaggcaggcgcagggcgagacaccacatcagcctgggaatggccggcagccggtgatagacgcaccgccaccacctccagagcccctcagctcatctacaaaggctggagtgttgcctatgacctgtggccgaccaacaggcgcaccgccaccacctctagagttcgcctcagctcatccacaaaaagtttag

SEQ ID NO: 22923 - DNA, 450 bp, Glycine max
  Peptide Sequence Number=SeqID_139701
atggataaacaacgcggttttaccatgatcgagctgatgattgttatcggtatcgtcgccatcctcagcgccattggcctgcccgcttaccaaaattatctgcaacgtgccgcgctgaccgacatgctgcaaaccatggtgccctataaaactgccgtggagctgtgcgccattgagcgcggcggaccggcgcagtgtcaggccggcgagcgcggtattcccgccgccaaaggctcacgctatgtggcgaacctgagcgtggtcaatggtgccattactctgaccggccaggaaagcctgacggggttaaccgttgcaatgttgccgatatggaatgcggcggaaggcgcactcagctggcaacgcatctgcaccagcgacaacaccagcctgcgcgacagctgtctcgagcagttccgctttgccgacaaggaagaaaacaatggataa

SEQ ID NO: 22924 - DNA, 216 bp, Glycine max
  Peptide Sequence Number=SeqID_139702
atggaggagttgacctcggagaagaagacaactgaggagaacttggcatcagcaaaggatgagattgctaacttgaagaaaaatcttaagaatatggagagtgagctacagaaaaaagagaagatcgggtctgatttgatggtcgagttggatgaggcgaaaagattgattgttctgaatcatcggaaggctttgaaaaggcccaacatcaagtga

SEQ ID NO: 22925 - DNA, 447 bp, Glycine max
  Peptide Sequence Number=SeqID_139703
atgacgttgactatcacgtatcaacgtctgagaggcaccttgaaactgcttgcattttttagcccatttgtgaaattcataaccctaaagcttggtttttggaagcacaaaccacaaacccatatcatgaaggtgtcgccgtgggtgaaggtgcatgaagagggtcaattaaagaggcagatgaagaagaggaaaagtaatgaagacaaagaattaactaagaatttggacaaagaaagaaatggagagaaaaaggtagagaaagaaaaagaaattgaaaaagagaaggcagagattgctcagaaatcgacctcgattgtattagggtatagttcaagcatcggaatgccgcatgttgattataagaaagttgtcttgcataatcacaaaggcaaactaagttggttgggtcatgctttcgttgctcctaacattgtttctctttga

SEQ ID NO: 22926 - DNA, 471 bp, Glycine max
  Peptide Sequence Number=SeqID_139704
atgacgagaagctatatatggatattgacagaggttttaagggaggaattaaagaatgcacgtctagtttctaatcctggttgttatccaacttctgttcaacttcctcatcccattcataaaggtcagcatgcttacttttcactaaacaatgcatatagttttcttagtattgagcttaaaaatattatcattgatgctaaacctgttgtgagtggagcaggatgtagtgccaaagaaaatttattgttcactgaagtaactgaaggtctcaattcttatggtgctacccaacatcgtcatgttgtctctagaatatttccattggatttaatggtgaaatctatgcaatttcaggtgaaaaagaggctaagtcatgaagtgataaaagtgacagttgagcttagctcatcagttgggctaagcacgcatccaccgctaagcgtagcttcagcgtgcttagcgcgatag

SEQ ID NO: 22927 - DNA, 399 bp, Glycine max
  Peptide Sequence Number=SeqID_139705
atgaagttcttcctccaccaacatggaagcgtcatcatcctaaggtatccaagccttcatccattctggcctcgcacggagatttttacaagattccatcaggggcctacagagaaaagttatccgtttggtattcacatcaaaccaaccaccactatcaagttcgtttcagatcaaattgctccaaggtttcctccattggaccccaggaagaagaaaggaaaggttccttctcacaccaagcatatgcctcatcctgatccaaaggataatatttcattgcatccaattccttatgattggagcaggtacttcaccaaggatgctgttaagaaaatcgttgctctgaagctagatgctgagtttgatcaaaatgacttcatactcttttatttttaa

SEQ ID NO: 22928 - DNA, 501 bp, Glycine max
  Peptide Sequence Number=SeqID_139706
atgcatcacaccaaggcacaatgggaagatgatagctcaaactgcaacaagtttgaaggcaaaagtattcattttgcaaagttatggtctcttgtggtcagaacaataagcttcttcttcatattgtcaagactttgctcaagacgaaggaacaaagaaaaagaagttgctaacccttacggttctaaagagtcatcatccaaggccattgttgttaatgagacttcaaaagaagaatctgacaatgatgaatctgatgaagaagatgatgagctaagtctgatcaccggaaagatcaagaggatttggaaaaacaagaatccctccaggttcaacaattcatccaaaagacccttctataagaaggagaaaattctagtcatcttctatgagtgcaagaagttaagacacttcaagtcaaaatgtcctgatcttgaaaagtcacaggataagaagaagaaattatttaagtccaaagaaaagatcctcacgagcacttga

SEQ ID NO: 22929 - DNA, 201 bp, Glycine max
  Peptide Sequence Number=SeqID_139707
atgtcaaagctagatgagttctttgtagagatgaaaatagaaaatatcgccaagtttattgctacgtccaatgaagaccaacttgcatccaactcaccaatggacaatcaacctaaagaagtcaaagtaccaattgggcatttgttgaggaaacatcatccagaatctcagatcattggtgatcctaaggacaaggtctag

SEQ ID NO: 22930 - DNA, 926 bp, Glycine max
  Peptide Sequence Number=SeqID_139708
atgtctgttgaaacgattactcaagccattgggtgtgagcgatatggcacaaaattcatgaatagttggggagacgaactggaagaccatatttggcactctttgtggggacctaactgggctaagaccctaaggagatatggaacattgttcaacaaggctaaaatcttccaacagattgtcaacaaagctatcattcacaagcaaggctcaaaggattttttgtctaacacccacaagtttattctgtaccatctgatggaaggcactccctttgacttgccccagattctcttcaacttctttgtaagtaaagtgatgatggacaagtgcatcgagaaagacatataccatagtgttgtcctcactaaggtatttgaagcccatggagtaataaggaagttcttgtatgagacacccatggatatgatggctcattccaacaaactccccaggtggatgattccatactttttgaacttcatcaaaagtttggactcaacattaggcgagacaaccagttggatgcagtatgggaaaaatctgcaaaagaataacaagtggattctcgtagctcccaaagaaataggtgccatgacaaatgtcaccaaaaagcttgcatcgaagaagcaaaagcctttgtcaactacagaacgcctaagggcactcagtgagactgagagtgatgataatcaagccttgatgtttacaaaacccaagtatccaaagggtgagcaatcctctactactgctaatgctaccaacaaacctccacccgtagagattccactaagaattgagtccactagagatatggacgatgaagttcaatatgaagcccctccatctcccttccaccttgatcgcttccaacatcaaggtccacttgccatcgaccccaacctcattgctgatgatatagcaag

SEQ ID NO: 22931 - DNA, 276 bp, Glycine max
  Peptide Sequence Number=SeqID_139709
atgctaaatagagaagatgtccacaaaaaccaccacacgtccatgaccaccaacccaccaccacaaacaaagaagacgcacgcgaggcgcccaaccatgagcccacgatcacgagaatggagaatggagaacatgaaggagacacaaacaaaaaaaatgcacaagcagcatgaccaccacgatgacacgtgtggccaaatgaaatccataagagtcgctgaaacgcaaaccctaatagtgtcgttgagcacgatccgcgttcaattgtggacatag

SEQ ID NO: 22932 - DNA, 105 bp, Glycine max
  Peptide Sequence Number=SeqID_139710
atgacagctgattcattagaggatatgaattctgaatctacacaaggctattctgatttgggtgatcaagccatgcaatgtaggcattgtaatgcaaaaatgtga

SEQ ID NO: 22933 - DNA, 393 bp, Glycine max
  Peptide Sequence Number=SeqID_139711
atgatagaacatgagaggaattctataaaagtgaacaaaatttgggagtcattagaaaagtataagaagaagcttgcccgtgctgaagcagtggataccatagagtattgcaatgagaagattaatgaacttgaggccagattggaatatgaggaaaagattggcaatctaagctttgataaagatgatcagttggctatagaatttgttactatagctgcaaacataagggctgcttcatttggcatccccaggggcacaagtaaaactctccacaggggccataataagtctaaacatagcaaggagactcatgcaactccaatcgttaacaatttcaaaatcttaggtgctttccttggtattcaactagcaaagaaagtatatcattaa

SEQ ID NO: 22934 - DNA, 414 bp, Glycine max
  Peptide Sequence Number=SeqID_139712
atgggatcagaaacatgctttagagaagtgagcacaaagaggaaccctgaagacatgaagcatacctcgaacccaacaacgacaatggcagcgagaatggagagtcgcgaaactagagttatggcagagaccttcaacttggcatcagagccaggttcttcgggccactgttcgcgccgccgtccaccgccacgccgccgccgtccgtcaccattttctctagcgacaacagggtttggtgcacctcgagaagcgcaacccaaccccacaactcgcatgaacaacaggtcacccacgtgccgtcacgtgcctctgccgtccatcaccaacctcgacgcgtggcggccacgcgtcgtcttcccggcaccagaatccggccagaccaatgccagtcgtctcatcggcgtgtcctga

SEQ ID NO: 22935 - DNA, 762 bp, Glycine max
  Peptide Sequence Number=SeqID_139713
atgtatggtttccttgaacctcagtgtatacacaacgcaaaggacaaacgccaagaatgtaaacaatacattcaaacatgggtcaaggaatcacaacgacaagtgtacctaggagcttatcagaatcaggcacattggcaacttattgttctatgtccacaggataatattgttgtttggttatgttccctgcgtaaaaagcctaatgttaacatcaagggtgcaattagcagtgcaatgaagacattaaccaacagtttggaaggaaagggagatcaagttgttcctcggtggattgaacgaaagagccatgttcaaaccggaggctatgagtgtgggtattatgtcatgcattggatgtggtgcatagtgagtggcagattgaataatgaatggaataggcaagatctttgtggactttgtgtagatgtcttaaagaaggtgtgggacttgtctgatcaggataatgatagcatgctttctttgaaggagttttgctttgctctgtatttgatggaaccctataaggaaggtcgtcctcttccacagtctcttccaagcaatgttttgtttgacgagacaccgatgtcaatgacaggccaaccaaaaattgcttatggaaatgcagcttggggtattggccaaggttttcagcagcaacaagggattccagttcatggaagttctgcccaagctgatggcactcaacagtccaatcagcaaaagtcaggaaaacctgtgttggaggagattcctttttga

SEQ ID NO: 22936 - DNA, 282 bp, Glycine max
  Peptide Sequence Number=SeqID_139714
atgtctcgcccaattggaccaaaagcagcaaaaaggaaaagcaaaggaaaagaatgtcctaacactctcgatttatctggcatagaatgtgtaataaaggacaaaaatatgaacacgtcaaaacttattcaattaaaggaggcacaggaaaagcgtctacaagaacaggaacgacgtatggagtatgaaatcctcatgaaggatacttccaacatgtctgaacaacaacgcaaagaccacgaaaagttttgtgaccatattaggaaaaaattaggatattaa

SEQ ID NO: 22937 - DNA, 823 bp, Glycine max
  Peptide Sequence Number=SeqID_139715
atggatccaaccatcgatttagatgaagttttagatcaaatgatagatgaggaattggaagataacaacgatgaagaaatcattaggttcatacttgagagccaacaacaactacatggcaacaccactagccgtagccaaagaagaagagtggtacatcgtaatcgtgaagaaggtcatcatcgattgttcaatgaatatttttcagaaaatcctgtgtacacagagattcaattccggagaaggttttgtatgctaagacatgtgttaatccgaattgtaaacgcactcagcaatcatgatgaatactttcaaatgagggtcgatgcactacgtcaaaaaggcttatctccattgcaaaagtgcacaactgttattcgtatattggcttatggatcacctgctgacagtgtcgatgaatacgttcgaattggtgaaaccactacagtggaatgcttggagcgatttgtattaggcatctgcaccatatttgggaatgaatacttgaggagaccaaataatgaagacatcaaacgcctactacaaatgggagcggcacgtggatttccagttttgtcaggacatgcgcccgcaatgcaattcatggtgaatagaacccaatataatatgggatactatttagcagatgacatttatccagactttgtcacgtttgtgaagaccatctcaatgccacaaggagaaaaaagaaaattatttgcacaacgacaagaatcggtaagaaaggatgtagaacgagcgtttggagtgctccaatctcgattcgcaattatacgtggtccgtcacgtttttgggatgctg

SEQ ID NO: 22938 - DNA, 273 bp, Glycine max
  Peptide Sequence Number=SeqID_139716
atggagaagagaccatggccggagacgcgacatgcaaccgtaatggagacgacagatgcgaccatggctggagacgagaccgtttttggagacccgaccatgtgcttcattgttgacgccaacgaagtaaaggtgaggccacacgaaggtgttacggtggtggccggaggtgttgacgaatgtggccatggaggagaagaagaagatacagagaaggagaggaagaagatagagaggaggagagggggaagcttctggaggtgctgctggtga

SEQ ID NO: 22939 - DNA, 264 bp, Glycine max
  Peptide Sequence Number=SeqID_139717
atggatgaaaggatcactcgtgagagcaccctctgtttcttcttcttcctcctcgtcctcttgagacttcttctgctcagtacatattggggcagtacatggctgctagtggagggcagaggctttagaattagattaacaatgcgtatgccatgggaaagctacatgcttgaagagggtgaagcttgctctaactcttgtaatctattgttggctgacatgttcactaagtccttcaaaggcttgtgtttactacatttataa

SEQ ID NO: 22940 - DNA, 402 bp, Glycine max
  Peptide Sequence Number=SeqID_139718
atgactactgtgctcaacactacacaaaaaccccacaatggaaacgcaaacgacatcgagggagaagagtgcataactcgacaatgtcgacacgctgaaggagaagaagaagaagaacaaagcaatgggccaagaagcggaggagaagacgacgctgcagaacggagctgggtggaagaagaaaaccaagaagcgctggattgctgggtgcacaggccacagggtcgcagaagaaggaagaaggttgtagaacaagaagaagaagcgcaaaagaagaaaagcctctgctgggtgcacctagcaactcccattacaacgagaagcggaatagtgagaataacaaaatctatagctaggtcactgactatccgctcaaatcgaatgacattgggagattcatag

SEQ ID NO: 22941 - DNA, 519 bp, Glycine max
  Peptide Sequence Number=SeqID_139719
atgaacctaacagtgcttgaggctataactctctaccctgcctatgccccagcatttctcaaatacaaaggaggcaccaaattaattttttatttatttattaagattgtagatgtagactttgagtgcaatggaagtctggttctcaatggtatgttctctgtgcagggtttgtatttgcatgatattttagtagagactgagaagcgtgggatatcttttgatgaactactcaccattcaagaacaagatgaatgggtatacagtgatgggaagtccacaacttgtgttgcctttatcctttcaaatacaaagaggttgaagtttttggttccattactaattccatttcaagtaaccgagctcactattcttggtgaatacaagatggaactgcctggctataacaccttggagccatatgccaacatgaatgagatgataggccttctcgatgttagatctgtcttccatcgtttctaccatttggaattatattgcctgttaaatttaacttaa

SEQ ID NO: 22942 - DNA, 1046 bp, Glycine max
  Peptide Sequence Number=SeqID_139720
ctgctcccggtatgacccaaacagttcatcttcctcccccacttcaaaccgaccctaccataagaggaaagcaaaatggtaaaccaaaaggttcaagaaatgcaaaatctgcggctcacagaccttatgccgattccactaattcgactgcggttaacaactgtcgttatgacagttccttaggactgttaaccaagaaatttgtgagcttaatccaggatgctaaggatggaaccctggatctaaatagaaccgctgaaatcttggagcttggttctatacaggctgaagttgatagtctatatgccgaggaatgcaaacttgatgattgtataaggaaaaagcaggagcttctaagaaacctggaggaaagtgaaagctctcaaaagtacctctttataaccaaggaagatattcttggccttccatgcttccagaatcaagaaattattgcaatcaaggctccaaaagctagttccatcgaggttcctgatcctgatgaggaattaggttttcggcaaaggcagtacaaaatgattgttcgaagtgccattggaccaatatatttgtacctcttgagcaaggacgaccacaagtttgaggatgatagtgccaaaccgatgaaattaacaaatccatcatggaatagtgatctctacagaaagaggggtgtgggattattagaaagccaaaatgatgaaaataatccttctgagcgtttcagtttgcagggttcacaagcatttggaattcaagaaattactcccactgattttgaaatggaagatgactattggtttcaatcagatcctggagtgagccaaacagaattgtgggttgagatggttatcataaccactattatcgctgtaaccaccaccaccataattgtctccataaccattattatcgccaccaacatgaatatcattgtcgccaccgcttgtgaccctgacgatagtgacagtcatgttgatggcgacgatagtggtcatgacaacgatcatgatgatgatgatagtggcaataggaacgagcgatcataa

SEQ ID NO: 22943 - DNA, 378 bp, Glycine max
  Peptide Sequence Number=SeqID_139721
atgtacaagaagcacaacaacccacataaatcaggaacagagggttttgttgttataaaaataagaggaggtactgaagaagaagcatactttgaacaaatccctcagcctcgtccaaagttgaacctctctgccatgaagctcttccaacgcttccgcaagatcttcatgcgcctaatgttctcggtacctaattctcgtcgctcaaaggattcgaagcacaaagttaatgaccggtttgaaccgcccaagacttcatgcagttcctactattcctctcaatcgcattacagcgaggccattgccgattgcatcgagtttttcaataagtcagcacaagatggcgttttggatggtcgaaaatctgatgttgtctga

SEQ ID NO: 22944 - DNA, 156 bp, Glycine max
  Peptide Sequence Number=SeqID_139722
atgtggctccttgtgaggtttgtgaacaagaccttcattgtcgcgcacgggaggtgttggtggagacgaaagcggaggcatgacaacaatctttttggatcgacagtgagaggtaaagcgatggttgaagaaagggtccttacccatgatgattga

SEQ ID NO: 22945 - DNA, 348 bp, Glycine max
  Peptide Sequence Number=SeqID_139723
atggagttgtgcattccttgtttgtcgtcatcaccttgtctttctcttcacattcgtggtggtgatttctcatctacattcatcttcgcctatgcgatggcactagtttcatatgatattttaaaaagtccattccaaatatttgcccactcgattgatcaaactagccatgtacaatggatggctccacctaaaggcttcttcaaatgcaataacgaggctgcatttcaaaaacaatgtgctacaactagttggggtgcttgttgtagagatgacacaagggcttttgtcttaactcttactaaatgggggaaccctgtatggagggtgaaggcatggggttgttaa

SEQ ID NO: 22946 - DNA, 162 bp, Glycine max
  Peptide Sequence Number=SeqID_139724
atgccacttgatgttgtaaggaaaataattatggacgtcatcgaaggtaatggatttgttaaatacgagtgtatgaaggttaaatgcgacaatgatttgaacaacaacaacaacaactacaactacaagaacaacaacaacaacaataataatacttgctag

SEQ ID NO: 22947 - DNA, 459 bp, Glycine max
  Peptide Sequence Number=SeqID_139725
atgttgattacagagatcaaaatgttcatgaattatacctcatcctacaaaaaaggcatggttagtaaagcaaagagagttggagatgattcatggaaaccaggaagaatcatatgccaagttgagaatgtgatcgctgctcaaacaaaatctgtgtttgaaggaggagaaatcgtaccaggcaaaagaatgcttaaacgtgtcttttggtcatttggttcatgcattaatgagtttgcaggttgcaaaccaaacctacaagttacgcatacacggagaagatgcactagcgacatcttgaggacatccgtgcgaataagcctaagtgctcaactccgactcacggctaaacacttcttctgttctcacatcatggctgcttgtaaatctgtcaatgttgaccacatgaactatgtgtccgccgctattcgccttataacacattttgcacgtctatga

SEQ ID NO: 22948 - DNA, 1236 bp, Glycine max
  Peptide Sequence Number=SeqID_139726
atgaagcatagcagtggaagaggctcaaaatggattctcattttagataccctttacccgccaaacgataggtatttttatgctagaatgggtatggagcgtgttgttgaggatcttcctacggctgtagaggaattgaacaaggagcaacaagaagcacctgttgaagaagttgttactgatgttgagggtttttcaggtgaaccccatgacacatcagttatgagagattttgaacatcacattgctctgagagtttggaatggagaggaacgtcctgagctaaagctatcttcccatggaaggaagatgactaagttcgggaggcctgctccagagattgaaggccttatggctgccagcagacgaagtcctttgatcgcattgactatcaccttggatgacatcgcgccattgctacatttgcctatcgtaggggcgttccacaactttgagcaacttcatgttgatgatgctgttgatatgttggtggaattactcgagatgaagatcgaggcatgtcactggattgtagcagcgcgagcgtatttgttgcatttgcttggatgcatactctttgctaacaagagttccacacacgtgcaagtgatattcttggatgcactgcgtgacttgatgcagagtgggacttacgctttggacgctgctgcacttgtgcacatgatctacgagcatttcctgttcgttggttccgccctagctgccaaggattatgatgagaggagactgcctgcatgtcaatggacctctagcaaggcactatccatgtcgacatattgcaggtatctagacagactgacccctgaatttggatacatccagactatttcgccacatcctactgcgtcttcggtctctgttgaagaaatggatgatagatggatgcagttcaatgactacattgcacttgtagagcaaatctgtgtagttcctgaccagtgttcgtcagattacatggattggttttacatgattttgcactcattcatgagttcggcacagccaggggattctcctagagttccgtcggttcagcaatatgacacatttgttcaaccagatgtgcatccgcaactggtggcgacaacaacacctgatgaggcagacgttgatgtgcatcatcttcgacatttggagaggctactgaacctaaggatcttgaccgaaggaatagaaacctataatgttgctgaagaatgtctagggatcacatga

SEQ ID NO: 22949 - DNA, 2178 bp, Glycine max
  Peptide Sequence Number=SeqID_139727
atgacgaaacgacacactaataaacaacaacaatctcaatcttcttcttcttcttctgggggacgcaacctaatccctcctgcgtgtggtttgaatgcgagtcgtggggaccttgagttttcggagaaatcaaagaaggagaaggtgagaagcttgagcgctgttgatgaagctttatcaatgggttgccgtgtctctcactctcataaaccaaccaagaaatttaagcttcccagaaagtttctgaaggactgcaatggcgttgatcatgcctctgttccacggaagatacgttcaggtggggattttgtatctgttgaaattacagctgtgaagaaacggggtcgcgaatccatctttggtgattctgaaaaggtgaaccataggatgaacggaatggaatctccccaaaaagatggcataaagaaatccaaaaaacaaagaaccccgggctggtccacgaggctagtctcaccggggcccatcacaaaggatgaggaagaggttgtggagactctctatgcattggctggaatgttccctgcagataatgcctccaatgctattaagagtgaacttggcagtgaatctttaccagaaaactccacggttttacaggaccaagaggagagtcagagtgctaatgttactgttgaagcctcgggagctactcaggatggaggagaaagatcacctagggggtgtaaaaaaatcagttttttgaatgaaaccaattgtcaagaacagactgattttcccgagagtgctaagttcttggtggctactcacagcactgctccaaaaacaaatctgcaggccgtgcctatgatggttaaaagtgaaagtggcggcaacgttgcattgcatgactctgaattgttgtctctggaaatgggattaaatgtgcctgcacaaccacagatttcatatatagaaaggcaatcagacgggggatttcagacggtcagaagcgttgattataagcaagaacaacaacatctaattaagtaccaaaaagaaactgaaggttcagcattgtcgccagacttgtctcggattgcatcagctgggatcactagtgcttcttatttgcagtcttcttctgctaaagctcaagattggctgaatactgctattggtatctcgaaacagaatttgatggaaagttgttcctctggtggaaagatttccgaaattattactcataaaaagtcatggaagaggtgtgcagctcatgttcacatcagtcatctcatccgtagtttagaagtgtcaaaacgacaggtgggcaaagaacatgagctttgtcctcaaacaagagtacaccaagggtcaaaatgtggggttctaacacaagcacacaacttgaattggatgagaagtggaaatagtcatgctactcgaacagtttattctgctactacgagtaattcacgtgaaaccaagaatggtattcttcagcatggcctttatcatgaaaaatctcaggctcccccaacacctggagtgtatgatcctcaaaagcaatgttccaacttcttgtccttgtcaactagaggtagtgagttaaaggtcaacgaaagttttaataaaggtgaaagtaagttggaaccatattcaaaacagcaactgccttattttcagtcactacatcagcagcagcagcagcatggcctcatgcccattcaaagttctacgtatgcctcaactttccttgatcagcttcctgttgcaggaccacaggttcgattgcagcagcctcattattatggtaccccgttacgtggaactcattatagttcgacagtttcctataaacaacagcagcaaagtttttgggcggtgcagctagcagctcaaggtgggtcttcttctatgaattgcagcattgtgagggcccaatatcctaattggcaaagtggtagacatgactcttctgtagcccaagtaatccttccccattcccctgcatctgcatctgcatccttagaaacacttggatccaaaatcacttcaatctccgagcagaacctattcagcttcgcttcatcaagatccagggcaaatgggcaaggcatttatcttgcttcgtctgtgtgtgatgaaagtaaaggtaggttccgtagtagtaatagtggtaccccatcactgcaattgttatgtgatgagcgtatttga

SEQ ID NO: 22950 - DNA, 657 bp, Glycine max
  Peptide Sequence Number=SeqID_139728
atggatgctcttgctgtgaaacaagcttgtaaatttgcaaaggagtttgctttgaagaatggtcccattattcttgaaatggacacatacagataccatggccactccatgtctgatcctggcagcacataccgtacacgtgatgagatttctggtgtgagacaggagcgtgatccaattgagagagtaagaaagctactattgactcacgagattgctactgaaaaggagctaaaggggtctgttgcatgtaagacttgtaatacagcacagaggctggaggctggtgggcattactccttgtcctttcattaccttttcaatcctctctccttgacattgagcaagggtttgggacctttaggcagtggagaaaaaccccttgaacagcctgacattgaaaaggaaataagaaaagaagttgatgaagccattgccaaagcaaagagttctgtgttcatttctgatttccaggaaagtcaaatgccagagccatctgatttatttaccaatgtatatgtaaaaggctttggtgtcgagtctgcttctagagttaaagctcatcttaaatgcaagtctaaaggaggtagaggtgaagttgtcctcaagattgatattaccaaagcttacgatggcatggattgggagcgctcctag

SEQ ID NO: 22951 - DNA, 2373 bp, Glycine max
  Peptide Sequence Number=SeqID_139729
atggctttgaatacgatgatacttcaatcatggccttttatgagccttgtttttgttttacttttgcacagtttgtcaataacaccaacctgtcattgccaaaccagcaccaattctcctactcaaaacattgaaactttctatccaaatggaacttcagccacagctccagcaacacaacaaccaccaccaccagtaccaaccggtaacatagcgcctagccgcggttcatcgaaccgtaacatagccacggcagtggctgcgactgcagctagcaccatagttgtttgtggtttaattttctttgtggttcaaaggtgcttgaggaagagaaggagaaggagagaggagataagaagtaacactgctggtggtggtggtggtggtggagatacccgagttgtgcctcagggaaatttgtttgagagaattgatgggaatgtgagagggttgattgttgatgaggatggtttggatgtgatttattggagaaagcttgaagggaagaactctaacaaggatcttctgcataaggaggttgtgaggagttctagaaacaacgaaaaagaagatgaaaaacatggtcatgatgaaaatcaagtgaagaaatcaaagtatatccaagaggttcctcttcttagagggaaatcttcaacttctcacttgaatgtatctccagaagaggatgagccttatagattttcgccacttccttctcctcctccttctgcttctgtttctgctcctaattcttccagtgttcctgcatcagtcggaattgttatcaagggtgctcagaaaccagattctccaactcaaccatcaactccacctcctccagtttcaccatcaacaccatcatcctctacttcttttgcagcggttccaaaaacgaatattcctgcgccgtcgcctccccctcctccgatcccagctagaaggaatccaacacctcctcctcctccgccatcgtcaaagccaccgcctgctcccattgaaatgcaagctattaagcaaagaaactcttcaggaaaaggcatgctggaaactagcaatgatcaagtgaaactgaagcctttgcattgggataaggtgaatactaataatgctgatcactccatggtttgggataaagttgatcgcggctctttcagagttgatcaagatcttatggaagctctcttcggttatgttgcgaccaaccgaagatctcccaaaggaaagagtcactcagccattcctagcaaggatgcttcagctcaatcagcaaaaactaatttccttcttgaccctagaaaatcacagaacattgctattgttttgaaatctcttgcagtctcacaaggcgaaattctcgatgcactcactgacggtaagggcctcaatgcagatacccttgaaaagcttgctagagtttccccaacagaagaagagcaatctcttatccttcaatacaaaggagatccagcaagacttgcagcagctgaatcattcctctttagcatccttaaagctgttccgtcggctttcaagcacttgaatgccatgctattcaggttgaattataactcggagattcaagaaatcaaggaatctctgcagaccattgaactggggtgtaacgagcttaaaagcaaaggactctttttgaagcttcttgaagcagttcttaaggcaggaaatcgaatgaatgcaggaactgcaagaggtaatgctcaagctttcaatttggcttctctaaggaagctctctgatgtcaagagcaccaacggaagaacgacattacttcactttgtggttgaagaggtagtccgtttggagggaaaacgggttgctcttaaccgcaatggcagcctgagcagtagcagcagtaggagcagcagcaacagcaatggaaactatgagaacaacattgcttcaaatgaactggtagaaagggaatatgtaacactaggattgccaattgtaggagggatcagttctgagttatccaatgttaagaaagcagcacaaatagatcataacaacttagttggttcaatctcagccctctcaacccagttagttgaaattcaacaacttgtttcctcgtgtggaaatggtgaaggaggaaattttgtgaaagaaatggatcattttcttggaaatgctgaggaagagttgaaattagtgagggagaagcaaacaagtgtgtttcagcttatcaagaaaacagcacagtactatcaaggaggatcttcaaaagagactgcagaaaacaatcttcaattgtttgtcatagtgaaggattttctgggaatggttgatcaaacttgcattgagattgcacgtgacatgcagaagaggaagcctcccaaggcactttttagatag

SEQ ID NO: 22952 - DNA, 195 bp, Glycine max
  Peptide Sequence Number=SeqID_139730
atgtccaagagttgtgtatcacagtgtgtaaaagggataaggatccctcttgtcactaagtgcatgatggatgtttgtatgttttttgtgttagaatatatgaggagtcatgagcctagttgtttggcaagtgatgaaaggttagcatatgggcgcctcataggagaagcttggagcatggagttgcatgcttag

SEQ ID NO: 22953 - DNA, 708 bp, Glycine max
  Peptide Sequence Number=SeqID_139731
atggaaaagttggatctaaaactacaaagctgccaagcaaaatccattgggactgtgatctcaattgctggagcattaattatgaccttatacaagggattgcctatgacaagtgatgtgatgccaaacaatgtttttctttcatctcaacaatccaaatggctactaggaggatttctccttgcagttggttgctttttttgttcaatctcgcttgttattcagacatggactatcaaagactaccctgaggagctaatgttgataaccattagtaccagtctctctgttatcctatctttcatagtggctttcattgcagaagaaaatcctaaggcatggacacttaaacttgatatggagttggtgtgcatactttattcagcaatttttgtgatgtctacacgaaatgtggtgaatgtatgggcgtgtcgaaagaaggggcctgtatatgttgctatgttcagtcctttagggattgtcatagcacttgccatggggattgtatttttgggagatgctttatatcttggaagtttgataggagctgctataatagctattgggttttatgctgtaacatggggccaggctcaagaggaaacaatgggttacgaaaagcatggaacttgtagcattatctcatcgccttcttctgaaacccctctattgctgaacaaaagcaaagattcaagttattttgtttga

SEQ ID NO: 22954 - DNA, 204 bp, Glycine max
  Peptide Sequence Number=SeqID_139732
atggccacatgggtgaatggttggggcaaattactaccatttctggggatgttgatggctatgctaactcaaagtggaagcatggtggtaatcaaatttgctatgactgatgggatgaacaagtcagagcttcctcttctcacagttcctgcacttggaagcttctttttgcttgcactctttgcgttagtattactcttttaa

SEQ ID NO: 22955 - DNA, 201 bp, Glycine max
  Peptide Sequence Number=SeqID_139733
atgagcttagatttagagatcctcaagcctagaggttggttccatgagcaccctgagtgtcgttgtggctctctcttcgatgtcaccacttctgtagccaccggcgacgttgctcaaggatccctctccaatgtcgtcgcttttgtagccactatcagtatcgctcaaggctctttctctctaatgtctccacttctctaa

SEQ ID NO: 22956 - DNA, 696 bp, Glycine max
  Peptide Sequence Number=SeqID_139734
atgacaaggaaacaagcaagttccacgagacgtggcggtctttcaggagtcttgcattccaaatccaaatcttctcctctactctccatatcccttgtcctatttgtagccatccttctcatcctttatgcttgtatcgggtcaggtatattgggaggaagaaaggatgtgattagcatggctgaagatgatttttcatgcacttttgaagttccaagtgcaattcctgttttgaagaatgcatatggtggcagcatgaaaaatgttttgcacgtaggccctgagagttgttcggtggtctccaaatttttaagagaaggggaaactgaagcatggggtgtggagccatatgacttagacgatgctgataggaactgcaaggctcttgtgcagaaaggcattatacgtgttgcagatataaaattccctttaccatacagggtgaagtctttttctcatgttatagtgtcagatgctttggattacctgtctccaaaatatataaacaaaactcttcctgagctagcaagggtatcttctgatggtattattattttcacaggttacccaggtcaaccgagagctaaaatagcaccattatccaaatttggccgtccacctagtcaaagggaagactatggagtgtgttggatgttaggatccaattgcaaagggaagtatggggtttctgtgtga

SEQ ID NO: 22957 - DNA, 327 bp, Glycine max
  Peptide Sequence Number=SeqID_139735
atgacgactggtgatggtcagataccaaccaccaaagatgccttggcgtttctcaaggcagtagaggacgcgtttcaagataagagggaaaagtatgattactttatggtaatcatgaaggatttcaaggctcaaagaattgatacaataggtgtcatggaaagagtggaggagctgtttaaagggcacaaagatctaattttggggtttaacaccttcttgccaaagggatataaaattatacttccattggaggatgagcaacctccccaaaagaagctcattgaattgaaagaagaagccataaattttgtgggcaagattaag

SEQ ID NO: 22958 - DNA, 1704 bp, Glycine max
  Peptide Sequence Number=SeqID_139736
atgaagagtatggaaaatgatgacactgttgaccttaataatcaaaacaacaactggttgggtttctcactctctcctcaaatgaataataataatataggagtttctacacacacacaaccttcctctgctgccgctgaagtggttcctacaagcttctaccacactactccacttagtagctatggtttctactatggacttgaagcggaaaatgttggattgtattcagctttgcctatcatgcccctcaaatctgatggctctctctatggaatggaagctgtgagcaggtcacaagcacaagcaatggctactacttcaacaccaaaactggagaacttcttaggtggggaagcaatggggacccctcatcatcactatgaatgtagtgccacagaaacaatgcctctgagcttagacagtgttttttacaaccaaccctcacgccgtgaccaaaataataaccaaacttaccaaaaccatgtccaacacattagcactcaacaacaacagcaacaagaacttcaagcatattactctaccttgagaaaccatgatatgatgttagaagggtccaagcaaagccaaacttcagaaaacaacaacaacaatcttcaggttcaaaacatgggtgatgatgctgtttctgttcctgttgctggccttaagagttggggagtgaggaacttccaagctagccatgcacatgagtcaaagatgattgttcctcatcatgtggaggaaaatggtggtgaatcagggtccattggatcaatggcttatggtgacttgcaatctttgagcttgtccatgagtcctagctctcagtctagctgcgtcacaagttcacaccgtgcttcatctgctgtcattgattctgctgccatggatacaaagaagaggggatctgaaaaagttgaccagaagcaaattgttcataggaagtccattgacacctttggacaaagaacctctcaatatagaggtgtaacacggcataggtggactgggagatatgaagctcatctttgggacaacagctgcaagaaagaggggcaaagcaggaaaggaagacaaggtacacaagaggaagcagctgaagcctatgacattgctgctataaaattccgaggagcgaatgctgtaaccaactttgacataacaagatatgatgttgagaaaatcatggcaagcagcaaccttcttagcagcgagctcgctaggcgcaaccaagagacgacggacaatggaactcagtacattgatcaaaatcacaataagccttctgcatatgaggacactcaagaagctgcaattctgatgcatcagaagagctgtgagacccaaaatgatcagtggaagatggttctctaccaacaatcctctcagcaacttgagcagaatattccaccgagaattgagagtgacagaactaaccagtccttctcagtggctttggaaaacatgtttcatcaagaagtagaggaatcaagtaaggtgagaacacatgtgtcaaatccttcttcattggccacaagtttgagcagctcaagagaatgtagccctgataggacaagcttgccaatgctctctggagtgccttcaacttcatcaaaactattggctactaatccaaataacgtgaattcttgggacccttcaccccatttgaggccagcacttactttgcctcaaatgcca

SEQ ID NO: 22959 - DNA, 141 bp, Glycine max
  Peptide Sequence Number=SeqID_139737
atgaccaatagcatcaacctcgctctatggacgattctcgccgagttgactgatagcaacaaccttgtcgaactcgaactcggaaatgcaaacctcattggtattttgcctgatgtattcgacgagtttgtatctggatga

SEQ ID NO: 22960 - DNA, 684 bp, Glycine max
  Peptide Sequence Number=SeqID_139738
atgtgtggggtagcgggtatcacaagtggtagcatagtgaatgttggtaatctggttggttatgtgtcaaccccttgggcaaggtcttattgtgcaggcaaggcttcaatgcaagccatgtcaaacagtttgcggctaaaacttaggccttttggggtgaatgtggttctagttttgcctagctctatgaggtcaaatttggggagggccaatttggaaagattaggtaattatgagtggaagctttataaggactttaaagaggtgattgaggagagagctagagcttctcaggatgacaaagctatggatggtagagtttttgctagacatgtggttagaaaagttttaggccctaaaccaccaaagaaaattgtttttttgtcacatgactggtttgtttgccttgcactcgtggtctcccctgtggatgagaaagtgatggaaattaagaagactaaagaattgaatctctcaaatgatgatgaagagattacttctcaagttgtgaacaagaataatgaaaagaaaggtgaaggtaatgctaaggatgaattagggaagcttgcacataaatatgaagaagctctcaaatttgagctgatatggaaatatttcaagatatgccttcaaacattcctaattctacatccagagatctccttaagaagaacacacaattag

SEQ ID NO: 22961 - DNA, 125 bp, Glycine max
  Peptide Sequence Number=SeqID_139739
ggtatttcatagtcaagagtaaagaactaatcccaagaggtattggaatctatatgaatagtgaagaggtgcattccaagaggtggtggatgtatcttgactcttggagaatcccactatcataa

SEQ ID NO: 22962 - DNA, 378 bp, Glycine max
  Peptide Sequence Number=SeqID_139740
atgagtgaccgcaaaattgttctagtgattggctgtgccaaaggtggcattggctatgaatactgcaaggcatttgctgagaaaaattgccacacgtatttgcctctgacgtctcgacgcggatgcaagacatgtagcacagggacattgaatgagatgccacttgatgcaattctggcttgggaaatcaacacattggggcaactaagaatggtgcagcatgcggtgcctcacatggctatgagaagaagttgtaatcctaatagaacaatcggaggagctcaagagaacaccgaaaattccaccattactaatggcagagaacgttttaacgactacatcaaggtaagagatgagttactcacacttgaagattag

SEQ ID NO: 22963 - DNA, 1806 bp, Glycine max
  Peptide Sequence Number=SeqID_139741
atgacagatagtgccttagcatatctcaccacagtcaaggatgcatttaaagatgatagagaaaaatatgataaatttctggaactcgtgaaaaatttcactgctgaaagattcaaccttgttagaggcatagaagaagtgaaggagctgcttaaagggtatagagatctaatcttgggatttaatgttttcttgccaaagggatatgaaatcaaacttccattggaggatgaacaacctccagaaaagaagcttgatgtgtttgttaaagctaaaaaacttctgcacaagattaaggctcgattccatggtcaagataatgtttacaagacatttctggccatattaaagatgcacaaagatggaaccaagtctcccactgcagcttacggggagattactgcacttcttcagcaccatgcggatcttcttaatgagttaccttttttatctcttaatacttcaagaactatctcaattcattttacttctgcacaaaattctttgtttcgtgaaaaaagctctgcagttccaatagtgcaacaaatgtgtgttctgaaggtttatctctctgcatactatgtccctttctttgatgatatagtcggtcatctagctgattttttcactcatagcgattggagtgaacgggaaaaggataatagagattattatcaagatggtattcagaagcttctatctctgaaacggacacatttttgtatggctgaagaccttatggctagatcattttgtaatgttgataaacattttggtagtgaaaggttttctttctgtgcaaaaatcaaggataaattacaaaatcctaagaattacttttcaaagcatgtggatatctacagcaaggaaaaaactactcgacaagaattgccatcatcaacaactgatttcccaagaaaattcccagatctcatgaagggatttaatgaatgtgtaacccaatgtaagaagatgaatgaggaattcagtgttggcattgtgaagaaaaaatcctcgagggatgaagaacatgtgcagaaacaaataaagttggaagactggaacagagatcgacatcatgatggtgatgatcgggtgaaagaaacagttagtgattgccggaaaagggacaaatctactgtagttgccaacaagaatgtttctggtcgtaagttgtctctatatgccagcaagaagaagaattctgcaaaatctgttagagagctggatctatctatctgtgaaaagtgcactcccagttactatcttctaccaaaagaatttcaaatcccatcttctagccggagaacaaaacttgatgcagaagtattgaatgaccattggaaatgtgttgctccaagtattaaggattattcttctaaacacatgagcaaaaatcttaatgaaatgaccttgtttgaatgtgaagatgataggattgaacttgacatgtgtttagaaactgcaaagtcaacaactaagcaagttgaagagctcatagaaaagatcaataccaatatgattgaaagagacaatccaattaacattgagaagcacttaatagctcaaaatcttaggtgcattgagcagttatatggcgaccatgggattgatgtgctggatgtgttaaggaagaatgcatctcaagttttgccagtcattttaactaggttgaagcagaaacatgaagaatgggcaagatgtcgtgctgatttaaataaactttgggctgaagtatatgctaaaaactatcataaatcacttaatcatgatcgtgttccttctactaggaaccaagagctttag

SEQ ID NO: 22964 - DNA, 183 bp, Glycine max
  Peptide Sequence Number=SeqID_139742
atggaaaaaaacgatgaaaacgctgatgaggttttcgatgaaaacaagatggcatatctccaatctacctctgcaaagacaatgcctacaagaacctcgtcattgaggcacttattgaggcagttgacaaaaggtttgatcatcatcggatcagaggtagtggagagtgagaaagaaaattaa

SEQ ID NO: 22965 - DNA, 804 bp, Glycine max
  Peptide Sequence Number=SeqID_139743
atggtgaatggggtagcagtttccatttcactatcaaagcaagcacgcccccacctctactaccacatcccaaccataggggtttacaaacctgcacagctttggcaacttgaagatcaaatgccacgacctacaaaaaggctacatggatcatctgtttacacactcaaggagatggaggaggcaacatgttcattcagtgatgagaatctgcttggtaaaggaggatttggcaaagtctaccggggaactttgcggtcaggagaggttgtagcaatcaagaaaatggagttgccagcaattaaagcagcagagggggaacgtgagtttcgtgttgaagttgacatcttgagcagacttgaccacccaaatcttgtttctttgataggctactgtgcggatggaaagcataggttcctagtatatgaatatatgcgtagagggaacctgcaagatcatttgaatggaattggggaaagaaacatggattggcctcgaagactccaagtggcactgggagctgcaaaaggacttgcttatctccattcaagttctgatgttggaattcctattgttcatagggatttcaaatcgaccaatattctcttagacgataactttgaagcaaagatatctgattttgggcttgcgaagttaatgccagaaggacaggagacacatgtgactgccagagtacttggtacctttggctattttgatccagagtatacatcggaactgactgatagatactgtggccaagagctcaacccataccatccatggacatggtctagtaactaa

SEQ ID NO: 22966 - DNA, 294 bp, Glycine max
  Peptide Sequence Number=SeqID_139744
atggatggcatcactggacagagtgtgtggaagctgagttttgctatagatatggaacgtggacccaccaccgccaaatctggatacttgcaccaatggtattggtcgattctgacttccccacaaggggactggagtgacatctccttttttggctacttccttcactcctcctccatctccaacgctgactttactgtctccactgccgcgacatcaaagaagagagaagaggttaagagagggtcatgcgagaacggtttgaaaatcaaacataaaaaaattgatttctga

SEQ ID NO: 22967 - DNA, 441 bp, Glycine max
  Peptide Sequence Number=SeqID_139745
atggcaccgtttgatctagacatgtcaatggggcgggatgggtacgggtattgtctccccaatctcttatcccgactccccaccatatccctatacccgtacccgatacctcatgggtttaagtttattgtcccattcccgtacccgtcgggtatcctcaatcccgtctcatacacgattcaaattagaaaaatatttttttatgtgaggcacatactgaatgaccgcaagaagcttcgtaaggtgatagatccagagatggctcgaaattcttacaccattcagtctatagtcatgtttgccaatctggcatcaagatgtgtccgtactgagagtaatgaaagaccttcaatggcagaatgtataaaagaactcctaatgattatctatacaaattcgaaaggcttgggaatggttatgcatagtttgagaatgatctag

SEQ ID NO: 22968 - DNA, 612 bp, Glycine max
  Peptide Sequence Number=SeqID_139746
atgtatgctccgccaggagacaatccggaaggaccattatatgcggcaaagcttaaccggcttatccctgggaggggcgggcgaggggatggaagcattggcgcctcttttgtcgaaacagagctccaccatcccagccaagcacgcttcttcttcttcttgatcagcgccggcggctgttgtttgggtgtagaatgcgacgagggtggcggtgtggggcatgagggacctgcggtcgaggaggtactgtttgacaaggaaggcgaggaatttgacgtagggttgggggaggagcatggactcggcgaaggactcggcgaggaggaggacggtggggtcggtctcgtggggccgcatgacgcggacggagagggagccggaggggaggtcagggcggtagaggaatgtctcgaggaggcggaggcggcggagctcgtcgttggagaggaagcggcccgtgtggaaggggtcgtcggaaacagtgagggaggagtgggaagaggagagtttgaaagtggagaagagtttgggggagagggagggtttggtgggggagaaggggaaggagagggtttggatttgagggtggaaggggaaggagagggaaaatag

SEQ ID NO: 22969 - DNA, 1491 bp, Glycine max
  Peptide Sequence Number=SeqID_139747
atgtatttggataaagatgatggagattatgttatgtcaaactcatttgttggggaaacatctaatgaacaagatgtaatcgatgatgatttttctgacacaaatgatgaagtaacatctattgaggcaagcaagttggataattgtgctgttgatttaagggcttgggggaaaaacctcaaattgagtttcagagctgagattgacagatgcaaaaaagatgtagaagcttttagggctagcaaggaagaggacattagggatgaagagggtattagaaggtatgaggaagctagggaggccatgggattgtggctgaacaaggaagatgcgttttggaagcagaacaaaattgataagttgttggatgataatgggggaagtcatggaatttcaagaggtgaccttgtgattaagtgtgttgaagctagagtttttgattcagataatcaagagcttactaagcccttcttgaaggaggagctcaagcatgccctgctcaatatgaattcggacaagccttcaaggcccgatggcttcaatccggtgttctataagagattttggaacttgtgtggggaaaatctagaatccatgaaaggtcttcgtcccatatctatttgcaatgtggtttataaagtccttattaagattcttgccaataggttaaagcctcttttgccaaactgcatttttgttgagcaatctgcatttgtggagaataggtcaataactgataacacgattgttgcttttgaggcgattcatcatatgaagtgcaaggtgaagggcaagcaagaagaggtggcacttaaggttgatatgagtaaggcatatgatagaattaagcattacaacttgattaagaaggaggagttgaggggagacttgcatggtattaaagtgtgcagaggggcttccagccaagccattaacttggccaaatcaaatgtttattttagtaggaacccatcccctctcatcaaggatgaagtttctagtattatgggggatagaatctgcaagaagataaaccattggttatggaagcatttatccatttctggcaaggagcaccttccccatgctcgtctccttagtcgactagatctagcgtataatgaactcattctggtggggtggcaacaatggaaagggcaagggattaactggttgaattgggataagatggcagtgagaaaagagtttgaagggatgggtttccgacacctatttggattcaatctagccattctagcgaagcaagggtggaagctgatttctaacccaaatactactattgtgagagttttcaaaaccaaatattaccctcaaggggtcttcttggaggctgctttaggccataattcaagctttgattggcgaagtatccaagcttttcacgtgttggttagcaggggtctcaagtggagaattggtgatggtaagaggatcaacattgggaaagatctttggttgcgggctccatga

SEQ ID NO: 22970 - DNA, 294 bp, Glycine max
  Peptide Sequence Number=SeqID_139748
atggtgagggcctactgctccttcgtggtgaagcggagcctatgggtggtgatggcattcatggcgcagggctccttcctgcacctcgtgaaggccgcttatctcgagggattcgaagaggccgccatcggatctatcctcagggagactctcaaggggttggagtatctccaccgacccggccacattcatcgcgacgtcaaggctgggaatattctcctcgacgataatgacaaggtcaagctcattgacttcggcgtctccgcttgcatgttcgacaccggcaaccgttag

SEQ ID NO: 22971 - DNA, 288 bp, Glycine max
  Peptide Sequence Number=SeqID_139749
atgaagaaagacaaactaattggtatgcttgatgaggtactgtgcaaagtatcatctcgggaagctcaagacaaaaatagcaaaattgatagagttggtttaaaaattgatatatcatttaatgtctataaatatttacccacgatagagttgcttctgaatcaccttccagcaatcaaaggaaggatcgtaatgaaagtctgggacatcgtagagccaaaaggagttgaagaaattctaaaaggaggtgttgtcagtgacaacgtgaaccaaacccaacaccactag

SEQ ID NO: 22972 - DNA, 159 bp, Glycine max
  Peptide Sequence Number=SeqID_139750
atgaagaagaaagaaagcaaacggaggaagcaagttggtgaggaaatgacggaaacggaggaagcagtaaatagatataagtgttggagagatggaatcatggagcatgtttacgtagtgagttcggcattgtcccatgaaataagtgaaacatactag

SEQ ID NO: 22973 - DNA, 642 bp, Glycine max
  Peptide Sequence Number=SeqID_139751
atggtgccgaagagaaagcgtttgaaggcttgcaaacttacagataaattaccgcctcttgatcttggggtgttggtttctatggtgcttagtattgtatggagtgcagggagttcttggttgggttacagtggtggattagtggtgtttcatgactggttgtcttatggtgattgggagatggtagaaagaaaaagtgatgaaagaaagaaagataatgtaataaaaatatggttttggtctttatgtggcgtgaactgtgaaggaaggaaggaaggtttgtcaagtctaggacctgctcttgttcagagtgcaacagactacttgatattatcacatgctctacatttcaaaattaatccagttttcttaatcggttggatggttacggattttctgctcacccctacgtttaacatggccatcaaatggtcattcatgcttgtcacattgaccttgtcaatagcattaggctttaccttatcatttctcatcattttctctccaaaaaaccaaaacttggaccttcattcttctccatcttgcatcagatcttcaaggaggaagagaccaccattttcatcttcttctaagatccatagtagtgtcttgagactcttctcgatctcaaaacttgggtaa

SEQ ID NO: 22974 - DNA, 3216 bp, Glycine max
  Peptide Sequence Number=SeqID_139752
atgcggggatttctgatggttatttcacttgactgcacaaaacttgaactattaggagaggaacatgacaagtcttcatcaggtaaacctaaagaaaagcctagtgtttctaaccgtaaaaagaagggacgaaatcgcaataataaaaggcaaaatcctgtctctaagacttgtgtggatgatatttcacatgaaaatccactgaaggacattgattgtaaagtggataataaaaagaagactgatttagtggcatccagtgaacttcctgctgttcatatggggaaggagatttctatggagttcccatcatcaactgatcatactcaaggattggatattggcaaaataaaagtacggaccacttcaagaagtagaaaagagaaaaataaaagtaaaaatattctcatcagtgcaggtggagattctcaaaagtcaagtatccatgctgcctctaccacagttatttctgaaggtgaggtggcaatatgtgataggtttttgaatagttctaccattcagaatgtcaaaaatgacaatgcaattggtaatgacatccttgcttcaaattcaagcctttgtagttctcttagtgggcttagtagggagaacagttctaccaggaaagttgaaggaaagactgaagatcttgctgaaagtggcaatagtttaggtcctcagtgttgtttattgtcagatgaaaggaaaactttatgttctggattagatactttaacttgtgacatagattgtactgctgctacaactcctcctgtacctgcggtgaaacaaggtagtttcttcagcaaggaagatacctgtcctttgaactcatcatgtgctgccaaagctgatttaaagaccactgttcctgacaaaccaattagagaggttaatgcaaaagaatttgggttgttgaaggagcgtgatagatgtctatttgaaagtagaaattcagctttctcaaagtgcagtccatatgagtggcctggcttaccttctatctattttccatcttttaactcacatctccctcctgccacagatagattacatctggatgttgggcacaattggcataatcacttctgccacccatttgttcccacattacagcaggcaagaaatcctcctattgaaggtgggtgcaacccaatcctgtctcgtcctattcctatgagttttgactggcccccagtttttcgtggtggcatgaccccatcaccaaactataactatgactctggttttatatctaggaagcaatgtaccttttcaaaaggattggctgttcacaacatgcaggttgatgcaactgctcctgatgatgaaagaaaatattccggggatgtatgggatttacctgatctgacaaatacattggagctagctgatgaatttgacaatcactgtgtatctgaggaagagtatgaggttcatactgtttctggtatagattataatcaatattttggtggcggtgtaatgtactggaacccttctgactatccagggaaaggtttctcccggcctccctcgcttagctctgatgacagtctatgggctttgcgtgatgctgacatgaataggacggtggatgatatggttgctttctcttcttcgtatagtacgaatggtttaacatcacccactgctgctacattttgttctcctttcgatcctgtaggaactgctacccagactattggttatgtgatgtcaggtaatgaagtacctggaaagatgctgcattcttcttcagttacagatgcagcagtggatgaagatacttctggttctttgggtaataatttgcctggagaagttgaaggaaaggcaggtgattcacatccatatcctattctacggccaataattattcctaacttgtcaagggaaaggtttgatcataaaagtccctgtgttcctccctccaggcgggagcagcctcgtataaagcggccaccatcgcctgtagtgctttgtgttccacgtgcacctcgtccacccccaccatcccctgtgagtgactccaggaaacacaggggttttcccactgttagatctggtagttccagccctaggcactggggaatgcgaggctggtatcatgatgggagtaattttgaggaagcatgtttaagaatggatggtgctgaagttgtgtggccttggagaagtaataatcttgcggtgcgacctttgattcagcctttacctgctgccttgctgcaggaccgcctgattgcattgtcacagatagcacgtgaccaggaacacccagatgtcaccttccccttgcaacctccagacttacaaagctgttctgcacagagtgcatctttaactttgatgcatggcattctacatgatgagattgactctttctgtaaacaggttgctgcagaaaatatggccaggaggccttacattaattgggctgtcaagagagttacacgatttctgcaggttctgtggcccagatcccgtacaaacatatttggttccaatgcaactggtatgtcccttccaacaagtgatgttgaccttgtggttggtctccctccagtgagaaacctggaacctattaaagaagctggaatactggaaggtcgtaatggaattaaagaaacgtgtcttcagcatgcagctaggtatcttgccaatcaggattgggtgaaaaatgattctctgaagacagtggaaaatacagctattcctattattatgcttgtggtggaagtacctcaggatgttattacctctttagctcctatgatacagtcgttaaatgaagagccacattgtactcctggagaacatggtaatgacaatcaatctgatagcattcggttagaagattcggctttgcccaaaggctcccaaatgaaatttgatgccttgaaatcgaaatcagttagactggacatcagcttcaagtccccatcacatactggactccagactacagaaatggttaaggagttgacagcgcaatttcctgctgctacacctcttgctttggtactaaaacagtttttggctgatcggagccttgatcagtcctactctggtggcttaagttcctactgtttggtcttactaattatacgatttcttcagcatgagcaccatcttggccggccaatcaaccaagtaaactttgatcgctctagttattccagtctgtatctgttgatggccatcgtggactaa

SEQ ID NO: 22975 - DNA, 129 bp, Glycine max
  Peptide Sequence Number=SeqID_139753
atgtgggaaggaattgcttccgaatacatcaatgtattaagttctcatacttggcctttgctatgccatgatgacaggaaaaagaaacctgtggttgatattatccacaagctgttaaactatctgtaa

SEQ ID NO: 22976 - DNA, 849 bp, Glycine max
  Peptide Sequence Number=SeqID_139754
atggctcaccaccaactcatcgacaccctcacctctcacatctcactctaccattcccaatccccaaaccctaaccccaaccctaaccctaaccctcgatcatccattttgaaatggttttcttctctttccattcaccaccgccaggctcatttaacaatcgtggatgcgaatttcgttcagatccttctccagatgctcgcgaagctccgatctcacggccacggctccttcatcctcctccctgatctgccctcgcgcgacaacctccccaccctctgcttcaagaagtcccgcggcctcctcgcccgcgtcgctgactcggacgccgctgggcgggccgtcttcgagtcctcccgcctgtttgactcgcgcgagggcgaggaggccgccattgccacgctgccctcggccaggcggctcgacgcgctggcgcttgccgagggcttcgtcggggacgtggacaggttcgtagaggccatggaccggatttccggcggtgggttcctccgcggggaggaggccgagctcggcgaggactgggtggagttgcattggctgaaatcgaagggatactatggaattgaggcgtttattgcgaataggatcgaggtttcaatgaggttggcgtggttgaattgctgtggagggaggaaaaggggtgtgaaattgaaggagaagatgggtgctgcgggtgttggggtgaatgtgttttggaggaagaaggggtgtgtggattggtgggggaatttggatgctgggaccaggaggaaggtcatttccaccttcctcatgaaagctgcaaaacccttggtacttttctgggaacttatagaactgttagtgtga

SEQ ID NO: 22977 - DNA, 255 bp, Glycine max
  Peptide Sequence Number=SeqID_139755
atggttggagtggttgctactgcactgtcacagaatggagcctccttgctcccaaagcttgttgcagagcatttaactattgcggaattacatgtagaccatggacttagcttctctgtagtgttgttctcacaagatgagtatgccacccactggctggctggggatatgacttccacggtggagcttgaactggcggcggtagcggaggtggttggttttcagaagccatgggatatgatcaatatgctctag

SEQ ID NO: 22978 - DNA, 147 bp, Glycine max
  Peptide Sequence Number=SeqID_139756
atggcagcatacctaatatggtctctagagcatattgatcatatcccatggcttctgaaaaccaaccacctccgctaccgccgccagttcaagctccaccgtggaagtcatatcctctgtactattgaaagaaaaggaaagggatag

SEQ ID NO: 22979 - DNA, 1713 bp, Glycine max
  Peptide Sequence Number=SeqID_139757
atggactcatcaccagaccaaacccgcaagaggaatcagaatcagaatcacacgctggcgcaaaaatcacttttcctctgtttttctttcttcctcttcctcttcttcttttcctcctcgcaccactctttttactctcacacctccctccaaccctctactttgagtactttccccacacccactccatttcccaccaccaaattaccagtttcctccctccacgtgctcgatcgcatcctcttccccgatcacgtgcttctcacgctctccaaccctcatgttttttctcctaaacatttccactgcgtttattacaacctcgtcaagggttcgactccgtcgaactcgaacccggttttcgacgttctcgtccttccggttctttccacggaccgctacgacgagttccggtccatagcaaggtgtccgctccccggcaaaaaattctccgccgtcgacttgagatggcgcagcggagacgacgatcgccagcctttccggttcccggttcaaccgaccgtgccgcatagcttcgacaagctagcgtacgaggtagccttagacggtgacaccgcagttgtcttcgtcaaaggactaaacctccgaccacaccaaatatccgacgaaggcctactccgatgccacttcggacctcaaaacggcaagcattggcaaacaacaaaagccgttgcggcggcgcaggaagtcgtgcggtgcgcgctgccgcagagtattcagaacagcccacacgaggctcgcggaataataagcgtcagcgtgagtcacgtgcggcacgaggctattttcgactcggtcgctaaaattggcgggtacagaaaacaaataaacagagtgaacatgaacatgaacaagaacaagttagaactttgcgcgtgtaccatggtgtggaaccaggcacgtgcgatgaaagagtgggttatttaccacgcgtggctcggcgtggagaaatggtatatatacgataacaacagcgacgatgaaattgatgacgtggttcgagagcttgaggtaaaaggttacaatattaatagagttgtttggccttggattaagagccaagaagcagggttttcgcattgtagtttgagggcaaaagaggaatgtaagtgggttgggttctttgacgtggacgagtttttctacttgagagaaatgaaacagaatgctctaatatcaactgtggggaatttatcgaattcgattgcggaaataaggacagggtgtcttaatttcggtccctcggagttaaggactcaccctagaaatggagtgagcgtagggtatacgtgtcggcttcggacgccggagaggcacaagtcgattgtacggcctgatttgcttcatgctagtcttttgaatgtggtgcaccattttgaattaaaagaggggtttggatcacttaacatgcctcaatcggttgcggttataaaccactataagtaccaggtttgggaaatttttaaggccaagtttttcagaagggttgctacgtatgtggtggattggaaggaggatgcaaacataggatcaaaggacagagctcctgggctgggaacagaagcaattgaaccaagtgattggaggttgagattttgtgaggtttgggacactcgtctcaaggactttcttctttctaattttgctgatcaagaaacagggttgttgccctgggaaaggtcatcaaaataa

SEQ ID NO: 22980 - DNA, 417 bp, Glycine max
  Peptide Sequence Number=SeqID_139758
atggctattttcttgttaagcaggctttctcagcatatgcaatgccccactaatttacaaatgcaagcagctaaacttgtcttgcgctatctcaagggcaccattgatcatggtttacaattcaagcgagactcctttattcacatcagattgcaagtacacaagggtctagctacatcatttacttttgatccaatcccatatcatggtcatgtaagacaaccaactgttgcaaagtcttcaacagaggtcgaatatagaacaattggttccaccactacattagctactttggatccaagaactgttaaatgtgcttcatcttccactctccagaaagcctctggtggctggtgcacttggacaatcttggagcaacttatctacgtgcaaatcctgttttccattctaggatga

SEQ ID NO: 22981 - DNA, 192 bp, Glycine max
  Peptide Sequence Number=SeqID_139759
atggcatcttctggaccacaaaagccagaaccacctggtggccttaaggacatcttaggaagtatatggtggcatggtaaactactaacttacaatgcacccacaacgagacatgtctacaccaacagacttcattctatcaaccttatgtgcaatatgactcaatggatacctagaaacaaatccacatag

SEQ ID NO: 22982 - DNA, 396 bp, Glycine max
  Peptide Sequence Number=SeqID_139760
atgagtaccactgaacaaaagtcatggatgcgtgaggcctcgctatatctcaataaagttaaggttacatttcaagatgagaaggaaaagtataacatttttgtagatgtgttgagggattacaaagctcaaagaattgatgaggagagtgtcaaggatagagtgaaggtcctatttaaaggacatagagatctacttgaggggtttaatttcttcttgccaaaggcatatgaaatcacaattccatcgaagaatgaacacccatcacagctgagatattgccacaacaatgttgggcactttaattttttaagtcttattggattcttttcaagcaggcttgaaggcgataatggtgtttataaggtcatctctagacatgttagatgcatatag

SEQ ID NO: 22983 - DNA, 747 bp, Glycine max
  Peptide Sequence Number=SeqID_139761
atgaacatcataaaggaatatgatgtcaacaaatattccttctatgcaaagtcacaagatgatgaaagcagtgtgcataacaatggggtgaatcttgaggctgattttgaacacttttgtggtgcatcagataacaactcgattcgagcgttgatgccttactttggatgggttaatggaaatatcggtgtgcatcaagatcaattggggttaactttagtagacctccataaggtggcttacaaggacgagcttttcatcatggtagaacaatccaaacaagtgttttgcatccaagatccatgtgactcaagattgcccgtggttctacaaggaagaaaaagtggtatcagtcaccaagatgatgattctacacttgatatttgtgagatgtctgctttttccacacgaatgacttccataattgaagaacacgaggatcagcccaggccaatgattaatgtcaatcctgcgattgggaaaggatcgggcccagaaaaagagaagttccatagctatctgggggtcatagctcaagaaaaaattcctattgtccacatatgggatgacatttttggaaaatttgatatcctagaagcatcgaatgccaagaaggtgatgtcattggtggccactagatggaggcaatttaagtcttccctaaccactaaatacatatatgctgacaatgagggtcaagataaacaagatccttctattaagtatggactagatccacaaacttga

SEQ ID NO: 22984 - DNA, 348 bp, Glycine max
  Peptide Sequence Number=SeqID_139762
atggacaaaaatattaaccatgttgaaattactattggatgctttccatcctctataccgctaggatcatgctggaatgggaatttattgtccatgattctcaaggtgcaatggcgtctgacgaggtttttcactgaaaatggtacaacattgcatgtgagccaacatattacgagttccatgctggagatggaaaggcttggcctttgtcagggaaatgctctaatagatgtgatatcgaggcatgtggccttccctagggactctcctttggctgtagacatgtcaactgccattctacagctctctgaaactggagatctaaagcagattcatgagccattttga

SEQ ID NO: 22985 - DNA, 744 bp, Glycine max
  Peptide Sequence Number=SeqID_139763
atgactggaggtttcaaagttaaattgggtcaaggaggttttggctctgtatacaaaggaaagcttcgaagtgggccagatgttgcaataaagatgctgagcaattccaaatctaatggacaagattttattagtgaagtggctaccgttggaagaattcatcatgtgaatgtgaacttcgtcccaaaggtttcagattttggacttgcaaagttatatcccgtaaatgatagcattgtcactttgactgctgcaagaggaactttgggttacatggctcctgaattgttctacaaaaatattggaggagtatcttataaggctgatgtttatagttttggtatgcttttgatggaaatgacaagtagaagaaggaactcgaatccttgtgcagagcattcaagccaacattacttcccattatggatctacgatcaatttaaagaagagaaagatgttgatatggaagatgtttcggaagaggataaaattttaacaaaaaggatgtttatagttgcactttggtgtattcagttgaaaccgggagatcgaccttcaatgaatgaagtagtggagatgcttgaagggaaaattgaaagtcttgaaatgcctccaagaccctctttttacccacatgaaatgtcagaacctaatgccataatcagctctgaccaaacaacatggagtgattccagtagcatggatacctaccacggtgaacctataaatattggatgtgcgtaa

SEQ ID NO: 22986 - DNA, 462 bp, Glycine max
  Peptide Sequence Number=SeqID_139764
atgcttgacaatctctcgaaattcagagctatccacatgctccttattgacactattagaaactctttggcagtcaacttcaatgaccacattatggttccacatgaaggaccaatgtgtgatctcttgtggtctgaccctgatgatcgctgtggatggggaatatctccacgtggtgcaggatacacatttggacaggatatagctgctcagtttaatcataccaatggtctctccctgatatcgagagctcatcagcttgttatggaaggattcaattggtgccaggacaaaaatgtggtgactgtatttagtgcaccaaattactgttaccgatgtgggaatatggctgctatactagaaataggagagaatatggatcagaatttccttcagtttgatccagcgcccaggcaaattgagcctgacaccacacgcaagactccagattattttttataa

SEQ ID NO: 22987 - DNA, 378 bp, Glycine max
  Peptide Sequence Number=SeqID_139765
atggccaacaaagattacagagacaacaagagatcagtttgtgagacgtcaatattgttggtggcaaacatcatcagattatcttctctaagattttctggccagagtttcacgaaagaccttgaacctccacaagaggaaggaacctatgtgggcaaaggcaatgaatcttcttcggtatcaaaattttacaagagtgaaagaactaaaaagctggagaggatcaaaaggcctcgttcgtacctcatgaaactaccaaaggaggatccaacgaactatttgagtcaggcactagacgatgttgatgtcaacgctgagaactatatcagccatattcgtggaaagattattagggatagtggtaatattgaatattga

SEQ ID NO: 22988 - DNA, 291 bp, Glycine max
  Peptide Sequence Number=SeqID_139766
atgtcgctttctttaagatgtttcgtggcactgtcaaaaattgtgcaagcagactatcaaccacgaagttcccaggataaaacagcccaaatcactataaacaagctgttggccgatataggcacattacatgctcagaaaaatgaactggaagagcagatcatttctaaaagtgatgaagcttcgactcaagtcaaaagcattacaaatgagttgaatgcgtgcatgatctcatggtcaacatatgtacacatacaaaacctcctcctgtctacactaccatgcttatag

SEQ ID NO: 22989 - DNA, 315 bp, Glycine max
  Peptide Sequence Number=SeqID_139767
atgtcggggatggcgagactaacaaactggtataaacttcaaaacgctgcgtttcactcccccgtcctcgcgttgcttcgaaaccctaaccctatccacggcattcctccgctcgccgtcgacgccgtcaccgtcgcgccaactgccgcaaaccgaataaaccgaatcgatctgagagaagaagaagaagaagacgcgatctcggaggtgggagcgaaacgaaacgatgccgtctcacgcggatctggaacgacagatcgagcagctgatggagtgcaagcctctgtcggagtcggaggtgaaggcgctgtgtga

SEQ ID NO: 22990 - DNA, 4344 bp, Glycine max
  Peptide Sequence Number=SeqID_139768
atgccatataagtcgccgccggaaagtgacgtcacggcaccgactccgggagcgttcaggctccggtgggacgtgttcctgagcttcaggggcatcgacacgcgcgacaccatcacgaagggtctctactcgtctctggaggcgcgtggggttcgcgtgttcctggacgacgtgggattggagcgtggggaagagataaagcaggggctcatggaggccattgatgactcagcagcgttcattgtcatcatatctgaaagctacgctacttcccattggtgtctcgaggaactcaccaagatttgcgacaccgggaggctcgtcttgcccgttttctaccgggtcgacccgagtcatgtccgcgaccaaaagggtcccttcgaagcgggttttgttgagcatgaacgaaggtttggtaaaaatgaggtttccatgtggagggaagcattcaataaacttggtggagtttcaggttggccttttaatgacagtgaggaagatactctgattcggcttttggtgcaacggataatgaaagagttgagtaatactcctttgggtgcgcctaagtttgcagtagggcttgatgaacgcgttgagaagttgatgaaagtgttacaagttcaatccaatggtgtcaaggttttggggttgtatgggatgggtggggttggtaagacaacccttgccaaggcacttttcaacaatcttctcaatcattttgagcatcgttgcttcatttcaaatgtcagagaagtttcatcaaaacaagacggtttggtttcccttcgaaccaaaatcatcgaagaccttttccctgaaccagggtctcccaccatcatcagtgatcatgtaaaagctagggagaatcgagttttgttggtcttggatgatgttgatgatgtaaagcagcttgatgctttgattggtaaaagggaatggttttatgatggaagccgtgtgataatcaccacaagggatacagttctaattaagaatcatgtgaatgagttgtatgaagttgaagaattgaactttgatgaagcactagagttgttcagtaaccatgcactgcgaagaaataaaccgccagaaaattttctgaatctgtcaaagaagatagtgtctctgactggaagaatgcctttggctctagaagtgtttggttcgtttttgtttgataagaggagggtggaggaatgggaggatgctgtggagaagttgagacaaattcgccctaagcatcttcaagatgtgttgaagataagttatgatgcattagatgaagaagagaagtgcatattccttgatatggcttgtttgtttgtccaaatgggaatgaagcgtgatgatgtgattgatgtgttaagaggttgtggttttaggggtgagatagctattacggtgcttgtgcagaaatgcttaatcaaaatcaccgatgaggacaatacactgtggatgcatgatcaaattagagacatggggaggcaaattgttgtagatgaaagcattgttgatcctggtaagcgtagtagactgtgggatcgtgctgaaatcatgtctgttttgaagggtcatatgggaactagatgtattcaaggaattgtgctagattttgaagaagacagattttatagaagcaaggccgaatcaggtttttcgacgaaccttcaatggagatcaagtttaagaaatgtattaggaggcatcatcgaacaatgcctatgccttaagaattatctccaccctcaagcagaggaaaacaaagaggttatacttcatacaaaatcctttgaaccaatggttaatctgagacaacttcagattaataatcggagattagaaggcaagtttcttccagctgaactgaagtggctacaatggcaagggtgccctttaaaacacatgcctttgaaatcttggccacgagagttggctgttcttgatctcaaaaacagcaagaaaatagaaaccttgtggggatggaatgattacaaggtgccgcgaaacttaatggtcttgaatctctcctactgcatcgaactcactgctatccctgatttatctgggtgtcgacgtctagaaaagattgatctagagaactgcattaatctaactaatattcatgactcaattggcagtttgagtaccttgcgtagtttaaaactgacgcgctgttcaagccttatcaaccttcccattgatgtctcagggctaaaacaactagagagcctttttctttctggctgcaccaagttaaaatcattaccagaaaacataggaatcctgaaatccttgaaagcacttcatgctgatggcacagctataacagagttgccccggtccatttttcgcctcacgaaacttgaacgacttgttttagaaggttgcaaacatttgagaaggctacctagttctataggacatctatgttctttgaaagaattatctctatatcagtctggattagaagaattacctgactctattggatcattgaataaccttgagagactcaatttgatgtggtgtgaatctctcactgtaattcctgattctataggcagtctcatatcattgacacaacttttttttaatagcactaaaattaaagaactcccttctaccattggttctttatattacctgagggagttatcagttgggaactgtaaatttctcagtaaattgccaaattcaattaaaactttggcttcagttgttgagcttcagttagatggaacaaccatcacagatttgccagatgagattggagagatgaaattattgaggaaacttgagatgatgaattgcaaaaatcttgaatatttaccagaatctattggccacctagcatttcttactacactgaacatgttcaatggaaatatcagggaattgccagagtccattggatggctagaaaatcttgtcaccttaagattgaacaaatgtaaaatgctcagcaagcttccagcttctataggaaatttgaaatctctgtatcacttcttcatggaggaaacttgtgtggcaagcttacctgaaagctttgggaggctctcaagcttaagaacattgagaattgcaaagaggcctaatttaaataccaatgaaaatagcttccttgcagaacctgaagagaaccacaactcttttgtacttacaccttccttttgcaatctgaccttgctaactgagcttgatgctcgttcctggagaatatccgggaaaattccagatgaatttgagaagttatcacaattagagactttaaaattgggcatgaatgattttcaaaaacttccttccagcttgaagggcctttctattctcaaggtgctttcacttccaaactgcactcagctgatctctctcccctcacttccttcaagcttgattgagctgaatgttgaaaactgttatgcactagaaactatacatgacatgtcaaatttagaaagtctgaaggagttgaaactcacaaactgtgtaaaagtgagggatatacctggtcttgaaggcttgaagtccttgagaaggttgtacctgagtggttgtgttgcatgctcctcacaaatacgcaagagactttcaaaggtagtattgaagaatttacagaacttgagcatgccaggaggcaaattacctgaatggttttcaggacaaactgtatgcttttccaagcctaaaaatcttgagctaaaaggtgtaattgttggtgttgttctttcaatcaaccataatattaacattggcatacctaatatgcagcgagagcatatgcctggagtgcttgatgttcaagcaaatgtcctcaaacagggcaaaactctctttagtacagttttaaatatctgtggggtgccaaggacagatgaagaacacatacacttgtgtaggttccatgattaccatcagttgatagccattttaaaagatggtgatacattttgtgtgagtaagagaaatccaccttttgataaagggttggagttaaaacaatgcggggttcatttaatctttgaaggggatgatgattatgatggaggggaagaatcattggacaaagacctacaatctgtctcagaaaaattagccaactttttcaagacttatgaagatgagagtgtcaggaatcagaatgaattggagatgatgggacaagagccaagatcttttcttgttacacttagaagcaattttatttttcttttcctgattggagaatttgctattagctctgttcttcacgtgcccattaaggtaggaatcactgcagtgtttccggtgatgttgtggtctttctttgattctggagagttcagcaaggaaaatatttga

SEQ ID NO: 22991 - DNA, 2551 bp, Glycine max
  Peptide Sequence Number=SeqID_139769
atggatttgtttcaaaaacatgttgaagtatatattgatcatacttcacacatgacaaagggagttttgctgactgttgatgagggaggaaaacccatggttgaaggagatttgggaaatgatgccattgatggaaaagacagtgatagagaggttgtcatgattgacttggatgatagggataaggaaactgatgaagataagggagatgatgataattatgaggaaaatgatagtgataatggagatggcttggatgctaaatatgatactgataaattagaatttgatataacaagtgaagaagatgatgactgttatgcacttcctatggcaccaattaatggagaagatatatcaatagaaccagtttctaagagatttcaacctcatgaaatgggaagagattttaattttgaggttggtatgaagtttgattcaattagtcagttcaaggcagccattaaagaatatgatggttgtgaggtggcatatgtgagtatggttggtggatcaacaacatatagcttgaatacttacaatgaaaagcacacatgtgccagcaagaacaaagactcttggaagtggtttctacaaaacttgttaaatgatattggtcatgagcagaagtgggtcttcatttcagatcaacaaaaggaggcatatgactgggtgatgcaactagacccgagattttggtcagaggctcacatgtcagagtactccagaaaattaggagagaaacaaaaggcaaagggtcaaaaagtatgtccaaggcccatgaagagattagatcaagaggtgttggcatgttcaaagtggattgtggtttggggtggcaatccgaaatttgaggttcaaaaatacccacttgcattcaagatcgatctcaatgagaaaagttgctcttacaagttttggcagttgattggaataccatgcaggcatgcagtggcagcaatgtttgactgtagattgctaccatctaacttttttcatccatattatcatgttcatgttcttggggaggttgtcgctcgcgcctttattgttggtgtctccgtctaccttgatctttcgcatcatgattctcgtgttgctcctcttggtaccctctgggtcttgctactgcttgatggttgtccgcctaatgggtacctccaagttgaaagcttcctccaggattgtagtgcgattggttgtcagggtgcttccttcttgcttgtcgtgcttctttctggcttgtctgactttgttcctaaatctagacatttcttccatctggatatttcggatctagaagacaatgcgcctaaatctgtccatgaattttctaagagactcgttgtctgcttgtcacagattggccaaggcgacaatggtcatacgataagaccgactagttgcgtattgcacattgaagcgctcgacgaggatttgcctaagtcaggaaggcatccagatgttcatttggatcggtggtcctatcataccgctccaggtgtgattcctcttaggtgcactcaggaaatgtgtgagcagagtgctcattgccctggggatctcctcctcatggtttcgctccatttccacaatgcagttttagagttgtcgaagagtatttgtgaaggattaaagccttcaaaagggatctcgtgtctgagttcagaccaagtgctaatcatgggtgaaaaagagagagatgacaagagaccgtggagtatgttttactgtgactccacggtgggcaccaaatgtacttatcaaaattcggagctggcacacgtcatggtagacttggctaaggtgtgcttattatgctcaagatgtgctgctgagagcatgtatgttgagagttcgaagaaacctagtatttataagagaggaatggagctacagtgtggccttgctgttttctcaatgagaaaggcttttactctgcaacgcgcacttttgcgcttctctgttgcgttgttgctggttgccagcttcacttgtgctacttctgttatggcaataactgaagtttcagggaatgaagtgaatacagatgggaagcttgtaaatgaagaactagcaaaaacaagccaacaaggatatgacaaagaagcaaaatttaaaggatttttttcaaaacctattccaaaaccaatttctgttgttaagcctattcctattccactatataagtctataccaaaatcaattcccatagtgaaacctatcccaaagtcaattcctaatgaagaagaaaaatttaaaggactttttccaaagcctattcccatagttaagcctattccgaagtcaattcccattgttaagccaatactaaaaccaattcctgttgttaaacctattcctattccagtatacaagtccataccaaaatctgttcctattgttaagcctgtgccaaagttaattccggttgttaaacccataacaaaacccattcctacttttgagccagaatcttttctaaagccgaagcctttctttgaaaaacctgttcctaaattgccactggagcccaaattcaagaaaccac

SEQ ID NO: 22992 - DNA, 696 bp, Glycine max
  Peptide Sequence Number=SeqID_139770
atggaaggaattagaaatgttttcttcaaatggaaagttgtggccatatgggcattcttttctgtataccagtctctaatatttttctattttgtgagttcaacaaatttaagtgctaaaaactcagcaggcaagatatttggactctgggatgtcagtacaatggccttcacttgtgttgtaataactgtcaacttgcgactgcttatgatatgtaattcgatcactagatggcattatattagtgttggtggaaggattagcactccttatgatcgtcaggagaatatttattttgtcatatatgtcttgatgagtacattctacttctacgtcatgctatttcttgttcctgttgctgcacttttctgcgactttgtttaccaaggggttcaaagatggttcttcccctatgattatcagattattcaagaaatgcatagagatgaggtagatagcactggtagagcacagctgctggagatagggaaccagcttacaccagatgaggcaaggagttatgctatatctcaactcccacgcgaattgtcgaagcacaccggatttgcttttgattcacctggatacgaatccttctttgccgcacagctcggtgtatatgctccacccaaggcatgggatgtggcaagaagagctagcatgagatcacggtcaaagactgggcagcaaaaataa

SEQ ID NO: 22993 - DNA, 1004 bp, Glycine max
  Peptide Sequence Number=SeqID_139771
atggtatatgttcgtgaatctcatgttgagaaaatgggcaaagttcaagatgtgtcttatgagattttaaatgtgctcgagtttaataggaagcgtcagtctgttgtttgtcgttatcctgatggaaggcttgtactatactgtaagggtgctgataatgtagtctatgagagactggctgatggtaataataatatcaagaaagtcaccagggagcatttggaacaatttggatctgctggattacgcaccttatgcctagcctacaaagaattgcatcctgatgtttatgaaagctggaatgagaagtttatccaggccaagtcttctctaaatgatcgtgaaaagaaattggatgaggtcgcagaacttattgaaaatgatctcattttaattggtagcacagccattgaagacaagcttcaagagggagtaccagcttgcatagagactctgcaaagagctggtattaaaatttgggttcttacaggggacaagattgaaacagcgataaacatagcctatgcatgcaacttgataaacaatgagatgaagcaatttgttattagttcagaaactgatgaaattagagaagttgaagacaggggtgaccaagtagaaattgcacggtttattaaagaagtggtgaaaagagagctgaagaaatgcctcgaggaagcacagagctcttttcaatccctacgtggaccaaaattagcacttgtaattgatggaaaatgtctgatgtatgcgttggatccaagtttaagagtgatgctgctgaatctcagtttgaattgtcacgctgtagtttgctgccgagtttctcctttacagaaagcacaggtcacgagtatggtcaagaaaggtgcacaaaaaataacacttagtattggtgatggagccaatgatgttagcatgattcaagctgctcatgttggggttggcataagtgggatggagggaatgcaagctgtgatggccagcgattttgccattgcaca

SEQ ID NO: 22994 - DNA, 480 bp, Glycine max
  Peptide Sequence Number=SeqID_139772
atggtgaaaattggtgctttaaaggttcattgggtaatcagaggattaggtcctgtgtctccaataactaatgtgcttcctctatctctggtgcttcttgtctctcttattaaggaagcttttgaggactggaagcgttttcaaaatgacatgtccataaacaataatacgatagatgttttgcatgatcaaaagtgggagtctgtaccctggaaaaagttgcaggttggagacattgtcaaggttaagcaggatgcattctttcctgcagatctgcttttcttggctagcaccaatgctgatggtgtctgctacattgagactgctaatttggatggggaaaccaatttgaagattaggaaagcattggaaaaaacttgggattacgtgactccagagaaggcatctgagtttaaagatggaagtgttaaatttgggatcacaactggatttaagcaggagaatcttggaagatactag

SEQ ID NO: 22995 - DNA, 237 bp, Glycine max
  Peptide Sequence Number=SeqID_139773
atggcatattttaaaatagggtattgtttagcaagttggggatgggaagaagaaggagaaagtgaccaaatccttgctattccgttgggatatagccaaagagataataagttggcttgggggctaagttcagatgaaaattgctctgtaaaaaatgggtatagagtagcacagaggaacaacggaaaggaaattgggagttctagtagctacaatgttttgtttggggaccattga

SEQ ID NO: 22996 - DNA, 1239 bp, Glycine max
  Peptide Sequence Number=SeqID_139774
atgtcgacgccgagcaggcattgcggctggccgacaaggcgctgtacctggccaaggagcagggccgcaaccgggtggtggtctacccgtacgccgactgacgcggagccgggctgcccggctccgcagcgggtctcagctctgttgcagcggggtcagcaggcgcagcccgcgcttggcgccgtccaccatgtagacgccgccttccggcagcagatcgctgccggcctgctcgaccgggtcggcctcgtgccacggcacgctctgccgcggccccggaatgaaagcgcgccagcgaccatagcgttccgcctctgcattgggatcatggttcagggcgaagttcaccgggatgcgaaccgtccagctgtcccgggtgctgtcctcgccggtggtcggcggcttgaaggtccacgtgcgggcggtgctgacgctggctctggccaggatgtcgcgcatcttggccagggtccgctcggatgcgaccacggccatgttcacctgctcggcggccacgtcggccactgttccgtcgcgcgccaccttgaccagcagcagcacctcaccctggccaccgtttcggtaggccgcctccgggtagcgcggcggtgtcatgtgcagcggggtcaccgaaccagtggccttcggatcgtactcgctgaagtcgacactggtcatgctgatttcataaccgccgtcggccgcagccttgccgcgcaggcgaacgcgcaaaggggcccgcgtggccaccgcctggccatcgcgcagcgtgggctcgaagcgccagccaccgatggtgccttccacgaaggaggcaatgctcggggcgaccatggctttctggtccagcaccagcgaactgaccgcgccctccggcgtgacctcgatgtgaccggacagcaccatgctcatttccgcagtcgcacgtacagcgcgtgcggtctgcgcagtggcgtcacctgcaagcaggggggcgccggcaccgacggccagcgcgagggcgagaaacagtggagaacgcatcattgccggatccttggtgatgaacagcgagcgtacctcagtcccaatacccatgacagccggctcaggccagccggtgtgcgcccgcatagggtggcgtatccggatagtcaccacgggcaaaacgttcctgcagaccctgccaccaggccgggtcgaacaggtgccggtagtgctcgcgcaccgccgccagttcgccggccggcaggcccatga

SEQ ID NO: 22997 - DNA, 162 bp, Glycine max
  Peptide Sequence Number=SeqID_139775
gcgtttggtgccgctggattttcggtgaacagcgccgctgaactggaacccacgttgcggcgggcgatagaggtggaaggaccggccgtggtggctatcccggtagattacagcgataacccgctgctgatggggcagctgcacctcagccagctgctttga

SEQ ID NO: 22998 - DNA, 1276 bp, Glycine max
  Peptide Sequence Number=SeqID_139776
tggatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacag

SEQ ID NO: 22999 - DNA, 357 bp, Glycine max
  Peptide Sequence Number=SeqID_139777
atgaagttatttggtgtcccaggcgagccagaggctggtctgggcgagccagaggctagcctgggcgacccaaggttcagaaaaagccttaaaatgacccttttgccctctcctttgggtattttcacattcttgatcaaaacattgaatgatcatctgtttcgcactgtaactggtgttcaacatccaatgccttccaagattattttgatgatgccaaagaatcaagagtcaaacaagtttcaagaatcaagatcaagattcaagaataatcaagatcattattcaagattcaagattcaagtaaagaatcaagacttaagattcaagaatcaagagaagactcaatcaagataa

SEQ ID NO: 23000 - DNA, 271 bp, Glycine max
  Peptide Sequence Number=SeqID_139778
atgatacataatgaacctattgtggaagaaccacaagaagtaacattaaggaggtctcaaagagaaaggagatcagctatttcaaatgactatatggtatacctacatgaaccagaaacagacttaagcattaatgataatgatcaaattttgttttcacaagttgtaagctatgataatttagatgccatgaaagaagagctaaactccatggaacataatagtgttcgggacctcgtacatttcccaaagggttgtaagaaagttggtt

SEQ ID NO: 23001 - DNA, 321 bp, Glycine max
  Peptide Sequence Number=SeqID_139779
atggttttctcttactcgacgcttttcgcccatatttctcaagtgatgtctaggccaaagaacaagattgttgatgaggacataaccaagggcaaggaccatgaagcacttgaaggtcccatgaccagaggcagacttaaacaagtccaacacatcatagagacaaggctgacttatcaaggtaatccttgtggcgtctatcctgacttatcttccttcaccggaagtggcatctaccctaacttatcttctttcaccagaagtgacgtctatcctgacttatcttccttcactggaagttgcgtcaaccaacctccgtag

SEQ ID NO: 23002 - DNA, 378 bp, Glycine max
  Peptide Sequence Number=SeqID_139780
atgcaacagaagcgacatcctcatgctcagtcatcttcacaaccaacaatgaactgcacttccgaatatgatagttcgggctctaattttttaagtgcctatgaggattgccaatctccaactaatcatcttgtaatcaacaccgaaggatattctgatcttggtgatcaactcatgcaatgtagatattgtaatgcacaaatgtggtatgatgaaagaatatcaaaagataaaaattgtcagagtccaaggttcagcttatgctgtggagatggcaaagttgaattgccattattacaaaatccaccccaatatctccaacgacttctgtttgatgataatacaattgatagtaaaaattatcaacataacttatga

SEQ ID NO: 23003 - DNA, 204 bp, Glycine max
  Peptide Sequence Number=SeqID_139781
atggatgtggccagtaatggcagaaacttcaagaccatcgtaaagaagacggagaatgttgtcattgtcgaagaacagagaatgatttgctccatggttgaactcactgttcaacaggtggagaagttgagggaaatgagtccactttatgaatttgtcaaggaaggtatcaacatcaaggacattcaatgggcacagcactga

SEQ ID NO: 23004 - DNA, 222 bp, Glycine max
  Peptide Sequence Number=SeqID_139782
atggaagaagcaaattggtggggaaatgacacaaatgaaggaagcaggtgtcaaccgaaaaaggttggagaagaagccacgtgcatccatcaacagaagttaaacactcaagctgaaatgcccaaaaaactagcaaattggacaggtgtcaagctctcagccatgagcattttagggatttcattgggcttctcttttattatataccttggatgttgttga

SEQ ID NO: 23005 - DNA, 905 bp, Glycine max
  Peptide Sequence Number=SeqID_139783
atggggtcaagtcaaacgccttcgcttaaaaagaggttctatcaagtcaaggtcaagagcctagggatcaccagtctaagagagttagggcaattgatgggtcagctccaacgacaagcgtttcgcaaagcttacggtaaaatctgggacctagccatggcagaagtctccacggaggccattgcatcccttgcccagtattatgaccagccgttgaggtgcttcacctttggggacttccagctgtcacccatggtggaagaatttgaagagatcctaggatgtcctctagggggaaggaaaccatacctcttctcagggttctatccctctttagctagaatttctaagatagtccaaatctcggcgcaagaattagaccacagaaaaggggtcctctttccaaatgtggatgggttggtggacctggcagcgatcgacgcttttctcgcctatcatgaccgcaaggaaagcccggttgtcgctatactagacgatctatatgacaccttcgaccgaagatgtgagaagagcagtacaaggattgtttgctgtactccgaccctctatgtatggttggtttcacacctttttcgccatgaggtgaggcatgcttgcctgctagatagccatcgttcatgcacagagaaaagaggggcaaattgggaccgactcttagcatgcaaagaaggagtgtctgtcaactggttccctcgatggaaagaaggaagaaccaggattcttatttcgtgcggaagatttccaaatgttcccttgatggggacaaggggttgcatcagttacaatcccgttcttgctataagacagcttggctaccctatgagaggagcaccactagaggaaagctcacacctgttattgcacgaggcttcaataagaccaac

SEQ ID NO: 23006 - DNA, 225 bp, Glycine max
  Peptide Sequence Number=SeqID_139784
atgagatttcggatgttagcgttcattcctaaacgaccatttagaggaaacactgggcccgacagaatagaagaatatcactcgaaggtttgtggtaagttgggattttggctcaaggcttgtagaacggctggacatgatatatgtcaggatgttggtttggccagcggctcagggaaaaaggagaagtcccacattatttccatgatacacatgcaacactga

SEQ ID NO: 23007 - DNA, 522 bp, Glycine max
  Peptide Sequence Number=SeqID_139785
atggaagaaagttcagggtttcctgtgttattagttggtgaaaattcaaaccctcctgatgatgatggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatgccccaagagatctataaagaaagaaatatatgaagaggtgctgggaatttcttattccacggtgagtcaatcagagaaggttgtggcacatgatctgaaagagccacattctggtgcaataaagaccatgtcagctagcaggaagctgaacacaggagaaaaaactgtgctttcgtggatgattgaaactggaacaatactacaacatgagaaggtattgtgctctctcttgactcggtgcacatgcaaggaggattatgaagatggagatgaattgtga

SEQ ID NO: 23008 - DNA, 192 bp, Glycine max
  Peptide Sequence Number=SeqID_139786
atggcttcttacgggtcggcgttcgcttactcgaacaccctcaggcagcgctttccgtttgtccagacctgggcaagggacgacgatctatcagttgtgaccctagcctctactcgggtccgtccctatgtacctgaaagtaggaaacgacatcgcgccgcaaactgtggccgcgttactgttttaccctga

SEQ ID NO: 23009 - DNA, 231 bp, Glycine max
  Peptide Sequence Number=SeqID_139787
atggaaaaatccgacaagatgaatttcaaagagaagaaagaaaagaaaggatatatcacttgggaagataatgtcataaattattcaagtgattcagagaagaaaatcataagtttgggtatcatgatgaaagactatgaaaatggagaagaacaaagtcgatacattgatagcaatttctccaaacacatggcatgcatcaaagtttattcatatgtctccccaagataa

SEQ ID NO: 23010 - DNA, 369 bp, Glycine max
  Peptide Sequence Number=SeqID_139788
atggtgaagggtactacctcagattcagaatgcagtgctgaatctgaatcttccccagaggtttcttgcaccttaggggacaatgattcaaccactaatgatgattcatctcactcttgtggctctaagtcatcaccccagctagacgacaataaggcgccaactccttgggttaatctattcaaagataacaaaagtccttccaaaggttttggaatgaagttctcccctccaccctctgatgatgaagtgctattggaagaaactgatttacaacccctggaagaggcttggggacatagccttattcgctatgtggaaggtcgattcccaggaaagaaagcgctgctggattgttgcaaaaaatga

SEQ ID NO: 23011 - DNA, 303 bp, Glycine max
  Peptide Sequence Number=SeqID_139789
atgcgtagtgatttcctagtgcaattctccattctccacttttattcggagccccatgaattgattgtcgttcatgcatcctccacccgtgagtttggagccatgtgtagtgattgcctagtgcaattctccattctccacttttattcggagccccatgaattgattgtcgttcatgcatcctccacccatgagtctggagccacgcgtagtgattgcctagcgctgttcatgtgtcctccaccgtcaagtgcggagcctccgaaaacagaagaaatagagacgagagtcgtcatagactaa

SEQ ID NO: 23012 - DNA, 252 bp, Glycine max
  Peptide Sequence Number=SeqID_139790
atgactaaagcacgtcaaaaggggagcttaccggttgaagaccgaagaacgaacgatgaacgacgaagaacagttgaaaatctacgcgaaatcacccacggaaatgggaggagcttgccacccagctcgcccaagcgagctcagctcgcccaggcaagccaggttgcttcctctagaagcaacagccttctggaggaacatcctggaaggcccaagtgggtctggttcctatttgcaccctttttttactaa

SEQ ID NO: 23013 - DNA, 1173 bp, Glycine max
  Peptide Sequence Number=SeqID_139791
atggccgccgcggaggccctcagcggcgcccccaagagccgcgacctggctcgagtgatattggttcggctcaaggagttggtgtcgtcccacgcggcgccgcacggctccaccatggagaggctcgccgcctacttcaccgacgcgctccagggcctgctagaaggcgcagggggtgctcacaataacaacaacaagcatcaccaccactacatcacatcatgtgggccccatcaccaccaccgcgacgatcatcatcatcaaaacgacaccctcgcggcgttccaactgctccaggacatgtctccctacgtcaagttcggacacttcaccgccaaccaggccatcctcgaggccgtggcccacgatcgccgtgtccacatcgtcgattacgacatcatggaaggggtccagtgggcctccctcattcaggctctcgcctccaacaaaacgggcccaccgggcccacaccttcgtataaccgcattgtcccgcaccggctccggacgccgctccatcgccaccgtccaagaaaccgggcgccgcttagccgccttcgccgcctcccttggccaaccgttctccttccaccattgcaggttggagcccgacgaaacgtttaaaccttcgtcgcttaagctggttcgcggagaggctttggtttttaactgtatgctaaacttaccgcaccttagttaccgcgcgcccgaatcggttgcgtcgtttttgagcggagccaaagcgttgaagccgaggctggtgactttagtggaggaggaagtggcctccattgttggagggttcgtggcgcggtttatggattcgctgcatcactattcagcggtgtttgactcgctggaggctgggtttccgatgcagggccgggccagggcacttgtggagcgggttttcttgggcccgaggatagtgggctcgctggcccggatgggggaagaggaggaaagagggtcgtggggggagtggttgggtgcggcggggttcaggggagttccgatgagcttcgcgaatcattgccaagcgaagctgttaattggtcttttcaacgacgggtatagggtggaggagttggggagtaataagttggtcttggattggaaatctaggcgcttgctctctgcctcgctttggacttcttcctcccactcagattaa

SEQ ID NO: 23014 - DNA, 333 bp, Glycine max
  Peptide Sequence Number=SeqID_139792
atggacgagtctcaggcccttggaatcgtcgccggcgtcgtcgtcctcctccgtgatggagacggagggggagttgctggcgacgtggtcgtcggggctgaggttgtcctcctcgggggcggcgccgtcgcacatgatggagtcgatgatttggtggaagtcgtcgtgggcgccggtgaaggcgtcccagttgacgacgggggaccagtggttccagttgcaaccatagtcatcatcagaagagggggttgtgttggtgatggtgctgtatccggagaagtcgaggttgtggatagcatctatgtccatgtctatttcgatggttattggtga

SEQ ID NO: 23015 - DNA, 900 bp, Glycine max
  Peptide Sequence Number=SeqID_139793
atggacacattgagggtgcaaagcttagcttctcagtcgaaggaaacgattcctgcagagtttgttaggtcagagacagagcaaccaggcatcacaaccgttcatggaacccaacttggggttcctataatcgatttcagtaaccctgatgaagacaaggtgctgcatgaaattatggaagcaagtcgtgactggggcatgttccaaattgtgaaccatgagatacctagccaagttatagaaaaacttcaagccgtggggaaagagttctttgagttaccacaggaagaaaaggaacaatatgctaagcctgcagactcaacatctatagaaggttatggaacaaagcttcaaaaggaggtggataacaagaaaggttgggtggaccatttattccacaggatatggccaccttcggacattaactatcgcttctggcccaagaatcctccttcttacagagaggctaatgaggaatatgataagtacctacatggggttgttgataagttgttcgaaagcatgtcaatagggttggggcttgaaaaacatgaactaaaggaattcgcagggggtgataacttggttcaccttttaaagggccttcaagcctcaagagatggccattggtacgacgttaagtatatccccaatgctttggtcattcacattggagatcaaatggagataatgagcaatggaaaatacaaggccgtgcttcacaggactacagtgagtaaagacgaaacaagaatttcgtggccagtgttcgtagagccccaaccagagcacgaagtggggcctcacccaaagctggttaaccaagacaacccaccaaaatataagagcaagaaatacaaggattatgcttactgtaagctcaataagatccctcagtaa

SEQ ID NO: 23016 - DNA, 2505 bp, Glycine max
  Peptide Sequence Number=SeqID_139794
atgaaacccatcataaccttctcttgcattctccttttctttaccaccatctcagcccgcagtttttcagattatatcactccaaatttcactgcctcataccttgagttcattgacaactttggcacgttcctgttttctcacaacagaacattcaaggctgctatattcaaccccggtggccaacaaaccagtttctatctatgtgtcattcatgctgcatccaacactatcatttggtctggtaaccgtgatgcccccatctcagattctggcaaaatgcttctatctttcaaagggatcacaattcttgatgaacatgggaacaccaaatggtcaacaccatcactgaaatcacaagtgaataggcttcagctgacagagatgggaaatcttgtgttacttgacaagtccaatggttctctctgggagagtttccaaaacccaacagacacaattgttattggacagcgtttacctgttggagcatctttgtcaagtgcagcatccaattcagacttgtcaaaaggaaactacaagctcacaataacttcctctgatgcagttctgcaatggtatggacagacatattggaaactttcaacggacacaagggtctacaagaactcaaatgacatgttggaatacatggccataaacaacacaggcttttacctctttggagatggtggaacagtttttcagctggggttgccactggctaattttcgaattgccaagttaggtacctctggccagtttattgtcaacagcttttctggcactaataacctgaagcaggagtttgtggggccagaggatggatgtcaaactcccttggcttgtggaagagcaggtttatgcactgagaacactgtttcctcttcacctgtttgttcttgtcccccaaacttccatgtaggctcagggtatgttgagtactttggcaatttttattctgatccggttttgtataaagtgaatttatctgcctgtcaaagtctttgttcaagtaactgttcctgcttggggattttttataaaagcacatctggttcttgctatatgattgagaatgagttggggtccattcagtcaagtaatggaggtgatgagagagacatcttgggcttcattaaagccattacggttgcatctacaactagtagtaatgatggcaatgatgataaggaaaattctcaaaatggggagtttcctgtggcagttgcagtgctgttaccaatcattggattcattattctgatggccttaattttccttgtgtggagaagattgacactcatgtcaaagatgcaagaagtgaaactagggaaaaactcaccttcttctggggaccttgatgccttctacattcctggcttacccgcaaggtttgactatgaagaactcgaggaggctacagaaaacttcaagactctaatagggtcaggtgggtttggaaccgtatacaaaggtgtgcttcctgacaaatccgttgtggcagtgaagaaaatagggaatataggaattcaagggaagaaagacttctgcactgagattgcagtcattggaaacatccaccacgttaacttggtcaaactcaaaggcttttgtgctcaagggagacaccgcttgttggtttatgagtacatgaaccgtggttcccttgaccgaaacctctttggtggtgaaccggttttggaatggcaagagaggttcgatgtggcgcttggaacagcacgtggacttgcttaccttcacagtggatgtgtacaaaagattatccattgtgacatcaaaccagagaacattctcttgcaggatcagtttcaggctaagatatctgattttggactctccaaactcttgagtgccgaacagtctggtttgttcacaacaatgagaggcacacgtggctaccttgctccggagtggctcacaaactctgccataacagagaaaactgatgtgtatagctttggaatggtgcttcttgaacttgtcagtggaaggaagaactgctattacaggtccagaagccatagcatggatgatagcaacagtggtggaggaaattcctcaacctcatcaacaaccgggttggtttattttcctctatttgcattggagatgcatgagcaaaggagttaccttgagttggctgattcaaggcttgaaggacgtgtcacatgtgaagaggtggagaaactggttcgtattgccttgtgttgtgctcatgaagaaccagcgcttaggccaaacatggtcactgttgttggcatgctagaaggtgggactccattgccacacccgaggattgaatctttgaactttctgaggttttatggccgtaggtatactgaggcttctactatagcggaagaaaatgagtatggttctgtgatgcttcaacaagcgcgtagttctactacaagcatgccaagtgattcatcgactcgtggtttttcttacatgtcttcgcaaaatatctctgggccaagatag

SEQ ID NO: 23017 - DNA, 306 bp, Glycine max
  Peptide Sequence Number=SeqID_139795
atgccatcgctagccagcattacatcctcgtttgctggtggcttaaccccagagtgggatcgtaatctgtctatagaagctggtgaatcgatccaatcgggtgaagcatctcctcaagtcaggggctctaatctgtggatagctggtatgatcggatgtgaggaagtgaagcacgaccgacttgccgtggtagttgttgagcagaagcgcgaccgagcgataatctgcggccctatgatggccatccgcctaatccatgatctcgagcggtccccttctatcttaatctccccaatttctccgtaa

SEQ ID NO: 23018 - DNA, 2178 bp, Glycine max
  Peptide Sequence Number=SeqID_139796
atgcagtccaattgcataagaccaaggcgcacgctacttcctcaaagaagagcatctagcacttcttcttcttcttccgatgtcaccaattctcaagaagaagcttcttccaaggattcgctcaacgccgtcgtcccttctcaaaacctagactctcagaagaaagtccagttttcagttccaagcaacgctgcctcgcaggatggaaaggccactgagttggagaatttatcttctcacatgagttcgcttggattcgcagaaatggagtgggttgaaggcagccaaatcgaagcatggtcgtcgtcgtcgtcgcttggatgcaaccagcaggagagtgttcagcaggcggggattgacgcgagtttgaaatgcgagagtggagtgagttccgtgctgccgaagagaagcgtggttactccggatcatttgcagcaattcagaagttttttgagtcagccagcgacgcaatcttcggtggtcggacctacttgtgccacaactacatctgttcattcaacttcagcgccaatgctgaattcaacaacacggtattctcatttccgtcaatattgtggctcaagtgtggctgctgagcctttgggggaggttaatgttaatccatgccctataactgaaggggttgtgaaatcgattgatgtttccatacaagaaaccaatagaatgccagttgatccgggggcagaagctgaagtccgagcttctggttcttgtattgatgatgcagggtcgttatccaaggagagcaatcaatctaaggagcaacaagggggtgagttgaaagaatctggcaattctaagtatacttcttgtgatgatgggaaagggaaagaggctgtggatgttgccactgtacaaatgcaggctccacttcccacaaccataacctcatcttcagatgtgaagttggggtcttctaaggtagaaaaacgagagaaggctgcaagtagtaaaggtacattgggtgcccggaaaagaacttatgaccctgatttgtttttcaaagtcaacggcaagctttatcagcgacttggcaagataggtagtggtggaagcagtgaggtgcacaaggtgatttcatcggactgtaggatatatgcacttaaaaagatcaagctcaagggtcgtgattatgctactgcatatgggttttgtcaagagattgagtatctaaataggctgaagggaaaggataacatcatacagcttatagattatgaggtgactgacaaggctttgcttgaggaagttatgaaaggctccttcagtaataaagatggccgggtcaaggatgatggatgtatatacatggtgcttgaatatggggaaattgatttggctcacatgttgtctcagaagtggaaggaactggatggaagctaccaaactatagatgaaaactggcttcgattttattggcagcaaattcttttagctgtcaacactattcatgaggaccggattgtgcactcagacttgaagccggctaacttcctccttgtcaaaggctccctaaaactgattgattttggtatagccaaagcaataatgagtgacacaaccaacatccaacgggattcacaggtgggcactctaagctacatgtctccagaagcatttttgtgtaatgaaactgatgcgaatggaaacatcataaagtgtgggcgaccatcagatatctggtccctgggttgcatcctttatcaaatggtatatggcaggacacctttttctgattacaagacattttgggccaaattcaaagttataacagatccaaatcataaaattacgtatgaaccagtttcaaacccatggcttttggatcttatggaaaggtgtctagcatgggatcgcaatcaaaggtggagaattcctcagctactccaacatccttttcttgttcctcctgtaccatctcatccatgtttgccccaagatcatagctgtaaattgctacaacttatttctgaaacttgtacatatgaccctgaagcatcccaactgtgtagtcgcctccaacggcttcttagcgacccacttgagaaaacaactcgctcactaaattcaggagatcaacaactaaaactgctgtcccaaatgtcagaactctgtattcagctgcacgaacgtttgacaaatactgaatacaagtag

SEQ ID NO: 23019 - DNA, 363 bp, Glycine max
  Peptide Sequence Number=SeqID_139797
atggcgggtggtggaaaggtttcgttcaaagtcacactcacctccgatccaaagtttagcgttccagaggcggcaccttttactgccgttctcaaattcgccgccgaagaattcaaagtcccgccccagaccagcgctatcatcaccaacgttattagaactgacttggtgagcccatcatatgttgtgacctttggcatttactgttgcactactaaaagcatagtactgttcattaagaaggaaaagaaacatgggaaagatggtgttggcataaatccccagcagagcgcaggcaatgtcttccttaagcatggttcagaactgcgcctgattccgcgtgatagggtcggtgccttttag

SEQ ID NO: 23020 - DNA, 252 bp, Glycine max
  Peptide Sequence Number=SeqID_139798
atgactataagttgttacttcattgcaggagtgtatccagctgttcaccctctgcttggcttgcaatattatacttgtggaaaactagaatggtatctgggagacacagatgaagctgttaaatcactgatcaaggccgtggatatactacggattactcatggcacaaatacacctttcatgaaggacctcttgatgaagttggaagaagcccgtgccgaagcgtcttacagattgtcccctaaagagtag

SEQ ID NO: 23021 - DNA, 1389 bp, Glycine max
  Peptide Sequence Number=SeqID_139799
atggcttctgagaaggttgagactgttgttgcagggaattacttagaaatggagagggaagaggaaggttctaagtccactactagcaaattgtctaggctcttttggcatggtggctctgtctatgatgcatggtttagctgtgcttctaatcaggcacttgctatccctgctttgattatcttgctactgacactaccatattccttttcacaacttgggatgttatctgggatcatatttcagcttttctatggactgatgggaagctggactgcttatcttatcagtgtcctttatgttgagtacagaaccagaaaggagagagaaaaagttgacttcagaaaccatgttattcagtggtttgaagtgcttgatggacttttgggcaaacactggaggaatcttggtctttttttcaactgtactttccttctgtttggatcagtaattcaactaattgcttgtgcaagtaacatatactacataaacgacaatctggacaagagaacttggacttacatctttggggcatgctgtgcaacaacggtcttcatcccttctttccacaactacagaatctggtcattcttgggcctcgtgatgaccacttacactgcatggtatatgaccatagcttcccttacccatggccaggttgagggggtgacgcacacagggccagccaaattggttctctacttcactggggcgaccaacattctctatacttttggtgggcatgctgttacaccacagaagtttaagatgatatatctgatcgcaaccttatatgtgctgaccctaactttgccatcagcatctgcagtctattgggcatttggggaccagcttctcacccattccaatgccctctcattgctcccaaagactggtttcagagataccgctgtcatcctcatgctcattcatcagttcataacttttggatttgcttgcactcctttatacttcgtgtgggagaaattcattggggtgcatgagaccaagagtttgttcaaaagggctttggctagacttcctgttgtgattccaatatggttcctggcaatcatattccctttctttggtcctattaactcaactgttggatctctccttgtcagcttcactgtttacattattcctgctttggctcacatggttacctttgcttcagcaccggctagagagaatgctgtggagagaccaccatcaaagttaggaggttgggtaggattgtactccatgaacgtgtttgtggtggtatgggttttggtgataggatttgggttgggaggatgggcaagcatgattaatttcatacaccaaattgacacatttgggctatttgtaaagtgctatcagtgtccccctcacaaggcttaa

SEQ ID NO: 23022 - DNA, 2061 bp, Glycine max
  Peptide Sequence Number=SeqID_139800
atggatttaaaccaaatccagttagctttacgctgttgtggacgctttcaagctatcaaacatgccaaatcactccactctcttataataaaacttggcctctcaaatcacatttttctccttaatagcatcatctctgtctacgcaaagtgttcccgattcgatgatgcacgaacccttttcgacgaaatgcctcacaggaacatagtttctttcacaacaatggtctctgcattcaccaattctgggagaccccacgaggctcttacactctacaaccacatgctggaatccaaaaccgtgcaacccaatcagtttttgtactctgcggttctcaaggcatgtggtctcgtgggtgatgttgaattgggcatgttggtccaccaacatgtatctgaagctaggttagagtttgacactgttctgatgaatgccctcttggacatgtacgtcaaatgtgggagcttgatggatgccaaacgagttttccatgaaatcccgtgtaaaaattctacttcatggaacaccctcattcttggacatgctaaacagggtctgatgagagatgcgtttaatctgtttgatcaaatgccagaaccagaccttgtgtcttggaatagcatcattgctggtcttgcagataatgctagcccccatgcattgcaatttctttctatgatgcatgggaagggccttaaacttgatgcgttcacattcccatgtgccctcaaagcatgcggtcttcttggcgagttaaccatggggagacagattcattgttgtattataaagtctgggcttgagtgtagctgttattgtatatcatcattgattgatatgtattcgaattgcaagctattagatgaagcaatgaagatatttgataagaactctcctcttgctgaaagcttggcagtatggaattctatgctttctgggtatgttgccaatggggattggtggagggcactcggtatgattgcttgtatgcatcattctggtgcacagtttgattcctatacctttagtattgctttaaaggtctgcatctattttgataacttgaggttggcatctcaagtgcatggattgatcatcacccgtggctatgagttggatcatgttgttggaagcattcttattgatctatatgcaaaacagggcaatattaacagtgcattaagattgtttgaaaggttgccaaataaagatgttgtggcttggtctagtttgattgttggttgtgctagacttggtttgggaacattagttttttccctctttatggatatggttcatttggatcttgagattgatcattttgtcctatcaattgttctgaaagtttcttcaagtttggcatctcttcaaagtggcaagcaaattcattctttctgtcttaagaaggggtatgaatcagagagagttattacaactgctcttactgatatgtatgcaaaatgtggtgagattgaggatgccttagctttatttgactgtctttatgaaatagataccatgagttggaccgggattattgttggatgtgcacaaaatggaagagcagacaaggcaattagtattctgcataagatgatagaatcaggtacaaagccaaacaaaatcaccattctaggtgttcttactgcatgtagacatgcaggcctagttgaagaggcatggactatatttaagtctattgaaacagagcatggattgacaccatgcccagaacattacaattgtatggttgatatatttgctaaggcaggacgttttaaagaagcaagaaacttgattaatgatatgccatttaagcctgacaaaaccatatggtgctccttgcttgatgcctgtggaacttacaagaatcgacatcttgcaaatattgttgctgagcatcttcttgctacctcaccagaagatgcttcagtatatataatgctgtcaaatgtttatgcatcacttggaatgtgggataatttaagcaaagtacgagaagctgtaagaaaagtaggtataaaaggagctggaaaaagctggatcgagatctttagttga

SEQ ID NO: 23023 - DNA, 300 bp, Glycine max
  Peptide Sequence Number=SeqID_139801
atggcgcgaaaagagtgggcaaaaaagcattctggcgtgggagtttcgcgtgccactagcatgcacggtggagacgttgcacaacagcaattagtcggccttatgcaggaagcattcagtgactgtactcaggttcatatggtttggactgtactgttgcacttgctaagtggcttcccaagaacactgtgctctcctaatttaggtgcccccacttattcaagctttgtaaattgcaactattaccaagcagatattcagttcacttctatggcttggaaagaccaaattggtgcatga

SEQ ID NO: 23024 - DNA, 1044 bp, Glycine max
  Peptide Sequence Number=SeqID_139802
atgctgttgcgcaaccctgcgttgacagcgtcgctgctgtcagccaccacaaagaagctctgcaaccaccgttgttctacacctgctgcattaatggcatcttcaggtgtggcgtgcagtttgctggttttgtgtggcaaatcactggcagagaatgaaactgctaaagctataaagaccagtagcacactgaagcttcccgaggatgaaaaactctcgctcgttttgcattcggagatggataattctgttatgcaaggctttttccaagttcattcctacatggattctctttccaccaatcaatttggcaggcttctcatttggtctccagacttaaattcaacgcacgatatcgtttctcacaacttttgtgagcttcccattggtacagtttccattgctgatgttcagaccaagggacgaggtcggtcgaagaatgtctgggagtctccattaggttgcctcatgttttcttttactatgcaaatggaggatggacgagtcgttcctttggttcagtatgtggtttcccttgctatgacagaggcaatcaaggatatctgtgacaaaaatgggttacccagcatagatgttagaatcaagtggccaaatgatctttacttaaatggctgtaaagttggaggcattctttgtacctcgacatataaatcaaagaagttcaatgttagtgcaggaataggcttgaatgtcaataataagaacccaacaacatccttaaatacaattctaaaagggttctatacaggagcttaccaatttcaaagagaagatgttctagcagccttttttaacaaatttgagaaattttatgatttatttgtgaatcaaggcccccgatactctacatcaccaaatattttgattagtaaggtaattttgagcttcacctattctgttaaatgcaggatttcaaaccctagaggagctttatatcaagacatggttgcacagagaatcattgttaccctggacactatttttcgtgatattttggtgactaacctagcagtcagtgaataa

SEQ ID NO: 23025 - DNA, 1239 bp, Glycine max
  Peptide Sequence Number=SeqID_139803
atgaccaaaaaggtcagccaaaaccaagagcaacagaaaactgagaaacaaccttcatgggtggtgagaggcctattggcttgtaggaatgtgcaaatccaacaaaatcagcaacagcagaaggaagcaaaaccaccctcagaagcaaaagaaaacaggaaaaaacaggaacagagaaagctgcaagaggaacgagtcccagaagaaaacagcaagaagtgcaagaagatgaaatgctcaggctctctttgtaacaacaccaagatcactgcaaagcccgacacagcaaccccagatgttcacaacaaaaggttgttattaagtggatgcaacaacaacgatgcttccagcagatccatgaaagcacctcttaatgagctcaatggaaccgtgtccgctacttcttctttgtcagcatcttcaacttcttctggcggtggctctttgaggggaatgccgtttagaagactctctggttgttatgagtgtagaatggtggtagacccagttctcggtttcactagagacccttctctcaggagtagcatttgttcttgccctgactgtggtgagatcatgaaagctgaaagcttggaacatcaccaggctgtcaaacatgcagtttcagaactgggtccagaagacaccagcaagaacatagtagagataatattccactccagctggctgaagaagcaatcaccagtgtgcaaaatagaccgcatcctcaaggtccacaacacacagaaaaccataaccaaattcgaagagtacagagactccataaaagccaaggccacgaagctctcaaagaagcaccctcgttgcatagcagacggcaacgagcttctcaggttccactgcacctccttcaattgctccctgggtctaaacggctcctccaacttgtgcaactcgataccacagtgcaacgtgtgcagcataatcaagcacgggttcaaggtcaccggaggaggagccggcatcttgacgacggcgacgagtgggaaggcgcacgacaaggcggcgtgtgtggacgagagtgaggagaagagggcaatgctggtgtgtagagtgatagcaggcagggtgaagaagaatattgcagaaggtggtggcatggaagagtatgattctgttgctgctgctgttggggcttattctaatttggatgagttggttgtgtccaacccgagagctattttgccttgctttgttgtaatctatagaggcttttga

SEQ ID NO: 23026 - DNA, 528 bp, Glycine max
  Peptide Sequence Number=SeqID_139804
atggaacggatgagtcaaaagatagatggtgatgctgagagtgagtgtgtttctgaggctggagatattggggatagaactcttcttggcacaaggcacagtgaaggtgatggccttcggttatccttagatagcacaccgaaaaatgaagatgtttacatttcaagggaccatgaattgcagaacatggcaagaaagccaagaagttacccaagctactggactacgttttgtgtctctgatttggctgtgtttgtcattgttggagtcttaaaaggatacttgctgcaaaagttatttggaccaggtgttgctgatgtgactagtgatcagaatattctttacctcgattttccttctaatatggttggctccttttttatgggatggttaggtgttgtatttaaagcagacatatcccgtgtatctgagcatctagccattggactaacaactggatacttagggagcctaacaacgttcagtggttggaatcagaaaatggttgaactcattaattgctactag

SEQ ID NO: 23027 - DNA, 276 bp, Glycine max
  Peptide Sequence Number=SeqID_139805
atggaagaaacatgtagtcgtgctggttttggaaagaaatttactaaggcaaagccttatttgttaacggtgggacttcaatttggtttcgccggaggatacatcttctccgtcgctagtctcaaccatggaatgagtcgttatgtgttcgttgtctatcgcaatgccatcgctgcattggccctcgctccttttgcattaatcgttatgaaaataaggccaaagataatacttcctgtcttcttacagatagtggcagtcggatttgtggagtaa

SEQ ID NO: 23028 - DNA, 207 bp, Glycine max
  Peptide Sequence Number=SeqID_139806
atgtcaggatttacacgtgattctcctcaaatttcagccagcccgcatcaattagaccttgcaccttacgcttcaggcccctacaatgctcaatggaatgccccggggattctccatgacaagcacacgttgcgttcgagtcgtattctcggagaaatggaggtggtgtttgtcattggaagtgcagtaggtaggctttgtggttga

SEQ ID NO: 23029 - DNA, 387 bp, Glycine max
  Peptide Sequence Number=SeqID_139807
atgggtttctcaaaggaacagcttcttgcgcggttaaaggagcttcaggttccattttcccagtatgagcatcctgttgttttgaccgtcgacgctcaggctcaatatgttggacatttggggggtggcctcagcaagaatttgtttctcaaggacaagaaaagcaggttgtatattgtttctgctttagctggtaccaaagtagatctcaaagtgttatctcagcggcttggtttgggaaaaggtggtctcagaatggcacctgaggaggctttaggtgaagtacttcaggtacccttgggttgtgtcactccatttgcacttgtgaatgaatcagcacggtatgcttatgttcttattctgtttgcttggttatgcgatatctaa

SEQ ID NO: 23030 - DNA, 702 bp, Glycine max
  Peptide Sequence Number=SeqID_139808
atggtggtcggaagtgctttgggagcgtttgcagtggcagggccttcctcgccacttttgttgttaagaggacaaaaggttttcaaattcagacccttctcttcttcttcatctgctgcaccttctagaaagctcgtcctctactctaaacccggttgctgtttgtgcgatggcctcaaagagaagcttcatgctgcattcttactctctggcaccgattcacttcacgacgttgatttgcaggcatctctctttctctctcgtaccttggatataactaccaatcctgagtgggaaaacgcttaccaatatgagatacctgtgttggccaaagtgctttccgatggcaccgagttttacaacttacaaggcaaaccggcaatcagtagcataggacaaagagttctcctggtgtttgaaatagcatcctttgatggatgcttttgctggcagtgcttttttgaattcgatatcactattcttcatccttgctttctcgctataagatgcggccctctgatttggactcagcttgttgttaagcactacaatcttataacttttcatttgagtaatcattgtgtccaattgtacttagttgttcaagtttttccattttggtcagatttctcctctccagtctccactaatattagtgtttgcacatcatttggacgtaactattgggtggtcagaggctaa

SEQ ID NO: 23031 - DNA, 864 bp, Glycine max
  Peptide Sequence Number=SeqID_139809
atgaagtatacttcggcttcattcacatctactattgtgaacgctgtgccctctatcacctttgtgcttgcagtcttcgtccggttggagcgtctaagacttgcggagattcggagtcaagccaaagtgattggaaccatagtaacctttggaggtgctttgctaatggcaatttacaaaggtcctgcattcgacctttttcattctgaaagcacaacccatcgtgaaagtggaagcacctcccctcacaacagccaccaaactgctggtgctatttatatactaatgggttgtgtggctttgtcgtctttctacattttgcagtctatgacggtaaagagatacccagcggagctatcattggcaacgttgatatgcctggcgggaaccgtggaagcgtctgcagtggcatttgtggctgaacgtcactcccgagcttgggctgttggttgggattataggctctatgctcctttttacacgggagtagttagttcaggaattgcatactatgttcaagggctggtgatgaaactaagaggccccgtatttgcaacagccttcaatcctctttgcatgatcattgttgctgctttgggctcccttatattaggagaactgcttcatctcggaagtcttattggaggcattgtaatcgcagtggggctttactcggttgtgtggggcaaagccaaggattattcagaacccaaattaccatcagcaaatgcagaagacacaaaatcactgccaattactgcaactgatgattccaaaattgatattatttatgggaatttagaaaaacaaccatcaaccaatcagaaattagaggagaccaacaaagtgggggacgaaaattaa

SEQ ID NO: 23032 - DNA, 748 bp, Glycine max
  Peptide Sequence Number=SeqID_139810
ggttcaagaccgccaacggcgaacagggcgccatcgcagccattaaagtcgacaacgtggtggacaccgtcggcgcgggtgatggctttgccgttggcgtaatcagcgcgctgctggaaggcaaaacgctgacgcaagccgtgaaccgcggtaacaaaattggctcgctggccattcagcgcggcacagcagcgcccgttccggcgggcgtatgtcacctcattgacagaggcaagcctatgaacagttcaacaaatgcagcaaaacgttggtggtacatcatgcctatcgtgtttatcacgtatagcctggcgtaccttgaccgcgccaacttcagctttgcatcggccgcgggcattaccgaagaccttggcatcaccaaaggcatctcatcgctgcttggcgcccttttctttcttggatacttcttcttccagatcccaggagcgatttacgctgaacgccgcagcgtgcgtaaacttatctttatctgccttatcctgtggggcggctgcgcctcgctaaccggcgtggtgcataacatcccggcgctggcggccatccgctttatccttggcgtggtggaagcggcggtcatgccggcgatgctgatttacatcagtaactggttcaccaaatcagagcgttcacgcgctaacactttcctgatcctcggtaacccggtcaccgtactgtggatgtcggtcgtatcgggttatctgatccaggcctttggctggcgtgaaat

SEQ ID NO: 23033 - DNA, 969 bp, Glycine max
  Peptide Sequence Number=SeqID_139811
atgtcagatccattatgctttgatgcactgaaaacccagttaattagagtcttatcctttacaattgcagctctaaatgcatgtgatcttgacaagtttcttaaatcaattggaagaaatccatcatacgttgatttggagaccaatcctacagtggggaaagatcaaccccctgatctagctgcactagttccatctggttccatagttttacccgatcaaccccaaaaacaatcttcttcacaggttcctaaggatgcaaaccatgtttctgtggataatggagccaatacagtttcagctaaagttgtcaagccatcctctggtgggaaaaatacaaaggggacaccagcaaaaaatgttaattcatcaggctcctttgcagatgctgggcaattcgttgaagagatattgcaaaaaacatcacaattattgctttcagaggtcaaggacgaaaatataaagttacacggggagcagctcggtactgtgttatctgacaaattacagaaaaacctcaatgcagagttcaagagccttgctatgatatttaagaacacagcatatacggaagggttccatgctgtgtatgagcaaatatattcaactgcgacaagagggctgccacggaacaatgcaatcggagtgatatatgtgcttgcattgaagctccctcgcttctccacccacttcgagttcctcctgacaaaccggacactgagaattctccttcagatgcgcgctctcgattttcaccgtcggaatcgtctcgatcgccctctccggccccggcgccggacactgccggtcgttttccgttatttgttcgatgagttcgttgagccctggcccgaagaaataatctcgcgcgtcgaatccgcgcgggattgggcttgggccgtgtcggtttgggatgttaatgggctcgaagggttgatggataggtccatgggctggaaagcgatccag

SEQ ID NO: 23034 - DNA, 243 bp, Glycine max
  Peptide Sequence Number=SeqID_139812
atgtctgcatattttggcctaaagacaaatttcttaaatgaacgtgaatcatcaactgatttgaaatatgggaagaatgataatgccacgcagccaaagaacgatcataaactaaagaagccgccggctcatagcacaaacaattgtgatacgctcccaggaatctcgggacaaccaggccaaaggagattcgatggaggttgtttgggtatgatgtacactcatataacccgcatagattaa

SEQ ID NO: 23035 - DNA, 192 bp, Glycine max
  Peptide Sequence Number=SeqID_139813
atggagaaagagtcagagggtggacctgcaaaggataatgcgttttctggattgtggcctcattttcagtggaaacagtcgacatggttgaaggaagatcaggattacgctgtagctccaactattttttggagcacctacatgtaccagccacgtacaatcatgtgtgatgcacgtggtttaattaagtga

SEQ ID NO: 23036 - DNA, 765 bp, Glycine max
  Peptide Sequence Number=SeqID_139814
atggctggtgcaaaaataaaaagcatctctttgcaccctccagattttgctgtcccaattgaaaaattgaagtccatcgtgtcaagtaatacacgtgccattcttataaatactcctcacaaccctactggaaagatgttcactttggaagagctcaatgctattgcatcactttgcattgagaatgatgttctagtttttgctgatgaggtttatcacaagttggcatttgatgtggagcacatttcaatagcttctttgcctggaatgtttgaaaggacagtgacaatgaactcaatggcaaagacattcaacttaacaggatggaagattggttgggccatagcaccctcacacttatcatggggagtgcgacaggcacacgctttcgttactttttcgagccccaatgctctgcagtgtgctgctgcagtagctcttagagcaccagactcttactatgtagagctgaagagggattatatagctaagagggctattttggtggaaggattaaaggccgttggctttaaggtattcccacccaatggaacattctttgtgttagcagatcacacccattttggaatggaaaatgatgttgcattttgtaaatatctgcataaggaggtgggggtggtggcaatcccttgcagtgtgttttgcttgaatccagaagagggaaagaatctagtcagatttgttttctgcaaggatgaggaaactcttagggccgcggttgagaggatgaaggagaagctttga

SEQ ID NO: 23037 - DNA, 330 bp, Glycine max
  Peptide Sequence Number=SeqID_139815
atgacccgtctaaatgttgcgaagcgcttagagaagttccaaagagattggggaggtgcaaccaaccagaaagatggaatcataaaccttggacgaggctttcccaactttgatggtccagaatttataaaggaagcagcaattcaggccatcagagatgggaaaaatcagtatgcacgaggttttggagttccagaactgaacattgctattgctgatagatttaagaaggatactggaatagtggtagaccctgataaggaagttactgtcacaaccctacttagaagcaattgctgccactgtgctaggattgataaatcccggtga

SEQ ID NO: 23038 - DNA, 237 bp, Glycine max
  Peptide Sequence Number=SeqID_139816
atggtttatgattttgttgttgtctacttgtctgtctctgacattatagctgctaagtattcatgtttaagtgctaagattcctggctcggaatcgagaggttgtgctcggaaaaatgcttgtgttcaacaactgggatcaagccgtttgaagctcatgcaagctgaagatgctctttcagcagagtctgatccacgacatgcatggcagaatttgaggcatcagaaggtaatataa

SEQ ID NO: 23039 - DNA, 147 bp, Glycine max
  Peptide Sequence Number=SeqID_139817
atggagaattggcgaacagcgctaggcaatgacattcgcggggctccagactcaaaggtggaggagaatggagaattggcgaacatggctacgcataacttcgcggggctccagactcgaaggtggagggtgcatgaacaacgctag

SEQ ID NO: 23040 - DNA, 150 bp, Glycine max
  Peptide Sequence Number=SeqID_139818
atgactaatgacaacagaaagtatgtggttggtagcacaaagaaacacgctagacgaatgagcatgatgaaagctggagttgctgcacatgatgttcaacgttatgtcaaggaatcagattggggctgcacaatgcacaaggcaagataa

SEQ ID NO: 23041 - DNA, 1013 bp, Glycine max
  Peptide Sequence Number=SeqID_139819
atggatcaagttcaacgtgcatatgggaagatctgggatctggcgatgatagaagtgttcgtcgaagccatcacatctctcactcaatactacaaccaatcactcagatgcttcacttttggggactttcagttagcaccaaccatagaggaggataccaaggaagcgcttggaggagaaggcagaagctctagccagctaaggagaatgggcaacattcatcaacttattagctctgctagtgtttgggatgcggtgatcgatgcctttcttgcttatcaccacaacaaggaaagcccaaccattactgttctggcatatgcatatgatacattcgacttgaggtgcgagaagagcagtgcaaggattgtctattgtatgcctgctctttatggtaaagtgaattgggaagaactcttggcaggagtgttatgctcaagcaaaggaataccaaatgtcgacttgatagggatgaggggtggtttcattgaagctagtgcgaagatacttcaaagagtccgtaaagcatggaatagagtggaaagaaaagataaagagcttaggggaagtagcaatggcgtcataggcgactatcacaaatggttgaagtctaaaacacaagggataacttggctcccaaagataaaaggtctgagtgggaaagaggttgaaattcctgaggagagtgaagaagtgcaagctttgaaagctgagctcgaaaggacgagagtggtaaaggagaagctgaaggtggcggtcactagggtcaggaaagaatgtgatgagctgaaagatatcaacatagccatgggcagcagtaatgagctcaaacttagaaaggctgagagggaaaaatcaaagatggaaagcatggtgttagaggataaattgaagagttatcagaggtcgaaaaggagtttgatagagcggttgaaccaaacgaaagagaatatgttggtaatcatcgatcaatatcaagaaaaggtgaaactagccgctagtcataggcagat

SEQ ID NO: 23042 - DNA, 468 bp, Glycine max
  Peptide Sequence Number=SeqID_139820
atgggacatgtatgtgaagaaaggctacacatgtctctagatgagttttcttttaatgctgaaaatggtagcaacagggaaaggatgaggaggaaaaactatgactatgacacacaagtgttcaaatccaagaaccttgaggtggaaaggagaaggagggagaagctcagtaccaggattttgctgctgcggtctttagtacccatcatcacaatgcaacaaccacttgaacttcacttaatgaacaaagcaaccattgttgaggatgccatcacctacatcgaaacccagcaaaacatagtccagagtctcagctatgagcttcatgaaatggaagcaacatcagaggaaataaaaccaaagaaagaagaaattgatgctgcagaagagatgaacaaattggggatagtacaggaagagaggtctaggcgacaaaaattgatgggaacaaactgtgggtcaagatga

SEQ ID NO: 23043 - DNA, 589 bp, Glycine max
  Peptide Sequence Number=SeqID_139821
atggctccatttagaccttgtgttgtgttcaacactgttgcagaagacacaagaagtcacaaaatgtatcacgttcttaaccgcgctttctgcaccgccacagagcccgccaccaccatcgccgcttccatcaggtccatttcggaggatctgtacaaggaagtgaagctgaagaacgtggtggagaagttcaagaaagcctccgacaacgaccgcttccgcaaaaaaaccggcatctacgaggacaccgttcggcgcctcgccggcgcccggcgcttccggtgggtccgcgacatcctcgagcaccagaagcagtactccgacatctccaacgagggcttctccgcgcgcctcatttccctctacggtaaatccggcatgaccaagcacgcgcgcaaggtgttcgacgaaatgccgcagcgaaactgcagccgcaccgtgctctccctcaacgccctcttggccgcgtacctccactcccacaaatacgacgtcgtccaagagcttttcagggacctcccaacgcagctctcgatcaagcccgatttggtgacttacaacaccatcatcaaggcgttttgtgaaaagg

SEQ ID NO: 23044 - DNA, 528 bp, Glycine max
  Peptide Sequence Number=SeqID_139822
atgttgtctctgacaccaagatcttctgttgttccctcacacctcattcttctccttcttcttattcttcttcctctcacagggtcagcagcagcagtggaagaagagaattcttactcttctgatcttcacagggtgctccacagccatggcttgccagcagggctcttccctcggagtgtcaagtctttcaatttggaccagacgggtcgcttggaggtgcacttggatcggccgtgtttggctcagtacgagacgagggtgttcttcgacagtgtggtgagggctaaccttagtttcggacaactcaaggtgttggaagggatgtcaagggaagagcttttcttgtggttgcctgtgaaatatatcttagtgaccgatccttcttccggactcattgttattgatattggtcttgcttttaaacatctctccttgtctcggtttgaagatcctccaatttgtaaatctcattctggtactacatcatgtcctttctctctactacctctaattggatgtcattaa

SEQ ID NO: 23045 - DNA, 3873 bp, Glycine max
  Peptide Sequence Number=SeqID_139823
atgttggagaagatcgggttgccgccaaagccttcgctgcgagggaatacttgggtggtcgacgcttcacactgccagggatgttcctctcagttcaccttcatcaatcgaaagcatcactgtaggaggtgtgggggaatcttttgtggcagctgtactcaacaaagaatggttttacgtggacaaggtgattcacctgtgcgtatttgtgaaccttgtaagaaactagaagaggcagcacggtttgagttgcgacatggacgcagacctgggagaggaagcttgaaatcagcacctagagatgaagaagaagttttgaaccagattcttggtcaagccagtggcgaagttcccagcagacaaagatcaattggcattgcatcttcttcgagtaattccaattttgatgaagacatacaaaaaattgtctcaaatgacaagcctaatgttttgggtattgatttggaatccaccactccagatgagttacgtaagcaagctttggaggagaagaagaagcataaaattctgaaaggagaggggaaatctgacgaggcgttgagagcttttaagagagggaaggaacttgagaggcaggctgatgctttggaaattcaattaagaaagtctcgtaagaagagtttgccttctggaaacttgtctgacatgcttaacaaaggcattcctgcagagtctgacagaaaaacaaagtcactttctcatgtgggtagagtaaaggacgatcttacttctgaacttagagagctgggatggtctgatatggatctacataatgaagacaaaaagtcatcaaacttgagtttggagggtgaactctcatcactgattggagaagtctttacaaaaactggtgaacaaaagggcagcaagattgacaagtcccaagttgttgctctgaaaaaaaatgctctaatgctgaagcgcgagggtaagcttgcagaagccaaagaggaattaaaaagagctaaaattttagaaaaggaactggaagaacaagaactccttgctgaagctgaagattctgatgatgagctatcagcattaattcgtggcatgaatgatgataaagaattatcaaatctgcacgatcatggggatggttttgattttgaacgccttttggccattcctgatgaccttcacggtaattttgaagtgaccgatgaggatatgatggaccccgcaatagctggtgctttggaatcattaggttggaccgaacctgaaaatacatcttcccagtcacaaacctttgacaaagaagaattgcttagtgaaattcagtctcttaaaagagaggctcttaatcaaaagcgagcaggtaatgccgaagaagcaatgacattcttgaaaaaggcaaagttattagaaaggggtcttaacagctctggacctgaagattataatactatgtcacaaaaatccactgctgtaaggaaaggtgtgagttctgaaattgctggtaatggatcagactccattcaattagatgagagaaataccagtgccactaataatgttgcttccagagtggcaccaaaaagcagattgatgattcaaagagagcttttgagtttgaaaaagaaggctctcacattgagaagggaagggaaaatgaatgaagcagaagaagaaatgcagaagggtgcagctcttgaacgtcaactgatggagatggacaaggcttcgaatgttacaatatcacggacaaataccactgataatgtcccacatacagcacatatggaagctgatttcagtagaaatctgccacttgaggaaggaagtgaagatgacgtaacagatcaagatatgtctgatccaacatatctttcattccttagggacttgggttggaatgatgacaataatgatctttctaattctccaagcaagcctttgaagaaagatgatgatcattttgtgcctgtcaatgatgcttcattaagtaagcattctacaaatatcttggttcaagcgccaagaagtaaagctgaaattcagagggaacttttgggtttaaagagaaaggcccttgctttcaggcgtgaagggaaagctgaagatgctgaggaagttcttaaaatggccaaagcattagaagcccagatggcagagatggatgctgcaaagagtaaagcacaggttgaggccactgtcatgaaagacagacttttcaatcctccagttgatgaagaaagggacatggttgtttcagaacaggatatgcatgaccctacattgaattcaatgcttactaatctaggttggaaggatgatgaatctgaacctatgactataaaagaagagccagttaaggaagctactgttaggtctaaacatactgtggatctatctgcacttgattcctcttcaggcattcctgctacagctttgagaagtaagggagagattcaaagagaacttttaacattgaaaaggaaggcacttgctcttaggcgcaagggagagatagaagaggcagaggaaattttgaggcagtccaaaactttggaagcccaaatagaagattttgctaaccagaacaagtacttgtcacttaatgtttccatggatgaacaatctgttctgtctgaatcatcagtcttccaggaaaggcttgggagtttgggagttgctactgaagttgataatgcttcagcctcatctgtggtttggtcaagtaagaatagttctgaatcaacatttggtttagaaagaatcaacaatgagacaaatattgccatcttaaggaagtctaataatttaattcctgcaacctctcactttgcagatggtaagcattcattatctgccgacgggagtacttcaagtgaaaatctttcaaaaaagatgaaagcagaaaaaatcattggtcatagctcctcagctggccactctatggatatggtagatttacttgccagtgatgatagtaacatgtctgaaatatttactcaaaaacataaagaatataaactttgttcagctaattcatctcaagctgatcctactattcatttggacacttcagtgaattttaaccaagatcggggattcaaaaacagtgatacaactcaaaaaagagaagtgattgatgcaattgaaaagccaaacataaacaagccaaatgctgttcaggataatgcttctcagcacctccttaccttgcgtcaggaaattttggctcataaaaggaaggcagttactttgaaaagagaagggaaactaacagaagctaaggaggaactccggcaggccaagctgttggagaagggcttggaggatggaagtatgcagccagacactgcttctgcctctgtgaagaatgttgtacaaaagaaacaagaattgtcaaatgttagtgcaaaaccattgagtagccgtgatcgatttaaattgcaacaggagtctctagggcacaaacgtcaagccctaaagctacggagggaaggccgaatagaggaagctgaagctttgtttgaacgggcaaaggcaattgaaacccagttggaggagttgacagctcaagattccaataaatcagatggtgtagatgatgtgactgttgaggattttctcgatcctcaactcttgtctgctctgaaagctgttggacttgatgatgtaagtgttgtgtcaaaagccccagaaagagaagagactgtgaaatccaatgctaaagttgaaaactctaaccaagagagaattcagctagaagaaagaatcaaagaagaaaaagtcaaggcacttaatttgaaacgttctgggaaacaagctgaagccttagatgctcttcgacgtgccaaattgtatgaaaagaagctaaattcattgacatctggttcatga

SEQ ID NO: 23046 - DNA, 1896 bp, Glycine max
  Peptide Sequence Number=SeqID_139824
atgtcgaagaagaaagttagcggcaacaccatgacgctgaaggacttccatggcggttctattccctctgatctccctctaccttctgctcctggcgtgactgtgaggacttcagatcgttctggttttgatcggccgtcggcgtgggggatgccgatggggcgatcggatcattggtctcggccgcacacgtcacccgcgactagacattatgatgacaaaaccccgtttctgtctaacactgccccaattggcaggaattttgatgaggatgagaggaagccccttgatggtggttcggtgccgcgtaggacaatcagtgatgagagcatccgtggtggtccacctcctcgtgttgaggtgaggccaccggagtatggactgggagggagttcattgggcaggcaagtggctccagtgtctcaaactcctgttggggcaggcaattcatactctgcaaggctcactgaagcggtgcatgtgggaatgaatcctctaagtttaggaggtagtaaggagcagggaactgcaggtgatggtggtggttatccgaatgtgtggtcaatgaggaaagaagtggcaagtgctgttgagccagagcaaccggcttggtctagtgctagtgctgcttccaagttggctcatgcgagtgctcttgagaaggtatcttctggtagatggcagtcaaaggctgtacattatcagacagatgctgaggtggttagatctcctgaattggagaatagaccacgtgttaatggcgttggtgcctatagtaggatggatgcagtgggtgaaaaggagtattatgatgcaatgctagctagacacactgaaaggggcttaggcattgataatcagatgcaaggtggtaggaatgagttactaaattatgaaaggtccagggtttcccggtattcagatgtacgaccgacaagtgcacctcatcactctggtggggttcagctggctcgaaatgatggcaaaattgttgggtctgatttgcagcaccgtatgccttctgaaccaactgagcgacataaactgaagttgctaccaagggcaaagccagtggaaagttcagaacctgctgtcatggattatgcacagggtaatcgtcatgttaatgattctggccatgttgaaaccgtttatcaggcccacggccatgccaattttgtgaagcctgtatcagctgggactgacagtgggaaagactcaggacagcgcccgaaactgaatttgaagcctcggtctcagcccattgaacagctggacggaaacagtgaaagagacaggaatgttttatttggtggagctcgcccacgtgaactaggatatccggtattgaaggagcgagggattgatgatgttgcaatcaacaattatgatgtggttgagcattcaaacagggttgaaaacaatatttcgagggttgagaaacttcctgaccattcaacccagactcgatatggtgaaaagactgaggacgctcatcttgatcaaaagacaggcagaaaacccgaaagaaaggagcaaagggtagatggtgaaagggctcatgcacagaggagaaattggcggggtgatactcggagaaacgggaaggagagcaataggcagccgccggcccttgagaggcaaccttcacctgagacatggcgtaagcctgctgagcagcagccaaaatcagctccaggtgctgctggcacacggtatggtagagcagcttcagcggtcgaacttgcacaagcattctccaaatctgtatcagatccaaaagtaaatgataagttttcaggtcaaaggggtctgaacactggcaacagcaggacacaagtgccattttcacggcttgttggtcctacatcaagacctcagatcaatggttattaa

SEQ ID NO: 23047 - DNA, 262 bp, Glycine max
  Peptide Sequence Number=SeqID_139825
atggaggagcctccaatggcggctccgaggacttttcagacgcaatccattcaccttcgtgatcaacattctggcaatgtctccaacgcttccggcaatggccagtttagaatgtgccaaggaaggtcacttgattcaaaggcattttatagtggaaatgaaggtgccgatagcttcgccaagattctatacaagcgtcatgggagtctcgttggagcttccatcagagcgtcgggagagggaggaacacaaagaaatataa

SEQ ID NO: 23048 - DNA, 225 bp, Glycine max
  Peptide Sequence Number=SeqID_139826
atggggagcaggaacaacaggaacagcaacacgattaagattgatgtcgggtttgaggtgcgaaaccgaaaggggggaaagaaagtgaagaagatggctgcggatcatttgattggaatgaaatttggaatgggtatacttgacgattgcaattttctccagacccccggaaaaagcatgaaaaaaaggctcgaatggtacgatcccaccgtcaccccagaatga

SEQ ID NO: 23049 - DNA, 660 bp, Glycine max
  Peptide Sequence Number=SeqID_139827
atgtcacataattatctatgtggcattgggtacgactcatcaaccgatgactacatggtggtgattggacggttgggcaaggagtttcattatttttctttgagaactaattcatggagtagcagcgagtgtactgtcccgtatcttctcaagcatggatctggattcaggaatgaagggttgtttttgaatggggctcttcattggttggttgaatcctatgataatctccgcataattattgcgtttgacgtgatggaaagaagatattcagtggttccactgccagataatttagctgttgtattggaatctaaaacatatcatttgaaggtgtctgaaatgtgggtgatgaaagaatacaaagtgcagttatcttggaccaaatcatatattctgtctactaaaaactttcctctctcctatcacttttttcccatatgtttcaccaaaaatggtgaaattttggggtcaaatagtagtaataaattagtgagacttaatgacaaaggtgagcttcactcacatggagatgagaagaggagatttgattatatacgagattctgtcatgtatagagaaactttgctatcactcccgggaggagactatgagaaaccaagtgtcgtccctccactgttaagaagaaaaaggttctga

SEQ ID NO: 23050 - DNA, 369 bp, Glycine max
  Peptide Sequence Number=SeqID_139828
atgtctcctaaaggaaaagataaaaactctccagcacaacttgaattggaatcagaaatgtctcagacctttcagtttactcttggctacagaagccttaacatgctccatatgacaggaatctttcagaggtccattcaacccagagcaggagtcattggctgcaaatttagtagagcaagagcaaataagaggaagcggtgcctcttcaagagtgtcgaccaactgcccagttcatgctttgcaaactgcctcctgaaagatggtgacttcgaagacgacaaaatggactctagaaccatgacttctacaatgacttacttaggactgctcagccagaatctgtacaacatgtcaatcgaacattag

SEQ ID NO: 23051 - DNA, 504 bp, Glycine max
  Peptide Sequence Number=SeqID_139829
atggaagtgcttcgaggagaacgaggatcgccccgccaagcctcgttgctttggcgtcaccgagattcgaagaccccactacactctcttctcccacaaccttcttcagaattgaagactgaggatatttttgaatctgtgggagactatgttgatgggttgaagttttctggaggttctcacagcatgatgccaaaggctactatcaagcaagccattgacatggcccatcagcatgacgtgtacgttagcacgggtgattgggctgagcacatggaatacaagcagttggggtttgacacaattgagctcaatgtgagttcgcttgagattcctgaagagacctttttgagatttatccgcttggtcaaaagtggtggtcttaaagctaagcctcattttcaagtgaagtttaatgagtctgatatctctcctttaaggaggaacttaaacatatttaggccttgtggcagaggctatattctggaatctgcattgtactag

SEQ ID NO: 23052 - DNA, 282 bp, Glycine max
  Peptide Sequence Number=SeqID_139830
atgaaaaatgtagaatcaacacaaacacaaaatattggttcaccatccctttataacatgcgtgcggatatcattgccaagatcatagggcgccttggtattgagaagactatgtttgaagcatcaaatcagagaatatccgagtggttcatcaaacaatatggtccaaatgtgaacctctttattgatcattggaacgtggtggatgtggagtgcctcaggggacgcaacttgggtaaaaatcttgcttctgtccttggttcttcagatttcctgttctga

SEQ ID NO: 23053 - DNA, 612 bp, Glycine max
  Peptide Sequence Number=SeqID_139831
atgaaaccctccaacacagacagggagcttcattctctcatatcctccaaccaagttcagttcaaagacacacttcggtcttctcttacaaccaccaccaccactagtcctcaattaaccaactacttttcctccaactccgacaacaacctacgaatcctcatcggcatcctcacactacccgaccagcacctacgccgcaacctcctccgcctcgtctacggcacgcagccagccccacccggcgccaaaatcaatgtaaagtttgtgttctgcaacctcacaaaggaggaccagaaagttctagtggcccttgagatcatgcggtatggcgacatcataatcctagactgcaaagaaaacatgaacaacggcaaaaccctaacctacttctcaagtctcccggagatgttaaacgacacggcttcatcgtaccctccttatcactacatgatgaaaaccgatgatgacacgtatttaaggctgaacattttggtgcagtcgctgaaaccgttgtcgagggaagacttgtactatggttatgtgataccgtgtcgcagcatagaccctttcgtgcgctacatgtcggggatggggtacttggtgtcatga

SEQ ID NO: 23054 - DNA, 162 bp, Glycine max
  Peptide Sequence Number=SeqID_139832
atgtgtagctctctttgtgtaggtacacgaataagccagtgcatgaaatcaccaagagtgcctctttcctcaaaggtggtgaagctgagtgattcaacagcaaatgcaagaatgtggttttttcttcttcattttcttatcttcaatttcaccatgcattag

SEQ ID NO: 23055 - DNA, 435 bp, Glycine max
  Peptide Sequence Number=SeqID_139833
gcattgatcacgggcctctgccagtcattcggggttcccgtcacccgtagaaaggtgatccgaccgccgatcacccgggccttcattgagaagtattgcacgcttaggcaggcacagggtgatgcacctcaggccgcagacgcaccactaccacctcatcaagctgatctcactgggtcactaggcatggagcgttatctacagcacttggttcgccagcaggcggccaaccaccgggggcagggacagggtatcgctccttttgtgtgccctactccagagcagtttagggctgaggtcgcatggcccggagattggcccgaggcccaggcaggggaggcgcctgccggatcccccggtgatgcagaggaggcccgtatggatgaggagatcacgaacttgctcggtttcttaggaggaggcggagccacgtga

SEQ ID NO: 23056 - DNA, 252 bp, Glycine max
  Peptide Sequence Number=SeqID_139834
atggccgaccagcaggcgactaagtccaaagccaaagtcatcacccgtccggctcaagacgttaaagaagcgctactaggaggcaacctagaattggctacgaagaagctccccgcgaagcggtccaggaagggcaccattgaaaaggattccactgtggcctcacaagtcgacacatgctttgacaaacatcgatcaaagcgtggaagatcaatagcgtttcaaggccatcaaaggatggtcattccttag

SEQ ID NO: 23057 - DNA, 360 bp, Glycine max
  Peptide Sequence Number=SeqID_139835
atgaaaaccattcaaacaaaggaagaagcagatgccactcgaagcaaagcagggtgctcacttacactctacaatgggggaaatcacgacacgatttatgaccagaaagcacagaaagaagcaggtttgcccacatacctaaatcgcgacagtgaggaacacgaactcgaatgggaactgctgcaaactcgaactcgaactccaacaccaactcgaacgggaactggtgcgaactccaacttgaacatgaacaagaatggcaacttcaagaggacaaataacctaagcgatgaggaagaaatggagaaagagttttggttactaaacgcatggagggaaaatggattttcagggttttag

SEQ ID NO: 23058 - DNA, 255 bp, Glycine max
  Peptide Sequence Number=SeqID_139836
atgaagcatgatcgcgaacaatgtttgaaatataacagcttactcctgtttgtattgctgagcagtctgcacctcaatagccacaagcatagtcaagagcaacctgtagagcaatgtctgaagctccctgtaagtgaagatgatgaattgggtgatgctactaactctgcaacaatggggaatgatgtagactcaaacagtggaacagaggatgacattcattcttcaactgactttgaattctacttacaatga

SEQ ID NO: 23059 - DNA, 252 bp, Glycine max
  Peptide Sequence Number=SeqID_139837
atggaagaagaatcattttttgctactagtgccaaagctgtggacgacaacattgttcgtgaggttattattaatctcacaaacactagtgttatgaatgaaattctagagttgtccaaaacagctcaggctgatgagattgttcatcaagagaaagaaccagcgtctaaacagtccactgataattgccttaagaacattattttaatgaccattttatgggcaattatgttaatatttgaatacatttaa

SEQ ID NO: 23060 - DNA, 648 bp, Glycine max
  Peptide Sequence Number=SeqID_139838
atgaacaggaaaactatagtatccaaggctctaggagcaaaggtggtgctttccagtgactctatagacaaggccacaggctgccttgatgaagggagcacataccatgaagggtgggagaataactatgactccaatgttgcaagagcactttacaaggaaaacatagaaaatacaggtgatcaagagaccatcgtctataacttgatgtttgaaagggaaaacattcttaacaagagtattcttcacaaagtttggtcgaagacaactctgtctgatctacataagatggacaaagactctaatcacaccatcatagccaaaggttcaattgttgctaagcagaaaaaatttagcaaaactaacctaaaatctatgaagaaagaaaggattgccaaactagcagctacaaccaaagatgttgtcattttgtctgttgttccaagacgagtcaagactagagccaccaaagctaatcccaagattggtgacaaagattgttatattcctattgttggagacaaggaatatgctcctctatcctcattagacaatgagtctactgaagatgctcatgtctttccactacggcaagcgtccattcactgcaacaaaaaaaacgtctacctctatctctcacacacctag

SEQ ID NO: 23061 - DNA, 1188 bp, Glycine max
  Peptide Sequence Number=SeqID_139839
atgatcatcatcaaaacatcaaagccaattgcatctacacactgtgttaggcatgtatggatctgtcaagagtggccaaaggtgaaacttgtaagccattatggccacgtgctaccacccttactcatccacgagttcgggcttatgtggaccaatcaaggcagacccattgatcatgttccatcactctttgacagagaggcaatgaagatcttggtgatgactcatctaagcattccaacagagacaaaggcttctgtggtgacaaacgcaggtgctagagtgaggttaatgtggctagaagacctttatcaccgctatgttgagtcaaacccttatgtttgggttgcgatgacttatcccttgcacttgatcaatagtaaaatacttgtcgacaagtcctcgactcacgttcatattgcttacctccaatacctcgacaacctagatacttgccacgagtacgcatggagaataggtgtactagcgtacctatatgaccatctatcctatacaagccaatataacaacaagcagtgtggaggttatatgacattactcatgtcatgggtatttgtgcatctacccattgttggctactcaaaggcaaaggattatgttgtggacaacctagtagccaccaaatggaagccattgaaaagttctaggcatgccctttcgatcagggaaagactcgatgacctacaaatgaatgttgtcatgtggtgttcatatgagaaccatagggcagtgaggcctttcacacaacaatcatttttctctggcttcatcaaatgcgagactaacgttaggtcttatcattcggagggggtgctgagctttgtgatcaggcgtgagtggagtaacaacaacatatcattccccttagcaatgttatgccacctaggagtccttaggattgcacctatgactatctgccttggttttacaaggtttcccatccctatgtcattccattggaggagggacaaccaccatgtggtcatatcgatgttggatagcattagaagctatgcaaaacttgttggatttcaaagtcgtgccaaaaggcacgagttatcatcaggtcatacaacaagctttagaattgttgtaggagggcttagcaactgggtgcctaggaagagtgttgacaaggatggtggaaaaggtagtggagacggttga

SEQ ID NO: 23062 - DNA, 217 bp, Glycine max
  Peptide Sequence Number=SeqID_139840
gatattattagggattgctttttccttgctgatattaggctcctcagccaactcaagatcaagagaatcgtgtgggatatcaaatcgtcggtttctatccattggagggattctatgcttcattcacggcttgttcactattggttattatgtttctgtaacggcaacaagaagggaagaaaagaggcaaggaaactcctttgtaggccacacttaa

SEQ ID NO: 23063 - DNA, 1491 bp, Glycine max
  Peptide Sequence Number=SeqID_139841
atggtggactccatccaaagattaggcatcgagtaccattttgaagaggaaattgaaactattcttaaaaagaagcttctgatgcttagagttcacaaccatcaaggaagggcttatcaagaactatcagaagttgcacttcaatttcgtctgttaagacaagaagggtattacatccatgcagacatatttgataagttctggggcaatgaaggcaagctcaaactaacattctgtgatgacataaatggattaattggcttgtttgaagcctctcaattaagcatagaaggagaagattatcttcatgaagcagaggaatgctgccgccagtatcttaatacatggttgagtagatttcatgagcatcctcaagtgaaagttgtggcagattcattacggtatcctattcatagaagtttgtcaaggttcacaccgacaaactctttacaaatagaaagtacagaatggataagatctttacaagaattgtccaaaatagacaccgaaatggttagctctttgcatctgaaggaaatgtttgcagtttccaaatggtggaaagaactaggtctggcaaaggacttgaagttagctagagatgaaccaataaaatggtacatgtgggcaatggcatgcctcccagatccacgattctcggaagaaaggattgaactcacaaaaccgctgtccctagtctacattattgatgatatatttgatttttgtggaaatattgatgaactcactctctttacagaagctgtcaagaggtgggacatggcagccacggagcaattaccagactacatgaaagggtgctttaaggccctttatgacattactaacgaatttgctttcaagatccaaatcaaacatggatggaatcctataagcaccttaataaaatcgtgggtaaggctcttgaatgcattcctggaagaagcaaaatggtttgcttctgggcttgtgccaaaggcagatgattacttgaagaatgggatagtgagcactggggcgcatatgatccttgttcactcattctttttcatgggtgacgctataacccaggaaaccatcactctaatggatgaattcccaagcattatatctgccacagccacaattcttaggctgtgtgatgaccttgaaggggaccaggatgttaatgttaaaggtgatgataatgatgggtcgtatataaagtgttacatgaaggagcacccagcaacttctgttgaacaggcacgggagcatgtcgctgaattgatttcggatgcatggaaacgtctcaaccaagaatgtctcatgacagatgcaaatctgttcccatcatctttcactaaactttgcctaaatgctgctcgaatggtacctctgatgtacggttatgacacaaatagcccatcgaagcttgaagagtatgtgaaatcattgctttgtggtggtgctatgcagagtattccagaagaccagaccattgtttcatga

SEQ ID NO: 23064 - DNA, 1470 bp, Glycine max
  Peptide Sequence Number=SeqID_139842
atgaggattattcacagcctcgcatgtttggttctcaccttcatctccttcaatccttgtaaagcagaacaagcacaaactattttgaattccctcagcattgaccaaatcctacagaaaatatatgaatggggaaatggtgcacaagggttccaagaaggccagattcaaatttcaggccctatagtggtggcaggagtgctgtgtttcatagcttcttcaatatctagtgctggtggaattggtggtggtggacttttcttaccaatattaactattgtggctggcctagacctcaaaacagcttcaagtttgtcagctttcatggtcacaggagggtcaattgcaaatgtcttatgcaatctttgtgccacaagtcctaaatttggtggcaagtcattgattgactatgacatagcacttttgtcagaaccatgtatgctgctgggagtgagtgttggagtcatatgcaaccttgtcttcccagaatggttgattactatgctgtttgctgttttcctcacttggtctacctcaaagacctgcaacagtggagtgctgttttggaagattgagtcagaagagagaaggaaaaatgatggatttgaagggcttgaaaaaggactattggaagatgggagctctgaagaaagggaagagagagttcaggtgaacaatgaaaaggcagggatgaaaagtattgaagaacaagttatggttcctgaagaaaatattaggatgaggataccttggttgaaattggtggtcttactcttggtctggctctctttcttctccctctatcttcttcgtggaaacaaatatggacagttttcaaaatgcaagattgctcagaaagttggtgaagggtggtgtaagagtatcattccaatggagccatgtggtgtgggatactggattctttcatcagctcaagtccctcttgctttatttttcactgcttggattgtatatagaaaagaaagccatcaagaccaaaatctcatgcaagaggatccatgcctatcctcaaatggaccatcaaacaagcttatttttccaatgatggcactgctagcagggatattgggtggtgtctttggaattggaggtggaatgctgataagtccacttcttctacatgttggaatagctccagaggtgacagcagcaacatgttctttcatggttttcttctcatccaccatgtcagccttgcaatacctattattgggcatggatcacatagagactgccctcatcttggccctaatatgttttgttgcatcacttattgggttattagtggtgcagagagcaattcaaagctatggaagaccatccttaatagtattttcggttagcatagtgatgactttaagtattgttctaatgactagcttcggagtcattcgaacttggaaagactatacatcaggtagatacatgggattcaaactaccctgctga

SEQ ID NO: 23065 - DNA, 564 bp, Glycine max
  Peptide Sequence Number=SeqID_139843
atgtcaaatgagaagggtgcacctcatgctataattgtctactccactagttcaggtcctaccccactcaactatgctcatccctctgctatgactagagatcaagtccaagatatgataggtcaagcaatggattccttcattgaacgacagaggcaagaaaatgagcaatttaggctttcaatgcaaaattccatcacaacgcagttctccaactttagtgttgttctactccaaaatctacaaaaaactcaaatgactatcttaggagttgttgttgcccttgcatctattgttgcccctgcatccccacctctcaaccatcaacccccacttattgaaccaacaccaccatcttcaccacggagctttaaaccctcagagcagttttacaaagcattttctacgttctctgtttcattttctctgatgctcgagaatcctaatagagcaatcggaagagtagctctagagagcatcgaaaacgtcgccattgcaaatggagaatgcttgagtgactacatcgagtatgattccgaaaattattcaagtgttggagtttga

SEQ ID NO: 23066 - DNA, 135 bp, Glycine max
  Peptide Sequence Number=SeqID_139844
atggcctcaatcattgtgtccatttgctctttcatggcctccatgtcggccttcatcttctcttgtacctcctccgctttacccattactctagctctagcacgggttcgaggaaaacgcaagggtcacgcatga

SEQ ID NO: 23067 - DNA, 183 bp, Glycine max
  Peptide Sequence Number=SeqID_139845
atgacgaaggaagtgatccacggtcacaactctgtagtgccttggccccacttttcttcttctatgtttttctctcagctttcagaaaaagccatttactgcaagggaaactcgcctaggcaagctgcttgcttagggctgaaggtatcagctcgcccaggcgagtggcttgcttggggttga

SEQ ID NO: 23068 - DNA, 657 bp, Glycine max
  Peptide Sequence Number=SeqID_139846
atggcgaaagatgcacctgatgcaccagcgcccaaatccatgtcgcaatacttgtccgtgctgaaagacaaagatgcctggtggtttatgtttttctacagcgtcacctttggtggttttgtcggcatggcctcctctttgaccatttacttccatgaccagtatggcctggatcctgtgcatgccggttactttaccgcagcctgtgtctttgccggctccctggtccgtccatttggtggcctgctggctgaccgcatcggtggcatccgcagcctgagtgcgatgtatatcctggcggcgctcttcttgtttacattgagtgtagggattgagacgcaactcatcggtttaggggtcgtgatgttggccatggcggcattgggaatgggcaatggggccgtgttccagttggtcccacaacgtttccgcaaagagatcggcgtcatgaccggactggtgggcatggctggcggcgtaggtggtttttacctggcctccagcttgggttactccaagcaaatcactggcagttatcaggtgggcctgactattttcgcgggcctggctatcctggcgctgattggcttatccaatgtgaaaaaccgctggcggacgacctggggtgcagccaccgtcaccagtgctaaaatctag

SEQ ID NO: 23069 - DNA, 258 bp, Glycine max
  Peptide Sequence Number=SeqID_139847
atggcgcctatactcggtcaatggagtccactgctgggactggcattggattcggccgccagttgttttgctattggtggcacatggtccctgtatatggaactggtcagagaacgaatagacgcgggatcgataggctccgaatatccagttttggatctctctaacgggactggaacgggcgaagccattggattgattgggcgagttagcccaacaggaatgtggtcgtctagatcgtacctgcggaaagattag

SEQ ID NO: 23070 - DNA, 1722 bp, Glycine max
  Peptide Sequence Number=SeqID_139848
atggcactgcatttcaaaacgtgcattttttctttcaaacctcatcaaattatgacaacaaaggctcagctttctcaaagcttcaatcctgctaaacttgattctcttcacattgccaacaaatggaacattgttcaagaagaaagatctagcgcattattcacaaaaactggagatctcatcagcattaatcactcagacaaactggaggtggtcaagaatgaatttatgaacactgtgggtgaaaattcattaagaggtttgtacatgattgatgccatgcagcgcctaaatattgattaccacttccaagaggaaattgaagaattcctaaggaggcaatatgtgaattctactactattgcgggtggttattatggtgatgatattcatgagattgcacttcgcttcaggctattgagacaacaaggtttctttgtgcccgaagaggtgtttcacaagttcacaaacaaggagggaaagttcaaccaaaaacttggtgaaaatataaagggaatggtagagttatatgaagcctcaccgttaggcatagcaggggaagacacacttgctgaagctggtgaatttagtggcccagtcctaaaggaaaagttggattgtatagatatccataatcttgaagctaagtttgtgaagagaaccttagaacaacctttccacaaaagcttgcccatgtttactgctagaaatttctttggtgatttcgatgccacgaatacatggttaggttccttaaaagaagtggcgaaaatggatttcagtttgctgcaatgcatgtaccatcgagagattactcaaatttcaaactggtggacagggcttggtttagccaacgagttaatgtatgcaagaaatcaaccacttaaatggtacatttggtcattggcatgtttcacggatcctactttgtcagaggaaagggttgagctcacaaaaccaatatctttaatctacataatagatgacattttcgatgtttatgggacactagatgaattaactcttttcacagaagctgtttgcagatgggatattacagcaattgagcagctaccagattacatgaaggcatgtttcggagttctctacaatctcacaaatgaaatcagctccaaggtctatcagaagcacgggtggaaccccatagactctctacaacatgcgtggaagagtttgtgcaaagccttcctagttgaagcaaaatggtttgcttctgggaacttgcccagtgccgaagaatacttaaagaatggaatagtaagctctggagtgcatattgtgatggttcatgctttctttcttttggggcatggattaacagaggaaaatattaagatcatagacagaaaccctgacatcatttcttcccccgcaacaattcttcgactttgggatgacttgggaaatgcagaggacgagaatcaacaaggcaatgatggatcgtacgtgaattgtctcatgatggatcacccacactacacgacgagaacagcaagaaaaagggtgatgagtaagatctccgatgcatggaagagcctcaaccaagagtgcttgtttggtaaccatttccattcgacattcactaaggcctcactcaatcttgcaaggatggtaccattgatgtatagttatgacgacaaacagtcccttccagggctagaggagcaagtcaagtcattgctttatgatgattttctttaa

SEQ ID NO: 23071 - DNA, 288 bp, Glycine max
  Peptide Sequence Number=SeqID_139849
atggcctcctatggtgtggcgtctcctctctctcttcctttctccattccgctgccattcatcttccaagaagcaaaggaatccattgatgaagaagatcctaggcctacaagctccaatggagcttgcatcaatccagaccaaagaaataattttactatatacaataaagatacaccagagtcttcaacaagtatactgaaacgtgctacaaaagttaaatcaaaacagacccctaattggtacaatagatacaagaagatgaaaccccaaatatatagagcatag

SEQ ID NO: 23072 - DNA, 540 bp, Glycine max
  Peptide Sequence Number=SeqID_139850
atggttaacgctgaagacaaagatgtccgcatcaaccgtctgacgctgctgtccaaactgcgcgagctgttcctgcaggttgcggatatttcactgctgcagctcgggcctggctatcctatgccccgacgaatccctcgtctcactggagcgcacacgacaaatgaacaaacacgactgatgaatttcacgccttacctcgcaaacgctgcgggtaggggagtattgatttcattcaggagtgcttatggctcattgtgcccacaccccctcttttgttttacatcaggtcacctgtcagttcgcgacgggacagacgctttttggcccgctgaatttatcgctggaaccgttgctttgcggccttgtcgggcgaaatggcgttggcaagacacgcctgttgcgtctgctggcgggcctcgattctccctcctgcgggcatatcgaacgatcggccaccgttgcctgggtggcgcagcagccgaccctcacggccgggacaaccgttgcctccctgctgggttatgcgccagtatttga

SEQ ID NO: 23073 - DNA, 246 bp, Glycine max
  Peptide Sequence Number=SeqID_139851
atgacaggagattggcttggcgcactggaaaggagattaaagatgggatggaatatgccaagggctgatacgagtactcttcctaaagcaccggttattgcaacaacgggacacttagctaacgtaaaccttgtctctctatctactgctcgtggctatcttatccctaccgctcgtagattcacttcattttattttgaaggcggacatgttgacatgaaaaagaaattgaattgctcgagttag

SEQ ID NO: 23074 - DNA, 330 bp, Glycine max
  Peptide Sequence Number=SeqID_139852
atgcgggggtaccttatggttatctgcaccttttgtcatctagagacggcgagttcgatgacatgcggggttaccttatggttatccgcacctttgtcattcagagacgtgacggcgagtccgatgacatgcaggggtaccttatggttatccacaccttttgtcattcagaggcaagcgggcccgttgacacgcagagacaaacttctggtcattcgcaccttttgtcatccagagacggcgagtccgatgacatgcgggggtaccttatggttatccgcaccttttgtcaaccagaggcaagcgagcccgttgacacatagagactaa

SEQ ID NO: 23075 - DNA, 392 bp, Glycine max
  Peptide Sequence Number=SeqID_139853
atggcgaggacgtgtagtgctctaaaggtgagggcatgcagccctctgatggcgaggacgtgtagtcctctaaaggacaggatgtctagtccactgaaggtgagggcgtgcagctctctgattgcgagaacttgtagtcctctaaaggcgcggatatctagtcctcatatggtgaggacgtgctgccctctgatggtgaggacgtgtagtcccctaaaggcgaggacgtctagtcctctaaaggcgtggatgtctagtcctctgatggcgtggccgtgtagttctctgaaggtgaggatgtgcagccctctgatcccgaggacctgtagtcctctgaaggtgacggcgtgcagccctctgatggctaggacgtgtggccctctgattgcgag

SEQ ID NO: 23076 - DNA, 750 bp, Glycine max
  Peptide Sequence Number=SeqID_139854
atggctgcacacccccaccttcagaggactacacgtccttgccatcatagggctgcacgcagtcaccttctgaggactacacgtcctcggctgcacgcgctcaccttcagaggactagacatcctcgcctttataggactacacgtccttgccatcagaggcctgcacgccctcacctttaaaggactacacgtcttcacaatcaaagggttgcacgccctcaccttcagaggactacacgtccttgccatcagagggctgcacgctctcacctttagaggactagacatcctcgcctttagaagaccacatgacctcgcgatcagagggccgcacgtcctagccatcagagggctgcacgccctcaccttcagaggactacaggtcctcggcatcagagggctgcacgtcctcaccttcagagaactacacgtccatgccatcaccttgagaggactagacatcctgccctttagaggactacacgtcctcgccatcagagggctgcacgccctcaccttcagaggactacacgccttcgccatcaaagggttgcatgccctcactttcagaggactacacgtccttgccatcagagggctccacgccctcatcttcagaggactccacgtccttgccatccgagggctgcacgccctcactttcagaggactagacatcctcgcctttagaggactacacgtcctcgccatgagagggctgcacgccctcacctttagtggaatacag

SEQ ID NO: 23077 - DNA, 440 bp, Glycine max
  Peptide Sequence Number=SeqID_139855
gcttttcgtcttacagacagctaaaagtttatacggataacaacacgggtatttccgcccgtcagcgtgactcaaaagtcaatatgactgatcttgtgagcgtggaagattaccgtgactcaaaagtcaatatgacagatcttgtgagcgcggaagatgacacagcaaaagtttatacggataaccactcgggtatttccgcccgtcagcgtgactcaatagagagtatgacagatcttgtgggcgcagaagatgacgtatatctccgcgtgtcaacgggcttttcgtcttacagacagcaaaaagtttatacggataaccactcgggtatttccgcccgtctgcgtcactcaaaagtcagtatgacagatcttgtgagcgcggaagatgacgcttttcgtcttacagacaggaaaatgtttatacggataaccactcag

SEQ ID NO: 23078 - DNA, 1047 bp, Glycine max
  Peptide Sequence Number=SeqID_139856
atgattgaatccgaaagaatctcctatgttagaaacaaccaaaagaaactcagagttgacaagttctgtagcttgcagcagtcatccgaagctggaaatacagaagataggccagaaataatctcccgcattttcaagcttaaatatgagcagatgttatcagaccttacaaagaatcacctgctaggcaaagtcgttgcatacatgtacacagtgaaattccaaaaacgagggcttcctcatgtccatttattgttatttttacacgccaacaacaaatatccatctccaaacgatattgataatattatatcagcagaaataccttcacagaaagacgatccaaaactctataaattagtccaaaatcacatgattcatggtccatgcggaattttgaggcctgcatctccatgcatgaaggaaggcaaatgcagtcaattttatccaaaaaagtttcagcccacaactcttatagatggagatggttattctgtatatcgtagaagaaatactagtcgggcaataaccaagaatgatattataattgataatagatgtattgtaccctacaatccaaaattgctgaaaaaataccaagcacatataaatattgaatggtgcaaccaaagcacttctatcaaatatttattcaagtacatcaataaaggatacgatagagttacagctgtgatggtacatgatgacaatgaaatagttccgcatgcaaagactccaaatgatgaaatcaaggaatatctagattgcagatacatttctccatgtgaatctgcttggaggatctttagttttccaatacatggtagaaaaccttctgtagagaggctacagttccatcttccaggccaacatagcgttctctaccaagaccatgatgatattgatgatctcctctctaacccaagcatttctgaatcaaaatttatagcttggatgaatacaaaccaagcttttgttgaaggtaaaaacctgacttattctgaatttgtgactaagttcgtgtataaccagaaacagagatgttag

SEQ ID NO: 23079 - DNA, 467 bp, Glycine max
  Peptide Sequence Number=SeqID_139857
atgtcttccagaaaaagaaagagcattgatgcaaggcccacaactcaatatgacataagaagattccactccttcgaggcctggaccagatacacagataatgtgctaggaagacatatactagctgagaggaaggtagaaatataccatacggagttggatgagttcaaggctgaattggagaggcgtaacttccataagcgcctcaccaatttagctgacagcagcatcgacctagccttggtgaaggagttctatgccaacctttacagtcccaaggggccttcaccagaacaagtcagaatccgaggacacttgataaaaattgatgcagacagcctcaacaccttcctggagacacctgtggtactggctgagggagaatccttacccgcttactccagatactgcaggatgcccactgatatcggagagattgaggctgctttgtgtatacccagccgagg

SEQ ID NO: 23080 - DNA, 213 bp, Glycine max
  Peptide Sequence Number=SeqID_139858
atgtcccacactgttaaagataatcgaggcaagtgggccccgaattatgaaggacctttcatggtgaaaagagctttttctgggggtgctctgatactcgcccacatggatggcgaggaattgcctaagcccatgaactccgatgtacatagggacggatgcaagtgggtatggggtcacgaccgaccaatcgttgccccttcccggcgctaa

SEQ ID NO: 23081 - DNA, 255 bp, Glycine max
  Peptide Sequence Number=SeqID_139859
atggtgaatagggaggtggtgaaaggcaaaggtactttgaaggaaatatttaggcctcagctacgagctaggatgagcagtgttatactccacaaattgcataagggttacaaggaaaatctctttgaaacaaattgtaaagtcctatctggaaaaaacggtggagagaagtattgttcttaccttgcggatattgcacgagagagtgcagaagcatgttggaagataggcctaacatttctttgctttatgtaa

SEQ ID NO: 23082 - DNA, 408 bp, Glycine max
  Peptide Sequence Number=SeqID_139860
atgggtgttaaacattttgaggtggtcaaacgaaggtcgcatgctgacaaacaatggtccccggacgaaattaggagaaaatgtggattgtacgtcgaagaaaatcctccccgcctggttgccctaggaagactttatgaggggtcgacaaccattcacaacatccctttgcgccatgatcaagtcaaggttggtgttgaggaagttagagatgtagatgctactgtttttgtacccactgaagaggttcagttagtggagcagacacttaacaccttcattgcttggacaacacatcttgtcaagagtttattagaacaaggagctgtgggaccagcaaaacctgcacataggctagatgatcatgtcgatgatcccctatatctgatgacattgatcatcccataa

SEQ ID NO: 23083 - DNA, 367 bp, Glycine max
  Peptide Sequence Number=SeqID_139861
cttgggaggattgatggggacccggtgttgagagaaacgaggatatgggctacgtgggagtacgtgagctcagatggaggtgggcaacaggggatgagtggtactggagatatgtcgcgggggtcaggagacttggggccgtcagcgagctcctggaagtcaacagataaaaggaacaaagaccacaaagcaaggaggcttgtgtggtggctagccagctgtgaatcttgtgtgatatatgggttatggcctctggtaatcgattaccaagggcttgaaaacgaggttgtggaggcctctggtaatcgattacctgtctgtgtaatcgattacacagaggaatgggtcactggtaatcgattatcag

SEQ ID NO: 23084 - DNA, 201 bp, Glycine max
  Peptide Sequence Number=SeqID_139862
atgtggcagaccactacttcattcccgtcaacacatctggacaaaagaaataatccaatgtatactgggtgctcctcatccgctggaaatcccattgcatgcaagaaaacatctgaaagaatgtggcaatcacatgacaattttaaggaagcatggacctcctctacaatagaacgtggttaccctggatgccgacattaa

SEQ ID NO: 23085 - DNA, 399 bp, Glycine max
  Peptide Sequence Number=SeqID_139863
atgcctccttcgcatttcgttgtccaattgctcgctgttcacattggtctgcatgttgctaatggagttgggtgtatcagctttagtatagttgattatgaaattctgataccaggggacagatgtcgtaccggatgtcacgacatcacgcttcagaacatgcagattatatgtgtccgtatgaacagattaaacaaggtaccatcaaggtggctcacaaaagactcaagtcccaaaaactcacaaactaactcttcaatcccggacttggtccagaactcgtgcagcctccatgattatatagccgtgtacgattctgggctgcaagttcttgatgctggaggagatctatcttcttctgaaaaatctgcagttaaagaactaaaagataacttttga

SEQ ID NO: 23086 - DNA, 149 bp, Glycine max
  Peptide Sequence Number=SeqID_139864
atggaggagttgattaacaaaacacaactctctcccaaatctaatcccaacttcatcacgtcggctcagcggctccacaacagaatctcacttcctgcaccctactgctgtcattctgctcccatgaacattgttcgcgatcatcacag

SEQ ID NO: 23087 - DNA, 390 bp, Glycine max
  Peptide Sequence Number=SeqID_139865
atgaaaagtggttgtagtgatgcaattagtgattacggtaacaatgataaaaatggtggtggtgggatcaatggtggcaatggtgttagtgatgacgattacaacaattattgtagcatcaacggagacaatggcaatgataaaacaacaagaatggagtcattcccaatagtgattatagtagtagcagcaaaggaaattgtggtaatggtggcaacaattgcggtgaagagttggaatgaagaagttgcacacacgaggtctttcctcgtttatggatgggaggatgtaaacttcttgctcttccatagtgcattctggtcaatccttccattttcttactcattcacaatgcaggaatatattccttctggattaatacattgttag

SEQ ID NO: 23088 - DNA, 429 bp, Glycine max
  Peptide Sequence Number=SeqID_139866
atgaaacccgaagtggttgcacacttgtcgggtcgaggaggaggaagggaccggtttaggagggattatccttctaggtgtgatgataatagggggaatggggttggtggacgtgacaaccgcaacagcagccgcaacaaccctccttccaggcatctttgggttgggaatctatcccacaatattgtagaggaagaacttgctcaccatttcttgaggtacggaccactggagaatgtggcattccaacccggccgcagctatgctttcataaatttcagaatggatgaggatgctattgatgccttgagagcactgcaaggctttcctcttgctggcaacccacttagaatcgagtttgcaaaggcggtgctccagaatatgcaccttactgttaagaagagcatggccgaaagttacttcttttaa

SEQ ID NO: 23089 - DNA, 702 bp, Glycine max
  Peptide Sequence Number=SeqID_139867
atgggcagggtctatatatccggttgctgcttcagaattagttttgcaattcataatgctataaatcacttttactcattgtcagaaaagtcaaaagcagaaaataactacgaagggtttgtggatgatttggatcttccattgcttgatttgtcaataattttggctgccactgataatttctcagaggtgaacaagattggagaaggtggttttggacctgtatattggggaaagctagccagtggactagaaattgctgcaaagagactttcacagaactcgggacaaggaatatccgagtttgtaaatgaagttaaactgatagcaaaacttcagcacagaaatcttgtaaagcttctaggctgttgtattcataagcaagaaaaaatattggtttatgaatacatggctaacggcagcctagactacttcatttttgatttgctgcgaaacacagatcacaccaaaggtaaatcacttgactggcctaagcggttgagcataatttgtggaattgctcgagggcttatgtatcttcatcaagattctcgactaaggattattcatagagatctcaaaggaagtaatgttctactagatgaagatttcaatccaaaaatatcagattttggaatggctaaaactgttggaagagaggagattgaaggaaacacaaataaaatagttggaacattgtga

SEQ ID NO: 23090 - DNA, 1113 bp, Glycine max
  Peptide Sequence Number=SeqID_139868
atgcataagcctcatcgaacagggaaatggacgctacggccaccaccaacaactgaagatggccaagtcacattcttttttaccaatttcctgatgagacttacagcgaaggacatgtggggtgcgctaggagggatcgtgatcagtggggtttgtctttgtgcgaatgtctcgcgttttgatgccgctgatcgttggcaacttgcattggggagaagggaagttgcagggtctggtcatggtggcctgtggaggtctaggggtgttcttggtggagggggttttgttgcaacaccatctagtttggtggcggcttcagtggtcgatgatagttgttcaatgcttggaagatggcttggtatgcgcggggaaggggggtgtcaggaaactactacactcggaggggtcatttctggtgtgggtgaccccattgggtgcgtctttggtcttattggagacatcggagttacaacgggtgttggaaatcttgtgtcggtggatgagtatatggcctgtaggggtcgtttggatatagttagggtcctagtgcatgttaaagggtttcacaacattgatacgcatgttctggtagacgtgggaggtgaaccttttgacatttgggtgaagcaagatgggtatacctctctatgtccttcttgctcaaacaacccaaagggcgagggggatggtgatgagactgatgatgagttggagttactgagtcttatagcagatgacctacaagtggatcaatcaagggttataggtggcagggaggggtctagagctagatctggtgttccgattatgatgaaggtgagcgactatagtagccatgctgctaagtttgtggaggaggttcataaggaggttgtatcttcaaacccccagccaagacgaagttgggtggttccgagatttagtcaacgtgaattgaggagatctgctagtgttattaccactctgagggttgtggatcattctgatgatgcaatggcctggcgtgtgtggtcgatggttagtgcttggggtttgaaggctaagggggctaattattcccccatgaaggtcttctcattgaacatgagggagataggggactgggctaagcat

SEQ ID NO: 23091 - DNA, 393 bp, Glycine max
  Peptide Sequence Number=SeqID_139869
atgactaattttgcacgttgttttcaaatcatcattgtcatgcgtgccttgtggaaaaacatggaagttcaggacgagagcgacaccttgacacccaaatttgtttcaccccagatatcaagattggaatcctcattctttcccccgaagcaaaggacagcggaatctcctcaagggagagcgaatagaacgctaaaacccgatttcccaaagaaagggatggggaaggaaaagtggaaagaaagaaaaggaagaaatggaaagaaagaaaaagaaaaagatgaaaataaagaaaaagaacaaaagaaaggaaagaaggattcccgatcaaagatcgaaaggaagcaaaaagggaaaagaagcaattctcaatcaatgaaagaaagaggatag

SEQ ID NO: 23092 - DNA, 753 bp, Glycine max
  Peptide Sequence Number=SeqID_139870
atgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggtaaagttatacaaatcgagtccattatcgatcaatttgcaaatactgtgcagaaaaaacgcgacaatggcgccagactcgatgcccagaaacaggcacatatccttctgctcgagaaagcccgagcggctcaacgtgaagtcgagcgtctcaccaaagaagcgaaagaaggatcttctgagatcaaagcctgtgatgataacatttcctcctgggaggcaactattacaaatttgctgtctcaggtcgatgatctaaggcagaaaattgtaacagagcaggccaaacgcaaagaactccaggagaaggctgctgattcgattcagaagctggttgccgaaaaagggagggaaggcctgaaggcctttagtgcatctcaagcggtagcagatgaggcgagagctatggagagtgctgaccaggttttgagcaaagagatggccaccttgaagaaactatatgaggacttagtcctgcattag

SEQ ID NO: 23093 - DNA, 858 bp, Glycine max
  Peptide Sequence Number=SeqID_139871
atgagtctggtcgattactctaccgcgcgtcagggacagccggccttgcggcgcgatcgtgcccgtcgcctgcagcccggcttgtggctggcatggacggtgctggcgctggcgtttgtggcggccgtggcaccgcagctgtttacccactatagcccgaccgaaggcattgccggcgcgcagcgcttagcgccgcacagtgcgcactggctcggcaccgatcaactcggacgcgacctgctggcgcgcatcgtctatggcgcctcgcagtcgctctctgcggcggtcgcggcggtggcgatggggctcactggcggaaccgcgctgggcgtcctggccggggccgtgggcggccgcactgaacaggcactgatgcgactggttgatgtgctgctttcaatcccggcgctgctgctgtcattaagcctgctgatcctgctgggttttggcaccgtgcacgctgcgctggcggtgggcatcgcctcgattgccagttttgcccggctggcacgcggcgaagtggtgcgggtacgccgcagtgaatatgtggaagcggctttcggcagtggcggccgtttctggcaggtactgtggcgccacattgtcccgaacacgctgaccgcggtgattgccttcgccgcgctgcagttcggtcaggccattctggcgctctcaaccctcagctttctcggctatggcacgccgccaccgacccccgaatggggtttgctgatcgccgaaggccgcaactatctggctaccgcgtggtggctgactacctttcccggcgtggtggtggtcgccgtggtgctggcggcaaatcgcgtcagccgtcagctggcaggaggtgacgcatga

SEQ ID NO: 23094 - DNA, 267 bp, Glycine max
  Peptide Sequence Number=SeqID_139872
atggacgaagatcaatggacatatgacaatacattgtctgaagaagttgatatggattatgaaaatgaagaagaatgtggtgtgaatgaaccatatgttatttctgaaattctcacccacccgaactcgtggcttttgcttctctctagctcgtcgtggacctcgtgggactcgcggcttccaagtaaactagtaagagtctacgagttgactctagagtttgacaaccttgctcatgagtgcattaagctcgcatgtttcacatga

SEQ ID NO: 23095 - DNA, 174 bp, Glycine max
  Peptide Sequence Number=SeqID_139873
atggatgaattggacatccttgtttctctcgtcctctcacaaacacatctttgcttattcaacttccaccagaatgtgagtgttgtgaaaacaaagatggatacctcagagccctacactgggacaatgaggggtaccatgcatgagcctcaagtaaacctaggggcagattag

SEQ ID NO: 23096 - DNA, 433 bp, Glycine max
  Peptide Sequence Number=SeqID_139874
acacggcgaggacgagtgtgaagcagtatcgaaacacggcgaggacttgcacaaacagaagaactccaaacggttccccttcaaggagatggaggaggacaatgactacgctgaggaagaaaactggactaaggtggtaagcagaagatcaatgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgacgtacgtgaagtatacatcgctaaaagactcaacaaggatggcaggagatacgggttcatgcggttcaagggagtctcggatgcaaaaggattggag

SEQ ID NO: 23097 - DNA, 171 bp, Glycine max
  Peptide Sequence Number=SeqID_139875
atggtttccggggcttccatggctttcgtaatgcttccgttaaatttccgaaaaccttggagaaggggggctgtttcaaaaatattcatgacccctaagctatgcatttcggctattttgggcaaaaaacacgttttcgtgaagaaaaatcgagtcgaagtgcttccgtaa

SEQ ID NO: 23098 - DNA, 319 bp, Glycine max
  Peptide Sequence Number=SeqID_139876
ctgacttcaactgcctataaacatttgggagcaaaacatgacgagattgactttgaattcttgggcaacaatggacagcctcataccttgcagaccaatgtttttacaaatgatgaaggaggaagagagcaaaggcatagcctctggttttacgtggatgaaataccaattagagtattcaagaactactccaatgtgggagtgagttttccttcacaacaaatgcacgttacggctagcatatggaatggtgaaccttgggcatctaatgggaagagaattgactggaagcaagcacccttcactgctcagtttcaag

SEQ ID NO: 23099 - DNA, 306 bp, Glycine max
  Peptide Sequence Number=SeqID_139877
atggggatgaggttgccgcccagctcgtccaagcgagcccaggcttccttaggttacagaaatgttacagaagcattacggaagccccagatgccatttttcaacaaaatgggggaggcggttgctgcccagctcaaccaagcgagctcagcttgccccgacgagctaggttgcttccacccaaagcaagaaaaaaactttacggattccatggcgatgggtgttaagccttctgaagcaatcaacaatggtccccaaatgaaattaggatggttaggtggatggctatggagaacctcatgctaa

SEQ ID NO: 23100 - DNA, 427 bp, Glycine max
  Peptide Sequence Number=SeqID_139878
atggggctccgaaaaaggggtagagatgggagaattgcactaagcaatcactacgcatggctccaaacccgtgggtggaggatgaacgaaaacgcaattcatggggctccgaaacaggctagagaatggagaattgcactaagcaatcactacgcatggctccaaaaaagtgggtggaggatgcatgaacgaaaacgcaattcatggggctccgaaaagggtaaagaatggagaattgcactaagcattaactacgcatggctcatactagtgggtggaggatgcaagaacaaaaacgtaattcatggggctccaaaaaagggtagagaatggagaattgcactaagcaatcactactcatggctccaaactcctgggtgcaagatgcataaacgaaaacacaactcatggggctccgaaaactggg

SEQ ID NO: 23101 - DNA, 552 bp, Glycine max
  Peptide Sequence Number=SeqID_139879
atgaggggcaccgtggatgagcctcaatcgaacctaggggcagatcaaaaatttcctaaatctaatgtccaaacttttgtgtttgggataagaggccccctcaatgagtcaatctcttgctttctcataaggttggaccccttgaggctacacatccttgcctctagaaggatacacgtcctcgcatttagagggctgcacgtcctcgccttcaaagggctacgcatcctcgacttcagaggcctacgcgtcctcgactgcagaggattgtacatcctcgcctccagagggctgcatgtcctcgcctccagagggctgtacgtcctcgccttcagagggctacccgtcctcaacttcagagggctacacgtcctcgcctttagagggttgtacgtcctcacctccaaagggctacacgtcctcgcttttagaggaatgcacatcctcaccttcagagggctacacgtccttgcctttagagggttgtacgtcctcacctttagagggctacacatcctcaccttcaaagaactcaaggtcctcttccattaa

SEQ ID NO: 23102 - DNA, 381 bp, Glycine max
  Peptide Sequence Number=SeqID_139880
atggaaacaactaaatcaactcaacaagcactccgaagtgtagaaatccaggttggtgagctggcagaagcagtgactcaatttatggtcagacaagaaaaatcctttgtagaggttgaagctcaaaagaaaagccctgtaaaagagcgtgagtcaagagaaaaagatgaggagaaagatgaggaacaagcacaaaaacaatgggagaagtacttaacagtagaaaatcaacaagaaaatattctccaagcttatccgtggctaagcgggacctattgtcgccaaccgcaattccttatggccttaattgaggtccatgacgctaagcgccagtcatggcagctaagcaagcttctttgcgacaatatgagtgctaagcga

SEQ ID NO: 23103 - DNA, 228 bp, Glycine max
  Peptide Sequence Number=SeqID_139881
atgaataatgcctcaaaagattctcctaatgaaagttccaccaagccaactacttcaaaagggcctcagaagctaactaacctcaaggttagccgtagtattaccatcaaagatgttttgcattcagatcgttataagcctccaaaggtttccaatagctccacgcttaagggaacaaaattacccacaattcagcaagtctttagccgcagaccaggagggaattaa

SEQ ID NO: 23104 - DNA, 396 bp, Glycine max
  Peptide Sequence Number=SeqID_139882
atgcctatatttgacgacatagattacgatacacgcaacccacaggatttattccacgagaatggacaatcatcaatggccgacgcaaagaaaattttttacccaaaaaatcgatccaacaaaggtactagttcctctcatacagaaactacccagaaacaagaacgcaagtttaccatgaaagatgtttgctattactcccaaccaagcaatattcctcctaaggattctgattcttcaagccagcaacagcaagcacgcacctttaccatgaaagacttttgctactataccaaaccaaacaatcctcctagtgtttctgatgcttcaacctctagggctggaacaccattacccactattaaaaagtcttttgctcgcaggacttggagctag

SEQ ID NO: 23105 - DNA, 249 bp, Glycine max
  Peptide Sequence Number=SeqID_139883
atggctgattccaaaaatctcataaaaaaagctttgtggcccaatagcttaagcaactcttccggtcctaaaacttcaaacactagccagcatgaaacaccaccaaaaatagccatcaaagatgttttctatagttcaagacctagtaatcctcccaacacttcaaccactactagcccaagtggtacaccgttacctaagatgagggacgtttttgcacgcaggaaagggaaagggagtggtagttga

SEQ ID NO: 23106 - DNA, 273 bp, Glycine max
  Peptide Sequence Number=SeqID_139884
atgaagctcttatcatttaatgtgaaagggatgggaagcagggtgaaatggaaagaaataaggagaattatctcaaaggaggaagtagacatagtggagtggagacacgtcccagctgcaaatgatgcaggtgggattttgtgcttgtggggagagggcaatttgatgtacgagattttagggcagatgttggtttcctttttctgcaaggcaattggaaaggggtccaaaagatcattaatatcattgatatttattcaccatgcacaataa

SEQ ID NO: 23107 - DNA, 1701 bp, Glycine max
  Peptide Sequence Number=SeqID_139885
atgccagctctccttcaaaattcatttgcatttgattttctgggattggcattgcttaccctgtttttcttgttcaagctttcttggtcaaaatcattggtcaagaagtggttcaatatcaagaacaaagctgaggattttcactcagatgaggttctctcccaaggtgttgatgaagagtgtagcagcaactattcagaaagggaggcatgcaccatcaggaaaagcaaatcagagagatcaagcagatggtactcagacagaatgcgaagaggaagaggtaagaatgaccttgatgaagctcaggttacagatgtgtataactatagaatctttgctgccacttggaatgtagcagggaagtcacctccatgttatttgagtcttgaagactggcttcacacatctccacctgctgatatctatgttcttgggtttcaagaaattgtacctcttaatgcgggtaatgttttgggaacagaagacaatggtcctgcaagaaaatggctagcccttattaggaggaccctgaacagccttcctggaacaaatggcggatgccacactccttcgcccctccctaatcctattgtagagctagatgccgattttgagggatcaatgaggcagaaggcaacttctttctttcaacgaagatccttccaatccttgagtcgtagtatgagaatcgataatgatatgctaatgccccaagcctgccttgatcgccgtctcagtgtctgtgatagagtgatgtttggtcacagaacgagcgactatgatcccaattatcgatggggttcctcagatgaagaaaatggcactggtgactccccaattacagcacaatattcaccaatgtcatatggcggttgtttctctacagaagacagtgatagacacacaggacactcaagatattgcttggttgctagtaagcaaatggttggggtatttctaactgtttgggtgaagagtgatataagagatgatgttcacaacatgaaagtgtcttgtgttggcagaggcttgatgggatatcttggaaacaagggatcaatatcaattagtatgtcattgcaccaaacaagcttttgcttcatttgtagtcatttgacttctggacaaaaggatggtgacgagttacggagaaattcagatgtaatggagattctcagaaagacaaggtttccccctgtcctagacatcggtggtgagtattctcctcagacaattctggaacatgaccgaataatttggctgggggatttaaattatcggatagccatttcttaccgtgcagcaaaagctcttgttgagatgcatgattggaagactttgttagagaatgaccagttgtgtatagagcagaggcaaggtcgagtctttgaaggatggaatgaagggaaaatatatttccctcccacttataagtattcaaacaattcagacagatatgcaggtgatgacagacactcaaaacaaaagagaagaactccagcatggggccttcaccaattatcatacgttcgtggggagtcaagattttctgatcatcggccagtgtatagcatgttcttggcagaggttgagtctgttagctgtaaccaaataaagaaaagctccagttccaggattgaagtagaagagttgtttccacattcacatggttacggctacactgatttgaactacttttga

SEQ ID NO: 23108 - DNA, 156 bp, Glycine max
  Peptide Sequence Number=SeqID_139886
atggaataccagaatgggaccaacattattcaagttataaagcagaacaatgcagagaagcaagcagggaatgtatactgtatcttttggacccttctcaactttgaggctgatattgatggtgatgttgatgtgaagcttttgaccatagggtag

SEQ ID NO: 23109 - DNA, 257 bp, Glycine max
  Peptide Sequence Number=SeqID_139887
atgcatgagaacgaatggcacggagcgtgtttgctctttgcccctattcgggaacctataggacaatatctatgggtctctaataactactccccaacaatttataactcacacggccgttctctagagtcgaaacgtgcccttcgcaggcgagcgagggcgaggctcacgggtgcgctttccaaaggaggaaaaatgcgcggagtcgccaccaacgtttattttgtggaaaacgtcggaaaaaccgaaggaaaccg

SEQ ID NO: 23110 - DNA, 1533 bp, Glycine max
  Peptide Sequence Number=SeqID_139888
atgggtaacgcagactatgcatacccttcgggtatgaacgtggagtgcgtgcaccgagtggccattcctccccctcaacccttcttcaagtccctaaagtactctatgaaagagacttttttcccagatgacccgtttaggaagttcaagaaccagccagcctctaagaggttcctgcttgggcttcagtacttcttccccatctttgagtgggcacccaaatacaccctccacttccttaaatcagacctcatctctggcatcaccattgctagcttggccattcctcaaggcatcagttatgccaagctagccaacctccctcctgttcttggactttattcgagctttataccgccattgatctatgcaatgatgggaagctcaagggatttggcagtgggaactgtggctgttggatcgcttcttatggcctccatgttgggtcgagtggtcaatttcaacgagaacccaaaccttttcctccacttggctttcactgctacgttctttgctggagttttgcaagcatcactcggtctcttcaggaaccatgtggaggagtgcaggttagggtttatcgtggattttctgtcacatgcaaccatagtagggttcatgggtggagcagctacagtggtttgtctgcaacagctaaaatcaatccttggccttgagcattttacccacgaggccgatctcgtgtcagtaatgcgctctgttttttctcaaactcatgagtggaggtgggaaagcgctgtgttaggttgttgctttattttcttcctcctcgtcacaagatacttcagcaaacgacagccgaagttcttctgggtgtcagcaatggcaccactgacatccgttatactgggaagtctgctggtctatctcacacacgctgagaagcatggagttcaagtgataggaaatttgaagaaggggctgaatccaccttcggtgacggatttggtgtttgtgtcgccttatatgggcactgccataaaaactggacttgtcactggcattatcgcacttgcggttaagtatctcaacctcatttcctttggtagaggtcatgtcagcaaggccttaaggacagaattaattgatcttgtgcaggaaggaatagcagtgggaagaagctttgcaatgtttaaaaattatcatattgatggcaacaaagagatgatagctattggaaccatgaatattttcggatcgttcacctcttgctatctcaccacaggaccattttcgcgttcagcagtgaactacaatgctgggtgcaagactgctgcatcaaacattataatggcaatagcagtgatgttgacattgttattcttaacacccttattccatttcactcccctggtggtgctgtcagccataattgtatcagcaatgctcgggctcattgattatcaagcagcaattcatttgtggaaaattgacaaatttgatttcttagtgtgcttcactgcttatgttggcgtagtctttggcagtgttgaaattggcctagtcatagca

SEQ ID NO: 23111 - DNA, 144 bp, Glycine max
  Peptide Sequence Number=SeqID_139889
gataagcctgaagagagttcttccacgccaacacacgctcagtgcatatgcagctcgctaagcgaggcgattgtctcttctgtgctaagcacaagattggtgctaagccaaatatcacttactcgtgctaagcgcgccttcgag

SEQ ID NO: 23112 - DNA, 249 bp, Glycine max
  Peptide Sequence Number=SeqID_139890
atggatagaatagactttgccaggatacttatcagaacatcaaccttgacacaggttatgtcctttcagaagttcagtattgaggggacactatttgggatcagaatagtggaagaaatacctgacaccattgaaagtgaatggccgaggatgcatgaggatggtggttgggagaaggagcgtatccctgaagtcattagcagagatcctaagtgttattgtcacgaaggaaagggagttcggagatga

SEQ ID NO: 23113 - DNA, 857 bp, Glycine max
  Peptide Sequence Number=SeqID_139891
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataagctcgactctcagaagttggtatgcatgggaggcagatgtctgctacccactcggacatgcgagtgggaacctagctacactctgatgaagaaggactttggaaatcgctgtattcaactcagatacacgtgggttcaggcacaacgattccacatgcttttctcacaacctttccctgccactaacatgagaacgttagcagctccttctacagtcaagcaggatgcgggagggttgtgccctgtccttagctctcacagggaagcatgccttgaagccacctgtcaactagctgcattcttatggcagggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23114 - DNA, 420 bp, Glycine max
  Peptide Sequence Number=SeqID_139892
atggccggaacactgcaggtggtttctgttgctggagaggcctttgtccctacctgcttggggagcagcccctctataaggaaattgtggatggttacaggtgtctctggtctacctggttgtaattatctctctttggctcgtgtgcgagtaatttctggtattgatgttgagcaagagccagttgttccgggagatgataacatacccgggggagaaaaactactagaaacgctgcaaggatctgcatccgttgatgacagtgcttttctagcaacagctgaagctgtcattgccagagtctgttgcgcaatgcagttctatttccaattgttcacgttgctttggatccctactccatatttggcatggattaagatcaatgtacgtagtggtggcactctaccatactctttggag

SEQ ID NO: 23115 - DNA, 339 bp, Glycine max
  Peptide Sequence Number=SeqID_139893
atggcttttcaaatacgggtgatactagcaacccttatagtggcttcagtaaatttggtttatggtcaagttagcacgtcctgcacaacatctatgatgagcagtttcacaccatgtgcaaacatcattacaggaagcactaataatggtttagtgccaccaagtacgtgttgtgatttattaaggtctttgatgagcactaatatggattgtgcttgcatggttatctctgccaatgctccatttttccaacaaccccttagccaagctcttgccctctccctttcacaagcatgcaacattaatggagttcctttacagtgcaaaggtgcaaactaa

SEQ ID NO: 23116 - DNA, 501 bp, Glycine max
  Peptide Sequence Number=SeqID_139894
atggtggctatgggcaaagcacagaaatatgaaaatatgcaattggcacgggaactgtcaccagcatcatcaccagtggaagcagaaacgcccacaagaactagaattccacaaatccgaccagtgttgactccacgtccttcagcatctcattcatcttttgcttccccctcagcttttccattcttcataggaatcctgaatcctggtccaggctcaagacccagccaaagttaccttgctgctgagttagttcttgaaataggttatttgttccagaacaatagagtagatccgcataaaaagagcaatgcacctttgatagccatgaaaccaaatgctgtagagaagcttcttgatatgatgcctcgaattggtgtcaaagctgttgcaaatttactgataatagtggcacgtgtgtatgagagaaatgggccaagagaagagctcaagaagctgcaaaggcacatagaggaagctccaaatttaactgatttatag

SEQ ID NO: 23117 - DNA, 756 bp, Glycine max
  Peptide Sequence Number=SeqID_139895
atggccacacccttggcctaccaagagcaccttccggcggcacccagttggctgaacaaaggtgacaacgcatggcagttaacagcagccaccctcgttggtcttcaaagcatgccgggtctcgtgatcctctacgcaagcatagtgaagaagaaatgggcagtgaattcagctttcatggctctctatgcctttgcagcagttctaatatgttgggtgcttgtgtgttaccgcatggcctttggagaagaacttttacccttctggggtaagggtgctccagcactaggccagaagttcctcacaaaacgagccgtagtcaatgaaaccatccaccactttcataatggcactgttgaatcccctccagaagaacccttttaccctatggcctcacttgtgtatttccaattcacttttgctgctattacccttattttgttggctggctctgtcctcggccgaatgaacatcaaggcttggatggcttttgtgcctctttggttgatcttttcctacactgttggggcttttagtctttggggtggtggctttctctaccaatggggggttattgactattctggcggctatgtcatccacctttcttctggaatcgctggtttaactgctgcttactggatgtgggcatgtgactctggttttattacgatctttgatactgtgagaaattgcaaatcaaacatctctttaaaagcatgctcttacctaatgggagttgctatgagatactaa

SEQ ID NO: 23118 - DNA, 216 bp, Glycine max
  Peptide Sequence Number=SeqID_139896
atggttatctgcacctttcgtcaaccaggggcaaaccagcccgttgacgcgcagagactaacgtcgtcttctgcaccttttatcatccagggacagcgagtcaggtggcaggcggagataccttatggtcgtctgcacctttcatcaaccaaggcaaaccaattcgacggtttttactctcgtcgtctggagacattcaagcccgacgatgcatga

SEQ ID NO: 23119 - DNA, 588 bp, Glycine max
  Peptide Sequence Number=SeqID_139897
atggcggatgaaacaccaaatgagatgaaggaggaggttccagaaattgttccttttgatcctaccaagaagaagaagaagaagaaaattacaattgtagatcctgctgatgaacctgtggagaaattggctgagaagacagaaaacctctcagtttccgagggggttgagactgcatttactggtttgaaaaagaagaagaagaagcctgttgaaatgggtaacttgaatgatgagagtggagatgcaattgaagatttggatgatcaccctgaagatgatgaaggagaaatggttgttccccaggctcgttatccttgggaagggagtgatcgtaattatgaatatgaggagctgcttggcagggtgtttaacattctacgtgaaaataatcctgaacttgctggagatcggcgaaggacagttatgaggcctcctcaagttcttcgtgagggcacaaagaaaactgtgtttgtcaattttatggatctatgcaaaacgttggagaaggatcggttgctgaatccaaacccaagtaaaccatccttctgtggaaggtttactccagaaacaacaaaaggactttag

SEQ ID NO: 23120 - DNA, 1269 bp, Glycine max
  Peptide Sequence Number=SeqID_139898
atgggggatatcgttctttccatcgtagcaaagttagcagaatatacagtgggcccaattttacaccatgctcgatacttgtgttgtttcaacaacattgctgggaatcttccaaatgccaaggaagaattggaattaacccgaaacagtgtgaaggaacgagttgaagaagctattatgaggactgaaaaaattgaaccagcagttgagaagtggctgaaagatgttgagaaagtcttagaagaagagcatatgcttcaagaaagaatttcggaagtaagcaagagctatttcagaaggcaattccaatattttcttacaaaaaaaatagcaagaaaaattgagaaaatggctcaactcaaccacaacagcaagtttgagccattttctaagattgccgaacttccaggcatgaagtactattcatccaaagattttgttcttttcaaatcaagagaatcagcttataagaagcttttggaagcattaaaggataaaagtgtttccatgattggactagttggactaggaggctcaggaaaaactactttggcgaaagaggttggtaagaaagctgaggagttaaaactttttgagaaggttgtgatgacaacagtctctcagactccaaatattcgaagcatccaagtgcaaattgctgataagttgggtttgaaatttgtggaagaatcagaggaaggtagagcacaaagactatcagagagattaaggacaggcacaactctactaatcttggatgatttatgggaaaagctagaatttgaggctataggtattccatccaatgaaaacaacaagggctgtggagtgattttaaccactcggagtagagaagtatgcatttccttgcaatgccaaacaataattgagcttaatctcttagctggcgatgaagcttgggatttgttcaaattgaatgcaaacataactgatgactcaccatatgcatcgaaaggcgttgcaccaaaaattgtagatgagtgccgaggattgcctattgcaattgtgacggtgggaagcacactgaagggcaaaactgttaaagagtgggaattagcattgtcaagactaaaagattcagaaccactagatattccaaaaggcttaagaagtccttatgcctgtcttggattgagttatgataatttgaccaatgaattagccaagtccttgttcttgttgtgttctatatttccagaggatcatgaaattgatttggaagatttatttcgatttggaagaggatag

SEQ ID NO: 23121 - DNA, 123 bp, Glycine max
  Peptide Sequence Number=SeqID_139899
atgaaaaagggaggggaaattgtggatggaacactgacggcgttaaattacgctgactttgagtggatggtaggcagagaagacagacagaacgtgacggtaccgccctatgacgtgctttaa

SEQ ID NO: 23122 - DNA, 692 bp, Glycine max
  Peptide Sequence Number=SeqID_139900
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctc

SEQ ID NO: 23123 - DNA, 361 bp, Glycine max
  Peptide Sequence Number=SeqID_139901
atgtgggaccttcgtcttccttatgaagagaagggcgcttctgaagtggatgctggagtagaagctgtagaagtagaaggaagcttggctagccttgccctcaccctcctagcccctcagatagagactgttagatcctcggggttccaacaattcttcctgatagcagggaacccaagtctagaagtgttagactgggctatagaggtcatctggccagagatcagcgctcctatgttcatatccaaaatcttcccaggatggccttcagagttcaagatgaaccctcaaccaggtatgcataaggcaggctctatctctctgaagtccataggcaacttgcagtatctggagtatgcgg

SEQ ID NO: 23124 - DNA, 255 bp, Glycine max
  Peptide Sequence Number=SeqID_139902
atgacgacttcctcttcaagctcggttctctgcaggaaactggaaataaccatgcccttcggagaagctttacagcaaatgccactctactccaaattcttgaaggatatgtgtcgcaacctacccttcggcgggagggcgacgagagggctcacgggtgcgtcttccatgagaggaaaatgcgtggagtcgccaccaacatttattccaggaaaacgtcagaaaaaccggaaaggtgtggtctatgaactttaa

SEQ ID NO: 23125 - DNA, 153 bp, Glycine max
  Peptide Sequence Number=SeqID_139903
atgtcacaaccatcaagactgtatacaatgaatgacaaagatattggcacaaagaaaggcgttcaagaaatggagatgcatttgaaggatgattgtcccttacttcctattgcaccacaatggagtacatactacacacatgaagctcgttga

SEQ ID NO: 23126 - DNA, 1536 bp, Glycine max
  Peptide Sequence Number=SeqID_139904
atggcaggagctgcaccaccacccaagccagaagagcttcagccacacccagtgaaagatcaacttccaaatgtttcatactgcatcacaagtcctcctccatggccggaggcaatactacttggtttccaacattacttggtgatgcttggcacaactgttcttataccaaccactcttgttactcagatgggaggaggaaatgaagagaaagcaaaaatgatccagactctgttgtttgtagctggcataaacacatttttccaaacactgtttgggactcgtctaccagcagttattggaggatcctacacctttgtgccaactaccatttcaatcattttggctggtcgctacagtgacatcgtgaatcctcaggagagattcgagaggataatgcgcggaacacagggtgcgcttattgttgcttcaaccctccaaattgttgttggcttcagtggactttggcgcaatgtcgtgaggttcttaagccctctttctgctgttcctttggttgctctgtcaggctttggactttacgagttgggctttcctgtgtacattcctcatgtgatgaaagcagaaaagcctatctttgatagatttgcagttatattctcagtgacaattgtgtggatttatgctcatcttcttactgtgggtggagcatataaaaatgtaccacagaccactcagagtacttgcagaactgatcgtgctggaattataagtggtgcaccttggattagaatcccatatcctttccaatggggagctcctacatttgatgctggggaagcttttgctacaatggccgcttcatttgttgcactagtagagtcaacaggtgcttttattgctgtttcaaggtatgcaagtgcaactccattgccaccttcagttcttagccgtggtgtcggttggcagggggtaggtattctgttatctgggatctttgggacagggaatggatcttcagtttctgtagagaatgctggactcttggctttaacgcgagttggtagccgaagggttgttcaaatatcagcaggattcatgatctttttctccatacttggaaaatttggagctgtgtttgcttcaatcccagcaccaatagttgcagctttatattgtcttttctttgcctatgtgggttctgcaggcctcggtttccttcagttttgcaatttaaacagctttagaactaaactcatcttggggttctctattttcatgggcttctctgtaccacaatacttcaatgagtacacagcatttaagaactatggtcctgttcacacccacgctagatggttcaacgacatgatcaatgtccccttctcatcaaaagcgtttgttgctggttcattggcactgttcttggatgccacattgcacaacaaagacagccaaactcgcaaggacagaggcatgcattggtgggacagattcagttcattcaagacagatacaaggagtgaggagttttattctctacctttcaatctaaacaagttcttcccctctgtgtga

SEQ ID NO: 23127 - DNA, 201 bp, Glycine max
  Peptide Sequence Number=SeqID_139905
atgtacacagtgttcatcatgagaaagaattatgtgtattccggggttaccatttcccgtggagtctttcaaactttattccattgtatgggggagctgatttacatgactatcatcactggttgctgtacaccaagtctgcaaactactcctcaaccccttacttacatggactggtatgtattggacatattttgctaa

SEQ ID NO: 23128 - DNA, 366 bp, Glycine max
  Peptide Sequence Number=SeqID_139906
atgcaaggcgcagtaactgcagcaatggttgtgtgcctcttcttgaccgtgggtttgaacactctcataaaagcaaacatgtctaaaggaatgagcaatttcgttttcgttgcgtattcaaaccttctcgcgttcgtttttctgctactagcaaccacaatccgccacagaaacagggctcctacaccaatcactaattcaattatcttcagaatttttcttattagcttgctcagcgtttctgttcagacgctttattatattggacttggatatagctctcccactcttggctcaaccatggaggaccttgttccagcttatactttcattattgccattgtttccaggttacagcaattttag

SEQ ID NO: 23129 - DNA, 489 bp, Glycine max
  Peptide Sequence Number=SeqID_139907
atgcagacctggactatcaaagactaccctgaagagctaatactaataaccattagtaccagtttctctgttatcctatctttcataactgctttcgttgcagaggaaaatcctaaggcatggatacttaaacctgatatgaagttggtgtgcatattctattcagcaatctttgtgatgtctacacgaagtgtggtgtatgcatgggcatgtcgaaagaagggggctgtatatgttgctatgttcagtcctttagaaattgtcattgcacttgcaatgggggttgcatttttgggagacgctttatatcttggaagtatgataggagctgctataatagcagttgggttttatggtgtaatatggggccaagctcaagaggaaaagattgtctgtgaaaattatgaaattagtaccattatctcatcgtcatcttctgaagccgcattattgctggaccaaagcaagggcaaaagttcttttgtatga

SEQ ID NO: 23130 - DNA, 396 bp, Glycine max
  Peptide Sequence Number=SeqID_139908
atggggagatgggtgaattgtaggggcaatatattcccattcctggggatggtgatggctatgctagctcaaagtggaagcatggtggtaatcaaagttgccatgactgatggaataaacaaatatgtcatggttgtgtactctttggcactctccaccatcttgcttcttccctttgccttgtttcttcacaggtcagagcgtcctcctcttacattctctgcactttgcagtttcttcttgcttgcattctttgggagttcaggacagataatggcttatgttggcatagatctaagctctcctactcttgcatcagccatgcttaatctcattccagctttcacttttatacttgctctcatttttaggatcttgaggatgcttgtttcttga

SEQ ID NO: 23131 - DNA, 519 bp, Glycine max
  Peptide Sequence Number=SeqID_139909
atgggggagacacatgaaattccccaccacaatctagccgacttcgagccttgcctcggatatgccactgaagggcaagcagttgttgatatacccctgcaaaacacattggagggccctcagtatcacccacaaccacacccctcacattccacagcgagtaaaaaccctcatgctatggcggaaatgggaaagttggatcatctagaggaaaggctcagggccattgaaggagagttgttcctagtacccaatatcatcacccctcccaagttcaaggtgctggactttgacaagtacaaggggactacttgccccaagaaccatctaaagatgtattgtcggaagatgggggcatacgcaaaagatgaggaattgctgatacattccttccaagaaagtcttactggggtagcttttacctggtacactaacttggaaccttctcgagtccattcatggaaggacttaatggttgccttcgttaggcagtgtcagttaattctgatatggctctag

SEQ ID NO: 23132 - DNA, 764 bp, Glycine max
  Peptide Sequence Number=SeqID_139910
gactctccctctctgctctcaagaagttcgggctcgttgacgacgagggcacaaaggatgaacggcgtgttcgcgtgacggacctcgccgtgcagatcctcaaccacccgagttcggacgcacgcgagaccgccataaaggacgcggcgctcatcccgcccattcaccgcgagatgtgggaggagtacgggaccgagcttccctctgacgccaacatgatgtggcgactcactcgcaacagaggcttcaccgaaacaggggctaaggagttcatccgcgagtggcgcgagacgatggagtacgcccagctcagccgcgaagacgcgtcggctgctcatctgagtaatggtgtcggtctgacggacgaggtcgcgactgaactcatcaccggtccagacccagagccggagcgctacgagccgcggcccgaagcgcaattgcagaacgccggctacgggttccccgcgcagcaggcggcgcagatcgttgactccttgccccgcgtgcaggatcccgctctacaggactacaagattcctatcgcgctcgccggacggccgcccgtgacaattactggcgcgttcccgctctctgagactgaatggacacagttcgtggcgatcttgagcgcaatgaagccggtgctagtgggcgcacccatgccgtctgctgaccacccgtctattgctgcgggcgaacaaatcgcctcgacgatcctcgcgcaggacagcgaggacccagagtcacccacagaagcgccgtag

SEQ ID NO: 23133 - DNA, 764 bp, Glycine max
  Peptide Sequence Number=SeqID_139911
tcgacagttcgaaccagtccggctggtggaacccgctcgtcctcgacggcgacgagacgtacttcgcgttcaacgtgccgggctcggaatcggcgaagcatcaggtgaacgtggccgtccgcgccggagacggcacgtggacctccggctgcctgcgactggccaccggagcgtgcgccgaatacctcgacgacaacggccacaaccagccgtcgatcgcgatcgacggcgacgggtacatccacgcgttcgtctcgatgcaccatgagccgtggaagtacttccgctccaccgcgccgtatgacgcgacctcgctggtcgacgtgagcgcggagatgcccgatgccggggccgcggtctcctacccggtcacggcgcagggggccgacggcgacatctggctcatggtgcgcatcggcgccgacccgcaggcccgccgcgacggggtcctctaccactacgaccccgtcgccgggacgtggagcagggagacgacgatcgccgccgccgtgaaccactccttctaccctgacgacctcgaggtcgacgcaaacggcaaggtccacgtgctgtgggagtggggtccgtggccggcggacccttaccgtcacctcggttcctacgcggtgtacgacccgaccaccgggacgttccgtgacatcgcggaccaggcgttgccgactccgatccgtccggacacccccggtgcggtcgtgtggcgcggctacgaaccgggcgagaccatcggcgatgccgtgcccgcg

SEQ ID NO: 23134 - DNA, 1257 bp, Glycine max
  Peptide Sequence Number=SeqID_139912
atgacttattcagctccactgattcacactattcaacaggaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatcccacacaagttcaaggtgccagacttcgagaagtataaagggaactcttgtccccgcagtcacttggtgatgtacgcgcggaaaatgtccatgtatactgacaatcataagctgcttattcatttctttcaggacagcctaactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccaacgttggagggaagtggctgcccagattgtcccgccgttggaagaaagggaaatgaccaaaatatttttgaagaccctgagccagttttattacgagaaaatggttgcaagtgcaccaacagacttcaccgaaatggtcaacatgggggtgcgattagaggaaggtgtccgagagggacgtttgactggggaaagtgtccctgctgcaagcaatgccaagaagtttggaggccactttgcgaagaagaaagatcaagaggtggggatggtagctcatggtaagcctcagcagaatttcaccccatatcgtcaggttgcgaatgtcgcatccgctatcccaaacccatcatatcaccaacaaaggccacattacccctacccataccctccacaacaataccctccacaacaataccctccacaacaataccctccacaacaataccctccacagcaataccatcagccacaataccctcaaaaacaacaaaatcgcccgcaacccccccaacaaccatatcactcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaa

SEQ ID NO: 23135 - DNA, 177 bp, Glycine max
  Peptide Sequence Number=SeqID_139913
gcaacacatacaccagttagcccttcgtccattaagcatgaacgcaagttaggctcagagggaaaactgccaggaagccacattataaacgaaacctcaaggagagttgagcttcatcctcaaaaggaaacaacaccagaatatttagccttccatagattcaaacataaaacgtaa

SEQ ID NO: 23136 - DNA, 643 bp, Glycine max
  Peptide Sequence Number=SeqID_139914
acctactaatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacagaatcatttgctgtcaaattacccattgccttccctactgtattgtgtggcattatgttgagtcagcatcccaatatgttaaactacactgactctgtgataaagagagaatctcctctatccctgcattacaaattgtttgaggggacacatgtcccagacattgtctcgacatcagggaaagctgctgcttcaggtgctgtgtccaaggatgccttgattgcagaactcaaggacacatgcaaggtgctggaagcaaccatcaaagccaacacagagaagaagatggagctggaacggctgatcaaaaggctctcagaaagtggcattgatggtgaagcagctgaggaagatggtgaagcagctgaagcagaagaagaagctgctgaagaagaggaagaagcagcagaagagacagaatcagatgatgattctgaagccaccccatga

SEQ ID NO: 23137 - DNA, 337 bp, Glycine max
  Peptide Sequence Number=SeqID_139915
atggtgggagcaggtttgaaaaaggatcttagagtgtctagggttgtgccaggaggtctcttaatgccttccttttcttctcatcggagttatttcacaaagacttgccatggtaaagaagaagggggaacaagcacacttggagagcgcagtacaacggatagttgtgcgatgatttacttcacgggcgaggtctctgctcagttggtagagctccgctcttgcaattgggtcgttgcgattacgggttggatgtctaattgtccaggcgaggaccgaaacatgccactgaaagactctactgagacaaagacgggctgtcaagaacgtagaggag

SEQ ID NO: 23138 - DNA, 414 bp, Glycine max
  Peptide Sequence Number=SeqID_139916
atggtcacgcatcatgttcacattttagtgaaaagccctgcttttgtcgaccaccctacctttttctaccatggcccaagatcccgatggcatacggagacacccgacggtaacccgcacacaccctttgctatacagcgatccgagagtctagtagcatgcagagacgccttacggttatccgcacctttccaatgtggtcatctgcaccctttccggagatgtcagcatcttccggtagagactatttcagtctcacacttctctcaagagctacacccagagcacgatagcattcagagactaacgtcgtcttctgcaccctttgttaatcgcggccaacaagccggtttacacgcggagatttacgtcctcctacgcgctttctgtcacactgaccctgaaatcaggtga

SEQ ID NO: 23139 - DNA, 177 bp, Glycine max
  Peptide Sequence Number=SeqID_139917
atggttaaagttgtctccagaacatttccattggatttaatgatgaaatctgtgcattttcagtgggctaagcgcgcatgcaccgctaagcgcagcttcatcgcgcttagtgcgaaggagaatctggcaaagcatcatcatcaaggttgcgcgctaagcgcgagatcaatgagctaa

SEQ ID NO: 23140 - DNA, 195 bp, Glycine max
  Peptide Sequence Number=SeqID_139918
atggaaaagatccaaaagtccacttctagggataattcccaagggaagtttcatggactatcagcaacaatgcatcaccaaaagagaaaaactctagatgaggcttcactgtcatcaagcgagtcgaagacccagcatgaccgcagatcgacctccactccttatggctcacatagacccgggtataggacctaa

SEQ ID NO: 23141 - DNA, 237 bp, Glycine max
  Peptide Sequence Number=SeqID_139919
atggctggtatattcttccttttgaaacagcaaaataatttagagaattatgagcggtttcggggagtgacgttaagtcacacattgtgtgtatttctgccttcttgtcttgagcatggacgtgtgactgattcacaggattgttgtgtgtataagataggtatggcaggacgtggtagggatcagaaccgtgacgtccttgaccgcatcaccgcggtgctggaaactctagtgtag

SEQ ID NO: 23142 - DNA, 168 bp, Glycine max
  Peptide Sequence Number=SeqID_139920
atggagcggtgtctaagttctatgtttagtaacctcgcagtcttgctcccaagcctaacacaacttgtagtcttgcactcggcgcagcagccaatactcgagcttgctcatccttggcccgagtgggtccaactcatgaagtgcttgctcgacaagggatacttctga

SEQ ID NO: 23143 - DNA, 393 bp, Glycine max
  Peptide Sequence Number=SeqID_139921
atgtctgggcgctcctccactcgccaatttcctagtcggaaactaggagggaatggtcgtaccaaatccgacccactcggagaatcatcttcgcatatcgcaacgacttggccttcgtgtcctagacctgcgcttataaagctcctacagatgtggcagggcgggccccctttgacttctcatcccaaacgcgagtgtcataccctaatttcgtccggggaccatccgtttgttgggatgcgaccctcgtttgaccacttcgagggggtgcaaatagcaaccaggcccacttgggcagaaagttctccagaaggcggtgccttctggaggaagaaccctagctcgcctgggcgagctgggtggcaagctcctccatcattatcctataaatag

SEQ ID NO: 23144 - DNA, 1209 bp, Glycine max
  Peptide Sequence Number=SeqID_139922
atgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtatccacagatactattctcaatcaacagggacaaaatgtaatatgtgtttatgtagctattggtcaaaaagcatcttttgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgactatctctccaaacaagcacaggcttatcgccaaatagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacag

SEQ ID NO: 23145 - DNA, 219 bp, Glycine max
  Peptide Sequence Number=SeqID_139923
atggaagacgcacccgtgagccctcgcgtcgccctctcgccgaaggttaatattgctagtgctgcaaatttatctgctcaagtgaattgtcaccccatgctgaatgggacaaatttcaaggttgggaaggaagctatagaaattgttcttggctgtatggatttggatttggcaccgagaacagaacaacccacttccactttggaaacctctaattag

SEQ ID NO: 23146 - DNA, 285 bp, Glycine max
  Peptide Sequence Number=SeqID_139924
atgtcagcatcttccgaccgacactatgaaaaagtctcatttgctatccgtaagactcaaagcacgatagcaagcagtggctatggtcgtcccctgcaccgttctcggagatcgtcatccgaccaacactacgaaaaagtctcatttgctatccaaaagacacaaagcacgatagcaagcagtggctatggtcgtcccctgcacctttctcggagatgtccgcttcttcaagccgagactatgaaaaagttttatttgctatccataagactcaaaggacggtag

SEQ ID NO: 23147 - DNA, 317 bp, Glycine max
  Peptide Sequence Number=SeqID_139925
gggaattgagcatcacattgatctcattccagcagcatccttgcccaagtgtctgaattcctatgcaaaggttggagccataaacaacatcaccatcaagtataggcatccaatccccaggaaagatgtgcggagtcgccaccaacgtttatttgtggaaaacgtcggaaaaaaccaaaggaaaccggtcacaacgaaatttctaagttcgggagttgtatttacgttcgaggaaggtattagcacctctcacgtcgacaaaagcggggctctagctcctacgtaccctccatcgaagaggaaatcagacctacgta

SEQ ID NO: 23148 - DNA, 306 bp, Glycine max
  Peptide Sequence Number=SeqID_139926
atggtggatttatgtgtgatttgtggatgtggagagtcgacttgcaccatcgcccgatcgccacctagtaccacatatgacggagtggtacatggagatatgtcgcgggggtcaggagaccttggggatgtcaggcgagctcctggcagtcaaccgataaaagaacaaagaccacaaagcaaggaggcttgtgtggtggctagccagctatggattttgagtgatatctggaatatggcctttggtaatcgattaccaagggtgtgtaatcgattaccagggctaaaaatgggatcaggaagttag

SEQ ID NO: 23149 - DNA, 333 bp, Glycine max
  Peptide Sequence Number=SeqID_139927
atgcacagtacctacaaggaagaaccaacagaggatttagctctccatatctgggaagcttcctttacaacaaagagaagagaaaaaggaaggattgaagaaatacaggtagtggggatgtctcctccacctctagaacctcacaatcactcacaaactcatctcaagctctcaggacgacttccacttcaagctccgttctctgggatggactcaagcggtgtgcttagctggactagccctcgctcaacgaacatgcacaactcattcttcttccagattcttcctcgcgctcagtcaaaggagtgttgcgctcagcaaatggctcgctaa

SEQ ID NO: 23150 - DNA, 399 bp, Glycine max
  Peptide Sequence Number=SeqID_139928
atgaatcttgaaagaacggtcgagaatcttcgcgtaattactcacggaaacattacggaaacgttacggaagcgcctcggcttgaattttcttcacggaaacaattttcctaagcaatttcgagagagagagaacaaaataggggagaaacttgctgcccagctcgcccaggcgagcaaggttgcttcctccagaagcaacagccttctggaggaatcttctggagggcccaagtgggcctggttgctatttgcacccccatttttactaaatacaccccctgccttttttttgctttcgaagaagttacagaaacccacggattgcgcaaaaacacctcttttcgacttccgccacattacggaatttcacggattgcgcaagcctgcttccttttga

SEQ ID NO: 23151 - DNA, 360 bp, Glycine max
  Peptide Sequence Number=SeqID_139929
atgactgttgcagacaatattaagataactcttcctaagaccgataatactaaaatgtttatggggttagtgggagaacactctcaaacaactgataagtctcttgcagggacattaatgagtacacggactatcatgaagtttgatggttcacatactacacatgagcttgtcattgagatggcaaatgttgcaacaagacttaaaaccttgggaatggatgaagaaacaaggcttaagaatcaaggaagtcactcggtctattatgtaagccaccaagggaatcaaggagctggaaggaagaagcatgataaaggcttaggaccattaaagatcaatgacgatcctgtgcaaatctag

SEQ ID NO: 23152 - DNA, 404 bp, Glycine max
  Peptide Sequence Number=SeqID_139930
atgaaacgcatcctgctcgccacgctggccggcctgtgcctgagttccgccgccatggccaaggacttcgtcgtggcgcacgtctacgacaagaccgggccgctggaggcctatgccaagcagacccacaacggcctgatgctgggcctggaatacgccacgcaaggcaccatgacggtggccggccgcaagatccgcgtgatcgagaaggacaaccagggcaagcccgacgtcgcccgcgcccagctcgcctcggcctatgccgacgacgacgccgacatcgcggtgggcccgacctcgtcgggcgtggcgctggccatgctgccgatcgccgaggagtacgagaagatcctgttggtggaaccggcggtggccgattcgatcaccggcgacaagtggaacaa

SEQ ID NO: 23153 - DNA, 351 bp, Glycine max
  Peptide Sequence Number=SeqID_139931
atggagaaatctgaaaagaaaaattttagtgaaaagaaaatgaagaaagcgtacatcacatgggatgacaatgatatggaatcttctgaagattcaaaaaatgaagaaataaacctctgtgtaatggctaaaagttatgaaagagatgaagaggatataaacctgaaaaacaacaaaaatttcataaaaacctctttacttccacacaaaaatataattctagttctatcacttgcttttactgtggaagaaaagggcatggtgtcataccctaatttcgtccggggacttttgcttgatgacatgcgacttttctttggtccttgcaaggtgcttggcacccatcattag

SEQ ID NO: 23154 - DNA, 192 bp, Glycine max
  Peptide Sequence Number=SeqID_139932
atgcacgaaacacaatgtggaccactacgggtgcatagaatgaatcgaaaagcttggttcgaggatccacgatgtcggatacaatgtcctgacatcctgcccgagaatactggagttgctgtacaatgcaagataaaagtcaagtgcagaagtgaagctgcaggatccacgatgtcggacacgatgtcctga

SEQ ID NO: 23155 - DNA, 255 bp, Glycine max
  Peptide Sequence Number=SeqID_139933
atggtaattgattaccagtggctaatttccagataccacccaagatacatagctggccagccgccacacaagcctccttgcttcgtggactttgttcttttattggttgactgccaggagctcgcctgtttaggtacgtcacaggattggccaagcttggttttgggtaatagcaccccacctgacgtccccaaggtctccagacccccgcgacatatctccaagtaccactctatggtcaacaaacaaaagtag

SEQ ID NO: 23156 - DNA, 177 bp, Glycine max
  Peptide Sequence Number=SeqID_139934
atgccaccgtctactgtcgctcaggctgctggagaaggcaatcaacctgctgttgaggttggccctattattggtattgtcgaggtcgcctctggtgctccttcccttgaggccactcttgatgctgaagttgatgcaccaaccacttcgactagtcctatcgtggctccatcgtga

SEQ ID NO: 23157 - DNA, 261 bp, Glycine max
  Peptide Sequence Number=SeqID_139935
atggatttcgaaatctgccaaatcgtgcccaaaaaagctgtcaaattttgtgcattaaaattgtgtttatgtgcagaaaaatgcttgtgcattgctggttatgggaaagaaaatcgaaaagaaaaattggattcgaggccagcacctccagacaaggtaagagtggaagttttgaattgtataatggttttttttaagagtgtctattatgctaatgaaaaaggatacgttcactgcacattcaaaattcatttatgttaa

SEQ ID NO: 23158 - DNA, 306 bp, Glycine max
  Peptide Sequence Number=SeqID_139936
atgtccagtattttcgggccagatgtcctggacatcgtatccgacatcgtggatcctgcagcttcaatgcttttagcaactccagtattttcgggccagatgtcctggacatcgtacgagcagttatgcaagtgggatcagcaacttccattatcagagtcatcaagcacagcggaaattcttcaagttggaagtcgtttccaggatgtcaagacacctcacgtgacatcagctttctgctccccctgtcttcatgctcttactgctgtgaagcagttcactgcagcatcttctatcagctactag

SEQ ID NO: 23159 - DNA, 195 bp, Glycine max
  Peptide Sequence Number=SeqID_139937
atggataacattgaattatcgagtagatatgggagcaagttagcatatgacactagaattggggcaggccttgtggctgatttagggacgacctttgtggttgattgggtggtgggtcctttaatggtggttttccaccatggagatgcagcggaagacaaaggagaagaggggagaggaggcgccatccactag

SEQ ID NO: 23160 - DNA, 170 bp, Glycine max
  Peptide Sequence Number=SeqID_139938
atggcccataaccccattggctatgcatttaagttgttttgggtgaaaaattattttcgtgaagaaaatccaagccgaggtgcttccataacgcttctaagacgtttccgcaagcaaatccatgaaggttttccgccgttcttcattgttcttcattcgttcttcaaccg

SEQ ID NO: 23161 - DNA, 282 bp, Glycine max
  Peptide Sequence Number=SeqID_139939
atggtggaaaatagacttaggtggtttgggcatgtagagagaagaccggtagactctgtagtgaggagagtagaccagatggagagaaggcaaacaattcgaggcagaggaagacccaaaaagactataagagaggttatcaaaaaggatctcgaacttaatgatttggatagaagtatgacacttgtctccccctttatgtcccataaagaagctatcatatcccacttaagttgggctagcctctttctggggttccatactctgactttatgtccatga

SEQ ID NO: 23162 - DNA, 243 bp, Glycine max
  Peptide Sequence Number=SeqID_139940
atggaaattctcatcctgggtcaaggtttaaggtggtttgaggtcttgggtcaaaaggcttgtagaacggccgaacatgatgtatgtcagggtgttggtatggccagcagttcaaggataaaggggatgtcccacatttatttccatgacacacatacaacaatgatgatttggaaattttatgcaaaagtcatgcatacacccatgtggacactcaagcatcaagtttttatggtcatgtga

SEQ ID NO: 23163 - DNA, 430 bp, Glycine max
  Peptide Sequence Number=SeqID_139941
atgggtgaagtagaggaggtacaagagcaaatggccacaatgatggaggccatgatgagcatgaagaagataatggaagccaatgcggtcacagttgccgctaccagcactgttgctaaggtgaacccgatgccctcatctggcctcaaccaaatgaatcatccaaccttaaatatggtaggcaaagatttgggaagtagggacggcccccatgatgtgcaaattcaaaataagtacaccttcccgccatatggctcgcctcccaaggaggatgccaataacttcgctcccatactcattgaaagccaacaacctcaaactaatcatgcacatgtctctcaaaccgtggaggagacacatgaaattgcccaccacaatccagctaactctgagccttgcctcggatatgccactgaagggcaagcagttg

SEQ ID NO: 23164 - DNA, 213 bp, Glycine max
  Peptide Sequence Number=SeqID_139942
atgtcccacgctgttaaagataatcgagggaagtgggccccgaactatgaaggacctttcgttatggggcagaatcaactgggcgtggtcagatgccacgatgaagttggaggccgaaacccatcaagtcaaaatggtaacacgaccacggtttaccacacaatgttgtttcctactttcaggtacttagggatggacgcaagtagaggctag

SEQ ID NO: 23165 - DNA, 170 bp, Glycine max
  Peptide Sequence Number=SeqID_139943
atgacgaatctgatggagatggcctccaatcttgactctccccagaagcttctcctcaccaaagtcatcttcatcaacgacaacaccttctcccaagcctccctcgccgccgaccaagctcgcttcatcaagactgttaaactgcctcccgatgaagatattaatgactg

SEQ ID NO: 23166 - DNA, 477 bp, Glycine max
  Peptide Sequence Number=SeqID_139944
atgactctcatgactcctcctccaatggatcagcaacagcagcagcaggagcacgatgagatgctggttcctcgctctgacctgcctgaaggtcctcaacctatggaagcagcccaagcagaaatcccaagtacagtggatgctccaacagtggatgctccaacagtggatgatacaccaactgccaaattcacttggaccattgacaatttttctagtatttcccaaaaactattttctgacattttctgtgtagggggctataagtggcggatacttatatttccaaagggaaatggtgctggccatctgtcaatgtatatagatgttgcagattcagctacattgccctatggttggagtagatatgcccacttcaacttgactgttgttaatcaaattcatagtaaatattcaataagaaaagacctatggagtcctaatacaagctatattgcaagaattaggcatccatag

SEQ ID NO: 23167 - DNA, 1038 bp, Glycine max
  Peptide Sequence Number=SeqID_139945
ggtctaactggattgatgagagaagctcaggaaaagaatttctttgaagggtttaagggttccaaagaaggtggtcgagaggttggtgaggctgcaatggtggttcctgtgagggggaaattcagattagtagaagatcgcctgggtgaactgggagaaaatctgtcttcaaaaggagaatgggaaaattgtgggcaaaagtattggactccagatatagaagttggaggtgtttggatgaacccagaaggaatagtagagattctatttggtgcggagatagacatagctgccaaattcatggaggacatcgagggggtggtaatgcaaactaacaagcaagatagttggtgttggggggtggatcctagcaagagatacatagtgggcagcgcttacaaactgctcagtagacattcgtcaaatgaaaataatgatggcgtgttcaatgaattatggaagctcaaagtcccaagtaaagcgtcacactttgctaggagcgctttcttggttaaacattgtgggagtccttgtcttgggtgggaatccttgtcttgggtgaacaatgtgggagttttcccacaagatccaagacaacatttcctccaacatggatcgatagcggctgatggattaaggattaataggtggagatgttggtggttggctgtgacttggactatttggaagaaaaggaatgacataatattctccaatgactctttcgacaacaacaaattgatggatgagacagctttcctcatgtggacatggctcagaaatttggagaaggattttgtaactcattttaatcattggtctagtaatcttagagaaggcgcccaaagatcacttccttcaacattctcacagttatctcaagggtatcagaattcagagatggcaaacatggtggatttccttgacttggtgcatatgatatggctcaaaaatttggaaaaaggatttgacatcccttttcattcatgggctagtaatatagggtcgggttttgtactcgggggaattgctctatag

SEQ ID NO: 23168 - DNA, 1236 bp, Glycine max
  Peptide Sequence Number=SeqID_139946
atgttgcacgtaccccttctcggtgtagttgaggcagggcctatcactcacgctctctctgtttctctctctacctcactctctcatctctaccccggtactgaatactgggttgccaaaaatgatggctgggaaaggggagagtgggttcagctgttcagagaagagaagaacaaaaatgctgcgaaaaaacaaaaagcccttaacctgccctttgcaatgtgcaaacttttaggttgttttgaagcttttggggccacctcccctggtgtgggctgtagcatgtgtcaggacctttttaaaccttttaaaacttcagtaaacacttgtgcaagttgtgctggacctgagttcagtccacatttttgccccatcattatcataccaattgactattcttcagattcacaacatcagttcaatgcacgtgagagcgactggggtttcattaatttcatgccacttgctgaattgtatgatcctgctagaggttatcttgtgaatgatacatgcatagttgaagctgacatttctgtgcgtaaagatatggattggtcatatgattcaaaaaaggaaactggttatgttggactgaaaaatcaaggagctacatgttatatgaattctctgcttcaaacattgtaccacatttcttatttccgaaaggctgtgtaccatatgcccacgactgaaaatgatatgccatcagtgagcatccctctggcattacaaagtttgttttacaaattgcagtatagtgacactagtgtggcaacgaaagagttaacaacgtcttttggatgggatacatatgattcgttcatgcagcatgatgtccaagagcttaatagggttctttgtgaaaagctagaaggcaaaatgaagggaactgttgtggaaggcactatacagcaattgtttgaaggacaccatatgaactatattgaatgcataaatgtggattataaatcaacaaggaaagaatcattttatgatcttcagcttgatgtcaaaggctgtaaggacgtatatgcttcttttgataagtatgtggaagtggaacaacttgagggtgataacaagtatcatgctgagcactatggtttacaggatgctaggaagggtatgttgttcattgatttcccacctgttcttcagcttcagttaaaacggtttgagtacgattgtacgcgagacactatggtaaaggagcatttgacatcaagcttagtttag

SEQ ID NO: 23169 - DNA, 2521 bp, Glycine max
  Peptide Sequence Number=SeqID_139947
atggggcaaaaatgtggactgaactcaggtccagcacaacttgcacaagtgtttactgaagttttaaaaggtttaaaaagggtccaaatagaaaaactcaagtgtaatcacacctatgatgtgagctctaaagcaacagtgcagggcaaagcagagggtctccacgattctccagccgacacgtcacagattgatggtgcagttataacaaccacaatcacacctgacacatgctacagcccacaccaggggaggtggccccaaaagcttcaaaacaacctaaaagtttgcacattgcaaagggcagctgaacccactctcccctttcccagccatcatttttggcaacccagtattcagtaccggggtagagatgagagagtgaggttcccagaagacatgagagaaaaagaactatggattgagttcaagaagtggggtgacattagggaggtattcatcgcaaggaatcaaaataagagtggccctacacatgaatctcctgaagcatggaagggaatagaatccgacaaagacagtcaacaagaaacaccagcaaaaggaggaggtagccatagagaagtaagcatgtggcaaaacggtggacaccgaagtatgcgtagcatcaaatatgacctcttgctcatctatccaactataacaagatcaacgaataagatgacatggctaaccaaagcttggataggtagactgaggaacctaatggcatttgatcagtgttgtcaaatggcggttatgacggcgccatggcgtggtggatttttgaaaaaacgccaccaaatagcaatggcattgcgggtttcaaatggcagcctccataggtttaacaatgcacgcaccaacacgagcaccacccgaactcccaaactccttaagtcgatgacggcaccaccaccaggcgagttctctcacgatctcacccgaagtcgatgccgacaccacacaagcaccacgcaccagcgcgagttctctcacgaagaacttatgagggatggaggtgaagagattaaaccaaaatacattggcgatgacatggtgcttctcatggggctcaatgacacaagagcagaagagttgcgtagagaaggagtagaaagtggtttatctatgttccatactctggagaaatggagtccaagtttgaggcctggtttcaggttgatgtgggtgatgtgctgggggattctgttacacgcatgggatgcggaaaacatcacaaagatcgtggaagggatcagggagatggttgatgtggacgaagacgtagatgatcttcaaaaaagagggggagaagggagtgaggtcaggatggatattctgtctaaggaagcacaggttgacggcaagcttccaggaaccaacacagcaacgggtgcagaaggagacgaacctgaaagaaacattgggttgcagcaattgcccgctggttattacacaaactatgtaaccatgatcaacaattatgccaggaggtcatactcactaaatggtgaccccactcagtttgggttaggtgaggaaagaactgaacaaaaagctgacgagatcgatgctttaggtggaagtcagctaataatctttgaagaaaatcactgcgatggggacagggacgataatacaaagcaaggccagacagaaaaggttgagtatgtagaggaggcagatgctaccccttctaatgagggagaaaggaataacaaaaagggtaaaagtggggaagaaagggacccacacctgaagacaaaatttgaattaaaggaactgtatagggaggcacgtgatttaacacaagagtgggaaaaggacaacccattatcgggtcccactgtaaaagtagctgatggaaaaacagtagagaagttcaatgatttgggcctcaaactgaatgggcccagtcacacatggaaggcagcatctcctaaacaaaatggaggcagtgggctgaaggaggttgtcacgtgggaaggaaaatacaaggtaatgcagggctctgtttcaacacccaaaagctgtgagatggtgaaagaggcagcaagcaattgggaaatggcaaaatatttgggagaagggaagcagtgccagtgtttgatgaagattgttacctacaatataaggggtccagggtgggggttaaaatggactccaatcaaaaaattgatgaggaaggaacatgtagatatgctatgtctacaagagactaagaaggaagtgatagacaaggctctatgtcaagctttgtggggagatgttgaagtcagatgggaaatgcaacaagcaattaatagtgttgggggattattctgtatttggagtgacaaaactttcaaaatggagaagcagggcgggggtagcttgaaggaatttaatgactggattggcgacttggaggttgaggacatgcctagttgtatgtacaaaattgtggctaaattgctatctagaagacttaagaaggtgttgccttgtataatagatgaacgtcaatctgcttacatggagg

SEQ ID NO: 23170 - DNA, 507 bp, Glycine max
  Peptide Sequence Number=SeqID_139948
atgggtgactcaaagaagattcctgaagaagagaaaaaccttggctcgcatgatcggttgatccatgtttatcatttcttgaaagacacaactcaaaatcagcaagttcagaattttggacatccttttttattggttatccgtgagggtgagacattggctgaagtcaaattgcgaatacagaaaaagttgcaagttccagatgaggagttttcaaagtggaagtttgcatttttgtcgtttggtcgtcctgagtaccttcaagattcagatattgtatccactcggtttcagagaagggatatctatggtgcatgggagcaatatctcggactggaacacatcgacagtgcttcaaaaaggtcgaacacagccaatcagctgcacttgaagcgttctgaaggtaacaacgagagtggtgaagctaccaatcttctaaagggtagtctgttgaaaaccataatttttttagctgaggtggtgggggtggtgtatagccttcaatag

SEQ ID NO: 23171 - DNA, 210 bp, Glycine max
  Peptide Sequence Number=SeqID_139949
gccaatagcatttgcacatagacatcgggtagttacacttgttgctgaggatgttgagcatatgcatcatgcagctgatgaggttcatgagcagtctcaggaggcagttactgatgatgcatgtgctgatgcccaaggttttccaagcgaaccccatgatacatcaattttgacggaatatgttcatcatgtggcacccacttatccatg

SEQ ID NO: 23172 - DNA, 270 bp, Glycine max
  Peptide Sequence Number=SeqID_139950
atgaagctaagcttctacacaaacgaggatggtacctctgttattatagatgccaagcttagacttcatcaactttgtcggattaaaagatggcctaaaccaaagtacatgtctagctggagatgtgttcgtgccattcaaatagccgctgaagatggtatctttcaaatgtcagggcatgaaaaatttccggtgaccaattcagagaactctgttgcttcctttgatgcttctagccttacaagagcaaaatcaactgatcatttgtga

SEQ ID NO: 23173 - DNA, 210 bp, Glycine max
  Peptide Sequence Number=SeqID_139951
atgtctatgagccctatggcctttcactcccggaatgtaggtttgagcaaaggccatagctattataatcattgccagcaataccgccacaaatccgccttagcctcagaaggcctttcaaccggctctccacctgcgacctggaaagaagatccacctactgagctttctttcagggcaatgagattgcttaagtctaccttgtactag

SEQ ID NO: 23174 - DNA, 256 bp, Glycine max
  Peptide Sequence Number=SeqID_139952
atggcccgcgccaagaaaactggccaaatgatgtctcaggtagcaaaggaaattgctgacaagattgcctcacaaggttcctttatcgcccatggatgtcaggatgtactgactactgccattgggcgactagaacaccctggtcgtctacgtgctggactcgcactgtctcctaagcctgaagttggtccttcagctgctcatatcaacacaaaggagagttgtgttgatccctcagggaatgacccagacacag

SEQ ID NO: 23175 - DNA, 568 bp, Glycine max
  misc_feature (549)..(549): n is a, c, g, or t
  Peptide Sequence Number=SeqID_139953
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggtcggctttccattttgaacttgcacaatgttgttaatcctgtggatgcatctcgtgccaatttaaagaacaaagagaagattgaggagcttatgctggaatggggcagtgaactacaaaatcagcagattgaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcangagaaaaaaggctgcaccg

SEQ ID NO: 23176 - DNA, 522 bp, Glycine max
  Peptide Sequence Number=SeqID_139954
atgaacaacacttccaattctgatcatggcatgaacaacccttctgaggagcataatggatcatacgcatattactcggtagggttatctctagggattctcctaatgatcgctctcataagtctcatttccttttactgtagccatagaagcttgcaaaacagccaagtaagtgtcactgccaacaccagcatggagcttgattctgccttaactatccaagttcatcagcaaaactcttttgtgaacaattatccagtgttgttgttctccgaagccaagcatcataggcctgattcagaaacaatgacatcatcatgttgctcaatatgcttggcagattacaaggacacggactgtgtgaagcttctttctaattgtggtcacttgtttcatagagaatgcattgataggtggttgcaggtgaacctctcatgccccatgtgtcgaaattcgccattgccatctcctctttcaactcctcttgctgaagctactcctttggtaacaagacgtgattaa

SEQ ID NO: 23177 - DNA, 486 bp, Glycine max
  Peptide Sequence Number=SeqID_139955
atggatgctgagaatgtgttcttaaatggtgatcttgaagaggaggtatacatgatacctcctctatgtgtttctcataatccatgggaggtgtgcaagttaaagaaggctctttatggtctcaaacaagctccacgggcttgttgcctatgttcgtcaatgggaatctttcatatggatgttaaaaatgtgttcttaaatggtgatcttgaagaagaggtatacatgatacctcctctatgtgtttctcataatccatgggaggtgtgtaagttaaagaaggatttttatggtctcaaacaagctccacaggcttggtttgagaagttctccattgtcattgcatctcttggctttcgttatagtgattatgatgctgccttgtttctaaagaacactcctcatggtaatattataatctccttatatgatgatgacatgattatcacatgggataatgtggatgggattatagagttaggttga

SEQ ID NO: 23178 - DNA, 702 bp, Glycine max
  Peptide Sequence Number=SeqID_139956
atgtcgcaatgttgcgcatcactggcctcgtgccgtcgggccctgcattggtggcgccatagaggtgtaccatccttcgtggtaggggcctccttactcacaccgttttgggcaagtaatccatcaactcttccatcatcttcacaagaacaacaatttaaagttcctagaatagaagaagtagatatctcctcacttgagaaagatccaggaaagcgtctttctatttggaaatatccgattgaccaacgtgacaagattcgtagagcttacatcaatgctggatcatatcaacctaaaaatatagtgttttcaacttctaccattggaaaacatcgtcaacaatttcaaccttcttggtataataagtttcgaagttggttggagtattcacctcacaaggatgttgtcttttgcttaccttgctacttgttcaataagaatcatggtgatcgaaatgatggaagacatacttttgctgaaatgagatttagaaattggaagaaagtcaatgatggaaagaattgtgcatttctatttcaagaaggagttggccctaacttaatgcataaaagatgtctaaaattttgtgatgatttactagatcaatctcaacatattgagaaagtatttgacaaacaaagtgttgaaattatagcaaacaactgcttacagctaaagatttctattgatgcagtttga

SEQ ID NO: 23179 - DNA, 303 bp, Glycine max
  Peptide Sequence Number=SeqID_139957
atgaagtaccagtttaacattccaaatttattcaatgtcattgtcatcctagtctttcttgcggcggatgatgatttcccatattttatcacatttgtaatagaaggagacctcatcaccatgggagaaatcactgtcggcaaggaattgatatcatggttgtacaacatatctgtggccaattccaacgtcaaggagcacaacattccattgcagtggaggtccaaattttctaaggattgtcatgtgttggccgcagacattaacatgtgtaatggcacaatttggaagtctctacaatga

SEQ ID NO: 23180 - DNA, 126 bp, Glycine max
  Peptide Sequence Number=SeqID_139958
atggcggacactaaactttctgccgcctgcgtggatcgcctcgaggccgccatggccaaactcgctgcagcccaaacttccatggcttccaaacttgatgtcattctccggatattgaataccatg

SEQ ID NO: 23181 - DNA, 1425 bp, Glycine max
  Peptide Sequence Number=SeqID_139959
atgaggcttactgcctgcaaaggagcaacttcatttgaggatattagaactgttacaaatattcaataccctacatatagagaagcatgctttgccatgggatttttacaagatgacaaagaatttgttgaagcaatcaaagaggcaaaggactggggcacaactaattatttgaggaaattatttgtgttgatgcttttaataggtgccatcaataaacctgaagaagtttcgaaccaaacttggcattggctagctgatgacattgcatatcattatagcaaatcaacaataaatacagaattgcatatcgatgataatcatctgagtaatttagcattgctcgagattgaacaactgctgcacgtaaaccaaaaatcacttaaagactatccttcaataccatatcctgaggatgttgattgcacgtcctatctagacaatagcttgatattagcagagctaaattacaacaatgatgagaccatatcagaatttttgcaacttttttcatccatgatagatgaacaaacatcaatttataaccaaatcattgaagtcgtcaacaaaaatcaaggtggcatgtttttcctatatggatttggaggtacaggaaaaactttcatatggagaacattggaaacttcattgagagcaaacaatcaaattgttattatagttgcttccagcggcatagcttctctattgttgctaggcagtaggactgcacattcaaaattcaaaatacctgtacccatttttgaagactcaacatgcaacattcatcaaggaagtgaattagctgaattgctaaatcaaacaaacctaattatttgggataaagcaccaatggctcacaaattttgttttgaagcgtttgaccaaagtttaagagatataattaaaactaaacccagttcaaatcaaatatttggaggtaaagtcatcgtctttggtggagacttccgacaaatactgccagtcattccaaggggaagtcgctcagacattgtcaacgcaacaatcaattcctcttatttatgggattgttgtcaggtcttaagactgacaaaaaacatgcgtttgcagaacaatgaacaatcaccagatgaacaagaaactaccacatttgctaaagggatcctagacattggagatggaattattggacatgaaaatgatggctattccacaattgaaatcccagaggacctgttgataactgaatatgatgatctaatccatgccatagttaactcaacattcccagatttatctcagcatcacaatgatcctcaattcttcaacagcagggcaatattagcttcaaccaatgaaacagtcgaacaggtcaatgattatatactatcattaatcccaggtaatcatagaatcactaatgtaattggtattacatctatctaa

SEQ ID NO: 23182 - DNA, 165 bp, Glycine max
  Peptide Sequence Number=SeqID_139960
atggcatgtgctccagataacatcaagtctattaatggatcaaaagagacacttaaacttgtcgtaagaattactgatctttggtttgttgggactcccaacaggtctgaacaagcggaaatggtcataattgattctcatggagatgcaatccatgttgtctga

SEQ ID NO: 23183 - DNA, 324 bp, Glycine max
  Peptide Sequence Number=SeqID_139961
atgcacatgggagaaccaaagaaggggcagcaaggtcgagcgtatgctaagcgcaacactcattggctaagagcaaggaagaatctggaagaagatgagttgtacagatctcccataggcaatttagttcctctggacttagaaattgaagctacattgagaaggaacagggccgagaggagaaggaaacttctaccagactcaatagttgcatccattcttgaggaagaaactcttttttctgattcattatcacctgattcaccatcaacaagggaatccactactcaattgcctgaaacagctagcatggaagacgagtag

SEQ ID NO: 23184 - DNA, 1136 bp, Glycine max
  Peptide Sequence Number=SeqID_139962
tggtgaccaccctggcggtgggcgatcacccttattgcgcgacaaccgatcatcgtgggcagcgcctgtttgtgaccaataccggggaagactctgtcacggtaattgacctcgcaagccgtcgaaccataggcaagattcgcgtgccaggcacgccggaaggaattgcttacgatgccgtgcggcagcaggtcttggttgccagctggatggataacgtgctggccgtgattgatgacacggcgcaggtattgaagtccgcgattaaggtgggctcgcaaccccgcgcatttggacagtttatcggacatgcacatatatctccatgttcaggccagttgttgcaacaactggccgatttttttgaaggacgctctatgcaaacaaaactatcaaacctcatactggccggcgcgctggccagcttctgttcctccgtattttcccaaccgctcgcttatgtgcccaatgaaaaagacggcgctgtgacggtgattgataccagcaccgaccaagtcatcaacacgctacccaaaaaaggcaagctcggcaaaaaagtgcaggccgccgccatccaccccagcaatcaaaaactctacgtcgtcgtgcgcgataaaaatgccgtctcggtggtagacacccagctcggcaaacaaaccgccctgatcaaggttggtgatgaacccgaaggtattgatatttcagcggatggcaagttgctggccgcctgcctggaggaggaaaatgctgtggcgctggtcgatttacaactgaacaaggtcaagcggacaattgcgacgcagggtaaaaatcccgagcattgcgtcttctcgcccgaccagcaatggctgctcgccagcaatgaggaaagcaataatgtggatgtgatcaatttaaacacattcaaatccgaacatttgattgccgccaccaaacacccgcgcggcgtcggtttcagccccgatggcaaatgggcctatgtcgccaatgaagccgcgagcctgctagagatcgtttctactgccgactggaaagtacaagccaatatcaaagtcggcctgcgctccaacggggttaaggttaatgccgatggcagccgtatttacgttagcaacggcggtgatcacaacctcagc

SEQ ID NO: 23185 - DNA, 489 bp, Glycine max
  Peptide Sequence Number=SeqID_139963
atgaaggaaggcataggtcacatcttagacatcactcccataggagggaaaaggaacaaaagcctcaagaggttaacattaacctcccacacttccatgggaaggacaatgaagtctacttcaaaatcttatggcactcactcatatccaaagaaagaccaaggtcaaagcatcttaggggcgacaacttctaagcctaaagatgataagaggaagacaatagaaaagcaaccccctaaggctagtatgcaagagaagactagctctataaagtgctttaaatgtcttggaagaggacacattacttctcaatgccccaccaagaaaaccatgattatgaggagccaagacattcatagtagccaagatgaggctactacttcaccttcctctagtgaaagtgaagaagcaaaatgggaagaatctagtgaagaaatctacccccaagaagaaggacaacctttaatggttaaggatgagtttaaagag

SEQ ID NO: 23186 - DNA, 627 bp, Glycine max
  Peptide Sequence Number=SeqID_139964
atggaaacagaacatcaaaaaccaaaaggaggcaaaagacctggtgcaggacgcaagccggggtcgactacgtgcttggaaaagactgtggtcattcgtatcccagccagtcagaaaccgctcgtgagccagcttatggaagcttatgtcaaaaagtcaaaaaacctccagctcgcacacaaccttgatccggtagccgtttttgaccagcctgcatccgatatgcgggagatcagcttgccgctattccagtcaaaagtccccgcagggtttccgtcacccgccgatgaccatatcgaaagccggttagatccgaacgagtatctgatcgaccaggttgatagtacgttttttgtcacgattcaaggtgagtccatgatagaggctggcttgatgcccggagacaaagcagtggtagataaaggcaaggtgccagtggtgggagatattgtgttagccatgatcgatggcgaatttacggtcaaaaccctggccaggcaaaaaaatggcaaccccaaattgattcccgccaacgcttcaggaaaatacgcccctatcctgattgaacccgccatgcaatttgaagtctggggcgtggtcattggttcgttcagacggttcaggtaa

SEQ ID NO: 23187 - DNA, 213 bp, Glycine max
  Peptide Sequence Number=SeqID_139965
atgaaaacccaaccattaacggagacacaaaacttacctcgatggtggaacaacaaaacgaagttgcaggtccttaatgtcgacaacgaaccacccaatgcacgacaaacgaacctccaaggaaagcaaacagtgccaagaggagaagaagctcgaacgtcgtcacgaaaacaaccaaacgacacaggaaagagggacgtacggaacgcgtga

SEQ ID NO: 23188 - DNA, 324 bp, Glycine max
  Peptide Sequence Number=SeqID_139966
atggaaactgcaaaagggaccaccaccgaaataacagcaagcaaccaaaaccaaaacggaagaaacaaagcagagaagaaagcgcagtaccaggtcaatgttatgtggagtgcctctcgggggaggttacgaagggtgttttgggtgaagaatgatgatcttgaggctaagaagcttttggaattggaaaaatttatgggggtgtctttcattcaaaatgagcataatgccctgaaggatctagggaagatgaaaaaaagagatcaagaagagctgagattaatcgaggaaaagacaaagaaaggggagaagaatggtgattaa

SEQ ID NO: 23189 - DNA, 981 bp, Glycine max
  Peptide Sequence Number=SeqID_139967
atgagggagtggaatttgggagagtttggttgtttggagagtagaaaaaaggctttaaaagaaattagtatgcttgacaaaaaagaggaagagaaaggtttgagtgtagaagagattcaagggaggtgggtggaagaacctagaaacattaaagaggagatgacgtccttttttgagaaaagatttagagaacaagaaagggaggtaaaggaggctatatgggagtatggaagccaaaagagcttcgacccagataggattaatttcaagttcgtgaagactgtttgggaaacttggaagtgcaatattttgagattcttaaatgaattccattcttatggtatccttccaagggggagaaatgcttcatttatagtccttttgcttaaagtggatgatttgcaacatttgggtgaatttggacccatttctttggtgggatgcacatacaagatgttgacaaaagtcttggccaacagattgaaagtggtgttgccgaggataatagatgggagacaaaacacctttttggagaataagtatctcttggatagtgtgatcactgtcataaggtacactttgtattactgtacccatcaattgcaaaataagcgagggagcgccattgacaacatcagcatcaacaccaccaccagcacggagcaaggtttcgccttgatcatccgagttcgcgaggaagaacaagctatttggaatagttatccactgctattgtactttgaagccgagttgcataggcctgattcagcaacaacaacagcatcactgtgttgctcaatatgcttggcagattacaagaacaccgagtggttgaagcttctacctgattgcggtcacatgtttcacagggactgcattgacatgtggttgcagctaaacttgacatgccccctttgtcgaacctcaccactcttaactctgctaactggagttgctccaatggcaacaaggagagcctaa

SEQ ID NO: 23190 - DNA, 474 bp, Glycine max
  Peptide Sequence Number=SeqID_139968
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatatagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 23191 - DNA, 258 bp, Glycine max
  Peptide Sequence Number=SeqID_139969
atgttgttcacgatccaattccacacacctccaccgttgggatttgcaaagaaatgtctgtggagagagaaatatgcatcgcacgaagcagtacaaaatggaggcttcaatccattctctttctctctaacgtttgggaactctatcagagcaatcagcggaaaaattgaggaatctcagaaaattgctagagatgccactatcgctgtcagaagacacatgagcccgcttagagggatccttagaggactaaattga

SEQ ID NO: 23192 - DNA, 459 bp, Glycine max
  Peptide Sequence Number=SeqID_139970
gcgcagccgccaagaaatgtgagcaatttacatggtgataatgatgatgatgattatcttgtgtctaactcatacgtggaagagtatttagacgaagatgatagtattgacggtatatctgatacagacgatgaagtcaccgacatgattcaactagtaagaattgttcacccagcagaaggtgtacaaggaattcaaaatccattttggaatgatgctttgcattataataatatcaactggagtcatcctgatgaggagggcatttgtggtttcgagatgccatcgagttttaatgttggccaagaattatatgttggcatcgattttgatagtaaagatgcagtcaaacaatatgttatgaaggtgcatcaaagtttcaaagttattgaaagcaaatcaaacaagtatgtcgtttgctgcttgaataaaagcgcagattgtccttgccatttataa

SEQ ID NO: 23193 - DNA, 453 bp, Glycine max
  Peptide Sequence Number=SeqID_139971
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 23194 - DNA, 435 bp, Glycine max
  Peptide Sequence Number=SeqID_139972
atgataatcgagacgctcaaaattgaacaacggatgctctcgagaaatttaaatggtcataagttttcactcggatgtctgattcaggccaataatgtatcgaggcgctcgaaagtgaacacgaaggctctgggcaattcaaacgaccataaatgttttactcaggtggttgtcatcatcaaaaagagggagaatgtaaatcatgcaggttttgatgatgtcaaaatgaatttgcttgataatgagtctcatcatcaaaaagggggagaatgcgagtcatccttgcttcaagatttcttcaagatcaagccttgcctcaaaacaaagggtttcaaagtcatgcaaggctctggtaatcgattaccaggaagtgtaatcgattatgatgaggacatgacagattaccagaaaggaagtttgaaaaagagttgttga

SEQ ID NO: 23195 - DNA, 180 bp, Glycine max
  Peptide Sequence Number=SeqID_139973
atgaaagatattgagctggtagaggaggaacatgcacggattggtgctgatccttctactgaagcagtagaacatacgaacaaaagagatacaggccatcaaaatttggcattggacaataagacaggagattcaactatgctgaagatgggagattcagctaaagttgtgatcaaataa

SEQ ID NO: 23196 - DNA, 270 bp, Glycine max
  Peptide Sequence Number=SeqID_139974
atgaactcgcttagcgcattgttcagttgtggcaagtgcaccggatcacgtggccttgttggtgcttgtgcgcttagcacgaatttggaccgcttagcgtgcatcagtgaatttcggcttagcgtgcgtcttcttgctcagcgggtggactcaagcggtgcgcttagcaggataacagcttgctcagaaaacatgcacagctcatccttcttgcaaattcttccttgcgctcagccaaaggagtgttgcactcagcggatggctcgctga

SEQ ID NO: 23197 - DNA, 836 bp, Glycine max
  Peptide Sequence Number=SeqID_139975
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgtttgcatatcgaagatgcaaacttttcggaaagggagtttgttgatcttcttcctatttgttgggattcatgttttaagttgttcgaggaagttcaggaattcgattcaaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23198 - DNA, 402 bp, Glycine max
  Peptide Sequence Number=SeqID_139976
atgtgggaatcaccagaagtatccctaagaaaagcgaagtattttgtatcaatcattgatgattactccaagagattatgggtgtaccccatcaagaagaagccatatatgtttatagtattcaaggaattcaaaacacaagtagagcttgaaactagtaaaagaatcaaatgcttgaggataaatgatggaagagaatatgtagatagtgattgtttgacattttggaagccaaaaggtggtaggccccaacaaagatcgaacccaagattaaaggcacagttggctagggggtttgatatgaagaacttgggacctacaaacaagattttagggatgcagattcatcaagacgtaaaagacaggaaggtttggctttttcaaaagaattacttatactga

SEQ ID NO: 23199 - DNA, 642 bp, Glycine max
  Peptide Sequence Number=SeqID_139977
atgggtgaagcagaggaggtgcaagagaagatgaaggccgacatggaggccatgaaagagcaaatggccacaatgatggagcacatgatgagcatgaagaagataatggaagccaatgcggttatagttgccgctactagcgctatcgctatggtgaacccaatgctcccatctggaatcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccactcccatactcattaagagccaacaacctcaatctgatcatgcacatgtctctcgacccatggaggagacacatgaaattccccaccacgatctagccaactttgagcctttcctcggatatgccgctgaaggacaagcaattggtggtatacccctgcaaaacactttggaaggccctcagtatcatccacaaccacaaccctcacgttccacaacgattaaaaaccctcatgactatggcaggaatgggaaagttggatcatctagaggaaagcctcagggccattga

SEQ ID NO: 23200 - DNA, 291 bp, Glycine max
  Peptide Sequence Number=SeqID_139978
atgaggccaccacctcttaaagcatcaagggacattatggaaatggaaactctagaagcagcagcacgtgcctatgacttggcagcattgaagtactggggccaagataccattctcaattttccactctttggaatagaatcaaggaacttaccaaatccattacatgctatcgaggttttggtgtgtttccggtgtgaaagaaggaaaaagaaatgcataagcgatgatgatgtacataggtacgtcgagggactacgaattctacatagccatacgcgtgcttcttaa

SEQ ID NO: 23201 - DNA, 303 bp, Glycine max
  Peptide Sequence Number=SeqID_139979
atgcagagttcaaaacgcgatgtctaccttggagcctacttgcatggtgctttaaaaggtcttaatgatgctccacggcctaaatcaaaggctgttgttaggtggattgtcgtcaagtgtaatagaaaaaaaggaagcactgagtgcggctattatgtcatgcaccggatgtccaccatcatattaggaagttttaggaataactgcaaagcgtattttaactatcctagaccattggagccagagagattaaaggcacttcggatccagtggggacagtattatctccgagttagagcttag

SEQ ID NO: 23202 - DNA, 477 bp, Glycine max
  Peptide Sequence Number=SeqID_139980
atgaaggaaggcataggtcacatcttagacctcactcccataggagagaaagggaaagaaagtctcaagaggcaaacattagcctctcatacttccatgggaaggacaatgaagtctagttcaaaatcttatgtctctcactcttatccaaagaaagaccaaggtcaaggcatcttaggagtagtaccttccaagcccaaagatgataaggggaagacaatagaaaagcaaccccctaaggctagtatgcaagataagactatctctataaagtgctttaaatgtcttggaagaggacacattacttctcaatgccccaccaagaaaaccatgattatgaggggccaagacatttatagtagccaagatgaggctactacttcaccttcctctagtgaaagtgaagaagcaaaagaggaagaatctagtgaagaaatctaccccctaagaagaaggagttgttggtgccaaaaatag

SEQ ID NO: 23203 - DNA, 1361 bp, Glycine max
  Peptide Sequence Number=SeqID_139981
atggccaaagctgtcatcccccacgcggctgacccaacccacgttcaggccgagacgcgccaggccggtcgcgacgttgagctcagcgcctgcgacgcgtttgataaagtgctccaccgcactcagctcgcccgtttcggtggcgacaaacatggccatggcctcgccgatcgtgatgacatccagcgtcttgtgcatggtttactcctcgcgcagcagctggccgagcagatccagccagcgtgcatcggcgcggtccggtgcgacggcgcggaagttatctttatgcggcacggcggccttcacgtggatatagctcacggcaggggccaggtgacgcgcggcctcttcaggggagtcgcccacccacagccagttccccatatcgaaggtcagcgtgacggggagcgccatttcccgacaggcggcctggaagcgctgcatgggcgcgagctgtccgcagtcggtctgatcgttctccacgaccagcgccatgccgctggtattcagcagcgtacgcagggcgtcgagcggttgcgtgtcgctgaaatggcccagggaaaccttcagccaaagtgcgttcagagtgttggcttcagaaagatagcggggcagggcggcgggtgcggagtagcacgccagcagacccagcagctcaatggattcgcccagcgcgggcagcgccagcagctcttcgctgttgaacagttcccggcggatctccacgccgtcagcccccgcgccagcaataacggggagcatcgcccgttgaccgcccgcctgtcgcacctgttccgcaccgtacgcggcggtgaccaccataattttcctgcccatcttcggactccatcgcaacatatcaatactattacgctagatggaaccggttccaaagaaaagctcgccggagaagacctgctcgcgaacggcatcgctggtgccttcaatacgacgaacgacttgttcaacagcagcatagccaatctgccaggtgggctgtttgagggtagtaatgccgacgccagccagctccgcccactccagttcatcaaaccccagcagaccgatgtcgctgccccagtgcaggccaatgcgcttgagcgagcgggcaacctgcagcgtcagtgccccgttggcggagataaccgctttgcgcatcccacgatggcgcgtatggaactgacgcagggtgttgtcaagctgcccggcttcgtgaagcggcgtttcggcattttcggcgatcacgccgggataacgctccagcgtggcgcgaaatgcgctcaggcgttcacgtcgggtgttgaccatccccagcggttcactcagaaacagaatggcctcgaagccctgttcaatcagat

SEQ ID NO: 23204 - DNA, 1653 bp, Glycine max
  Peptide Sequence Number=SeqID_139982
atggaggaaaaagtgcaaactgttttgaagctcttagaggaagagggagactcttttgccaagagagcagaaatgtgttacaaaaggagaccggaactgataagctttgtggatgaatcattcaaggcttaccgagctttagccgaaggatatgatcacatatcaacagagttgcaaaatgccaacaacaccattgcttctgtctttccagatcgtgtcccatttatggatgaagaagatgatgatggatcaccaaggccttcaagaaaaaaggcagaagggttcaaaacaaatattccaaagcctcccattaaagatttaaaaaatgtcataacaacagcagcagccacaaggaaatttcattccaagaagccagctgccacaacagcttctgctgctccgaaagttcctaaatctagtttgagcagaaaagaggcacttgaagaggttgacaagctgcagaaacagattctggctctacaaactgtgaaagtgtttgtaaagaactcttatgataattccattgctaggtattgggaaactgatgagcaaatcaaggaatttcaagagagagtttccactctgcaagatgagctgggagaaggtgttgatattgaagatgatgaagctcgccatttgatggcagaagatgtgaaggccaagttgggctctctcatggatgaattccattatgaacggagtaattccgaagagccaagggtccaaagagatttaaaagaaatagcagaaacaaaggacttggaagagaatgccggattggctccgaagaagcagaagttgcaattattgaaggagaacattaaagagcactttgagactagctccaattcatcactcagtgtggcagaaatggcaaagaagattgatgagctagtgaacaaagtgatcagcttggaaactgtagtatcgtcccagactgtgatggtaacgagattgaaaacagatactgatgaacttcaagagcaaattcgaactctggaaaatgataaggaaagtcttatcaaggacaaaaacaaattgaatgaacaactcagaaagatggaagaaaagatgcatggagtacaatatctaaatcaaattgttgaggatcagaataacaatctccaaacccaattcaatgaagcacataacaatcttgatcaactctcagagaaagtccaaaatgtgcagcagccaggcgaggaggccaagaccacagatttatcacacacacaaaaggattcatcaagccaggttgaattaaaaagcaaatctgaaggacaagttcctttgaatgaggacaatatcttgttgaatgatattaagtctgaaaaggatcttacgaatggtttggtagaagatgatgcaaaagataaggagcttaaggttgctggtactgttgaagacgatgtaacatcagacaacaagcttgaggccactagctcaccatttgctaatgaacctaatgtcacccgttcattggaaaatgatgctaagtcagtagataaggttaaggtcaccagttccttagaaatggaagaggcaactcctatggaaaaaaaatctccaaaagagttggaagaacaagataagactgtaaatcctggcaatgatgaaaattacaagcttgaggccactggctcaccattttaa

SEQ ID NO: 23205 - DNA, 546 bp, Glycine max
  Peptide Sequence Number=SeqID_139983
atgaaaagatttggagggccttaccgtgtaggaagcagtgttggggttggtgagaagagttgcttgtgtgaaattgcagagatcaaaggctttttggttcttgatatgaaattcgattcaattacctttgcattttggtcgaagagctcgatggatgttgagccaagacgaataagattgttgtccaatagatatactacaaacacacttttggatactgctgctaccatacagatcttgaagcctaggaccttcttggctactttctatccaaagcctatgatgtctgctacttctgctgctgcatgggaccgacttaaaaagcactatgctagtaggtcacatactcccatcatgtccctcaaggagagtcttgattcaataacaaaactcatcattgggttgaagggacttggccctgcatttcatgaattctctgcctccattcaagaatgtgattctcccttgttcgcaaaacttttccacaaacttgttgatagagatttttctccaacacgaggaatgttagcaatagtccattcctag

SEQ ID NO: 23206 - DNA, 389 bp, Glycine max
  Peptide Sequence Number=SeqID_139984
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaatttggtgtgaatttgcaggttgaaactaacaaagctgttcctagggatgatcagcaaactatgaacagacaaactggtagcatccatggactggatgcaccaaaaagatttttgttggag

SEQ ID NO: 23207 - DNA, 354 bp, Glycine max
  Peptide Sequence Number=SeqID_139985
atggaatctggtactccaaaaacctttgactggaccagcagacttgggatagcaactacaattgctgaggctttatctttcttgcatcaagagctatgccatcatgctattgttcgtggtaacctgaaatcctccaacattttgctaaacaagaatatggagccatgtataagtgaatatggtgttatgggtatggatgatcaaagaggttccctttttgccagtcctattgattctggtgcattagatatctttaaggaagatgtttatggctttggtgtgattctacttgaattgcttactggtaagttagtgaagggcaatgggattgacttgactgattgggttcaataa

SEQ ID NO: 23208 - DNA, 1032 bp, Glycine max
  Peptide Sequence Number=SeqID_139986
atgagagaggagtcacttggactgattattggggtttccataggtgtggttattggactagttttggcaatttttgcgttcttctgccacaggtaccatcgaaagcgatcacagataggcaatagcagttctagaagggctgctaccatacctatccgcacaaatggtgctgattcttgtaccattctatcagactcaaccttaggtccagaatcaccgataaagtcaggaagaaatggtatgcccttctggcttgatgggtttaagaagagtagtagcatgatcccagcgtctggactacctgaatatgcatacaaggatttgcagaaggcaacacataatttcaccacggtcataggacaaggtgcatttggtcctgtttataaagctcagatgtctactggtgagactgttgcagttaaagttcttgcaatgaattctaagcaaggggagaaagaatttcacacagaggtcatgttgttgggaaggttacaccataggaatctggtgaatttggttggatattgtgctgaaaaggggcaacgtatgcttgtatatgtatacatgagtaacggtagcttggcatcccacttgtatagtgatgtgaatgaagcactgtgctgggatttgagggttcacatagctttagatgtggcacgaggcttggaatatcttcataatggggcagttcctcctgtaatccatcgagatatcaaatcttccaacattctgttggatcaatccatgctagccagggttgctgattttggactttcaagagaagagatggcgaataagcatgcagctattcggggtacctttggctatcttgaccccgagtatatatcttcaggaacattcaccaagaaaagtgatgtatacagttttggggtgttgctctttgaaattatggctggcaggaatcctcagcagggtcttatggaatacgtagagcttgtaagatctctttctctcccttcaaaccatagtgaggataatggaattggtggttacttttttggagatatatag

SEQ ID NO: 23209 - DNA, 711 bp, Glycine max
  Peptide Sequence Number=SeqID_139987
atggtgggctacacaccttcaagctttgttgatttagttttcaccgacgaatggaataaagtaggtatgaaaagaggcaaatttaatcatcttgcttggacgaatgagaaaagtggggcaaatgaagagggtgagaatgagggagaaacccatgctgtgactgccattcctatacggccaagtttcccacctacccaacaatgtcattactcagccaataacaacccttctccttacccaccacccagttatccacaaaggccatccctaaatcaaccacaaagtctgtctaccgcacttccaatgacgaagaccacttttagcacaaacatttttatacaccaactaaaaggaattttgcagcaaaaagcctgtagggttcaccccaaattccgttgtcatatgctaaacttgatcccatatctacttgataattcaatggtagccataaccctagccaaggttcatcaacctccgtttctccgagaatacgactcgaacgcgacgtgtgcttgtcacggagaagccccggggcgttccattgagcattgtagggctctgaagcgtaaggtgcaaggcctaattgatacgggctggctgaaatttgaggagaatcgcttgttgaatcctaacattaacaagcaacaccatacatggggcaattctggaagctgttgttatgaggggcaattctggaagctgttgttatga

SEQ ID NO: 23210 - DNA, 462 bp, Glycine max
  Peptide Sequence Number=SeqID_139988
atgtttcattttcttttgtctaaatgtacaagcaaagtcattgcaccttctgtctctctgtggaagggtggtgaccaattgagatttttccaagcggatttgcatgaagaaggaagcttcgatgaggctgttaaaggatgtgtcggcgtgttccatattgctgcttcaatggagctcaatgttagtgacaaagaaaacaatgaggcttttgttcaagcgaatataattaaccctgcaatcaaaggaaccataaaccttctcaagtcttgtttgaaatccaattctgtgaaaagggttgtcttcacgtcttccattagtaccgttactgccaaagacataaatggaaagtcgaaacatattgttgatgaatcttgccaaatccaccctgacacatgtctatgcactttcaaagcttctcacagaagaagcagcatttcaatttgcaaaagagaacggcattga

SEQ ID NO: 23211 - DNA, 264 bp, Glycine max
  Peptide Sequence Number=SeqID_139989
atggggtcaatcgctttagttcacattgaagatatatgcagtgctcacatattcctaacagagcatgctaaagcagaaggtcgatacaaatgcagcagccaaagttgtacattgaagacagagaaaaattatgacaaagttccctctgtgatttcatcaaagaagctagaagatttggggtttagttacaagcatggccttgaagatataatttatcaaacacttatgtgtttcctagactatggttatttacctcctgtttag

SEQ ID NO: 23212 - DNA, 570 bp, Glycine max
  Peptide Sequence Number=SeqID_139990
atgcacgttttcacctctctctctctctctctctctctaaactctagcccaaaaaccctaacacctcctcgtccaccacccacgaccactggtagctaccatgagcatccgttgcttgtcgtcataccaccgtacaaagatgaacgctttaatcagagtgaaatcttcataatatacctcaaggattcgataaagaacaaagctctcaacccttttttcgttgtttcttcgaggagtgcgggcccaatgaagaacaagaagaatggaccccaaaatcaaggaaaaccataccagacccctcctaagcaatatgataaagacatgacatgcttcaattgcaaacaaaaaggccatattcagagagatcacccatatcccaagaatgagcataatggtgggggtctaaatgaccaaactagacgtttgaaggccacgagaagagtcttcactcttgatggtgttaaagcttcgaaatccaaagatataatccaaggttccactcaagaacttataaaggaacataaagtggaaaaagacaagtgtgcacattatagaaaaagaaaaccttaa

SEQ ID NO: 23213 - DNA, 548 bp, Glycine max
  Peptide Sequence Number=SeqID_139991
atgaaggtgtttatgaggaagacattcttaccaccttcttgtgagaaagatgcttatgaaaggcttcaaaacctcacacaaggtagcaagagtcttgaagaagacattcaatgcattgtgaagttgaagcactatgaaagtttggaggatatggtgcagaaagccaagaaagtggagagacaacctgagaggaagcattcctacaagaagacctatcactatgacttttctagtggtaaagacaagtccaagaaggagggatcttccctacccaagcaacaaggttcaaagtctctaagtggtaaacatgatcctaaccctatcactccttctacttctaggagtagttcaattaaatgctttaaatgcttgggtaaaggtcatattgcattacactatccaaacaagaaaaccaaagttttgagggacaatcaaattattactagtgagtttgcttctattagttcatctaatatctctagtgataatgatagtggatgtggtaccaaatgtctagatgatgtgttggaggttgttgggtatccaat

SEQ ID NO: 23214 - DNA, 403 bp, Glycine max
  Peptide Sequence Number=SeqID_139992
atgaagattattatctcaatcccattaatgaactgtgatttatccagaggagagcagcacaaagatagttgttatttttattctataaataattttgaccgaagacaggaatcggtcatgtatgaataccttgaagaggaaagagcccctgatcttgagagtattttggcagacttcatgacataccaagctagctctaaagggtcatgttatggaatgcaacagcagggaactcagtttcaaaggaaccagttttctacaggctatcaatgggagtcattctggcaaccaaattatcacgataaaacagaaggagttcttaatctggatgatctgttaatgcaattcaaagatacagtagagtcaatgcaacaagcctttagaagaattgcaactaagatta

SEQ ID NO: 23215 - DNA, 660 bp, Glycine max
  Peptide Sequence Number=SeqID_139993
atgactactaatgactgccatgagctgtcgttccttgccgccggagcacggcatagggatgaacactttaatcaaagcagaatcttcaaaatccacctcaaggattgggtagagaatgaagctctcaacctttcttttgtagtttcttcgaggatagcttatgctctccaagccttagcccaggctatggggaatcgaaattggggagaagatgtcggagttgctaagtatcaagggttggatcgcttccaacaaaacaatccacctgctttcagtggaggctataaccctgatggtgctcagcactggctatgggagattgagaaaatcttccaagtggtggagtgtatggaggagcagaaggttgcttttggcacatacattctggtagaaaaagttaagtattggtgggacaacacttgccaatccttggaggctaaagctaggttaaaagaactggtgactcattaccaaggaagagatggtgaaagctcaaaatgtgggaagtttatgaatgacttgcgacatgaggtgaagcaagctgtaaattatcaaggtgttcatcagtgtgtaggatttgggatgaggactcccaagacagggcaacatattatcggagtacgggcccaatggagaacaatcagaggactgctattatga

SEQ ID NO: 23216 - DNA, 333 bp, Glycine max
  Peptide Sequence Number=SeqID_139994
atgaaggccgacatggaggctatgatgagcatgaaaaagataatggaggtcaatgcggctgcagtttccgctaccagtgttgttgctgaggtcagggagggaaaaagttgggaagtacgggcggcccccattgcttgcaaatttaaaacaagcacgtcttcccaccatatggcttgcctcccaactatacaccacccaatgtggcacacactcccgatgagaatgtcaatgactccactcccctactcattgagagccaaaaaccttaatctaatcatgcacatgtctctcaacccatgggggagacacatgaaataccccaccacaatctag

SEQ ID NO: 23217 - DNA, 417 bp, Glycine max
  Peptide Sequence Number=SeqID_139995
atggagtataacatcatgaatacactccaacatatgaccatggtagctacagcctaccaaacctcccatgaatgttcggaagaaaccattatagatattttagtggtaggattttcaggacaattaaaagttaagacagatctcaacggaaaagtcattactaatgacgaagataaagagattcctaacgctgttaatacattaatttttacaatagcccaacacttcattggagacccatctttgtggaaagataggtccgcaaaattattgtcaaaccttaagtgtagaaccttagcagactttaggtggtacagagatactttcctaactaggatttacaccagagatactttaggtgaaccacacacctgtgtacataatcactgcatgttttcatcacttggggaccagtga

SEQ ID NO: 23218 - DNA, 177 bp, Glycine max
  Peptide Sequence Number=SeqID_139996
atggtggcagagaaccaactgaggagagggggggggggaggagggggaggtgaggaagctagtgattgtggcgaggagagtggcagaggaggaggagtcatcgttgtcgacgatgtagttcacgcatttggacgtgtgacatggtttcgtatgtgtatcgttgatgtatccaactaa

SEQ ID NO: 23219 - DNA, 252 bp, Glycine max
  Peptide Sequence Number=SeqID_139997
atgtggtcatctgcgccctttccggagatgtcagcttcttccggccgagactcttttggtctcacaacatctgctgatcctgacccatgcgtcaggtggcaggcggatatacccaagtggcaggcagatatacccaagggattatccgtacaaggacaacatttgttaatcctgacccatgcgtcaggtggcaggtggaaataccccaagtggttacccgtacaaacacaattttgttaccccgacctgtga

SEQ ID NO: 23220 - DNA, 219 bp, Glycine max
  Peptide Sequence Number=SeqID_139998
atgtttggtgttggaacaaaagaatgggctttggctgagctaataaaaaatccaaatatcatggcaaaagaaaggcaagagattgattcaatggttgttaagaatagcgaggcagattggctaagcgagcctcgttcgcttagcgaggcaaccaactcgcttagtggatgcaaaatcctagaagatgataagccagagatcaccgcacttagcgcatag

SEQ ID NO: 23221 - DNA, 276 bp, Glycine max
  Peptide Sequence Number=SeqID_139999
atgaaaggctctccgcatggaattaatgcaaatttcacttcaatttcagcgagtaagaggaattttgaagggaatctgccatgtaagcacgcgctcagtgcgttatcagctcgcccagcaagtcatctatctcttctggtgcttagcgcgcctagctcgctcagccaaagatcacttactcgtgctaagcgcaaaaatggcgctaagcgcgccttcaaggatagaaaaccctttttaaagcctgaagtgaaagaaaagagagggcttggtggataa

SEQ ID NO: 23222 - DNA, 759 bp, Glycine max
  Peptide Sequence Number=SeqID_140000
atgacaaagaatgaaaaagttattggcgacagcaaatacttgtcttctcttaaaggtcatcaagatgcttgttccatgtctactgacgaatcagattcttttgtaggaaatgaacatttgaagaagaggacagtaagaatagagagacaaagtgaaaaacagttggaattgaagcatacaaatggcaccttttctgagaaggatttgacattgcatacaaagaaaagattaggaaacagaatgcaagattgcaaagattttctctctaatgacttgaaatgcacacatctgtcaagttcaatatgtgatgcacgtgaaacagctgaagtcactgccaaagcttttgaagcctccaaggagtttaatgagaatcgggtgcaaggcagaatggttcctatagaagctttgaaggaggagtcgttggagtccatatctggtaaggattttgagaaaactataaagcaaaatgcgggaaatgattttatgaaaaatgctttagagcataaacttgaaaattcccacaaggataattatacggaccctaagaataataacacgtgtaatactttcatgatttccaagaaatttgaatgtgatgcagtgaaacataagagtgcatctggggctaaggtaaaggaaagacagaatggtctcaaagtggccaaccagttgctagttgtacttcctattgctgaagacaacattgctgcagagatgatttcatcaataggagtgcctctagttgttgcggaagattga

SEQ ID NO: 23223 - DNA, 225 bp, Glycine max
  Peptide Sequence Number=SeqID_140001
atgtataaaggaattagtgggagtcttctctgtttaaaggagctagtaggagcaatggcattacaagaggggaaggtgaagatcgagaagttcaatggcagagatttcaatttttggaagatgcaaatagaggattatctatatcaaaagaagctttatcaacccttatcaaggattaagccagacgacatgaagcaagaagaatggaacttgcttgatcgatag

SEQ ID NO: 23224 - DNA, 195 bp, Glycine max
  Peptide Sequence Number=SeqID_140002
ctcatcagttgggctaactgtgcacccatcgctaagcgcagcttcagcgtgcttagcgcgatagaagaatctggcagagcatcaatatcaaggttgcgcgctaagcgcgagattagtgcactaagcacagcagttgtctttagccaggctcaacgcacgactagcgctaagctcaaatccacttactcgcactaa

SEQ ID NO: 23225 - DNA, 714 bp, Glycine max
  Peptide Sequence Number=SeqID_140003
atggagaaagtagaagagaaaaagaagataaagggaaacattaaggataacatgccaacagtgtggttctctctgaagaagtccttacactgcaaatctgagccatctgatgttcatgaccccaaaacaaggaagcagttgagcacaatcttgacaaagagagcagggaggtcagggtgttcaaggtccatagcaaatctcaaagatgtaatccatggaagcaagaggcatcttgataagccaccaagttgcagtccaagatccatagggagcagtgagttcctcaaccccataactcatgaggtgattctgagcaactcaaggtgtgagctgaagataactggctatggagggttccaagaaggggttggaagtggtggtagcaatgctggaggaggtggtattggtggttctacttttgtggggactttgaggcctggtactccaggccctggagggcaccctacaatgcactactttaacccttcttttaggacttcatccactcctccaaggaaatctcctttcctatcagataaagaagggtctggtcctcatggtgctggacttcatcctagcaataggttgtctcttgagacagattctaatggctcttcaactgtgacttgccacaaatgtggagagcaatttaacaaatgggatgctgctgaagctcatcatctgtccaagcatgctgcttctatattcaagtga

SEQ ID NO: 23226 - DNA, 1170 bp, Glycine max
  Peptide Sequence Number=SeqID_140004
atgtcaaacaacacccagagacaaagtaataacattaataacccacaagatgaacacataggtaatgaactagtagacaatgtgcaagtcacaaatgaacaagtgatagaagaggcaccaaacgtgactcggaaaggaaatattgaaaggtataaagctagactcatcaccaaaggtttcattcaaaaagatggcattgactacaaacagaccttgtctccaatttctaagaaggactctttgagaattgtattgactttgatggctcattatgattcagagcttcaccagatagatgtaaggaccgcctttctaaagaccatcgttgatcggtgtatctacatgaagaaaggatatatcaagaaagttttagagaattacatgttcacatataggaggtcagatcaccttgaagtaattggctactcggattcaaactatgttggatgtgtggactcaaggaagtctacatttgggtacatctttcttttggctggagatgcggtgtcatggaaaagtgcaaaacaatctatgattgccacttctaccatgaaggctgagtttgtgcatgttttaaggccacaattcgagcattgtggttgcaaatttttacttcagggtttgaatgaaaaatactctaaaggagcaaaacatgtgaatttaaagtatttgtcagttaaagaagaagtgcaaaaacataaagtgtttattgagcatattggtacaaacttaatgataacggattcgttgactaaaggtttaccacccaaggcatttattggccatgttgaaaggatgggtgttatggataagtccttgagaccaaggaaaggaaatcagagaaggaagaaataccaaccaggaaattctaaagtgcattatggatttggcttaaacaaacaagcactaaaactttgtggtaaattaccaattcgaatgatagggaggagtcttcaaaagaacaaaaagggagctcctctgactttgaagcaacgcaaaaggcgcaatagagtcataggtaatgcaaggctagtgagagtaacaatgagcttcacttcgacaaccttggtgtcagggccagcaaaaaaggagaagcaaagggagctgccatgggtccaagagatggagatgcgacaaattggagggatgagacagtggtcgagagggtaa

SEQ ID NO: 23227 - DNA, 236 bp, Glycine max
  Peptide Sequence Number=SeqID_140005
atgcccttagagcactggttagcatttgcctttttctataacttaaattacaacatctgcactccatcccagcaaatggaaatgtctatggtacagcaggttgtgcctcggcatgacaactatgctcaaagtcgggcaactgctctgcacaatgtggaatctactatcactgagcttagtgggattttctcacatttagctacaatggttgcccatcaaggggagcttgctatcag

SEQ ID NO: 23228 - DNA, 339 bp, Glycine max
  Peptide Sequence Number=SeqID_140006
atgttgaggaaggtgctgattgagtctgccatgttggcaattctgagtttccttcaaagtcagtatgcgacggtttatgttttgcatggcggcaatggctacctggacacttcaactctcaagtcatatactaccaatcttcgacttttgtctaggaaagatgaaggatatagtagaggagagacaaggttgtggaacatagtggagatgcatatggtccacttgatgatacttgaattagcagagttgtctcttgatgaaccagagttggaagccatgctatttcttgatgatgggaatgagggagaggagaatgaaacaggtagtgttaggttgtga

SEQ ID NO: 23229 - DNA, 206 bp, Glycine max
  Peptide Sequence Number=SeqID_140007
atgggggccacaaacgtgttatgtggcatgtggtccaagaagtacattttgatagtgtcgcctagtgttgaatttgttattcctataacgctggaagaggtgtcgtacggagcttggagtagaagagaagagcaagagaatggaggaagcaagcgtgatgacatcatcgaagagcatgcgactgtagaaatgctcattgattttag

SEQ ID NO: 23230 - DNA, 2817 bp, Glycine max
  Peptide Sequence Number=SeqID_140008
atggaagaaaccaaagatgaggaggttgaatttgtgaaggactttcttgggatggtgttactcaacaacggtggtttagtgattttgatgcttcaacacctacccaagtttttgtttttgtttggagttgcgtttttgatcgattcttgtgttttgatttttggtgcaaacccttggttggtcttgcgggatgcaactctgaaaggtgatgaagggattgaatgggcagcagtcagcccttcggaaaagaagcaaacagaagatgatttggttagggagatacttgatccagcatctggattgttagatgagcatacgcacatatcagaaccgcctagtccaggccctgcagttggatcaccttcacccagtttaacaccatctcctgaacccagtctagcaccatcatctgaacctagtctggccccatcaccctttgctccaacgcctctagttcatagacctctgcataattctttgccaccaacatcatttttcccaaaattgacaccaccagcagcttcagaaatttctgctcctccaccttctgacattaacaaacaggaagagaagcatagtaataaaaaaacagttgttctcgctgtagttataactgcattagtgacatttatagctgcagcagtgctctttttatgctgtactcggtatcgtaagactggccatgttagactaaatgatgatagacctcttctcagcttgagcatgagtgactactctgttggtccttccagttattcttttggaaattcaatgaaaggggagaaagttgggtttcagtcatcaagtaatagtttagtagacaataagaagtactcagtgcaggaaagtcaatcaataggagctcttaatgctgctgcgggatcaccatttgaactgaaacctcctctcgggagggttcccaccatcccttctggaatgcctcctttaaaacctcctccaggcaggctaaaccctcttcctcctgagccaccttcatttaggccttctggtgatgctgctccagctgctactgccgctgttgctgcagcttctcctgcccctcaacagcctgctattagtagcactccaccaccaccccgaccaccagctggtgccaaacctggcccacccctaccactactgccagcactagctggtgccagacctggtcctcctccaccacctccagcctcagttggtgccaaacctggtcctccaccaccacccccaggaccagctggtgccaaacctggtccacctcctccaccacccccagctggtgccaaacctggttctcgtccaccaccacctcctcctatgagtggtgtggctcctcctcgacctccgcccccgtttggttcaaaggtgcaacgtcccttagctagtggatcaaaagctacagttgaagctggagtagaaggtgaagctgatgctcccaaagccaagctaaagcccttcttctgggataaggttcaagcaaacccagatcaatcaatggtttggaatcaaatcaaatcaggatcattccagtttaacgaagagatgatagagacgctttttggctataatgccgtggataagaacaatggtcaaaaacagaaacagtcttcctcccaagatccttcaccactgtttatccagatcattgacaaaaagaaagcacaaaatttattgattctgttgcgagcattgaatgtgacaatggaagaagtttgtgatgcactttatgaaggacatgagcttcccccggaattccttcaaaccttgctgaagatggcaccgacatcagatgaagaacttaagcttagactttttagtggtgatctatctcaacttggacctgctgaccgtttcctgaaagccatggttgacattccatttgcatttaagcgaatggaatttctgcttttcatgggctcacttaaagaggagcttgcaaccattatggagtcttttgccattttagaggttgcttgtaaggaactaagaaacagccggctgttcctcaagcttcttgaagctgttctcaaaactggcaaccgaatgaatgatggaacattccgtggtggtgcacaagcatttaaacttgatacacttctgaaattatccgatgtaaaaggaacagatggcaagactacactcttacattttgttgttctagagattatccgctccgagggcataaaagccatccgaaaggcaaaagagagccagagctcgtctagtattaaatcagatggccttcctgatagtacccaagaaacagaagatcactaccatgaaattggtcttcaggtggtttcacgcttgagcagtgaacttgagaatgtgaaaaaagcagcagttatagatgctgacagcttaacaggaaccactgccaaacttggctatggtctcataaaaacacgagacttggtaacaaaaaccatgaagaatgtggaggaagataggggcttttgtgagacggtgaaaagttttgtgcagaatgctgaggctgatgttacaaagctgctggaagaggagaagaaaataatgactttggtgaagagcactggtgattatttccatgggaatgctgggaaggatgacggcataaggttgttcatagtagtacgagacttcttaataatggtggataaggtatgcaaggaggtgagagatacacggaagaagctggcaaaaactctaaaacaagagactcctagaggagcatcttcatctgaaacacgtccaccacctgattttcatcagcggctttttccagcaattgctgaaaggaggatggatgacattagttcagacgacgagagtccatag

SEQ ID NO: 23231 - DNA, 279 bp, Glycine max
  Peptide Sequence Number=SeqID_140009
atggaagaagaagcagaagaagcgattcggcaaagcaaggagacattgaaaaaacaggaggaaaatggcggcgagagagagagactagggcaaataacaacaacaacaccaaagagcagtcgtgaaggaacgagaaaaaagatagttttcggaggtgaagaatccaactcaatctcgtcagcaacgaacacatgtgcctttatattttcaccgcctctgtgggaatctccatggcaatggaggtgcgaacagagagagagagtgaggaggataatttag

SEQ ID NO: 23232 - DNA, 162 bp, Glycine max
  Peptide Sequence Number=SeqID_140010
atgcatctttctattgttagtagcaacgtcctaccacttggaaaaaatactctcaacatcaccattattgctcagatgggtgaggaatacaacatgacgggggatgaattgatgagcaaagtgatgcaggatcttttcaagttatatgaagtgcctctgtga

SEQ ID NO: 23233 - DNA, 165 bp, Glycine max
  Peptide Sequence Number=SeqID_140011
atggagaatatggtgagaagctacacgagttcgaccctaccccttcttccattgaactggacgaggtcgacttcatcactccaacttcccggcttcaagtttcatgaagaaagagattgggaagacacacggatgtcatcaatgaatgttagcttgacatggtaa

SEQ ID NO: 23234 - DNA, 258 bp, Glycine max
  Peptide Sequence Number=SeqID_140012
atggcgggcacgggctctctcactatgcgtactcacagcatgagctccactgcacacaatggacgttgtcgagagagcgaggtttcgaggaactttcagggggagagaggggttagagttaaggcccagcagagcttcagggagagaggttcagctttaattggaaaggtctccaagcgtgtatgggccacgcacgtgaggaacaaagacgggcttatcagaggatcatcgttgtcttacattaaggtaacattctaa

SEQ ID NO: 23235 - DNA, 707 bp, Glycine max
  Peptide Sequence Number=SeqID_140013
atggcatcactgggatctccgtcttcatcattctggtgctaccgctgcaaccgcatcgttagggttccacaaaacgacgccgttctcctctgcccagattgcaactccggcttcctagaagagctacaaacccctccccactcgcgccgatccacgcgcggcggcggcgggtcccccttcaacccggtaatcgtcctccgcaacgcgaacgacgtcgtctcgcccgaaacgcggaacttcgaactctactacaacgacgccgtttcaggttcctccggcccaagcactctccgccccttaccgcaaggagtaaccgagtttcttttgggctcgggcttcgacaatttactcgaccagctcgacggcgccgcggggggcagcgctccgcctccccccgcggcggcgtcgaaagcggcgattgagtcgatgccggtggttaagatcctcgcgagccacacctacgcagaatcccactgcgcggtttgcatggagaattttgagatcaactgcgacgcacgtgagatgccgtgcgggcacgtgtaccactcagagtgcatcgtgccgtggctctcggtgagaaactcgtgccccgtgtgccgccacgaggttccttccgatgaagttgaagaaagtaatagtaatagtaacaataatactgtggggttgactatttggagacttcctggggggggattcgctgtgggcag

SEQ ID NO: 23236 - DNA, 441 bp, Glycine max
  Peptide Sequence Number=SeqID_140014
atgaggtatcttagggagttccatgcacatgggattcttcctaggggtactaattcttccttcatttccttgattgctaagtgtgaaaaccctcaaggatttggtgactttaggtcaatctcccttgtcaattgcctttataaaatactagctaagttattagctaataggatgagtaaggtgttgggtgaagttattgatttgacacaaagtgcttttcttgcagagggtttaagcgggttgatgaaagaagcaaagaggtgtaacttgttctccggatataaggttgatgataacggttgtgaggtgggtttacttcaatacgccgatgatgctatctttgtaggggaagggtaccaagttgggaggtggaaaaatgtgtggacttgttgtattgtcatatgctttcttttccttttgtatacctgggcatccttatag

SEQ ID NO: 23237 - DNA, 333 bp, Glycine max
  Peptide Sequence Number=SeqID_140015
atggacggagggtttaacggcgctaacggcgctcccagaagagtcgcttgggatagctctgttgggaggtctagggagagcagagggttcggttctgctctgaggaatgtcttttcgtatttcgggagggtgaaggagctcgttttctcgccgaacgagaaattcgcgtgccaacggaagatctcgctcttaaaaaaaaaacactgcaatttccaccgtaacctcaaggtttttgaggtcactgactctgtaaagcggtctcgcaatcggcgtcaccacattggtcgcgttttgtcatatcaaagactcggccgggacgagaccccgcaataa

SEQ ID NO: 23238 - DNA, 339 bp, Glycine max
  Peptide Sequence Number=SeqID_140016
atgttggacttacattttaaaatatcagacgatagccttattttgcttacgctctcttcttctccatctaagcttcttcttctccatcgcgctcaagatcgtgatagcttgccaccttacccaggtacgttttgcgactctttcttcttctccaccgttctattgaaacctaggtctttttggggaactcgtgctcactgcaaggacctttgtttgtttctgctgcaaggatttggtttatggaactcgtgctcactgcaaggtgcatccacagtcaagcatagtaaggattttgcaagacatagtgaagctggtcgggctctacactatgcaacataa

SEQ ID NO: 23239 - DNA, 309 bp, Glycine max
  Peptide Sequence Number=SeqID_140017
atggcttcagagccagttcactcaagtcgaacttcaaaccctcaaatccaagaaaggactcaatcaggacgtgttactgtcggaaattttcgacctatttttaagaaattgaagggtttctctgaactgttcactgaggatgagattaaggatgccttggcagagtcacatcagaacatggatgaagagattgattttgagtccttccttagggttttcaagagattaggcatatgtggtgtgcatttgcttgtgagtttatttgtgactcaaaagattatagttgaaaggttcaagtcagttgcttga

SEQ ID NO: 23240 - DNA, 366 bp, Glycine max
  Peptide Sequence Number=SeqID_140018
atggtagaactgtgcctagtgcccgacgtcgttatccctctgaagttcaaggtgtcagatttcgataagtacaaggggactacttgccccaagaatcacctaaagctacagaacatgtgtaagagggagcatgaatctttcaaagaatacgccctaaggtggagggatctggcaactcaagtagtgcctccaatgatggagagggaaatgataacaatgatagtggacacattaccagtgttctactatgagagtatggtgggttacatgccttcgagctttgcagatttactgtttgtgggcgagaggatcaaagcaggcctaaaaagaggcaaatttgattactgctttgatgaattctggtga

SEQ ID NO: 23241 - DNA, 192 bp, Glycine max
  Peptide Sequence Number=SeqID_140019
atgtctcagaactttacgaattccatgacaatgggtattaaacattttgaagtggtcaaacggaggtcgcatgctgacaaacattggttcccggacgaaattagggtggattttgtggccaatttgagggtggcctttatggatgattgggcgttcttagctggtagggtggtgggtaatgagaaggactaa

SEQ ID NO: 23242 - DNA, 219 bp, Glycine max
  Peptide Sequence Number=SeqID_140020
atggagatgcaactgaagacaaaggagaagagaaaactctcgaatgatttctttgagaggtccctcagtcttgaggaatgggtcactaataaggcaagacctgtcttaatccctgaagtgcctctaacgcaacatgaacctctaccccctccaagaagtattgttatgctttcttcatcttcatcctccaaagattcctctccatccatgaatgattaa

SEQ ID NO: 23243 - DNA, 234 bp, Glycine max
  Peptide Sequence Number=SeqID_140021
atgaaggccgacatggaggccatgaaagagaaaatgaccacaatgatggaagccatgatgagtatgagaaacatgatggaggtcaacacggctacaatcgttgtcataagtactgccactgaggtggacccaactcacccatctagcctcaaccaagtaaatcgcccaaccttggatatggtaggtcagggaggtgaagcattgggaagtatgggtggcccccattttgtgtag

SEQ ID NO: 23244 - DNA, 461 bp, Glycine max
  Peptide Sequence Number=SeqID_140022
atgccctgcgtgacctcactcagactaggaggtatgcatggagagctgctagcctcgtgcatatgtacgatcaccttaatgatgccagtaacagcaccagccgacatgttactggttacatcacgttgttacagtgttggatatatgagcacttttcgtcagttgcggagtgcaacgctgatccagactacgacgaggtgtcaccacgacagcttcgttggggggccgttgctattagatacagatcggagagggttatgcgccaattcggatacgtccagggtattcctgcacaccctgacgattcatgggtatcatttgatgacgtagacgataggtggacacactactcagaccatcttgcaccaacaggtgacatatgtgttgtgccaggtcagtgtgcgcccgactacatagattggttctttgttatatcgcatccattcatgactgcaccatag

SEQ ID NO: 23245 - DNA, 417 bp, Glycine max
  Peptide Sequence Number=SeqID_140023
atgcaccaaagcttgttcaaagacaatgacagtcacaaggaaagcaacgaaggccattcaaggaaaacaacaaagcttaccaaggtagacggcggtgaacatcctagtagacacgaccaaagcgcgaccacggcctcacggtggctttgcgagactcagagtaaggagtcacgatggtggcgaaggccagagagcgtgggggtgtttacttccaaaaccaaaaagaagaaaaccaaaaacgctgaaacccccaaaaccaaaaagaagaaaaacgctaaaatccccaaaatcgaaaagaagaaaaccaaaaacgctgaaatccctcaaacgatggcaaaacgaagagggatagagaaatcgccaaagaggagaacaagaagaagactaagaaaccaaagctcagcaacaacactttga

SEQ ID NO: 23246 - DNA, 318 bp, Glycine max
  Peptide Sequence Number=SeqID_140024
atgtacactccacttgaactgatacacaagagatgtaccctctcttgttctccgtataacaacccaagtagatgtatgctctacttgtaccacaaaggatgttttcaattccttgcgtcttctcctctttttcgatgcctctatccttcttcgtttgcctcgttttcattgcaggagaaattccttgagcaattcatgcaggaagcttatgctttttgtgttcgggaccgcaagaaatgcctcaggtgtagggatttctggatgatcagttcaatcagctttagaaactacaagatgagagtagtccatattttgtga

SEQ ID NO: 23247 - DNA, 135 bp, Glycine max
  Peptide Sequence Number=SeqID_140025
atgtcgcgctatgcgcgttcatcgtggctgttgaagcaaaacgatgcagacactaagcacgcctgtgcgctaagcgtcaatagtatactgagatactcagagaagttcaggctaagcaccagcacactgcactaa

SEQ ID NO: 23248 - DNA, 252 bp, Glycine max
  Peptide Sequence Number=SeqID_140026
atgtctagcagtttgtgctggggacatcacaaattcgtctgcagaatccttggaagcagcatctttgtacgagcaggcagcaattatttccttgtttattgtgccatgcacaatgtcaacaactttaacataaaagagatgaagaggtgccctcttacgaacaaagaggataggcttacaggcataagtgtccctcacctgagaagtgcttcacaggcaaatgctcttccagtcatgggagtcaatctgtag

SEQ ID NO: 23249 - DNA, 168 bp, Glycine max
  Peptide Sequence Number=SeqID_140027
atggaacaatgtcatgtgccgtcacgtagcatcatgactgttgaagaactaattgatggtattttagcactaggtctgcaaaacatgcagttggttttacggtggattattgagctagctagagctcatgtcgttccctcggcaggttcttctctatctgactattag

SEQ ID NO: 23250 - DNA, 468 bp, Glycine max
  Peptide Sequence Number=SeqID_140028
atgttttgcttctctttgatctcatcatctctagaagactgtagctttttcatctcttttctctcccgtgatctggagactcaatccatctccatcactggtaagtgcatcctcttcgccactgccattcacaactgctcacgaggaaaagcaaggccagagactccggcggcaaggtcttcttgcacaaggtcaacaacattgtcaaagttcctctacattttcgacatgaacatcagcaccccaagattgtcgttattgtcaaagataacagattggtttggaaggtggatgccatggaaagatgcagagaaggaattgagccacgcatgtcttgaatgtcatggaaagatgttgattcaagtatttcttttcttggctcagagttgtaaccttctcctcggaattggggtaccaccccaaatgtctgagggaaacttcttggcatatgatttttctatattgtaa

SEQ ID NO: 23251 - DNA, 258 bp, Glycine max
  Peptide Sequence Number=SeqID_140029
atggctccaaaaaagctttccaccaaaaggtctaggagagccgccgtggcggaagtgtccagtgccgcccccgagtttgatagccaccgtttccggagcgttgagcactggcagcacttcgaggccatcaaaggatggtcgttgcacagagagaggcgcgtccaactcagggaggatgaatatacagattttcaggaagagatagctcgcaggcattggacatcgctagtgactcccatggccaagttagaccctgag

SEQ ID NO: 23252 - DNA, 222 bp, Glycine max
  Peptide Sequence Number=SeqID_140030
atggcagataagagaagttgcattgaatcttcaacttcagatgcttacagaggtatccctagtccattcctatcctcatcactttttcacataaaaaagaatatgacttccaggagaatattctgttgtgacaaaggagagctagcaaccttcaggaatgaaaggagaattagccacaaaactcaccatcaaaaccatggacacattgagaaggatgagtga

SEQ ID NO: 23253 - DNA, 345 bp, Glycine max
  Peptide Sequence Number=SeqID_140031
atggcatcagcaatcacttgggtcacgtgtatgctcatccggcagagggaggtcggagttgtggttgctaggcaagacattgctgagcagcagtgtcatccatatctgggtcaaagtagtcatgctggtgcgcatgatccgcacccgcctccctgcaaccgttcgggagaaatcctgcctcggtatgcacagcagcagggcgatggcttcctcatcgaaattgtctgcctggctcctcctttggctgaattcacactgctggtcttcctccaaaaccaacgggtcacccaagaactggctgagggcatctgcatcaaagggaatccactgacccttctcccatga

SEQ ID NO: 23254 - DNA, 650 bp, Glycine max
  Peptide Sequence Number=SeqID_140032
atggcatctaaaaaaaggaaggctccttctacaccttcccaagtcagatatgatcggtctagattcacctctcaagaagcttgggagaggtatgccaatattgagatgcctaggaaactactaccagagagaaatgtagtagtatattacaccgagtttgataagttcaaggatgaactcgagagaagacactgggatgaggagctgactagttttgctgacgacaacatcgatgttgccattgtgaaagaattttacgcaaatcactacgacctggaagacaagtcacctaagcaggtaagggtcagaggccatctaattaaaattgatgaagatactttgaatacctttccgaagaccccagtgattgaggaagaaggtgaaattttgtgtgcttattcgagatttgcactcctgaggcctaatcctcaagagttggctgctaagctttgtatcccatggaggggattcaagctaaacgctgatggtcagccttcgaagatattaaggaagaacatgaccactttagctcagacatggagcgttctttccttctctaacttaattcctacctcccacacatctgatgtcacattagacaaagccaagttaatctatggcatcattatgaagatggatatgaatgtggg

SEQ ID NO: 23255 - DNA, 700 bp, Glycine max
  Peptide Sequence Number=SeqID_140033
tcccttggtcacccctttgatctcggaggagggccaactgtgtgagcacaaccagagggaggctattgtgcagccacgatgcatactggggcaagatttcacccgcgccgctgcaaagagacgagtgtggatcatgcacaccaacatgaccactcttacacagatatggatgacgttgctacttagcaacattctgcccagcgaccacaactccaatctccccctgcaaagtgtcaggatcacgcccacaagacacccagtggaccccgaggagtccaatagggccctaggatttccagctttggttacgagcctctatcagtcctacagggtgcccgtccccccagcaaggaatcgcgcccgtaagacacccagtggaccaggagaagtccaacagggccctagggtttccagctctacttacgggcctctgtcagttctacagagtgctcgtcgcccccagcaagttcatcaggcccctactaaccaagctttgatcaagaagtattgtgcccccaggcaggcgcaaggcgagacaccacaacaggctttcatcaagaagttctgggtacatctacttgggttgttgactgagaacaagagagggtacatctcttgtggatcagttctagtggagggtacatccactaggttgttcaaagagaacaagggagggcacatcccttgtggatctttgctt

SEQ ID NO: 23256 - DNA, 540 bp, Glycine max
  Peptide Sequence Number=SeqID_140034
atgcgcttacacagcaatctagaatcagttgatgaacaagaaactgccacatttgctaaatggattctagacattggagatggaattatagatgatgaaaacgatggttatgctacaattcaaattcctactcatctactcattactcaatatgatgatccaattagtgctatagtcaaatcaacattcccagacttagatcagcaccacaataatcctgaattctttaaatcgaaggcaatactagcttcaacaaatgaaacggtagaacaaatcaatcattacgtgctatccttcattccaggtgaccacatggaatgtctaagctctgattccgttgataaatcagaaactagtgaggattcgtatttccaatcaattactactgaattccttacttcattgaacacatccagtttgccaactcattctatcaaacttaaaattggaagtcctataatgctgttaaggaacctcgaccaaaatcaaggtctatgtaacggtactagattagtggtaacaaagatggcaaacatgtaa

SEQ ID NO: 23257 - DNA, 180 bp, Glycine max
  Peptide Sequence Number=SeqID_140035
atgtgcctaggaccacatgatgttgggaaaaacaaaatcatcaagttttctacaccaatgggcaatggtcaaatttggaaattgataacaagtgttgtgacattgcttgcttgcggacagatgctggaggtctcccaattaaaatacaagcatagcctagatcatcgacaaggactttag

SEQ ID NO: 23258 - DNA, 972 bp, Glycine max
  Peptide Sequence Number=SeqID_140036
atgactgtgtgggaggaatatgctcttcagctggatgatgctattgagaaaaaccattttgtgcaaaagccattggttgttatgctaacccttgctaagatcaaagaacccaaggacaagtatcccctcagtgtacaaaatataaagcatggttcgaagttgtatgtgaatggtgacatcgtagaaatccaacagtttcatgataggtatacatttatattcttcattcatgcagtttacgtgtgcatttatattggcggtctagatgatgagggtggtgtttctcagtcgcagtctacccagtattgccaagataagtttttgcataatgctcaaatagtgagctttggtgaaataaagactctgcgacaggattgttactgtttggctgttggcactgtcgatgaagtgatgattgatacaccatggagttatgacagttgtccatactgtactaccacttttaatccattaaaaataggtgcagtctgtcgttcgtgccagaaccatgttactcacactattccaaggtataagttagttgtcaagatgaaacagaatggggagaaggctaacttccatttttgggatgcagtatgtatcaaaatatttggtaaaactgcagatgaatgtcgtcaagagttgattgcgagtggtgatgagatcaaggtgttacctgcgtgtgttgatcaattgttgggtaaaacttgggttgtcagattcaaacaccgtatacaaatgcaccaatcatctgtgttggattttagtgaacagaaacatcatatacaatcagtgatatccacgctaggtctacagccttcatcatcacagtcagctgaatatgatcctggaaatactgtctttgtaactcctgcaaaaagaatgtccgatcaacaaggaagtagtcagtttgatagtgacgagttcgcaacatatgaactatcgaccaacaagcatataaaagctgagtaa

SEQ ID NO: 23259 - DNA, 222 bp, Glycine max
  Peptide Sequence Number=SeqID_140037
agactgggaagagaagaagatgaagaagggcagggtgatgatcaaagtgtggtttctgataataataataagccttatttgtctgaggcttgggatgttttggaccaaagggagatgggaaatcctttgttgaattggagggtaccagctaggggtaatgaaattgacatgaaagacaatcttaggttctgggctcacactgtggcatccattgtaagataa

SEQ ID NO: 23260 - DNA, 1932 bp, Glycine max
  Peptide Sequence Number=SeqID_140038
atggccaccgcttcagtggcatttaagtccagggaggaccaccgcaagcagattgagttggaggaggcgcgtaaagcagggcttgcgccggctgaactcgatgaagatggaaaggaaatcaatcctcacattccccagtatatgtcttctgcaccttggtatcttaatgctgagagacctagtttgaaacatcaaaggaaatggaaatccgaccccaattacaccaaatcatggtatgatagaggtgctaaaatctttcaggcagacaagtatcggaaagctatgacacatgattctaagtcatgcatggaaagacctcggagagtgggagcaaaatggacaaacaaacacattgctcctgatgaaaagatagaaacttttgagcttgactatgatggaaaacgggacagatggaatggctatgatgcatcaacatatgctcgagtcattgagaggtatgaagctagagatgaagctcgaaagaagtacctgaaagaacagcaactgaagaaattggagaagagcaaccaaaatggtgaggatgctgcaagtgatgaggaggaagaggaagatgaagatgaagatgaagatgatttaagggtagatgaggcaaaggttgatgagagcaaacaaatggactttgcaaaggttgagaagcgtgtgcgtacaacaggtggtgggagtacaggaactgtgaggaatctacgtattcgagaggatactgcaaaatatcttcttaatcttgatgtcaattctgcacactatgatcccaagaccagatccatgcgtgaggatccacttccagatgcagatccgaatgaaaagttttatttgggtgataaccaatatagaaatagtgggcaagctttagaattcaaggaattaaacatccatgcttgggaagcatttgacaagggacaagatgtccacatgcaagcagctccatcccaggctgagttactctataagaatttcaaggtcatgaaggagaagttgaagtatcaaacaaaggaaaccattatcgagaagtatggcaatgcggccgatgaggacaaacttccaagagaacttctgctgggccaaagtgaaaggcaagtcgagtatgaccgtgctggtagaattattaagggccaggaagtagctctccccaggagcaagtatgaagaagatgtttacattaacaaccacacgactgtttggggctcatggtggaaggatcatcaatggggctataaatgctgcaagcagacaatacgcaatagctattgcactggtgctgctggtattgaggcggcagaggctgcaagcgatcttatgaaagcgaatattgctcgtaaggaggctgctacagaggatcctacacctgtggaggagaaaaagcttgctacatggggtactgatgtcccagatgatctagttctagatgaaaaattgcttgctgaagcactcaagaaggaggatcaaagaaagagagaagagaaagatgagaggaaacgcaagtataatgttagatggaacgatgaggttacagcagaggacatggaggcatacaggatgaagaaatccacgagcctttctgttatgttactgccagcagctggattgggcagaatggattatcagtttggcatccttgatcctttgacctgtagtgagaaggaggaactaggtggttctagtcgtgggggaggttttaacaactgtggtggtggccgacgtggtagcactgatggtggagatcgagattgtggtcggtttgttaattttcagtgccaacccaatttcaattcaggttatggtcaaagtaatgctaattctgggcagcataatggtgatgataatcatcatgctaatgtttgggtgaacaataactataaatctgaaaattcaggagcttcttttcatgttgctggtgaatctcagaatacttag

SEQ ID NO: 23261 - DNA, 288 bp, Glycine max
  Peptide Sequence Number=SeqID_140039
atggacatgttaactagcgttgcaccaaccggagttattttcttaaggagaattgattcaatagggagagagaaggagggtgatgaaggtgcaaccagctcatctaatgatcctttacattggattggaggtcctatgataaggtccaagactaagaaaatgaagcaagcttttcaaggcatgattctaacgatcaaagagaaagaagactcgtgtgaattaagggctacacctaattgggtcgctttgggaatcccaattgatgaagatgcgctgagcccaacttga

SEQ ID NO: 23262 - DNA, 165 bp, Glycine max
  Peptide Sequence Number=SeqID_140040
atgaattcgtgggtctccagactcgatggtggacgatgcatgaaagacaatcaatacttcgggctccaggcaatcaattcgcggcgctccagactcgatggtggaggatgcatgaatggcaatcaattcatggggctccggataagatttgagggtggaggatag

SEQ ID NO: 23263 - DNA, 216 bp, Glycine max
  Peptide Sequence Number=SeqID_140041
atggattttgtgggtgatgctggagaggtctttgtagttgagtgggcattctcggttggccgagtaattgtattggtgcgagggatattggtacatggggttgtgaggggtttgttgggaacttggccacgtgggagctgtggttacaacatgggcatctccctcctttttcttagctccacctattccagtcctcctattgccgacacttattga

SEQ ID NO: 23264 - DNA, 294 bp, Glycine max
  Peptide Sequence Number=SeqID_140042
atggaagtcaagttcctcgaagcggtcaagcgaaggttgcatgtcatcaaacaatggtccctggatgaaattagggaaaggctgagggccattgaaggaggtggggactatccttttgccgacatggcagaactatgcctagtacatgacgtcatcattcctccgaagttcaaggttccaaactttgacaaatataaggggattacttgccccaagaaccacatgaagatgtactactggaagatgggggcgtacgcaaaggatgagaagctttcgatgcattttattcaatag

SEQ ID NO: 23265 - DNA, 186 bp, Glycine max
  Peptide Sequence Number=SeqID_140043
atggcgtctggacatccttcagcacaaaggttccttacagcaattcacgtagtcatctgctcccctgaacacaaagttcaagatcatcacaggatccaaacacaaacaacacacagggaggagaccagtcagggtcacgctgttttgcgagaatgctccaactatgtagaatcagcactggcttaa

SEQ ID NO: 23266 - DNA, 333 bp, Glycine max
  Peptide Sequence Number=SeqID_140044
atgatggatatccctggtgggggaattaaaatggttagagttttaagcatctctggaggggatggctcagaatctctaattatccacagtcagtgcattgatggtgctcgtgtttcatacttcatattgtacggaaatagtataaactttgtcagcttatcaccatggggggggagagtttcctgtgcacgacaaggtgacctcgacacttactgtctagtttttctaagtgagagtgtcacatggacacacttaggctatttcctgacggatggtaccacattgcatttgagagttgaggtcaggtgcatgcatcatactgagcatgattga

SEQ ID NO: 23267 - DNA, 168 bp, Glycine max
  Peptide Sequence Number=SeqID_140045
atggctcttcaacatggaaagataaggagacattcaagaaggagggaggatcttcattcaaatttcatgaaaaaggtaatagggatatcgctagtgcatcttcttatagctcttttagttcttctagtaagagtgaaagtgaatgtgatgtacaacccctggatgtaa

SEQ ID NO: 23268 - DNA, 828 bp, Glycine max
  Peptide Sequence Number=SeqID_140046
atgagggagggacaggatcatgttccaaagtttaggtcgactgtgtgggtggctgagatgggttacgcttcccaatccacattttccaagaaaaaagctgctgaacaggatgctgctagagttgctttggaaggtatgcttcagaggaccagagatgaaggactctctcttgtcaatcagcagatcatcttgtatcatgttgcagaggttcttggttctcagcagatttctccattttccaagtctatcatgaatgagtatgctgataaactgcatgtgcaacctacatatgacaccgttcaggaacagctaggaggggtgcttcgtgtttttaaaacttctttagttttcaatggtacaagttacaccggtgatccagctagaacaaaaaaggaagctgagcagtcagccgcaaaggctgctattctttccattatgggtgattctacctcaggaactacactcattgagattattaagtcaaagtctacattttatgatgcaatcaaaggaaagggaccacctctgttacagcctagtgcagtgttatccacaacaaatacaggacagatctctgttacactgggtcatagagatacaggagttacagcttccgtgcttgataataataataataataagaatattgaagctaaagttgaatttcctgagtcttctaagatgctttccacatgtcaagaaactccaatgataaaacaagaatcttcccttgaagccaataatgtgtctttgcaaacaggttcagaacattccattgataatagttcaacttcaaaaaaagcggaaaaagaacaagaagaagtctaa

SEQ ID NO: 23269 - DNA, 249 bp, Glycine max
  Peptide Sequence Number=SeqID_140047
atggcagccatatcctccacaaagtctcaccagaactcaaaaagcaaaggctatgaaacgacttacgaggagggtgagaatgaacgggagcaggaactggaggtggaggctcagaagaagacgaagccatggagttcctcactggctagtgttgagagaggaaaattaaagggtaagaattgtgctgtacccttttatagattcaccggtcaatcaattcaagaggttccactcactggtaactgctaa

SEQ ID NO: 23270 - DNA, 438 bp, Glycine max
  Peptide Sequence Number=SeqID_140048
atggcttgggaggttagatatgtgatcgttggcaacacaattaacttcatctttccctttttatacccaaacacgaaattagggctttccccattcccaattcttcttcttctatgccatgttcttacttggaaatgtcgtggtttgaaggttcttcatctggtgacattaaggaaattgttcggtggtcgtggtgtgagcggcgacggtgcgaacaacagtggtgtcagtgatagagctccactgtcgcctgtttgcaattgcaagccgttggtggttgtgcaaacaacgttcacaacagcctcgggggaagattttggggttgtccttactacaggaaacaacgtgggagtgcgagtggctgcaacttctttcaatggtgtccaaatgacattaatgacaaagatcttgttatgccagacagaggaggaagattaa

SEQ ID NO: 23271 - DNA, 264 bp, Glycine max
  Peptide Sequence Number=SeqID_140049
atggatgtatggtatcgactaactttaggccatgaaatggttaaaaggggatgggtgaaatgcaaccctgttggggtaactaagggtgcctcgagttcagttgtctgtgagggtattttcagggactatagagtttcttttatgggtggtttctcctttaatcttggtaactcttttgctcttcatgttgagttagttgggattatggtagctattgagacaacttttgatacaaggaggaagaaaggttttgatagaatgtga

SEQ ID NO: 23272 - DNA, 660 bp, Glycine max
  Peptide Sequence Number=SeqID_140050
atgtggtttttgagtattgttgacatggtggaggctggactgaggcctttgacagatgacaatggggcaatgcagacgattaacatagcaaaccaacatggaaatgtccatttgtatgtgttgcatccaatttatgtaggagaggccattgaatgtatagattgtgttccagctgatcaagagaataacattgggccagtagcagacaatagcctaggacaacaaaacaatggcccagtagcagaaaatggagcagttgttgatgatagtatccaagttgatgacaatggcccagattctaacatcgggccagtagatcatagtggaaattgtggttcaattaatgtcaataaagacaaaggtgctactgaaaaaaagaaaaggaagagaggaagaccaatagggagaagtagtctgccagcacctacttttgaagcagatgtgtctacatcagatgatgatttgtttggggcattaaatattgcaaaaggtggatatgctagagacttgtctgattctgaatatgattttgaggatgttgctactgacattgagagtgatgaagaaatggagccaaaaatgaagtatcccacctttgtacagcctacaaaaatggcagattacaaatgggagcctggaacttattttcttgacaaataa

SEQ ID NO: 23273 - DNA, 290 bp, Glycine max
  Peptide Sequence Number=SeqID_140051
atggaagccctgaatgttgatgagaacaacaaaaaattaaaagatctaatgtggagagcaacaaaggcaacatatccacaaaaacgggaaaggttgatgagagatataaaagccctaaatgttgatggatataagtatttgatgcaggaaccaccaaggtttactagtaacaataagcctaatatgcttctaaataatatgagtgaagcattcgatagtgtcattgttgaagctagggcaaagcatatctatacaatgctcaaagacataagattgtatttgctaaatag

SEQ ID NO: 23274 - DNA, 216 bp, Glycine max
  Peptide Sequence Number=SeqID_140052
atgacgaaagacaacgattgtacctcaaagccttacactggggcaatgaggggcatcgtgcatgagcctcaagtgaacataggggcagatcaaaagttctcacccgtcgatgtttttaaacaacaaaaaaaagggggggagacaaaccctggaatttcaatagatttattaaacgtcaaatggctccattgccgtcactccacaatggtcaagtga

SEQ ID NO: 23275 - DNA, 888 bp, Glycine max
  Peptide Sequence Number=SeqID_140053
atggcactctctttgacatctaatggggtcaatgagtaccaaaaatgtgtggttgaagaggaagatggctcacaaagtactaatgggctcagcaatgattcagcttcagccataacccattctcctcctctatgtagcaatagcaatgagtatgttcataataagagcacacattaccaacttgaagaagcagaatctctgattaacttcaaagccaatgagtacaacaccctcatacaaggtagtgaatcttttcttagcgttcagaagagttggctgttccccaaagagagtaatttgcatgaaggttataaccaatggaaccatgctattagtccaaaaagcaccacagatatgcgcctagtgcaaaatttcagttgctttgaaacttccgctgactatagttccatattcaatggtgcaaaagagaagcaacatggtgaaagttcatcatctgggtggctatactctgaaccaaatgtccctagcgatagcctgcttgagtcagcagcacaagagttggtcttgacaaaacgctcttctatgggagagaatatgcaagctaccaatgccaagaagccatgcacaagtgcgagtaaagcagcaaaaccaaagttaaacccattcaaggatcctcaaagtgttgctgccaagaatagaagagagagaataagtgagcggcttaagatactacaagaactggtccccaacggttccaaggttgatttggtcacaatgttggagaaagcaattagttatgtgaagtttcttcagttgcaagtgaaggtgttggcagctgatgaattttggccagtccaaggtggaaaagccccagacatttctcaagtgagacaagccatcgatgctattctttcatctcaaagatga

SEQ ID NO: 23276 - DNA, 201 bp, Glycine max
  Peptide Sequence Number=SeqID_140054
atgggtgacggtggaggtattggcggcgttacagtggtgttggggctgcgtggttcagattccttgctccttcactgtcattggcgacaagggccaccatgctatgaaaacctcaatttgaggaggaaagagttggctatgtgtggggtgacttgttgggatagtgaaaaaaagagattgtcgaaggttacttttggataa

SEQ ID NO: 23277 - DNA, 393 bp, Glycine max
  Peptide Sequence Number=SeqID_140055
atgtttccagcaggtgcggtgtgcgctgtgacaggtcagtgtgccagcgactacatagactggttcttccgcatttcccatcctttcatgaaaccatgccaggcatcagttcctctgccagatggtcatgctccgcagccccgagtcgtccctcaggccccagagacagatatccctcacgtgtcggagctaggagcactattgacatctgcgaggcccgctgtggaagagcctagacatgcagaagtttgctatgggattgctgagaggttggagctccatctgagcctaggggtggtcacgccaagctcatcgatacatgaggtgattgaagaatgtctcaagatggccaggagtgtcacacaggaccagctagtatatgttaggtcttga

SEQ ID NO: 23278 - DNA, 1624 bp, Glycine max
  Peptide Sequence Number=SeqID_140056
atgggttgtgcttatctcaacatgccaggcttcatgagggcaatgtttgttgtgttatgtgcgctgatgatattgccggagctaacacatgcaaagcatgcaagagtcactaggcactacaagtttaatatcaaaatgcaaaacttcacaaggctttgccaaacaaagaacattgtaactgtcaatggacgatttcctggtcctagaatcatagcaagagaaggtgacagaattatggttaaagtggttaaccacgttcaatacaatgttacccttcattggcatggaattcgccaactgaaaagtgcatgggcagatggacctgcctatatcacacagtgtccaattcagacaggccaaagttttgtgtacaacttcacagtcattggtcaaagaggaacactatggtggcatgcacatatctcatggcttagaacaactctctatggtcccattgtcattcttcccaaaagacatgtcccttacccattccctcaacccttcagagaagtccccatcatattgggggagtggtggaaagcagacacagaagctgttataaatcaagcaatgcagacaggattggcaccaaatgtctcagatgctcacactatcaatggtcttcccggtcctgtctccaactgcgcagccaaagaaacattcaagctcaaggtgaagcctggaaaaacatatctgcttcgtctgatcaacgctgcacttaatgatgaaatgttcttcagcatagccaaccacaccctcaccatggtggaagctgatgcggtgtatgtaaagcccttcagcacaaaggttgttctgatcacacctggtcaaaccgtcaacgtccttctcaaggccaaatccaaggcaccaaatgccacatttgccatatccacaaggccctatgctacaggtccagctgcttttgacaacaccacagccacagggttccttgagtacaagaaaccttcacttgcaagcagcaagtcaaacaccaagaagcttccacttcttagagcagtgttccctaaattcaatgacactgtctttgcaatgaacttccacaacaaggttcgtagcttggccagtgcaagattcccagcaaaagttccaaaaaccgtggacaggcgcttcttcttcactgttggcttaggaataagccagtgctcaaaaaaccaacaatgccaagggcctaacaacacaagggtagctgcagcagttaacaatgtgacatttgtgacaccaaacattgccttactccaagcacattttttcaacaagtccaagggagtgtacaccactgatttccctgctaaccctcctttcaagttcaactacactggcactccaccaagcaatatctttgtgagtagtggcactaaggcagtggtgctgccatacaacaccagtgtggagttggtacttcaggacacaagcattattggagctgagagtcaccctcttcaccttcatggcttcaacttcttcattgttggccaaggaaatggaaactttgaccccaaaaaggaccccaaaaagttcaacctggttgaccctgctgagaggaacactgctggtgtgccatctggtgggtgggttgctgtgcgctttcttgctgacaatccag

SEQ ID NO: 23279 - DNA, 1113 bp, Glycine max
  Peptide Sequence Number=SeqID_140057
atgacctttcatgatttttttgaagatacatacacactaaaggtgaagccaggcaagacatatctgctaagactaatcaatgctgcactcaacgaagagcttttcttcagcatagctaaccacaccctaactgtggttgaagcggatgccaaatacaccaaaccatttgacacagacacactcctcatagcccctggccaaaccacaaacgtgtttctcaaaaccaagccatattttcccaatgccacattccaaatggctgctaggccttatttcacaggccgtggcacctttgacaactccacaaccgcaggtaccctcatctacaagcaacattccaatgtcaaaaatctcacccttctcaaaccaactttgccaccaataaacgccacaagctttgtggcaaacttcactgcaaaattcagaagcttggcaagtgctaaattccctgtcaaggtacctcaaaaagtggacagaaaatttttcttcactgtggggctagggactaatccttgccccaaaaacacaacatgccaagggccaagtaataacaccaaatttgcagcctcagtgaacaacatttcttttgcacttccatcatctgtttccatcatgcaggcatactattctagccaggccaatggggttttcaagactgattttcctgccacccctttgaaccctttcaactacacaggaacacctccaaacaacacaatggtcaccaatgacacaaagctggtggtgctcaagtttaacaccagtgtggagttggtgctgcaggacactagtattcttggggctgagagccatcccttgcatcttcatggttatgacttctttgttgtggggcaagggtttggaaactatgatcccaacaatgaccctgcaaggtttaatctgattgaccctgttgagaggaacactgctggtgttcctgctggtggttggattgctattcgattctttgcagacaacccaggggtgtggttcatgcactgtcacttggacctccacacaagttggggattgagaatggcatggctagtactagatggacctgagcccaaccagaagcttcaaccacccccttctgatcttccaaaatgttga

SEQ ID NO: 23280 - DNA, 507 bp, Glycine max
  Peptide Sequence Number=SeqID_140058
atggatttcccccactttccttcatttgcatctctcagagttcttctgttttgtttctgcgttatgacattgtttcctgagtttgtagtcgagtacctgaacgtcactagattgtgccacacaaggaatattctgagtgtgaatggaaaattcccaggacctcgcttggtggcaagggaaggcgatagggttgtggttaaggtggtcaaccatgtctcaaacaatgtaaccattcattggcatggcatccgtcaaatgacaactgggtgggctgatggaccagcatatgtgacacagtgtcctatacaaaccaaccagtcatacacatacaacttcaccatcgttgggcagagagggactctgctttggcatgctcacatatcatggctaagagcaaccatttatggacccatcatcatcctccccaagcagaacgagtcttatccattcgagaagccacacaaagaaatccccattctttttggtataatagctacacgttattag

SEQ ID NO: 23281 - DNA, 306 bp, Glycine max
  Peptide Sequence Number=SeqID_140059
atgaagatgttggaggtatcactagcgagaaactttgatgtgacacgaaagagtaatgagttctggcttatcgatgtgggtttgaaacttcaacccaagtttggaacctttgccaagatgactaagattgagaattatgagagagaggaatctggaaattacattttaaaaagacagggttacttagcccaatttgtccaagacccgcaagtccaaacatattcatgggaaccctactctgagactactttagctctgcactgccacggttgtgaaactagtgatgcagaaacacgctcttcttaa

SEQ ID NO: 23282 - DNA, 594 bp, Glycine max
  Peptide Sequence Number=SeqID_140060
atgtacatcaagtatggcccaaaatacatcatgaagcatagtcaacaaaacaagttgtccaatgaaacaaaaaccccccacacttattcccaaaacaattccaaagctccaaaattccttaaggatatggacgcatcaacgagaatcaagccaaggctattgtgcaagcaatcaatggggcaaaacacaccaaatgattataatgatggatggctcaaattctcacaaagagggtacatctacttggggattgttatattgagaacaagagagggtacacctcttgtggatcagttcaagtggagggtacttccacttggtttttcaaagagaacaagggaaggtacatcctttgtggatctttggcttgtaaaggattttacaaggttgaaagaaatctcaagaaccgcaggttgcttggggactggatgtaggcacggatttgaggttaaagctataggtgttggcggtggtgagaaaagtgatcaaaattcaaagagagtcattgtgggggtaaaggtgaagaggggccaaagatggcatgggttaagtgggaaaaagtgtataccaaaggaggaagggggttcggaatag

SEQ ID NO: 23283 - DNA, 165 bp, Glycine max
  Peptide Sequence Number=SeqID_140061
atggctctgaagaagcttcttgctaaaagggctaggaaggccattgcaggggagggatccagtgcagccctgcaagcggagattgagaggcagtggactcaactgacagagcctatggctaagtatgaccctgagatagtcatggagttctgtgctaatgcctga

SEQ ID NO: 23284 - DNA, 297 bp, Glycine max
  Peptide Sequence Number=SeqID_140062
atgaccgatattctagagccattcggcacatttagcaggggtgccttatgcgttaacaccacacccattcgggaaagcctaggggcaagtggaaaggtgataggagtatctcgtaatatttcttcacatttgcatgttaacactttctttgtcaaagcattagggcaggtgccaacaggtgctaggtctatgatcagatctgctcacaatcaaggaaggggggttaaggaggatgagatggcgaagcctcgaccaccaccccggtttcggctaaagacgttaaagaagcgctcctag

SEQ ID NO: 23285 - DNA, 285 bp, Glycine max
  Peptide Sequence Number=SeqID_140063
atgaaactcaagtccagccagctgcgtgacgcagttgtgatcgcgcttgtcgccggtgccaccaccgcgacggcccacgcccaggaagccaccaacctcgaccgtatcgaggtcaccggttcgcgcatccgccaggtcgataccgagacggcacagccggtgttgagcatgagccgcgccaccatcgagaagagcggcttcaagacggttgctgacgtgctgcagaacatttctgccgccggcagcccggccatcagccgttccgaaccgctgtcactccggtga

SEQ ID NO: 23286 - DNA, 313 bp, Glycine max
  Peptide Sequence Number=SeqID_140064
atgagaaataacaacctgcatgacctggagccgttcccgaatgaaaaagcggtgaatgacttaggaaagtccgaatccggtggcaagacgtcttcggtgcttatggtcaaagagcatttctctcctgaagagtttgccattctcacccgcactaaagcggcaaacaggcagggtattcttgatgaaatgccaccttacagccaagacgtgctcgatcagttcaagcagatgatgagtcagcgtctattgccagccggtacatttcattcaaagcaaactcacgtaccgtcatcggctcagtttcatccagcac

SEQ ID NO: 23287 - DNA, 180 bp, Glycine max
  Peptide Sequence Number=SeqID_140065
atggcgggtgcgggatgggcagaaacacctgaatgtctaaccgcgcggggaattaaacgaggggcattaaaaaggccgcttacgcgaccgttttgtgattatccgcagtccagatcccgcacagccagcaggactggacagaatcacttaaagctccaggttggtgcagggataacgtaa

SEQ ID NO: 23288 - DNA, 411 bp, Glycine max
  Peptide Sequence Number=SeqID_140066
atgccgcagggatgcggcattaataaactttcattgtgcaaaatagcgggtaaaagcgcaggtcagagcactttattcacgaaaagcctgaaaaacagcaccaggttgtcgctgcgctccgctttatggccggcgcctttgctgcgcgtcagcaccggcgggcataaagtgccgtgccctcacggtagccgggcggcctcgcaaacaagggaagctgtcgccggcctgctcacccgttccccgccgtgcgcgggacattcagtccgctccggcggcgcgtgcggcttgcgcgtccgcccctgtttgctcagctggtcgcccggctttgtggaggtcacggcaccagagggtgcccccttcatccacaggagcacagcaatgtcacgattcatgcacggcgacagcgtacag

SEQ ID NO: 23289 - DNA, 348 bp, Glycine max
  Peptide Sequence Number=SeqID_140067
atggtcttcattgatttggaaaagacatacaattgggtgctaagagaggtattatggaattccctagagacaaaagttggtgagtcaagaggaaataggcgggaagttagacatgtggagacaagacttggaagcacacgacttttttttcaagtagaagtgttcatataccacaaggcttttcccatgccagcattatctttcaaattttacagtagtgaccctctttttgggaatgaagaggatgattctacacagttcatcacttctgtttgttggcgcggtcagtcctccaccttacttgctgcaaattccacaggaaatgtcaaaattctggagatgacttga

SEQ ID NO: 23290 - DNA, 1612 bp, Glycine max
  Peptide Sequence Number=SeqID_140068
gcagttgttgcagagtgagtttcttaatgaaccaagagatgatatagaaaactgtgaggcagcggtagaagttagagaaaggatagatgatcaggagttgttgcaagaattcctttcattaattcaacagaaaaaagaggaagctgctgagaagttacagcatactatctcatttctgtgttcagatattgaagaagcgactaagcagaaaactctatttaatgagataactggcactggactagatgattgtaccacatcgactttcccgtccattacagttgtcgataatgaggaatctgcttgtctagggaccagaaaacgggtcagaactattccgtgtgttgatgacactgaagggattgataataacatgagtgatgatcagaaaaatgacaggagtattctttcaaaaactccacggtttttgaataatttacagaaactagagtcagcatactttttgacacgatgcaaatcagcctattcctcagggaaacttgcggttcaacattcacctattggtactgatgaaaggagttgtgtcaataaagtagcattaaaagagaagttcagggagggaaaaagtccttggacaaatcctttccttgagggtttgagcaagtacctatctttcagtaagttaaaggttaaggctgacctgaaacaaggggatcttttgcagtcttccaacctggtatgctcactcagttttgatcgcgatgcagaatattttgctactgcaggagtaaacaagaagattaaagtttttgaatgtaacactaccataaatgaggatcgtgatatccactatccagtagttgagatggttagccggtcaacattgagtagtacatgttggaatacttacatcaaaagtcaaattgcttcaagtaactttgaaggtgttgtacagttatgggatgtgacaagaagtcacgtgcagtctgaaatgagggagcatgagcaaagggtatggtctattgatttctcatcagcggatccgacgttgttagcaagtgggagtgatgacggttctgtcaagctatggaatatcaatcaggcaatcagaccaaacattcttttgtatgttttgtgtttaattctagatggaattagtgttggtaccatcaaaacaaaggcaaatgtgtgttgtgttcagtttccccttgaatttgctcattcccttgcatttggttcggcagatcatcggatatattactatgatcttcgcaacctgaaagtgcctctttgtacattggttggacacgataagacagtgagctacatcaagtttgtagacaccatgagcctagtctctgcatccacagataacactttgaagctttgggatttgtccttgtgtgcttctcgagttatagactcaccaattcaatcattcactggtcatatgaatgttaagagtcagtggttcgacgcgatgtttgatttagacaagtataatggagttagcgatggatccatggatataggaatcccttgtatcgaaagtcttcttaatggaatttcagagcttgaggtaaaagaaagcattaaggaggatgactatggaagcaatttactagctacaacagatggagcaatatcataa

SEQ ID NO: 23291 - DNA, 147 bp, Glycine max
  Peptide Sequence Number=SeqID_140069
atgcattccttgctaggtgtgtgccacttgagcactttctcatgtccctttagtgtgattttgaggttgttcatgtgtggtttaagtgtatatgcatatatgttcttggtagaagtaggaatagtgggggcacgatacgcgggttag

SEQ ID NO: 23292 - DNA, 150 bp, Glycine max
  Peptide Sequence Number=SeqID_140070
atggatatgttcatcgctacaccacacgggacggtgagacctaactttttcgagaaagtacttgacactcttatgtatgacttcatagtggaggcaaccctagaggttgtcaaagatgattacttggttgttgatgtttgggttccataa

SEQ ID NO: 23293 - DNA, 696 bp, Glycine max
  Peptide Sequence Number=SeqID_140071
atgcccaccaaaggcattactcctcttccttatactgggaatatcatgaagggctacaattacaagaagttgaaaacccaagtccttgcaattgaaaaggagaaaggccaacctattgttacacaggcgtatgagaaggttgttgagggagcttcccaaaaatatgctcaagctgatgttgaaatagatcaacctattatcaaacccactcttgatggtggtgtttctaaagatccaaatgctggaaatttgcctatagtggttgaagcaaaggccaagttgaaagcggatgccgatgagaagaggaaattaaaggatgttgcaaaatccaaaattaaagagatggattttattcttgccaaaaagaatgaggataacaaagggttaactgagaagactaatgtcttggcaaaagatgttgttgattctaagaaattgggcgaggccttaagtaatcaattaaccaaggaggaggagaaaatgaaggttgttgaaatagagatggatgctgctttgggcgagaaaaagctagtcaaggataaggaagggtttcagaaggctctgtgtcaagttgcactctttgcatctcaacttgagttgaacaagttcaatgttaatatggatgtgaaatatgggatccttatgaaggaatctcaaatcaaaatattgaaaaggagtatgagggcaatgaagtga

SEQ ID NO: 23294 - DNA, 483 bp, Glycine max
  Peptide Sequence Number=SeqID_140072
atgaatggttcttcttctgggttttcttggcagaagattttcagttctaggagcttaaatttttttggaggctttgatagaatgggtgatattagcttgaggctatggttggataaacccgaacgatcagtgaatgtctctgaatgcttgcacatatttagggaaatagtagaaattgttcatgtggctcattctcaaggaattgttgttcataatgtgaggccctcctgctttgtcatgtcatctttcaaccatgtctcgtttattgagtcagcaacttgttccgattctggctcagatactttagaagaagctgttgagatcaaaactccaacacctactcctagctatgatatgcatcaacagagatgtttaggaagtgaagattttgtgcctgtcaagacttcaacagcttctttgacagactctagttgcatgttgtcaagtttgggtgtttgtggcacctgcatcattaatagatga

SEQ ID NO: 23295 - DNA, 789 bp, Glycine max
  Peptide Sequence Number=SeqID_140073
atggctgccttccatggctaccactcgccatacggagcttccaccttccactaccaccacccacactactcgtcgccaaacgaagcttcaatggctgccgaggaccgccttgaggccatcttgaccaaacttgatgccgctacacgccgcctcgactcccaactggacgcccttctcctccgactgcctcggcgacccgtccaccactaccctccgcagtctccatgctctacacccatacaaccaagtcccacaccatccccacctctgtcgcggactccgccgccacctccgccatttccggcgcaaccaccgctgactccaccgtcgcctctgttgctgactacaccaccgcctccgccgctcaagccaacaccaccaccacccgcactcaggccgaaccacgccgcacccttaccagttctgttttccatgccggttcttcacttagccgcccacagcaagcaccaagtggcccacgcgtcgtcctccatcttcaaccagctcggccacacccgtgtcgtggcttccctcaacaacctctcacgtattgttgttcattatggtcgtgaggcggctccgcatgacaagcttttgggacatagagacatggcactgttggagaagagcaatgtgccctatggatcgaccttggttgcacgtgagcgccaatcgactgcttttgcattagggacagtggctgacccaaaggaccctcaccgatacagaccttgggatcctggaggacctcgacagactcaaaacaccttgacgacaaggtgtttttga

SEQ ID NO: 23296 - DNA, 156 bp, Glycine max
  Peptide Sequence Number=SeqID_140074
atggcggtttccaaactcagaatgatgcaaagggttcctctcggtgtggggtttcaacggagaacaatggcagtttatggtggctactggtggctgtgggtgatggatgaaagaaggagaagaaatggcatttttccaaagctacttggactataa

SEQ ID NO: 23297 - DNA, 180 bp, Glycine max
  Peptide Sequence Number=SeqID_140075
atgggttctaagaaggccctcaacctagtgttaaaggttgtcatggtggataatgccaaatcggcatatagaatggatgaatggacgaatcctagagaggttaaggttaatgcataccttgttgaggtaagccactacccactcccatctatttttgataaagccacacttcctccatag

SEQ ID NO: 23298 - DNA, 946 bp, Glycine max
  Peptide Sequence Number=SeqID_140076
atgtccatgtcaggccattcccagcatctgggccagggtttgtgcgggctgcgggcgctccaggctgatgcgccgctccaggtccgcgagatggttgtcgttgatcttgaccgcctcggccacctgcccctgttccatcaggtcgacgatctgcacgtgttcgccatgctcgcaggcggcgttgccgggcggttcatacagcgccacgatcagcgagcagcgcgacaccagttcggccaggtagccgtgcaggatggcgttgcccgacagttcgcccaggcgcacatggaaggcgctggcctggcgcgcccaggcaggctggccggcgcggtgcagcaaggcatgctcgtcgcgcaactgcttgcgcagcgaggcgtagtcggccttggtggcgcgcgcggccgccagcggcaacagggccgcttccagcgcgcgccgcgcctcgaagatctggcgcgtgtcctcgggggtgggttcggccaccaccgcgccgcggttgtggtgcaggtcgaccacatgctcgtgggcaaggcgctgcagcgccttgcgcgcgaccgagcgcgaaacgccgaagatgtcgcacagcgccgcctcgggcagcttggtgccgggcgtcagccgctggctcatgacactttcatagaccgcctcgcaaatgcggcgctccatgtcggcatcgggggccgtgtcctccaggtgttcggacacggcggcggcggcccggcgagaaggcgtcgccctgggacgggatttggcgggatcgcgggtaggcatggcggactcggtggcaacgaaggcaaagggtcgatcaacgggaagacagtccggtcgccggtggcagcccatcgacgtgcgcgcagatctggcccggcgtggcgaaccagatctcgccccggtcgcgcgcggccgccaacggggccagcgcccggcgcaggtgccgcaggcg

SEQ ID NO: 23299 - DNA, 458 bp, Glycine max
  Peptide Sequence Number=SeqID_140077
agtttgacaagttcaaggaggaactcaagagaagacattgggatgagaagctgactgatttttctgatagcagtatagacatcgctgttgtgaaggaattttatgccaacctctatgaccctgaggataaatcacctaagcaggagttggctgctaagctttgtatcccatggaggggattcgagcgtaatgctgatgggcatcctttgaagattttgaggaagaacatgaccatgctctctcagacatggagtgttccttctttttctaacatcattcctaccttccacacatctgatgtgactttggatagagccaaattgatttatgggattattatgaagatggacatgaacctagtgatgcaatcctaccccgcaagggcattggatagaaaactccaagtagattgggccagagatgcaagagaaggccctagggttcttatgagccttagg

SEQ ID NO: 23300 - DNA, 258 bp, Glycine max
  Peptide Sequence Number=SeqID_140078
atgaaacaactgtgggacacccttgccataacatctgaagggtcgtcacaggtaaagaggaacaagcttatagagccttttgaagttttaaaacatggtttggaagtgtttgagaacaagggtccagacattgtttctagtaaattggtgaagctcttcttccacgacaacaattcagtcatcatttatgagggcttcatctatggtcttgggctttatctcaaacacaagagcataggaagcaagatctttgaatga

SEQ ID NO: 23301 - DNA, 957 bp, Glycine max
  Peptide Sequence Number=SeqID_140079
atgaagattcagtgcaacgtgtgcgaggccgcggaggccaaggttctgtgctgcgcggacgaggcagcactgtgctgggaatgcgacgagaaggttcacgcagcaaacaagctcgccagcaagcaccagagggtccctctctctctctccgcctctcacatgcccaagtgtgacatatgccaggaaatggttggttatttcttctgtttagaggatcgagctttgctatgtaggaattgtgatgtatctatacatacagcaaatgcctgtgtctctgatcatcaaaggtttttgcttactggtgtgagagtaggccttgaagctactgagcgcggtgcttcctcgtcttctgtgaagtcacagtctggggagaaaatgtctgatgctaaatcttcatccatctccagaaatgtttcctcactgccccagccatcaaatgccaatgaagtgttacccctccaaatgcaaggagttgaggagtttccaccaagcaatttctcaggttatacttctggaaacgtctcacaatggcccattgaagaatttctcggattaaatgaactcagtcagtattataattacatggatggatcatctaaggaaaccagggtaaacatgacaggagtagaactggtccagccttctgagggtaaattccctgttaaacatgtgatcacggctgacagtggtaaacttggggattctgattcttctgttttgaggtctggtgaagaggatatggatgatgacggcttcttgggacgtgttccagattcatcctggacagttcctcagatcccttcccctcctacagcttcgggtttatattggccgaaagtccctcaatatacatctgacagtgccatgtctgttcctgacatatgcttttctcatgtgcgacagccccaccatgcccagcataattctaatgtttccaaaaggcgtaggcaactataa

SEQ ID NO: 23302 - DNA, 808 bp, Glycine max
  Peptide Sequence Number=SeqID_140080
atgaaggatgtagagtctgtggatcatatgtttggaaaacttcaagttcttctaaatagtttggaagctcttggacagatgtactccaaggcccatataaacttgaaggtgttggacaactttcccaaggaatctgatggactagagaactctgttggatccacagatgataaagtgaacctcatgtctagaaaattcaaacaaatgatgaagaagaaaggaaatttccaacattcctctagacgtaaagattcaagatactctaaagacaagataaagaaaattttgatggtcacttgggatgaatcagatagtgagcagagtagcatctcaaatgatggacaagccaacatctatctcatggcagatacaaatgataagactaagtgcaaaaagtttgaagaaaaattcaaagattatgcttatgaaaacactgaattgaggaaatcaaatgaagatttgaaaaagaagatccaaactatacaagagagtttgagcctagctagtaagactgatgaaacttttacagttgaaaaactaagtgaagaagtaatatttcttagtaaagactttgagaagttcttggaaagttcaaagactctcaccactcttttgaaatttcatcaacatccccatgacaagtctgacctaggctttgaaaaaggaacaacatcctccaagtcacagtttatctcaaacaaatgtaacttctgtgatatccttggtaggaaaaggatgaggtttaagttggtacctgggcagtggatgttcatgacacatgatgggcaaaaggtttatgttccaagac

SEQ ID NO: 23303 - DNA, 350 bp, Glycine max
  Peptide Sequence Number=SeqID_140081
atggctaagttcgatcctgaaatagtcatggagttttatgctaatgcctggcctacggaagaaggggctagcaatgcgagtatagccggaggaggagtcaggcctcaagctttgatgaggaggctattagccaattgttgtgcatgtcggggtaggactttgcccggaccgcaacagggagaaagcaaaattctccctagcgaccataactcggacctcaccctactaaagtgtcagctggtctacaccatactgacacatgtgagtgtacatgtggctcagctgatctctgatgctatttaccagtttgcagggattgtgcgtaccagacacccggtggacccggagaa

SEQ ID NO: 23304 - DNA, 189 bp, Glycine max
  Peptide Sequence Number=SeqID_140082
atgactgtgagttgggctaagcgcgcatccaccgctgagtgcagcttcggcgtgcttagcgcgaaggagaatctagcaaagcatcagcatcaaggtcgcgcgctaagcacagcaggtgtcttcagccaggctcagcgcaagactggcgctaagcccaaacccacttacccgcgcaaagcgcgagggtga

SEQ ID NO: 23305 - DNA, 756 bp, Glycine max
  Peptide Sequence Number=SeqID_140083
atgtcctccacttcagaggactacatgtcctccacatcagaggactacacgttctcccctttggaggactacatgtccttgccttacgagggctacacagcttcaccttttgaggactacacgccctcaccatcagaggattacacgtcctcggcttcagaggactacacgtcctcaccttcagaggactgcacggggctacaagctctcgccttcgtagggctacacgcccccaccttaaaaggactactcatcctcaccttcagaggactacacgtcctcaccttcagtggactgcacgccttcgccttaacaggactgcatgttctcacctacagaggactacacaacctcgccttccgagggctaggcgccctcgccttcaaaggagtacacatcctccccttgagagggctacacgccctcgccttcgtagggttacacacccttaccttcaaaggagtacacatactcaacttcagaggactatacatcgtcgccatcagagggctacacgtcctcgcctttagagggctacacgtcctccccttcagaggacaacatgacctcccctttagaggactgcacgccctcgccttaacaggactgcatgttctcacatttagaggactacacaacctcgccttccgagggctagacgccctcgccttcagaggagtacacatcctccccttgagagggctacacgccctcgccttcgtagggttacacacccttaccttcaaaggagtacac

SEQ ID NO: 23306 - DNA, 180 bp, Glycine max
  Peptide Sequence Number=SeqID_140084
atggatgttgttgaatctggttctcttgaaattggttctactaatgttgattcagattcctctgaaatggaacttgacatgggtgatgagatgactacactttcaaaacaagcaagaacaacagcagaaaatgcagtagaccagaaatgtcatacacaccgaattgtgcagcaaaggtga

SEQ ID NO: 23307 - DNA, 444 bp, Glycine max
  Peptide Sequence Number=SeqID_140085
atgggtcttcattcttcatctagtgttaatggtgagggttgtaattgtggaagcaatgccttccaaggttattttgatgatgccaaagaatcaagagttaagaaaattccaaagattcaagaattaagattcaagaataatcaagatcaagattcaagaatcaatagaagactcaatcaagataagtcacatactaaacattactcccaaagaagagaaaaggatagaaggcttcaaaaggttaacattagcctccaatatttccatggaaaagctaatgttgagatctaccttgattgggaaatgaatgttgaacaactctttgcttgtcatcatattagtgaagagagaaaagttcattggctaccctcaactttcaagggtatgtcctttattggtaaacttcccttgttagggaaagaagaattcataaggatcctctag

SEQ ID NO: 23308 - DNA, 108 bp, Glycine max
  Peptide Sequence Number=SeqID_140086
atgtcattggatgcaatagcaaaaatgattaatgaggataagattcatatccttgtcaacctaaatggttatacaaaggtagggggttctgagacagcttgcacctaa

SEQ ID NO: 23309 - DNA, 339 bp, Glycine max
  Peptide Sequence Number=SeqID_140087
tttcatcgccgcgatgaactccttcgtctttggcttctcggcgaactccgccacaaagtcctccaccacgacggcactggcggcagcgctggcaacagcggtggagatggcgaggcgcttctccttgcggttgatcttgatggaccagtcgcagggcttcgggccgaaggtgacgcctccgccggggcggaggggagtgcggttggagccgcggtaggcgcggccggtttttttttgcgggaagggcttccggccgccgcctcggacctcgctgcgggtgagggtggaggcggtgccgcggtgcttgttctggaggtcggtgccgcggcacttgtttga

SEQ ID NO: 23310 - DNA, 249 bp, Glycine max
  Peptide Sequence Number=SeqID_140088
atggttatgggggatccgatcagcagactctccttccctgcatgtttgcattttagtggagaaaacaccgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagacaccttacggttatccgcaacctcgtcattcagttga

SEQ ID NO: 23311 - DNA, 279 bp, Glycine max
  Peptide Sequence Number=SeqID_140089
atggcagcatacaagaggagcatggcgaagagagtaccgtttagagaagttgctgtcggaggtgacgatgatcttgctcttgtccctggtgacggtaatggaatcgccaagtgcaccggccttgtcaccaaccttaatcctatcctgaaggaacttctccagagaaacaatgtccataatcttatcctccaccagcttcgcgcaatcgatcacgaagctcgctgccttcttcttccccttcactccgctcattttcgcgcctctccctttctaccctag

SEQ ID NO: 23312 - DNA, 1383 bp, Glycine max
  Peptide Sequence Number=SeqID_140090
atgagcggagtgaaggggaagaagaaggcagcgagcttcgtgatcgattgcgcgaagctggtggaggataagattatggacattgtttctctggagaagttccttcaggataggattaaggttggtgacaaggccggtgcacttggcgattccattaccgtcaccagggacaagagcaagatcatcgtcacctccgacagcaacttctctaaacggtactctcttcgccatgctcctcttctacaagctttaggatttattgaaaccccgtatatcaatcttgataaccctttggccatggaattaatggaagtctatgagtccatgggcgacacattagcctttcaatatgggggttctgcagcacacaataagattcggatacgcgagatacctgttcttgataagttacagtatctccacgtgctgctgtcctcggtgcttccggtgataaagcagatccgccgtgaacagtgttttcaagtagaacttgaaaagaagttgcgtgatcttcaagaagcaactgcagatcacaataaagaacctcaaacagagcaagcaaaaacttttgatcgaaatatattaagtaaatttctgcattggagatccaatgacaacggaagtattccatgtccccctaaggagtatggtggctgtggttattctacattaaatttaagtccaattttcaagatgaatcgggttgcaaagttggtcaaaaatgtagaggaaatggttagtggctgtagaattagtaatgctgatggtccaccggaaactgggctaaatgatctcagactttgccaatattttcatagagaagccagtgatgataattatctttattgtccagcatctgacgatatcaaaactgatgggattggcagttttagaaagcattggaaaactagtgagcccattattgttaagcaagtatttgatgggttatccattttaagctgggatccaatggtcatatggagagggattctagagacaacatatgagaaagaaaaagatgaaaacgggatggttaaggccatagattgcttagatgggtctaagcttgctcatttcatgaaaggatacttcgaagggcatattcttgaaaatggttggccgcagttattgaaattgaaagattggcctacacctagcgcttctgaagaatttctactataccaaagacccgagtttatcagcaaactacctttacttcagtatattcactccaagtggggccttttcaatgttgtagctaaattgcctcattactccttgcggaatgacgtaggacccaagatatatatatcttatgggattagtgatgaacttcgtagaggtgattcagtgacaaatctccacttcaatatgcgtgacatg

SEQ ID NO: 23313 - DNA, 651 bp, Glycine max
  Peptide Sequence Number=SeqID_140091
atgtacttaaggtgctttgtgtttgataatcctaagttatggtaccctatgctagcttgggcacaatattggtacaactcatcttatcatcacaacttgggtatgagtccatttaaagctttatttggcagagaaccacctatagttgttccttatcaagtccatcctaaggatcctgtatctctacaggaaacccttgttaacagagacaaccttttacagaagctcaaggggaacttggctagagcacataattacatgaaaatgcaagcgaacaagaagagacgagactttcagttggaggtgggagatttggttttggtgaaattacaaccatataggcaacactctattgctcttagaaaaaatcagaagcagggaatgcatttttttggaccctttgaagtagtggaacatgtgggacagatcctaattcaatgggagtcatttgatgctagtgaggcttcgtgggaggatttcacagctattaaacaatcttatcctcgattcaaccttaaggacaaggttgatttcaaagggaagggaatgatggactcgtggaaggcgatccacaaaacttggccacgagaagaagcacaagggcccgaagcaattgagaaggcaaagctagatttgcatttggagatctag

SEQ ID NO: 23314 - DNA, 333 bp, Glycine max
  Peptide Sequence Number=SeqID_140092
atgctctcgggaacggaagcttcgagcatactccagacatcttctcaacgatcccaacggtcagattgtgaagctgcagaccaaatttcgagaagatccaacggcatgagtttgaagaaatgcacaaataccctaggtgtgaaagatgatgacgattgtagtggtgaagaaaactcaaagaagggccctctagcgaaggtgtcgtggtatcttttgatcattccaaggtttaagtgtctgtttactaaaggagacaatgcaaaataccttacacggcatgcaaatgggagagattgtgatggaatactccatcatctggctgattcctcctag

SEQ ID NO: 23315 - DNA, 888 bp, Glycine max
  Peptide Sequence Number=SeqID_140093
atatgtattacaacgagcacttccgcggggttggagcagacgctgccgtggatcttctaccacaaggtcatcggagtctcaagttttctccttttcgtcgaagggaaggccgcgtcgcctaatgtcactagggttttagagaccattcccggggtgaagattgtatatagaacaagggagttagaggagcagcaagctaaaagggaacttgtggagtatatgggatttgaaatcttcatatctttggtggagtctcttgcattttttatggaaaatttgttctgggttgtcttatctaaatgtattccaatttggggacatgatgctgagattcagaatatggatgtgatcaaatgcttgtcctatgagatcttactgtcatatagccgaatatggaatgagacatggttggcaaccttcttctacaaaccatgtaattatgagttgtttgtgaagcaatctttgaacatggaaatggctattgtcatggcaagggattctggaatggattggataattcatctggatactgatgagctgatgcatccagcaggaacgcaagagtattctttaagacagttgttagcagatgtgcctggaaatgttgatatggtcatttttccaaattacgaaagcagtgtggagcgagatgatatcaaggagcctttcagtgaggtttcaatgttcaagaagaactatgaccatcttcctaaggatgtatattttggaaattacaaagaagcaactcgtggaaatcctaactatttccttacttacggaaatgggaaagcagctgccagaattcaggatcatctccgtcctaatggtgcccacagatggcacaactatatgaaggcacctaagtatgttgatcctgcctgtcattaa

SEQ ID NO: 23316 - DNA, 984 bp, Glycine max
  Peptide Sequence Number=SeqID_140094
atggtgacacgtttcaaccaaacaagcatacaaagagataagtggcattcaacagtgcctgcctgggaaaggaaattctgcacttcaattggctcagttccatggcgaaagctagtagaaagcaagaagtacatgcacctgtttgaacatgtggtaaattgggatgactctgccggcaaagaggcatttgacaatgcaaaaatgaggtattgggctgagatcaacggtgttccctgcaacatatcattgcctgatcccaacatttacaccgatgaagtagattggaatgcaattgttgaccctcaacttattctggatatggaaatggaattagcaaaggtccccaatgaggaactaaggaatgatcacgagattgtgatgattggtggcgctctcttcctgaacgagcaacagcttccgtgtaccggatgggacgacgattatgctgccgaagcaccaaatccaaattctgctgtccaaggctgggcagcaaatctgcaagcaaataatggagtagaatctgggcaacagaatcatgctcctgccgaacatgtagaagaacattttgctcctgccgaacctgcaaaagaagattttgctcctgctgaacatgctaaaggatatgaatggcaagattggaggaatgattcttggggttggaatcaaagggagaacaatggtggtggtggtgacttgcacaaaatgggaagagggagaaatggtcgagggtatggtaattggggaacatgggatggctataacagaaggagggaaaacatgtcatggtctaagacccctactaatggtaataatgagtatcatgtgaataataggggaagaagaaactatagagaaggaggaggaagaaggggcaattttgtttatgtgcctaaggaggtgcctcctactcctactcctgctggatggctgagactgcaacaaggggaccccaatgaaactgctgaggtggctgaagatatataa

SEQ ID NO: 23317 - DNA, 988 bp, Glycine max
  Peptide Sequence Number=SeqID_140095
tagtgttatcaattcagcattagtgccatattgttccagcatatctggtgcaggtgcacaatctggtgtatgctatggaagagttggcaacaatttaccgtccccacaagaagtagtggccctttacaaacaatatgatttccgaaggatgagaatctatgatccaagccaacaagtactccaagctctgagagtttccaacattgagttgctgctagatctccctaacgtcaacctccaaagtgtagcttctagccaagacaacgcaaacagatgggtgcaagacaacgtcagaaactatgccaacaatgtcagattcaggtacatttcggtgggaaatgaagtaaaaccttgggactcatttgcacgttttgtagtgcctgcaatccaaaacatccaaagagccgtttctgcggctggccttggaaaccaaataaaagtttccactgccattgaaactggtgccttggcagaatcataccctccatcaaggggctcttttaggtctgactatttaacatcatatcttgatggtgtcattagacatctagtgaacaataatgccccattattggttaatgtgtacccttatttcgcttacattggaaaccctagggacattagtcttgactatgcactttttaggtctccttcagtggtagtgcaagatggttcacttggttaccgtaacctttttaatgctatggtggatgctgtttatgctgcattggagaaagcaggaggagggtcactgaacatagttgtgtctgagagtggatggccttcttctggtggaacagccacttcacttgataatgcaagaacttacaacacaaacttggttcggaatgtgaaacaagggaccccaaagaggcctaatagaccccttgaaacttatgtgtttgccatgtttgatgaaaatcagaagcaaccagagtatgagaagcaggcaggtatggtccgtatggagctttatctgcactattga

SEQ ID NO: 23318 - DNA, 165 bp, Glycine max
  Peptide Sequence Number=SeqID_140096
atggcggcggctacggcaatttctcagcttggctgcttctccgccgtccaccgcagctcacacctccggcggcgctcgcttctattcccttgccctcgctccaagggttcgtgtttagccacaattgtctgcatcaagcacgccaatgtagaagttactacatag

SEQ ID NO: 23319 - DNA, 369 bp, Glycine max
  Peptide Sequence Number=SeqID_140097
atggaacattgtgctgaacagggtggatttgttttaactggagggattattggattcctattttcacggagtcctgcaacactaggcagtggtgtgctctttgggggtgctttactattccttagcacctttagcatgaaggtttggaggcaaggaaaatcgagtttaccatttattctaggacaagcagctttggcaggggttcttatctggaagaactttcaaagctactcattggcaaagaaaatatttccaacgggcattagtgctattataagttctgcaatgctctgcttttatttatatgtgcttatctctggaggaaatcccccacctaagaaattgaagccatctgccagcactgcatga

SEQ ID NO: 23320 - DNA, 454 bp, Glycine max
  Peptide Sequence Number=SeqID_140098
tccagttcttggttggagcgaggactgggagagccaaacccgtcttgttgccttgtatgctggattgactaagagaagagtccaggactttgtgaagtcctgtgatcacccttgtatagccaagacagtcactgagctattttcaagatgtgataaggctgcatggtattcccaaatcagtgttgctttacctcaatgggtgatgtgggctcagctatggtacaacaaatctttacaagcagccacaggtaggaaattaggtttccttaaaattgtgcctaacaacctgccaaaggggctggaacttgagttacaagatcaaggggagccagaatatgtaatggtgatggatgaatttgtgccatgtagccagtttccttctttcatccttaaggacaaggctgaagctccaggaaagggccatgttaggacacaaggttcagttatggagtag

SEQ ID NO: 23321 - DNA, 1140 bp, Glycine max
  Peptide Sequence Number=SeqID_140099
atgagcaggattggcatgactgcctgctctctttcttctgcagctgaagcttcagattttgaatgtgatgcgatccatgatgatgtcaaagcagcagagaaagataatgcactttgcttggctgtctcgcagcttgctagcgagtttagcaaggaatctatgttatctctgcagaagatttttggtgtacgccgtgctcatgtgatatctacaggctccttgaagcttgatctagctctgggaattggtggactaccaaagggcaggattgtggaaatttatggacgagaagcagctggtaagactacacttgcaattcaaattattaaagaagctcaaaagcttggagggattggagtgacaatcaattcttggctaagcaatgataatgaacttttggagcttggatattgtgcatatcttgatgtagaaaatgcattggacttctcacttatggaatcgatgggcatagatactgaaaaccttcttatatcacatcctgattgtgctgaaaatttgttaagcatggttgatacattaacaaaaagtggtgctgtagatgtgattgtgattgacagtgttgctgccctcgtccccaaatgtgaacttgatcaattaggagttaccactaatcgcgatttacaatcacgaatgatgactcaagcactgcggaagattcactattcattatctcattctcaaactctcattgttttcattaatcagattagattgagtccaaaatcagccaaggaatatggatctgtggaagaagtcacttgtggtggaaatgccttgagattctatgcagctgttcgtttgagactttcaagagtgagattgatcaaaactgaggataaggtagagggtgttatgatctgtgctcaagtggtaaaaaataaactagcaccagcagcaacgaaaagggctgaactgggtatcaagtttggaagaggcttttgccatgagtcagatgtcttagatttggcttgtgaacatggaatctttgtgaaacatgagggaagctactttattgaaggtaacagttttgatagtagagaagcagctgaactgtttttggctcaaaatcatgctgtttgtgacaaggtggttaaggatatgagaagactttatttttaa

SEQ ID NO: 23322 - DNA, 225 bp, Glycine max
  Peptide Sequence Number=SeqID_140100
atgcaaaatgtgctgaatttgattcgtccaaatttgaagacggacgagtctggaatatggaataatcctatggaggggtgtatgaaaaataacagtggtggagcttatctaccagtagtaggagtagcttcatgtggtgttgtcataaaaggtaataatggtagctttgtttgggcttactctagaaggttagggcactgcttgattttagaagtagagctatga

SEQ ID NO: 23323 - DNA, 234 bp, Glycine max
  Peptide Sequence Number=SeqID_140101
atggttttcggggcttctgtggttttcgtaaaatttctgaaaaccttggggaagataaaaaaagatgaaaatcaaatccgaaacacttccgtaaggcttccaaaatccaagtcaaggtgcttccgtaacgcttccgtaagcgattctgtgaaaattcttcatcgttcttcaccgttcttggttcgttcttcgtcgttcttcggtttccaaccgttttcttttcctccactttaa

SEQ ID NO: 23324 - DNA, 156 bp, Glycine max
  Peptide Sequence Number=SeqID_140102
atgatacctagcgttcgagggctagggaacctccacactgcgcgttccactcgagagttggagctcgagggagagaaagagaaacggcccatgcttaaccacttacgattagctgttattggcatggataaactctaccctactaacaatgcgtaa

SEQ ID NO: 23325 - DNA, 390 bp, Glycine max
  Peptide Sequence Number=SeqID_140103
atgaagggaggcgaggatctccaccaccaccactaccatcagaacaacttcccattccagctacttgagaagaaagaagaccaagaaaccgcctcatgctccacctcctccctttacccttccctacgcagttccggctccttcatgtctgtcccctcccagctccgatcctcctacttcaaccccaatttctccctccaacaacatcaacgtagaaccttcttcctcagcatagcctgttcctctgacaataccaacaacaacacatcaacacttctcaatttccaatccaacacccttaacaccaccatgttgcagcagcaagccaaaccggagcttagcaacgatggcgtgccatcttgcttagacatttcagacaccattgtctaa

SEQ ID NO: 23326 - DNA, 174 bp, Glycine max
  Peptide Sequence Number=SeqID_140104
atgggtgccaagtaccttgaagtggtcaaacgagggtcgcatcccaacaatggatggtccccagacgaaactaggatggaagcagtcttgcccattgaagttgaaatcccttctttaagagtgttgatggaagcaaagttagaagtgttagacaagtggcctcagatatcttaa

SEQ ID NO: 23327 - DNA, 393 bp, Glycine max
  Peptide Sequence Number=SeqID_140105
atggtcattcccaagttcaaggtgccagactttgacaagtacaaggggactacttaccccatgaaccgtctaaagatgtattgtcggaagatgggggcatacgcaaaagacaataaactgctgatacatttcttccaagaaagtcttactggggtagatgttacctggtacgctaacttaaaaccttcccaagtccattcttggaaggacctaatggttgctttcattaggcagtgtcagtacgattcggatatggctccggataggatgcaactacaaaacatgtgcaaaaaggggcatgaatctttcaaagaatacgcccaaaggtggagagacctggcagcccaggtggcacccccaatgacgaaaagggagatgttaactgtgatatag

SEQ ID NO: 23328 - DNA, 558 bp, Glycine max
  Peptide Sequence Number=SeqID_140106
atgaccataatttgtctctacgtgccatcatacttgatcgtctctggatggcgaaaggcacataatgaccataatttgtctctgcgtgccatcggactcgatcgtctctggatggtgaaaaggtgcggaatgaccataatttgtctctgtgtgtcaacaggctcaccgcctctggttgacaaaaggtgcggaatcaccataatttgtcttcgcatgtcatcgggctcgccgcctctggatgacaaaaggcgtagaatgagcataatttgtctctgcatgtcaacgagctcgccgcctctagttgacagaagatgtggaatgaccataatttgtctctacatgtcaccgggcccgccgcctctggatgacaaaaggtgcagaatgaccataatttatctttgtgtgtcaacaggctcgccgcctctggtagacgaaaaggtgcgaaatgaccataatttgtctccgcatgtcatcgggctcgccacctctggattacaaaaggcgcagaatgaccataatttgtctctgcgtgtcaacgagctcaccgcctctggttga

SEQ ID NO: 23329 - DNA, 324 bp, Glycine max
  Peptide Sequence Number=SeqID_140107
atgggtttagcttttgcttgtttggctttggtcctaatgatgttcaatatttttcgattggaagcagttgtcctcgatctagtggcagatgatggtgctggcattcagaagcaaagatctatgtatcactgggataagaggggtaaaataatggtgatcctcaggattcaacaagtttggcaggtattggatcctttgagacaaatgatcaatggtgttcctttggaggatgcttgccatcttactcaacgatatagtcggatgagacaagaagcagaggcacaggagatgaatttggatactcgcgacctcagtagaagatga

SEQ ID NO: 23330 - DNA, 660 bp, Glycine max
  Peptide Sequence Number=SeqID_140108
atggatgaatgtgagaggattgacgagaggctgcgggcgtggacgtggctgaatggggtcccaaattttacacgtcggcttagagaagtgtctttgacaggaggggagacctgcaaaacaaagactccgacgctcaatgatccctgcaaagattctttagcttatgttatgcctaacccttcgcggttggaagatgacctgagggttgatgccaaagctatattgaacactcctaccccgtatgctaccctgtttgatgacaacaaagtaatttggagactaagcaaggatggttgtctacctactagacatgctctcagtgcaacacaatgtgtggtacattcttctcagctcactaccagaggaaataacattggacatcgtcatgattttgtggagcttgtggtgagggcgagatctagtcaaagggttgaaccaatggtgaaccaccaattgcaaagatggatgctgccaccgccagggagtctaaagtgtaatcttgacgaaacgtttttcagccaagagatggcgttaagtaatgtcatccaagatttttcgaactggaagccatatttccccatggtcaaggaaggtgaagctatgaccttgaaaagtgcacttctatggcttcagactgagcgtggagaaggtcatcattga

SEQ ID NO: 23331 - DNA, 792 bp, Glycine max
  Peptide Sequence Number=SeqID_140109
atgtcgtggaaattcacggattgcctaacgatgggtatcaagtacctcgaagtggtcaagcgaagacaacataggaagcaagaccttgtagaagtaggaccgtggttgcctggtaaagacttctcctttgatatttatgaggagttgtgtttgaatttcccttggttgaagttcttgcctaaccaatgtggggatagttcgcttgacctgcaaagttcctcctctaatgattatgaggacggaccaaggagatggcttgggtttagtagaagtatgtaccaagggtggaccttgggttttcatacaaagggtggaacttgggaaagattgtcaagggtagaccttgcgtatcttgagttcccatggggatggaacttagtaatggaaagggcttcaccaagggtgaccttgggtttgtcgagccttggaccagggacatgtttgtccaagtataagtgttatgcccttgcatacatggccctcgccgtgggtggcatatactggaggcgtggtggtgtgaaccaatgggacttaccaagggcagaccttgggttttgcaacccctttagaggattgacaaggaaattgttcgacctaggttttgaacatcgtgctcttgaacacatgtcactcgtcgtgggtggcacgcaccggagacgtggtgacatgctcttacatatatgtcactcaccgtgggtgacacatattggagtcatgatgggaggttgcttcatgtgggagctacctagctcgcctgggcgagctgggcagcagccacctccctcattttag

SEQ ID NO: 23332 - DNA, 560 bp, Glycine max
  Peptide Sequence Number=SeqID_140110
atgggggtgcaaatagcaaccaggcccagttgggccttacaggatgttcctctacaaggcggttgcttctggaggaagcaacctagctcgcctgggcgagctgggttctgtcaggtcaaggtcaagagcctagggaccaccagtctaaaagagttagggcagttaatgggtcatctccagcggcaagcttttcgcaaagcttacagtaaaatttgggacttagccataatagaagtctccacaaaggccattgcctcccttgcccagtattatgatcagtcattgaggaaaccatacctcttctcagggttctatccctcattagctagaatttccaagatagtccaaatctcggcgcaggaattagaccacaggaagcgaatgggccccgttcatagatattctcgcactgttgatcttcggaggagtcctctttccgaatgtggatggccgacttatatgacaccttcgaccgaagatgtgaaaagagcaatacaaggattgtttgctgtactccagctctttatgtatggttggtttcgcacctttttcgccaagag

SEQ ID NO: 23333 - DNA, 405 bp, Glycine max
  Peptide Sequence Number=SeqID_140111
atgtcgctagtggttgcagtggtgtcaccgtcgttagctcatgtggcagtggacaagattgtggatataagagaggaaattctacgaaagagaagagccgggaagctacccggcgacacaacttcccttttaaaagcttggtggcagtcacattctaaatggccatatccaacagaagaggacaaggcaaggttggtgcaggaaacaggcttgcaattaaagcagataaataactggttcataaatcaaagaaaaaggaattggcatactaatccttcgtcttctagtggctccaaaagcaaacgcaagaggtgggtttctagtttcttagtatatttttggattaaagttagaagagatcaaagtagtggtgcaggggaatcaagtaaccagagcttcatgtga

SEQ ID NO: 23334 - DNA, 757 bp, Glycine max
  Peptide Sequence Number=SeqID_140112
tgacacgaaacgtcttaaagaaagcggcattgtccgcgacttagccagtggaaccaccacttggttgatttcctctaagaagggttggtcaaagcagatggtgtgttgtaacaccccgatcgaatcacaccagaatgaaagggattcagaggctgtgcagaattctacaattaatcgtgattggcttggagtagtcattgttcctggaagtaggagaagcagattgttgaggtctcaaaaagggctacctatgagggttctgaccaacaaggatattaaggatgctacacgtgtcggctcagctcgtcctttcccaagttatcatgaagctcttccagttacagtcttaaagcttcctccctctcatgagcctctgtcatggtggttagatgcctctctttcacctcctttgtcgtgtctctgccttgagtgggttgtcatttgttgtgctcgtggttgcgctgccattaaagtggtaagcccttccttcatacctgtttccattcctcgtagttaccatggtggttactcacaacaaatggtcaatgggagttttcccgaagatcccacaatgggcgccaatgttcaagtcggagaacaccagggagaaggagctcttgggaaaaggttgatgtttaagaagcacgagcacatgaaagtcaagggatatacttatgcatattgggttggtaacatcacagataggcattctagatcagactactttacatttgtagcaagctttcttgtaacatag

SEQ ID NO: 23335 - DNA, 186 bp, Glycine max
  Peptide Sequence Number=SeqID_140113
atgacgacaacatcaaagtgcaacgattctcccttccatggcaatgatgggtacaccttttttcagatttggaaaaaatcgcgaaccacaacccattgctcagatctagaacaaatcataactatctcaaacaaccagctccgatgctgcaactacaaggaggaagatagagaggatgaacaaatg

SEQ ID NO: 23336 - DNA, 159 bp, Glycine max
  Peptide Sequence Number=SeqID_140114
atgccacttctgaagatcacaaacaatactttcctaagtgtgtatgagcactatcctaaaggacttatccgtggtatcccactcaagtctaccaagatacaagaacttcttagacgtgctaaggctacagaaccatcaagtcacaaagtaaaagcctag

SEQ ID NO: 23337 - DNA, 700 bp, Glycine max
  Peptide Sequence Number=SeqID_140115
atggctgaagatcaaccgcaaacggttactcttgaagattattctagctcgaccttgattcaaggaaatctgtttcatggattgccaaatgaagacccttatgcacgcttggctacttatattgaaatctgcagcacagtgaagattgtcggtgtgccagaagatgcagttgtagagaagtttttgaagaaatattttcctgagtctaagacagctgaaggcaaggcttctatctcctcattccatcaatttccagatgaatccttgagccatagtccaagcagttattggatgcttctgctagaggaaaaaactaaattgaagactcctgaagaagctatggagcttattgaaaatatggttgctagtaaccatgctattttgcgtgatcggactcaagtacctacgaagagaagcttactagagctttcttcacaagatgcactattggcacagaacaagctgctagctaagcagctagaatcgctgacggagacacttagtaagctgccaactcaattacaagtgactcaaccttcacatttaacagttctgcaggttggaggttgtagcttgtgtggaggagcgcatgaatctggttgttgtatacctcttgaggatgctacaaaggaagtgaattatatgggaaatcagcacagaccagggtttaatgcaggtggatttgtaggttatcagcaag

SEQ ID NO: 23338 - DNA, 417 bp, Glycine max
  Peptide Sequence Number=SeqID_140116
atgagggataaggagcaacatgacatgcaaattcgtaaaagaagcaaagatgggcctagagccatccaatacaaccatcaaacaaagcatttagtcatgggtttacacataaatcatctcacaaacattgcaaagaagcaacaatcaaagaaccacatatcgaaaggaaagggtaaaattcgatggagatggcacttacttgaatcagatgaaaggaatgcaaaaataaatgatagaaaggtgcacaaaatgcttgaagatgctgctgccaatggaattcccgtgagcttgggtaatggattttgtgattttgaagagaatgggcgcccactcgcccaagattatgatcgaggcttcgccatctcatccttcctaactcctttccttgattttgagaaaatcttatcatggacctag

SEQ ID NO: 23339 - DNA, 264 bp, Glycine max
  Peptide Sequence Number=SeqID_140117
atggttggtctttcatgcaaactaactttgcgaatgtgtcgtcgcaagaaatggctccaaagaagcttccagctaagagggcaaggaaaaatgccgtttgagaaggtcgacaaaagcggggctcttgctcctacgtaccttccatcgaagaggaaatcagacctacataattctttcttaagggtgaatcacacgatttctttttacttgaaaggtgatcatttaaaggtgttggaccttaataaactgatcattgaaaggtga

SEQ ID NO: 23340 - DNA, 231 bp, Glycine max
  Peptide Sequence Number=SeqID_140118
atgggaaatggggataatacgaaatgccaattcataatagaattcaaggagatgaatgcaaatgcaaaaaggaaagcaaaaatgcacaaatggaggcttagggctactggactcgaggattcccatgagctctgggtggtttttgaaggttggggaagaaatggggtgaagaatggcttcacctcccctcttttaaaattatcgtcagacatgctcgcccaagcaagctaa

SEQ ID NO: 23341 - DNA, 306 bp, Glycine max
  Peptide Sequence Number=SeqID_140119
atgtcatctgccttttacctttcaaagactgtcagagtcttttgcctccgagactaccaagtctattggctcgcagagacgatcgaggttttcactgcttgggcttccgatagtggccgatcggatgccccctggctcgcccaggccagcctctggctcacctgggccaccaaaaatcttagggttgaagtaaccagctcgccgacgcgagctgagcttgcttgggcgaggaaggttacttttggaggaagtaaccagctcgcctgggcgagctattatgcaacctccacccctcatttcctataa

SEQ ID NO: 23342 - DNA, 528 bp, Glycine max
  Peptide Sequence Number=SeqID_140120
atggttgcaatggtgtctatagtgcttggttctatccagacaaagtctaggaggaggtataaggggctcacacttgtcgtgtttgtgtcgcttgttcgacctatgcgagttggtccttgtgctaccttcccttttgtcacatttatgttcaacctatcgaacttcatttcaaaacctcaacatttcttccatctgaatgtaccattggctcgctctcgtaactcatccatgttgttagaagaggttagcctaggtgaggaacacatgcaggtgctcctccgggtctgtggtcccatcatgacgctccaggttgagcagtttccaacccaagggcaggtcaaccaccacgattcgatctatgaaaggaagtcatcgagtcatccatccttcatgtcgatatgcatgcgaggtgttgttatcatccatggtattcttggtctgacaaggatgcgattccccttaggtgcactcattgattgtatgggcggagtgttcgtctccttgaaggaacccaacatgagcctctag

SEQ ID NO: 23343 - DNA, 309 bp, Glycine max
  Peptide Sequence Number=SeqID_140121
atgaaccatttgttcaagtcaagtgttcctttgctattggtgctggtgcagtcacttcttttggataccaaagatgcacttcctccacaagatgagcgtactccttctcctcctcctcagcgagatgattcagccctcatgactaaagttctttccgagttacagggtcttcgtacttatgttggagaacattttgattcattggataatcgctttgccggaatggatattcgtctcacacaacttgaagaagatgtgggttatattcgtctgagcttcgatcttccaccaccacctccaccttcttag

SEQ ID NO: 23344 - DNA, 4437 bp, Glycine max
  Peptide Sequence Number=SeqID_140122
atggctgaccatgcaacaaggaaaactaccaccgataggcttgaagaagctattactcgtctctctaatagccaatcctccctcctagataaacatgctgacctcgttgacaagtactctgaactttccggcaaggtggatacacttcttgatcatctccacctccgatctccggctcgagaacaccatgggacctcttcccagtttcatcagcgtaactccgtcaagattgacgtccctaggtttgacggacgcgaccctatggggtggatcttcaagatctcacaacttttcgaataccagaatacgccggaagaagaaagaatcactgtggcctctttttaccttgacggagctgcgttaagctggtaccaatggatgtttaggaatggatttattacgtcatggtcaggtttcttacaagccctcgaatccaggttcgctccttctttttatgatgacccgaagggggcgttattcaagctaacacaacgaggcacggttaatgagtacttaacggagtttgaacgattggccaatcgtgttattggcttacccccaccattcctattaagctgtttcgtttcaggtttaacacaggatattcgaagagaagtgctagctctccagcccatttcccttccccaggccatggcccttgccaagttacaggaagacaagattcgtgaccgccggcaagcaccatcacgaggtcacaatacaccatcaccatcctatgctcctcctagccggaaaccacagtctacatatgttcaaagaactccagaagaaatggcccttcgccgagaaaaggggctttgctacaattgtgaggaaaagtggagttccacccacagatgtaaaggacgcgttcttttattcatcgctgacaacccctccttgctaccagatgagcccaaccccgaacctcctttactgccggaaccgattctagcgtgtcccctcgacctagacacaacctcagattttacttccccccacgtgagtctccacgccctttctggcctcccctcctccgagaccttccgactcgtcggaatcatcaatcactcctccctcaccattctcatagacagtggaagtacccataacttccttcaaccccgacttgcccagttccttcatctcaaaaccgaaaacacaaacccacttcacgtcctggttggcaatggctctgtccttgaatgcaatcaagtttgccgtgatacgtcacttctccttcagggccaccagttcacggtcacgttccatttgctccctatcagtggtgcggatgctgtattgggcatagaatggctacgacaatttgggcctgttattactgactacaccgcgttttccatgaagttcacccatatgggccgacccattgaattacacgctgatatctccactggaccaaaaccaatttcggcccctcaagttaaacggttattacaaaccggatccgtttcagccctcttccacttaaaaatgatacccgaccaacaacccgacccattacttcatcttcctcacccgatacctgcggtcgaagctcttctcactcagtttcataagctattccgacagccttcatccctccctcccccacgatccatcgtccaccatatcaacctcctaccaaacacaaccccaattaatgtaagaccgtatcgttacccacaagtccagaaatcagaaatcgaaaagcaggtcttagagctcctcgaatccggtctaatccaacccagtatgagtccttactcctcgccggtattgcttgtcaaaaaaaaggacggaacctggagaatgtgtgtcgattaccgagctctaaacgcagtaacagttcgagatcggttcccaatacccacgatcgacgaacttctggacgagttaggaggcgctgcttggttttccaaactcgacctccggcaagggtttcatcaaatactcatgcacggccccgacgtggaaaagactgcctttcgaacccaccaagggcactacgaatatcgcgtaatgccctttgggttatgtaacgcgccgtccacttttcaggcggcaatgaataccttgctaacgccatttctgaggaagtttgccgcggtttttttcgatgatatattgatatatagcagaacactagcttcacaccttcaccacctcgaactcatcttccagactcttctccaaagccagtactatctaaagaagaccaagtgccttttcgctcagaagcaaatcgagtatttagggcacgttgtgtcaggccaaggtgtcgaaccggaaccctccaaggtccaagccatggtgcagtggcccacgccatcctcagccaaagaactcaggtccttcctaggactcacaggtttctacagaaagttcattaagaactatgctatgattacggcccccctcacttctctctgctccaaggaaccattcgaatggccctcggaagcccagtccgcgtttgatcgattaaagacagctatgacttcagccccagtccttgcgttacccgatttcgatgaaccatttatcatcgaaacagatgcttccggcgccggcatgggcgcggttctaatgcagaaaggccacccactcgcgttctttagtaagcaattcggcccacgaatggttcatgcctccacttacgtcagagaactccacgcgatagtagctgctgtccgcaaatggcgccagtaccttctgggccatcctttcaccattttcaccgatcataaaagcctccgcgagctcatgtcccaagttatccaaacacctgagcaacactactatctttctaagcttttgggtttcgactacacgatacaatacaaggtgggttcttcaaacgcagttgcggacgccctatcccgtaccactccctccggcgagttcctactcctatcagtgcctcaccttgacttcatgcgtgatttacgcaacaccctccattccagcaacgaatttcaagaactactctccaaagtacgtgacaatcctggtgactttcctgactatcgcattcatcagggactcatcctcttcaagaatagaatctggctcaacaacgataatccgtccatacctagcctcatgttcgaatttcacgcaactccaatcggaggtcatctcggcgtaaccaaaaccacccataggttagagtctaacttcttctggtcctcattacgaaaggacatcaaacgattcgtgaaggaatgcaccacgtgtcagcagactaagtctagcacacagcgacctgccggtcttcttcagcctcttccaccaccaactggagtctgggaggacatctccatggatttcattacccaactcccctcttctcacggttatactactataatggtagttgtcgacagatactcgaaaggtgttcaccttggagctctgccgtcgaaccactcagccttcaaggtcgcctccctgttcatcgatatcgtctgtaaacatcacggcttcccgagaagtattgtctccgacagagacccaatcttcctcagctccttctggcgtgagcttttccgactcagtggaacgagactccgtatgagcacggcttaccatccacaatcggatggtcaaaccgaagtcatgaatagggttctggagcagtatcttagatccttcgttcatgctcaacccaatacctggtatcgttatctaacaatggcggaatggtgttacaacacctccattcactccagttcaggaatgacgccatttgaggtcatctatggcaaaccaccaccaacacttccgcattacctccagggagcatctacaaatgaagctgtggattccatgttacactcacgccaagaaattcaccgaaagctgcagcagcgtattcgtaaggcacaagacgccatgaagaaagcagcagacaaaaaacgccgtgacgtcaactacagcatcggccagtgggtctacgttaagttacgaccctccggcagcgttccgtcgcagataagtgaacgtgtagggcaagtctcatacaagctcaagctacccgacgcggcaagaatccaccccgtattccactgctcactactacgcgagcatcacggaactccacccacccaacccgatcgctggcccttacagtttatcgctcacaaacccgtcgcacgacctttgtgtattctggactctaaactcgacacttcatcatctccgccaaaccaacttgtgttagtacagtgggcgggacaaccccctgaggacaccacctgggagtcatggccggaagttcgcgaccttcaccaccttgaggacaaggtggtcttcacgggtgagggtattgttagcaaccacctaaacaatatcacgactggacccgaaactgcagatacaaggcccaaacgaagaacatcgagacccagcttcttgatcgactacgagacatga

SEQ ID NO: 23345 - DNA, 810 bp, Glycine max
  Peptide Sequence Number=SeqID_140123
atgattaatgctcaaagcaaggggacatgtgacaggagtagttacatatcagactcagatggcagaaggaacttatcttttatttttactgacttctgcttggtttttggagatgatgaatggtcatttgggttctgtgagcaaggtactggggtttttagttgcccttctggaaagaatccaatgtatacatatcgtgaatccattgttttagggaaaacaaactgttccattttcaaggtaaatcaaatactaagagaactcagtagagagtggccagggagttcatatgatctgctgtccaaaaactgcaatcacttttgtgatgaattctgtgaaaggcttggtgtaccaaaacttccaggccccaggagttggttagtcttagtccaatcaaactcagtcatgtcatgggcctttggttttacttttttgcttccactgtatattcttacggcttccatgacaggctgggtgaataggtttgccaatgctggtgatactgccatggaagtggctggaaatacagcattacggttccggcaagctaaaactgagattgtatcagcaagcaaagtagcataccggttcctcttaggagttaccaataatgttactaataatgttaaaaatggtccagagtcccctgacaattcaaacagaggagggtcccctagacttcaagcatcttggttgaaaaatattgttactaatggtgcaaaaccgtctactagttcagaagctgagaatcagaacggagttatgcctctaccgccaacacgagatgacaaggcattgctacatagttaa

SEQ ID NO: 23346 - DNA, 192 bp, Glycine max
  Peptide Sequence Number=SeqID_140124
atggatttgttgttaggtgggtatggtattggaggatggatgggcaagtgcaagggttgtggaaagttaggaagaatgaggccaagtcatatgagcgcgtatgaattttctctgatgctggctcctgttgtttctgtttgggattgcatagttcgcaaaatgaggtactcctacagacctgagtgggtgtag

SEQ ID NO: 23347 - DNA, 587 bp, Glycine max
  Peptide Sequence Number=SeqID_140125
atgtcggccggtgacgcggtcggcgtcgcggaggctggtgatgtcgggggtagtgatgaggacggcctcgttggcgggcgtgatggcggtgatgaagccggcgtcaatgccggcggggcagtcgatgaggatgaaggccttgccgccgaatccgagggggagtttggatcggggtttggagatgcagaggagttcgaagttggaccagcgcttgtcgcggacgagggcttggtcgaggcggcattcgccattcaggacctcgatcacggtgtagttgacgcggttctcgaggccgaggaggaggtcgaggttgcggaggccgacgtcggcgtcgatggcgaccacggagaagccgagacgggcgagggagaggccgatgttggcggtggtggtggtcttgcccacgccacccttgccggaggtgatgacggcgacgcggggggtggagccggagagctcgggcttgcgattccactggaggagggcggagggaggtttgggttttttgggggtggagagaggacattgggaagggaagagagggagagggagaagaagaagatgaatgatgatgaagaagaagcaca

SEQ ID NO: 23348 - DNA, 1188 bp, Glycine max
  Peptide Sequence Number=SeqID_140126
atgtatctaaatgtaagaatatttgcagtaaagtacataaaaggaagaatggttgcttttgaaaaaaaaaagaaaaagctaccctcaagcggaaagaatcaaccttcttccctttcatttctcactttcagtgttcactcactcatctccactgtgcttcttcttcatcatcattcatcttcttcttctccctctccctctcttcccttcccaatgtcctctctccaccttcttcccggcgccaccaccgcccccaactccgcattcctcctccgcccccattctcccctcttcccctccaaaaccctaacccccaaaaaacccaaacctccctccgccctcctccagtggaatcgcaagcccgagctctccggctccaccccccgcgtcgccgtcatcacctccggcaagggtggcgtgggcaagaccaccaccaccgccaacatcggcctctccctcgcccgtctcggcttctccgtggtcgccatcgacgccgacgtcggcctccgcaacctcgacctcctcctcggcctcgagaaccgcgtcaactacaccgtgatcgaggtcctgaatggcgaatgccgcctcgaccaagccctcgtccgcgacaagcgctggtccaacttcgaactcctctgcatctccaaaccccgatccaaactccccctcggattcggcggcaaggccctcacctggctcgtggacgcgctgaaagcacgttcacagggctgccccgacttcatcctcatcgactgccccgccggcattgacgccggcttcatcaccgccatcacgcccgccaacgaggccgtcctcatcactacccccgacatcaccagcctccgcgacgccgaccgcgtcaccggcctcctcgaatgcgacggaattcgggacatcaagatgatcgtcaaccgggttcggaccgacatgatcaaaggggaggacatgatgtcggtgttggacgtgcaagagatgttagggttgcctttgctcggggttattcctgaggatagtgaggttattagaagcaccaatagaggtttccctcttgtgctcaacaagcctcccactttggccggattggcgttcgaacaagccgcgtggaggctcgtggagcaagatagcatgcaggccgtggtggtggaagaacaacccaaacgtgggtttttctccttttttggtgggtag

SEQ ID NO: 23349 - DNA, 216 bp, Glycine max
  Peptide Sequence Number=SeqID_140127
atggtatcactctcggcaccgttagagtatctagaaggggttgaatatgaacaccctaatacaagaacatctatggtatacatgttatctactgacatcttgtgggatctccaacaatactacaagaaatctcacaggattatcctacccactttaaagaccattgaggttctgttcagcaaaagatattccttaatatggagactcacactctag

SEQ ID NO: 23350 - DNA, 156 bp, Glycine max
  Peptide Sequence Number=SeqID_140128
atggttgagactgtgtacctgaatcaggaaggagagaccctgacaaactcttcggagtgtaggccatgggggtcatccagtttgagtactcctttaagcctgactgatcttcctatgatttcacttagtgagagtgacctgacttatccattgtga

SEQ ID NO: 23351 - DNA, 1374 bp, Glycine max
  Peptide Sequence Number=SeqID_140129
atgcgttcgaggatgcccaagaggaaggttacgtggtttttggatggagaatgtagcgctttatctctaagggggatggacgacgagaaaacggggagccatagtaccatgaagctacaagggaagataagtggaatttccattcttcttcttgttgacagcggggcgacccataatttcatttcaaggaaattggttgaagctttaggttggacatgggaggagacaaaatcaatgaaaattttgatgggggatggccacgcgactgaaaccagtggtatgtgtaaagaaatcaaaatagagacaaaggcaggaaggttcacacttgatgttgtcttgttcgatttggaatatattaatgttattttgggtatgtcttggctaaaaactctaggggtaatgatggtagattggaatacacagataatgaagtttgaaacagaactgggaatgaaaaacttgagaggagtaaatcaagaagagcctttgtttgccactttgtgtggggtacttgatgaaagacaagagcagaaggagaatgggctgagcagtgagcagcaacgagctttgggagatattcttaccagttttgatgatgtctttgtgaaaccaaagggattacctcttgttcatgtgaacgagcatacaattaacctgaaattgggacatgatccaatcaatattggtcatataaggccaagtcaaagtgaatattcaagtccgataattctagttaaaaagaaaaacaagtggaggatgtgtgtggattatagagctctcaacaaggccacgattccagataaattcccaatcccggtgattgaagaactactagatgagttacatggttccacctatttctccaagttagatttgagttatgccatttgggctaatgaatgggaggagcatatggagcaattgaaaagtgtcttggaagatctaaggaagcaacaactttatgccaacaaggagaagtgggtagaggtggacccaaacaaagtgaagagcgtgctggattggccaattcccactaatgtcaaaggagtatgtgggttccttggtatcacaggctattatagaaagttcatcaaagactatggaaagatagctagacctttgactgagttgacaaaaaaagatggctttgggtggaatgaccaggctcaaaaggcttttgaggaactaaagaataagattacttcagcccctgtcctaaccttgcccaattttgaacaagaatttgagcttgaatgtgatgcatccgatttaggaattggggccattttgatgcaaagcaggaaaccagtggcttactttagcaaggctttaagtagtagaaatgtcactaaatctgcttatgaaagagagtaa

SEQ ID NO: 23352 - DNA, 1287 bp, Glycine max
  Peptide Sequence Number=SeqID_140130
atggaaattccacttatcttcccttgtagcttcatggtactatggctccccgttttctcgtcgtccatcccccttagagataaagcgctacattctccatccaaaaaccacgtaaccttcctcttgggcatcctcgaacgcattttcttcttcgcactcaacctgcaactcatcatcagctacgatgagacaaagctgttttacggggcactgatgcaatgggccataaggtccaccacatttgaaacacagacctttttttcgcctgtcaaccagatcctaatatgccaaatgcttggccgatactatgccataaggaaattcattgtctattccgatcaaaagagtttgaagcaacttctccaacaaagaattaccacggggagccagcaaaattggctagctaagttgttggggtataatttcgagattgtatacaaactgggtttagaaaacaagggggcggatgcattatcaagaagcatgggggagatggagcttatttccttagcatacatacttgtgtggttggactacccaaatttaataactgaagtgcatgaaagttccacttggaggaaggttattgaagacttgaagcaagatcaaggaaagcatatcggttttgagtataaacaatgtgtgttattcttcaaagacaaattagtagttgctaaaacctcaagttggattcctaagttaatggaagagtttcatgccactccccaaggagtacactctgggttttaccgtacttataggcgtcttgcttcgaatctattttggaaagaaataaagggagatattatgaggtttgtgcaggactgtgatgtttgtcaatgccagaaatacttaacaacagcccctggaggtttattgcaacctttaccaataccatatcaggtatgggaagatatatctttagattttatcacggggctcccgagatccaaagggtttgaggctattctagtcgtggtagacaggctgtctaaatatagtcattttattccattaagacacccttacgcagcacgagccatagctaaaatatttgtgaaagaggtgataaggcttcatggggtacctaattttgttaaagaattcttcaaactacaaggtataacactcaagatgagtacaacctatcatcctcaaaccgatggtcaaagcgaagtcactaatcggtgcttggaaacatacttgaggtgctttatcacggatcagccaaagggatgggtcatttggcttctgtgggctgaatattggttcaataccacttattag

SEQ ID NO: 23353 - DNA, 387 bp, Glycine max
  Peptide Sequence Number=SeqID_140131
atgcaggctgcaaggaatgctggtgtgcgggtattgttgaattttgttgatattttgagtcctaatgaaactgaacttgctcgccttactggattgccaacggagagttttgaagagattacacaagcggctttgaaatgccatgaaatgggagctaagcaagttcttgttaaacttgggcacaaaggatctgcccaaaaaccaattcagcagcctgccatactttctaaaacagttgttgatacaactgatgctggtgatacttttactgctgcttttactgtggcattggttgagggcaagtccaaaaaggaatgcctcggatttggagcctctccctgcatgcctgataggaaatctgttttggatcttcttaattgtcaatga

SEQ ID NO: 23354 - DNA, 2107 bp, Glycine max
  Peptide Sequence Number=SeqID_140132
atggcggtaggactctccgccgccataaccatgaagtccctcctccgtttccaccaacctcacctgaacctccccaaatcaatcccaacaacactccctttctcccccatgagaattttccaccacacagcatcaccaagaacccaaaaagtttcaactttcaccgtttgtgtcctcatgcaggacccaaaacaaggcacccacatggaaattgagccacaagaacaacctcctcctcctcctcctcctcccgctcaacaagttctgtcaccaaagttggctgagaaattggccagaaaagagtctgagaggttcacttaccttgttgctgctgtcatgtctagcttcggcatcacatccatggcagtgttcgctgtttattgcagattctcgtggcaaatggagggtggagaagtgccttggtctgaaatgtttggcacatttgctctatcagtgggagctgctgtgggtatggaattttgggctagatgggctcatagggctctctggcatgcttcgctgtggcacatgcatgagtcccaccatcgaccaagagaaggacccttcgagcttaacgatgtatttgcaataatcaacgctgtccctgccatcgctctcctttcctatggtttctttaacaagggactggtccctggcctttgctttggtgcggttgtgggggttatctacacagttttgttattgggattacaaggagtgagggttgttgaatgcagagtggccaatggattggactgttttgagtaccctgctatcagctgcagaaaacacagtgcagttttgactgattttggtggtgttggtgatggaaaaacatctaacacaaaggcctttcaatatgcaattagcaatctcagccattatgcatctgatggtggagctctccttgttgtgccaccagggaaatggttaacaggaagtttcaatctcaccagccatttcacactttttctccaaaaggaagctaccattcttggatctcagtacattattagaatttggtcacctaacatcaagtcactagcctttcttttcgcctttttgcctaactgtgatttcttggcagatgaatcagagtggcccacacttcctgtgctaccatcatatggcagaggaagggatgctcctgatggaaggtttagtagtctcatttttggaactaacctcactgatgtaataatcactggttacaatgggacaattgatggacaagggtgttattggtgggacaagttccacaagggtgaattgaaactcaccaggccttacatgattgagattatgttctctgatcacatccagatatctaatctcactttgatcaattctccatcttggtttgtccatccaatttacacaagtgacattataattcaagggctgaccattcttgctccagttgactctccaaacactgatggaatagatccagattcttgttccaacattaggattgaagattgctacatagtctccggtgatgattgtgtagcaataaaaagtggttgggatgagtatggaatcaaatttggaatgccaagccaacacataatcattagaaggcttgaatgtgtatccccagatagtgctatgattgctttaggcagtgaaatgtctggtggaatccaagatgttagagctgaagacctcacagccatcaacactcaatcagcagttagaatcaaaactgcagttggcagaggagcatatgtgagagacatatttatcaaaggaatgaacttaaacaccatgaagtatgtgttttggatgacaggttcttatagctcacaccctgacaatggctttgatccaaaaacacttcccaacattactggaataaactatagagatgtcattgcagagaatgtcacatattcagcaagacttgaaggaattgctaatgatccttttacaggaatctgtatttctaatgtgactatccatagtggaaaaaagaaattgcaatggaattgcactgacattgagggggttacaagcaatgtctatcctaagccttgtgagttgctgcctttgaagcaagagaaaattgagtgtccttatccagatgacaaagtttccattgaaa

SEQ ID NO: 23355 - DNA, 465 bp, Glycine max
  Peptide Sequence Number=SeqID_140133
atgaaagatggttggggtctggcaactgatggaacattgttgtttggaagtgatggcagttcaacattgtatcaaattgatcctcaaacgtttaaagttgtatcaaaacaagttgtctactataagggtcatcaagtacacaatctcaatgaattggaatacataaatggtgaagtctgggcaaatgtttttatgactgactgcattgtaagaatctctccccatgatggcaatgttctaggatggattctcctccaaaatttaaggaaagaacttatcgaagctgggaataataatattaatgttttgaatgggatagcatgggatggtgagcaaaagcggatatttgtgactggaaaactgtggccagagctatatgaaatcaaggtttctcctgtaaacaaaccaattgaagaagggatcattgagaagctttgcttgcgtagccctttcaaatttacatga

SEQ ID NO: 23356 - DNA, 536 bp, Glycine max
  Peptide Sequence Number=SeqID_140134
atgtactattcttccaagcaacgcatcatcacttggttgatcttaatcatgattgttctctacatcctttattcttcaaattttcttctcttaaccaaggtcaagaaggattgttctacctccattcatttagatgaagccacccaagaacatcttgagatgagtggtaatatatcctcaactacaaaaaccattgaaagatcaaatgttgaagagggcaacaatgaaaaggaggaggaagaagaagaagaagaagaagaagaagaagaagtatcccttgaccagttatctcaaagacaagacacgaagctcaaacacattgtttttgggatagctgcttcatccaatttgtgggacataagaaaagaatacataaaagtgtggtggaagcctaatcaaacaagaggggtggtgtggttagatagcaaagtgaggactcaagcaaatgaggggttaccagagattcgaatttctggggaacctctaaatttaatatacaaatacacaagggcaaaatctgctttgaggattcaagg

SEQ ID NO: 23357 - DNA, 960 bp, Glycine max
  Peptide Sequence Number=SeqID_140135
atgggagatgatgatacaatatttattgtggataatgtggttagaattctttctaagtatgaccacactcaattctattatgttgggagctcatctgagagccacgttcaaaacattcatttctcttatgctatggcatatggtgggggaggatttgctataagctatccattagccaaggagctcgcaaaaatgcaagatcgttgcattcaacgctaccctgctctatatggaagtgatgatagaatgcaagcttgcatggcggagctaggagttccattaactaaggaacctgggtttcaccagtatgatgtgtatggggaccttttaggccttctgggggcgcatcctgtggctccactagtgacattgcaccatcttgatgtggtgcaaccaatattcccaatgatgaatcgagtgcaatccttacaacaactaatgaaatctgttaagcaagactcaggtagcgtaatgcaacaatcaatttgctatgacaagaagagatattggaccatctctatttcatggggctatgtggttcaagttttgaggggagtattatctcctagagagttggagatgccaacacgaacctttctaaattggtataaaagagctgattacactgcatactcattcaacacaagacctgtgacaaataaaaacccttgtcagaaagctttccttttctacatgaacagaacacgatatgatccagttaggaagcaaattattggtacatactatcgtttcaaatctagacctccttactgcacttggaaaatggagtcaccagagaaaatcaattccattataatttcaaaaagaccaaatcctcttcgttggcaaatgtcaccaaggagggattgttgtagagttttaccatcacgaaagaactcaactatgtatatatgggtgggcaagtgtcagcagggagaagttagtgaattgagtctttaa

SEQ ID NO: 23358 - DNA, 138 bp, Glycine max
  Peptide Sequence Number=SeqID_140136
atgacgccttacttactgatcggaatggagagaagcacaacttcacaagctttgaacaatcatggttggggtaacgatggtagtcataatggtggtggtggtgatcgtgatagtgatgataggtttgatatattttag

SEQ ID NO: 23359 - DNA, 393 bp, Glycine max
  Peptide Sequence Number=SeqID_140137
atgggaagcaggaatggttcaggttatgaagctaaaatggtatccatattctctcagattgagtcccctgacagatcacttcatgaccatataattgaagctcttggcaagctcactgttgaacaaggaattccttatgttaccaaaaaagtacaagaagctgcacattgttattcattgttgttctcctctaatttagcgtttttcgccatcgccgacaacattggagcaaaaaaagtcaagttcacgggcctgacctcgacggtggacgcgcaaacgaccgttgctcttcgcggaagcttcctcgcagcaccaccgcacctcctcaacgaagaagaagaagagccacaaagaagacgcgcaaccaatgaagaagaagaagcaggaagatga

SEQ ID NO: 23360 - DNA, 321 bp, Glycine max
  Peptide Sequence Number=SeqID_140138
atgacgaaggaagtgatccacggtcacgactttgcagtgcctcgactccacttttcctcttatgtggttttctctctgaaaaatccatttagtgtaggggaaactcgccaggtgagctacttgcttagggctgaaggtatcagcttgcctaggcgcgtggcttgcttagggctgaagttttctcttagcccaggcgagctagatgctagcttgggcaaatttagggtcagaaatcttcatgataagaccattttacccttccttttatatttgtttttggatctaacaaacaacaatcaaaacctacaaaatcatggatga

SEQ ID NO: 23361 - DNA, 654 bp, Glycine max
  Peptide Sequence Number=SeqID_140139
atgaagctctcaaaggaagagcaaacttttctagaaggattgatgttaaacatggcacaaaatgttgatccacagccaaaaaaagttgttgagcaaggtcaggtggaccagattgctcaagataaagaaatcaacatcctgaatctgcatgtgacctcaaatatcaggttccatgtccttatggagatggaaatctccgtgaaagttactcctatcctaactcctcaagtagcagcttctgatgccacctttggcacaaaaagtatcaataggttcttagcttcacctcaacttcttggagatctaccccaaatagaacctatccaagctcccccacctgatatttctccagtttttgagtcaccttgccctatattagaagaacttgaacctacccaagaagatcaatcacatcatcctaaaattcctgagctttcaatggtaaccagtgaggaaaatcctgataactcccttgctaaattattttcagagatttattccttgaaatatctaagaaacaagaccagacatgatcagaaaaaggagttaagaaactctactactttgcatgcatctatccaacaaacagcagaaaaacatgatcaatttcttcattggttcaactacaaaatgcttccttctcttgctccataa

SEQ ID NO: 23362 - DNA, 996 bp, Glycine max
  Peptide Sequence Number=SeqID_140140
atggaggagaaagagaagaagatgacagtgggtgggaagagaaggaggagggacgagggtgtagggaaacttccaacagggggagaggcaaacagagggagggtgagagaccgagagaggatcccaaaacttactatgccgccaaaaggaaaggacaaattcaaaaaggctcagtttaagagatggggggacgtaagggagatcttcatccccaaccataggaataaaggaggaagaagatatggcttcgtaaggtatttaggggtcttagatgaaagaaaactagaaagacagcttgataacattatacttggggaactcaagctgtgtgtcaatgtcccaaagtgtgggaggggcaagatgaggctcgaggagcaaactgtcaaacacggcacaaagctggaagggcacaacactgaagtggtagataggagacacactggaacgcgttacaggaatccttccatgacctatgcgaaggactccaaagcgaaggagatcatgtcggaagaactccaacacggcacatctccattttattcgctacagaaatggaacccaatgatgaggcccggccatagactcatatgggtccaatgctggtgtgttcctcttgaagtctgggacatagggaactttcaaaaattggtggctgcagtcgaagacctcattgagatcgtcgaagaagggtcgagcgacgttggaatacgtgcccctcaccatcgaggtgccatagaatctatagaggagatcgactccgatgataatgacagtgacatatcgcgcgcagtgatggcgccaacccccaactttcggcacctgttgaaaggcttcgacggagaccggaatgccgacaacgacgaccactggtcccagccgttactcgatggtccgagccttatggattatccagtggataataaccaggacaactggctccacctacctagcatcgacatccgcgcgaggccagaaatgaagaaaggaaagaaatag

SEQ ID NO: 23363 - DNA, 342 bp, Glycine max
  Peptide Sequence Number=SeqID_140141
atggaggagttgattaacaaaacacaactctctcccaaaataatcccaatgtcatcacgtcggctcggtggctccacaaaagaatctcacttcctatactctactgttgtcattctgctcccacgaacaatggtttgcgatcatcacagtatgatgcatgcacctgaccttaactctcaaatgcaaatgtggtaccatcccctaggaaatagcctaagcgtgtccacacaacactctcacttaggaaaactaggcagtaagtatcgaggtcaccctgttgtgcacaggcatctcccccccccccatggtgatcagcctgagtctcaagggagttccaaatag

SEQ ID NO: 23364 - DNA, 925 bp, Glycine max
  Peptide Sequence Number=SeqID_140142
gtggtcaagtattgcaaagcacttaccaaagcgaactgataacgaaatcaagaactattggaactcatatctgagaaagcagtttgaaaagaatgccggggattcctcaagtccaaaaccaattagttctgacagttccccagaatcaaaatccaatgacatgtgcatggttccattagagaaaactgattgccatgaaccaaacaccaaccagtctcatcagcacaaattatcaaagtcaacctcatcttcaactcatctactcaacaaagttgctagtaaaattctggcatcagggtaccttgaagcaatcaaatcatgccaacctgttgttgctgggaacagcaaaagtgaaggcgtagttaaaagtggaattgggccacaaaaggacaatattagagacccccttgtgcctaatttgacctcaccaagtcattcagtaacttctgctaagttactgaacaagatggctacttcactccctcataaagtttatggccttgaagctgtaaaagctgtattctcaaaactgatggaaagcagtgaaaaaggtggcattgctactagtgatggtagtagctttgttggcagtgatcaagttggaagttgtttaaatgctttaagcccttttgaggatggaccacacatatcaaaaataattgactccccttctagtcctacactaatgttcaaccaagtgaccacaccctcatgcttttcagaagataatgaagataactggcaatgtgtttcatctaactatgtttccttcagaaattgtgctgcaagtggtggtggtggtgactgcagtgtctctgagatcaacttgggtgagtcttctagttccacatcatgcttcctgtttgagaatgctgacctgggaacatgtgatgatgagataaggaagtacattcagtatctgtag

SEQ ID NO: 23365 - DNA, 324 bp, Glycine max
  Peptide Sequence Number=SeqID_140143
atgacaacatcaacccctgctaacatagtcatcaatatcaacatcatctcatatcaatattatcataaacatcaacgtcacctcatattaaataatgtcatcaataacaatatcatcaatataccgcatcccattagtcaaaaacattgttttcatgaaaaccagcatgcaacagggacaaacatacatcccatagttaggttccctgaccccaactatggtatcaaaaatgggtttttcaaaggaagtgtaaaaaatccaatattggctcccaagtcagaagagatgcaaagagaggctcaaactaacaaggagcaggcttag

SEQ ID NO: 23366 - DNA, 471 bp, Glycine max
  Peptide Sequence Number=SeqID_140144
atgaagcagaaagaggaaacaactaaatcaacacaacgagcattccaaagtgcagaaatccaggttggtgagctggcagaaaaagtgactcaatttatggtcagaagtgaaaaagactttgtagaggttgaagctcaagaggaaaaccctgtaaaagagcatgagtcaagagaaaaagatgaagagaaagatgaggaacaagcacaacaacaatgggagaagtactcaacagtaaaaaaccaacaagaaagtattctccaaatcaataaccttcctcatcaactgattttcaagaaaggaaggcaaggaaagcatgaggaaaccttaagtgcaattctttctttaatcactaacacctctcctacaatgatttggaatgtacttccagaatacatgaagttcatggaatttctagctaaaaggcaagactacaaggaagatgtcttctatgtgactttcatgccaccttga

SEQ ID NO: 23367 - DNA, 261 bp, Glycine max
  Peptide Sequence Number=SeqID_140145
atgagtatgatacaagatcacgagaagcttgattcagatttaattgacacttgtgtggtaggcacgatcaaagaagatccatcaataaaagtttctttgattcaagaaaggataaatagtgaatttgcctataaggtttcgtacagaaaagcatggatggccaaacaaaaagcgattgcaattgaatatgacgatagggtcaacaaacatcttcgttttttgcctatagtagaccatgtagtcggagttaaagctcaataa

SEQ ID NO: 23368 - DNA, 1155 bp, Glycine max
  Peptide Sequence Number=SeqID_140146
atgtcagaatcagaggagcgagccacgctgacgtggcgcaaaatccccatcctcctcaaatcctcccccaacgacgtcgttctcgtcccccccaccagcccccgcaaaaacgacgccgtcaccggcttcttcgctccgaccagtggcacccgctgtaaattcgccagcgtctcggtggcagaaaggaaattcgacaaagaattcgcgcccacggcggcacagcttctgcagcaccccctcgccgtcgtcgcattggttcccaaagacgccgccctctttctcgccggcgcccttgccggcgccgccgcgaaatccttcactgcccccctcgaccgcatcaagctcctcatgcagactcacggcgtgcgagttggacacggaagcgcgaagaaggcgattggtttcattgaggccttaactgtaatagggaaggaagaaggcatcaaaggttattggaagggcaacctcccccaggtgattcgggttataccttacagtgctgtccagctttttgcttatgaaatttacaagaaaatattcaagggaaaggatggtgagctctctgttctgggaagacttgcagcaggtgcttttgctggcatgacatcaacttttataacttacccattagatgtcctgagattacgattagctgttgaacctggttatcgaacaatgtcagaggttgcgttgagcatgctaagagaggaaggatttgcatctttctactatggccttgggccttctctgattggaatagctccatatattgcagtgaacttttgtgtttttgatttattaaagaagtcattgccagagaaatatcaaaagagaactgaaacatctctagtcactgctgtggtttctgcatcacttgccacacttacatgctatcctctggatacagtgcgaagacagatgcaattgaggggtacaccttataagacagtattagatgccatttcaggtattgtggcacgggatggagttattggcttgtatcggggatttgtgcccaatgctttgaaaaacttaccaaacagcagcatcaggcttactacatatgacattgtcaaacgcctaattgcagctagtgagaaagagtttcaaacaattactgaggaaaaccgcaacaaacaaaagaaaccccaatag

SEQ ID NO: 23369 - DNA, 459 bp, Glycine max
  Peptide Sequence Number=SeqID_140147
atgccatttctggagttctgcttctggataaagattccatgccctcttgagtggggtgctcctacatttgatgctggccatgcttttggaatggtggttactgcatacaaagctgcatcacgtctaacaagtaccacaccacctcctgctcacgtgctaagccgtggtattggttggcaaggaattggaatcttactgaatagcctttttggaacactcactggttctacagtttctgttgctgaaagtcacaatgtgcagcgcacagaaaaactaacttccatcaaccagcagccgcattgtgctcagacggtttccaacattatatatttggattcccctgctagtgttgggctctcttactccgagaacacaagcaaatatgccactggggatcccctattcctatctctctcagctttgtcattttactcatttatggatataccaagattctaa

SEQ ID NO: 23370 - DNA, 546 bp, Glycine max
  Peptide Sequence Number=SeqID_140148
atgtctagggtttctgcgaattcttctccttcacgcttagtctccatggcttccatcgtcagagcctacacgctccctattcttctcttcgccggagccatgttctaccagctcttccttattcccaatgcctttcctccttctcattacgatgttctgcaaattgagagctatagttcagtcgagaaagtgaaggaggcctacgacaaacttgaatctaaatggaattctgctgtggaagtttttgatattcatgagtttttaaagattcgatatgcttatgagttgctgacaaatcctttatggaaaagagactatgacatatttggtattgatgaacaacttcatattgttgagagtgccagcaagcgttatgcagggaaacatatttcagaattggatttccctttactacaggccccctctggatctatagatcattcttctaaagtcattacagctagtgacttccagtatatatttccagatgcaaagccatggctaattcaggaatatgtacagatatatactagtgagggatactaa

SEQ ID NO: 23371 - DNA, 246 bp, Glycine max
  Peptide Sequence Number=SeqID_140149
atggggaatgtggggattgcaaatattgcaagtggttggggattggctgtgctagtagggattcatctatcaccaaaaatgcttcccatccacccaatggagttgttccatggtcgcagaatagtaggatcaaattttggaggcatcaaagggaagagtcaattgccacattttgcaaaagaatgcatgaatggagtaacgactaccattccctctgagtttgcatttgttcttttcaaaaaatga

SEQ ID NO: 23372 - DNA, 303 bp, Glycine max
  Peptide Sequence Number=SeqID_140150
atgcaaaccaaaacacaacaatacaatgcagaaacatgtggagaaggattcactaacctagaaggtgatcaagaagaccaaaggaacaacagccacgaagaagacaaaagcaccatagcagcaaccaaggaccacgacgaaccagccaaccacccatggagaaaacaggaagaagaagcactgtcgaacaaaagaggaagaacaagcattgccaccagagaacagaggaagaagaagcatcagagaaaagaggaagaagaagtacttcctaagaagaagaaacggcacaggagaggagaatga

SEQ ID NO: 23373 - DNA, 369 bp, Glycine max
  Peptide Sequence Number=SeqID_140151
atggcaggccgagtggttgttgctaatgggaacttgaatccaaataataccaggggaaagaccattacttgcaaagctgccgtggcatatggtcctggagaaccctttgtggtggaacgtgttcttgtccatcctcctcagaaaatggaggttcgaatcaagatcctcttcaccacaatctgccacaccgatctcactgcttggcaaggccaggggcaccaaagagtgaggtttgacgcgcttatcctcggattttcggccatgaagcttccgggtaggacacaaaagttaatattgacactaactatgacagattataacattaatgatttagagcctctttacataaggagaattgaaaacctttga

SEQ ID NO: 23374 - DNA, 411 bp, Glycine max
  Peptide Sequence Number=SeqID_140152
atgtaccctggtgctagaaggctcctagctatgctatatttgaaggtatttgaaacactaccgaaatttcaggtgccaaattttcttggtaaaactagccttcataaggtaaaagtaatctttttctcaaattctggtgagcgtgctgctccatttatacgacaagcagctaaagactattgggcttctgcttcatttgctttcattctctggcgagaagaggaatcttcctattggtggggagcatttggggtggaatctgcacctgctattgtatttcttaaagacccaggtgtcaaacctgttgttcaccatggttcagtcaacaattcattttttttgaatttgatggaaaataataaacagcaagaatgtaggaaggccgagtctggagttgaacaaaatgcgtga

SEQ ID NO: 23375 - DNA, 1347 bp, Glycine max
  Peptide Sequence Number=SeqID_140153
atgacgcacttgaaattgaaatggttcagcattttgcttcgaaggagtgtgaacaagttggttcatcgccccatgtccacgtggcatcacaaagctgagacccccattagcctgaaaccaccaaaacccaaccaaacccttaagaaccaccttgaatgtaacaggcacgccaaggtgcttctactcttcagatccttcttaagaaaaaaacccactctcaacctcattgacagtttttctctgctgtatgccctcaaagcctgcaaccacaaacacccctccacccaaggaaaacaacttcataccctcattataaaacttgggtaccagcccatagttcaactccagacaacccttttgaaaacgtacgcgcaacgcagcaacctgcgtgatgcacaccaagtgttcgacgaaatacctgctaagaatattatatgctggacatccttgatttctgcctatgtagacaaccacaagcctgggagagctttgcaacttttcagagagatgcagatgaacaatgtggaacctgatcaggtcactgtgactgttgctctctctgcctgtgctgagaccggggcactcaaaatgggtgaatggatccatggttttgtgcggcggaaacaagtgatgaacagagatttgtgtttggataatgctcttataaacatgtatgctaaatgtggggatgttgtgagagccaggaaggtgtttgatggcatgagaaacaaggatgtcacaacttggacttccatgattgtggggcatgcggtacatgggcaagcacgcgaggctcttcaacttttcttggaaatgagcgcaaggagggacaaggatgattgtgtcatgaccccaaatgatgtaacgttcatcggagttttaatggcttgcagccatgcagggttggttgaggaagggaagttgcattttagaagtatgagtgaagtttatggtattcagcccagagaggctcactttggctgcatggtggatctcttatgcagaggagggcatctgagagatgcctatgacttcattatcgagatgctggtgccaccaaatgcggttgtctggcgaaccttgttgggggcttgcagtgttcatggtgaattagaactagctgcagaagtgaggcaaaagctactcaagctggaccctggctatgtgggtgacagtgttgctatgtctaatatttatgcaaataaaggcatgtggaataacaagatagttgttaggaatcagataaaacattcaagggctcctggctgtagctcaattgaagtgggaagtggggctggtgaatttgttacctcagatgatgatcatcctttaatgacagatgtgtga

SEQ ID NO: 23376 - DNA, 579 bp, Glycine max
  Peptide Sequence Number=SeqID_140154
atgggtagagccatgaggtggttgaagggcccctacaacactgcctgtgttcgatgggcccctacagcactgattaataggctaactgccattcaaaggcaatttctttggggtggtagctttgaagggaagaagatagcttcggtagcttggagacagatgtctgcctctagagatttgggagccaaagcatctgaagttgtagccttagggaagctaaaaactcttactgagagtaccatcagagaaagagctttaacagcacagcatagttccatgatcactatctcaaaatttgagtatgagtatctaacaaatcatgcagcctcagtagaagaaattgctgataaaaaagtagcagcagctgaggcatggattgaagctctcaaggccagcgagaaggaaataatgatggaaacaaaaatagctcaaagacaactcaaagaatcaaaattggagcaagagctggaggtttacaccaaagagaagatgctttcaagaagagttagtagtagtgaggagcttgacaattggccaagaaaatgcgagaagagttcatccaagaacttcatagtttaa

SEQ ID NO: 23377 - DNA, 207 bp, Glycine max
  Peptide Sequence Number=SeqID_140155
atggcgagaaggaggctacaggtagatagaggtgttttcgttgtgggatggttcaaatcgttgcgagaatcgttagagggagacatgccgtcacaggtgggaggtgctgtcgtcacaaggaaggaggtgttagggtggttgaaaggtgtaggatacaagtatggagatataggatccaacttcccttttcatgtattgatagcctaa

SEQ ID NO: 23378 - DNA, 228 bp, Glycine max
  Peptide Sequence Number=SeqID_140156
atggagaagaagagaagaactaggaagcaatgtgcactacaggaagaaaagaagaacaagtggaagggtgcacaactgctgcgggagaaagaagatgaagaaggggaagaagatattgaaggggttgaaagttttgttaattggcccaatgcttcttttgcccaaggcaatacggagcattgctatgtacatccagcaaaattgctagtaaacccaacaattttgtga

SEQ ID NO: 23379 - DNA, 1662 bp, Glycine max
  Peptide Sequence Number=SeqID_140157
atgaagaggcactggcgtaacaggagccacgacgacgatggcctcccagattcggattccgacacgcgctccagccggagattccctctcacgcgcctcatggcactctttttcttctccatcttcctcttctccctcaccttccttctcccacaccctcccatccaatcagcttccacagcaaagactctgctccaactcaaacaaactcaacaaggtgacgtttctgattctgttgagttgcaaaaagataaactacttggtggccttttagcagatggatttgatgaacaatcttgtctcagcaggtatcattcggccacatatagcaaaggactatcgggaaatccttcatcttacctcatttctagattgagaaaatatgaagctctccacaaaaaatgtggaccttacactgaatcctataacaaaacggtgaaagatctcaggtcaggacatgtaagtgagtccccagaatgtaaatatgtggtatggatttcatatagtgggttagggaataggatattgaccttagcttctgtgtttctatacgctctcctcacggatcgtgttctattggttgatcctggagttgacatgggggatcttttttgcgaaccgtttccacatgtttcctggcttctccctcctaatttccctctcaacagtcaatttcccaattttggtcagaaatctgatcagtgttatgggcaaatgctaaaaaataaatcaaccacaaactccatggtaccctcttttgtctaccttcatctagcacatgactatgatgatcaggacaaacttttcttctgtgatgaagaccaagcttttcttcagaaagttccatggttagtggtaaggacagataactattttgtcccatctctattcttgatgccatcttttgagaagcaactaagtgatctcttcccaaacaaggaaacagtttttcatttcttgggtagatatctgttccaccccaccaacaaagtatggggacttgttagcagatattatcaagcttatttagctaaggttgatgaaagagtaggcatccagataagagtttttgacactggaactggtccatttcaacatgtgttggatcagatcttagcttgctctttgaaggagaatcttttgcctgatgttaaccgaaagggggatattgtcaattcattggcaaagccgaagtcaaaagctgtgctgatgacttccttgagctctggttattttgacatggtgagagacatgtttttggaacatcctactgtgacaggagaagttgttggcatttaccagccaagccatgaagggcatcaacaaacagagaagaagatgcacaaccaaaaagcttgggccgaaatgtacctcttgagcttgaccgacatgttggtcacgagctcatggtctactttcggctacgtagctcaggggcttggagggttgaaaccgtggatactgtacaagcccgagaatggaacagctcctgatcctccttgtcaacgtgccatgtcgatggagccgtgcttccatgctcctcccttctatgattgcaaagctaagagaggaactgatactggtgcacttgttccacatgtaaggcactgtgaggatatgagctggggtcttaagcttgtagacagtaatagttggcaataa

SEQ ID NO: 23380 - DNA, 992 bp, Glycine max
  Peptide Sequence Number=SeqID_140158
atgtcgcgcgggttttgtcccactgtcatcacctacggcattttgatgaactgttgctgcgcccagggtgattttagcaatgcacgcagggtgtccaatgaaattcttgagagagggattgaacccaatgttgtgatttacactattttgattcgtgtgttttgcaacgagggtcaaatgggagaagcagaggacgtgtttggacggatgagggaatctggggtgcgtggcttgcaccctgatgttgtcacttttgctactttgatagatgttctacgcaaaatgggggatttgaaggctgcgcgaaactgttttggttatatggcagagtttgatgttgttcctaatgcccatgcttataattctttgattgatgggtattgtaaggcagggaacttgcccgaagcaatgcaattgcgggtggaaatggaaaggtgtggaatcttccctgatgttgtcacatacaatatactcatcaagggtctgtgtggctcgggtagattggaagaagctacgagtttgatagagaaaatggatgaagttgcggttcttgccaattctgcgacgtacaatgtggtgattgatggattctataaaacaggtgacatggagaaggctattgaggcatgctcccaaacgactgaaaggaaaattgaacctaatgttatcacgttttcgacattgattgatgggttttgccagaaaggtaacgtaaaagctgcaatgggcttgtacacagaaatggtaatcaagggtattgtgcctgatgtggtaacttacacggctttgattgatggacactgcaaggttgggaaaaccaaagaggctttcaggttgcacaaggagatgctggatgcaggactaacgcccaatgtgttcacagttagttgtgtaattgatggccttttgaaagatggaaagacgaatgatgcaatcaaactgttcttggagaaaactggagctggttgccctggtggtaaaatcgatagcag

SEQ ID NO: 23381 - DNA, 219 bp, Glycine max
  Peptide Sequence Number=SeqID_140159
atgaacaagcttatgtttcaagatagcatgacatcacaattgcaattctcaccagcaaaatcatcagcacaacaaagcatacaaaaatatgaaggaaatgtatcttcatcacctcgtacctcgatcaagttgtacctcagtatatgcaaaattacgtctagcaagtccagcaaagcgactgatgacgtagcaaacaaacctcgtacctcgatcagctaa

SEQ ID NO: 23382 - DNA, 720 bp, Glycine max
  Peptide Sequence Number=SeqID_140160
ctgccgtggcatatggtcctggagagccctttgtggtggaacgtgttcttgttcatcctcctcagaaaatggaggttcgaatcaagatcctcttcaccacaatctgccacaccgatctcagttcttggcaaggcaagaacgaggctcaacgtgcttatcctcgaattttcggccatgaagcttgcgggattgcggagagtgtgggagaaggtgtaaatgacatgaaagaaggggacttggtggtgccaattttcaatggggaatgtggggattgcaaatattgcaagtgcgagaagaccaacatgtgtgagagatttggggtggatcctatgaagaaggtgatggctagtgatggtgccacaaggttttctacaacagatggaaaacccatcttccatttcttgaacacttcaactttcacagagtacacggtggtggattcagcatgcgttgtcaagattgacgttgatggccatggtgttggggctgcttggaatatcgctgatgagcattttggttcaactgtagctgtctttggtttagaaccccctacactgttcttggaagtctggctcgaagaaaacccaacatacactgttgctactagggtgctgaaacactcgtgggtgttcaaagctcaaagctttctccgcgaggaaagcttaaagtttcgtgccattttgttagatctcactgccattatcactgtttgggttcgag

SEQ ID NO: 23383 - DNA, 1938 bp, Glycine max
  Peptide Sequence Number=SeqID_140161
atggagtactaccaaattgtgccaaaatcccctaaacataatcctttaagtgctgaggtggtttggttttccttttgggtctgtcaccatgctcttgctgagtttagcttgtttggtttaaaggccttgcaattaatttatgacatgcttcctgagattttatatatttataaacctcttgattttctctgcttcacagttaccttggtaaagtcggcaagacaggtaattgatgcactgaatgcagaagggcaacatatagatatcatactggctgaacttgaccttccgatgaagaagggtatgaagatgttgaagtacatagcacgtgataaagagtttcgcagaatccctgttataatgatgtccgcacaagatgaggtatccattgttgttaagtgcttgagacttggagcagcagactatctagagatgcttaagattttgcaagaaccacattgcataccatttatcaggctacctcatctgtgcaacagtttagtggcaatgccgaacactgttagttacccacagtttatgtctgctactgtcacagagacattatttatacttggacttgtagagaagaacatcttgaattacgattttgatctggtagtatctgaccctagtgatgccaacacaaacagtaccaccttgttctctgatgacacagatgacaagtccaagagaagcactaatccagaggcaggaatatcagtccaacaagaacaagaggtgggtttttttattcaacttggggcgtactttgcaaataattctacctttcagagtataaactttgacatcgacattgtcattgggttacatgtggagtatgaagaaaagtggtggtgtgtctcctcctcacagatccaaaggggttctactattgcaaatgctgctgctgttgagggacctccagatgctcatgcatcagaatgtgggcctgatgtggatggagttaatgatcaccaaacagcacatttttcatctggtccgaagaagagtgaactaaggataggggagtcatcagccttcttcacgtatgttaaagcatcaatacttaagagcaacttcgaaggggttgttaatgtagacaacaatggtgctacgcatgttgggatggaagttatgcatcaagcatgtgctcaacaaggggtgaatagccttcaaatactggaaaatggagaggcatgtgaaagtcaatcgcaagatgacttacccagcagcactagtattcctgattctttgtctattgagaggtcttgtactccacctgcatcaatggaagtttcacagcaaaagcactacagggaagaaaattcacaacagggtgtgatgcatcccagaaatgggacccattgttccgagcatgaagtatctggcatggcttcccaacatgcttatccatattatatttcaggggttgttaatcatgttatgatgccttcatcagcacaaatgtatcatcaaaagaatatccaggacctacagaatcatactagcacagctatgatttcacaatacaatcatcttccccaaggcggtcctcatggaacggggatgacatccttcccatactacccaatgagcatatgcttacaacctggtcagattcctaatcctcattcatggcaatcatttggaaactcaagtccatcagaagccaaattaattaaagttgataggagagaagcagcattgatgaaattcagacagaaaaggaaagagcgctgctttgataagaaaattaggtacattaacaggaaacgacttgctgaaaggcggcctcgtgtaaggggacagtttgtcagaaagttgaacggtgctaatgtggatcttaacggggagcctgcatcaattgactatgacgaagatgacgaagaggatgaagatgaccagggagcaagagattcttctcctgaggatgcttga

SEQ ID NO: 23384 - DNA, 303 bp, Glycine max
  Peptide Sequence Number=SeqID_140162
atggatcagccccgcgcatgtgataattgtggcttactttacttttcaactcggcctccatcccaacctttgtcgattaggtctccatcttcgccattgccgccttctcaaccttcgcctatctacctcaatcgtcctcttccaccagacacacatattcgtcctcctctaccagagacacatatcgaccttaatcatcctcctcctccagagaaatccgtgacctccgccttctcgacttatcgtcctcctccaccaaagacacatatcgaccttaatcatcctcctccaccaaataaatga

SEQ ID NO: 23385 - DNA, 693 bp, Glycine max
  Peptide Sequence Number=SeqID_140163
atgaagatgagaccaaaagaaatcaatattgcttatagctcaaattgtgaaaattgcaagcatcttcaatgcaaaattgagtatcttgaaaagacacttgcaaagttcacaaaccataatgccctagagcacctttctgaggaaaagaaggatgaggaagaagcccatttcgagcctcaaaatgaggtactgatagctgatgcaggagatcagactactcaaaatgtagaaggagaaggactactgactccaatttggaaaaaggcagcgcataaagctggagagaagacctatatgcgatcttcgaaggatcttttatttaacacaaaacatgcaaaatctcttcaactctccagttttgacatttctatcaaagttgcatttggtcttggaccaattcttggtgaatcttttaccttttctattccatttcctccacttcctactgaacttatcaactcagaacctcccaaggtttctaaaaatattccctatgctcatatccctattcctccacctttatttgcaagttttcctaagtctgtggaaaataggctcacttctttggagaagcaagttaggaaatttcgttttgatcaaaagtcgcccttctccaataaaatgatttcattgagagatttcttaggcttgagtaatggatttctcaaaagaaagactttccttgattcctga

SEQ ID NO: 23386 - DNA, 129 bp, Glycine max
  Peptide Sequence Number=SeqID_140164
atggtgtcatcaccatcaccacatagctcatggtgccttaactgccttatgtatgtgatgatatttgaggataatctcaagtgccccaaatgcaaaagcactgctttaattcattttacctcaccataa

SEQ ID NO: 23387 - DNA, 222 bp, Glycine max
  Peptide Sequence Number=SeqID_140165
atggtcggcaccaagaaaactagacaaataacatttgaggcagcaaaggaaattgctgacaaaattataagattctttagaggagtaggcttcacggggttcctttgtcgcccatggacgttaggatccagtgtcacaatcaagcaatactttggatcggctccaaggacctcccacacgtctttgtccatggctcctgaagacttggagcagctgacgtaa

SEQ ID NO: 23388 - DNA, 615 bp, Glycine max
  Peptide Sequence Number=SeqID_140166
atgaccggaaagtacctccaattgcagaagaacgacatgcaaggtcaaagtgccccaccacaagcggctccaacccaggcccaagcctccttcatgaagcaaagcagcaccctaagcaagagcaagtggcctccaagcccccccaacgccaccacagaaaccgtggaggttcaccacgtgtcccaaaccgaatacgtggacgaggaagacgaagagccatgccaacccgaacccgtcaccatcatcgacggccaagatcagagtgtgagcgtcaaggacagaatcaaccgcgcacgcgccaggctcaggcgcttagactcacaacaacaacaaagtcctcgtactcctcgaaccttgccgtcgccgcatcgacaacagatagataagtacttattgaatcttgagggttcggtatataaagctgagacatgtggtgagagggttgttattgtgggtgggggaggagaatctgttgtagaagtggcggaagaagcggttgcggatggacacgtactggtggtggctcgcggcgggggagttgcaagcagcggcggagaaaggaagcacgtctttgagggaagtgtaagaaggagttttcaagaagagtgggtctaa

SEQ ID NO: 23389 - DNA, 327 bp, Glycine max
  Peptide Sequence Number=SeqID_140167
atggcgtaccaagctccaacaccaagcaagcgcaacattgccactattgccttccacttcctcgacttccttactggattcccgactttgctgttgttgctgccttttttcactgttgctgtgagggaaactgccagcacgagggaggaagaaagaaagtttgagctagaagacaagggacttgaagggtgcagatttgggaaagaatggagagaaagtgatgaaaagcgtgaagctgcccttgtcggtgctggggacaactttgcggaggctaaaggtggtggcagtgccagtgataaaagaaaagagatcccaatagaggtgtga

SEQ ID NO: 23390 - DNA, 237 bp, Glycine max
  Peptide Sequence Number=SeqID_140168
atggcgtcacagaggggggtagtggagcctcactgctttgaggagtcacattttcgatgttgtgaacgaccaaagaagatcctaagtccattgatgtgtcttatgcctagatctgagagatctaaagtgaggttaggtggtccaaatcctatttgggtcatcaaagtggatggtgttatgaaggtggtgatgtgtgtcatagagagaagggaggatatgggtctggtgaatggttaa

SEQ ID NO: 23391 - DNA, 333 bp, Glycine max
  Peptide Sequence Number=SeqID_140169
atgaatgacggaaatggaaccacttcaacaatggtgttaccaccttcaccacatagctcatgtgcgtccactgagcccaaccaagaggacaacaacaacgacgacgacaacgacaacaacaacctcaacaacaacgacgacgaaaacaacaacaacaacaacaacaacaacaacaacaacaacaacaacaacaacaacaacaataacgagaacaacaataacaacaaccctgaagctccttccttggtgctagtaaggtgccctcactgccttatgtatctgatgatctctgaggataacctcaagtgcccaaaattcaaaagcactaattag

SEQ ID NO: 23392 - DNA, 357 bp, Glycine max
  Peptide Sequence Number=SeqID_140170
atgtgcgacgttgccgctattgccttccacttcctcgacctccttattggattcccgactttgctgtcgttgctgccttttttcatccttgatgtgagggaaactaccagcacgagggaggaagaaagaaagtgtgagctagaagaggagtcacttgaagggtgcggatttggggaagaatggagagaaagtgatgaaaagcgcaaagtcgcccttgtcggcgctggggaaaactttgcagaggatgaaggtgatggtagtgccactgataaaagaaaagagatcccaatagagaaattcaaggtgaaaagtggagcacatgtagcactactcataaaaattgttttaaaaagataa

SEQ ID NO: 23393 - DNA, 213 bp, Glycine max
  Peptide Sequence Number=SeqID_140171
atgctgacatcttcgaaaagggtgcagatgaccacattggcctctgcttgtcaatcggacttggggtctccgaatgacgaggtgcggataaccgaaaggtgtctccgcatgctaccagactcttgggtcatgagagcaaaaggtggggtggtcgacaaaagagagccttttgctcctacgtatcctccatttgtgatgaagaactcagactaa

SEQ ID NO: 23394 - DNA, 119 bp, Glycine max
  Peptide Sequence Number=SeqID_140172
atgtcatcacgtcggcttggtggctcctcaacagaatctcatcccggcaccctactactcccacgaacaaaggttcgcaatcatcacaagtatcaaccacatgatactaaattgcaagg

SEQ ID NO: 23395 - DNA, 639 bp, Glycine max
  Peptide Sequence Number=SeqID_140173
atgaccgggattaagggagccccttacagagcacgtattgatgccctaacagtgaccgacgtctgttggatgccatatgctgagcatcggggagttcggggctatgacttgatctcctcgtacacggggcaagtcagatggggtccgatcatcgtctaccttcgaccagagagggtggttcggcaaatggggtacattcagatcgttcctccgccaccggttcgtgatttgttgacagatcatgtggcgcctacaggagagctctgtgtagttcctgggcaggtggccccagactacatggagtggttttttcagatttcgcactcctttgtgacgccaacggaggacactgctgagccgagacctgtgcctccccctcccactcatgatgatgacttcgtcgagccacctgtcgccgaggttccagttgcgtcagatccccctatgcattctgtggttgattgcacagcatgtgtcaggatgggaaggattgctgagcatttggagcgcgtcatcaacctcaagatggtgactgcagggactgacttatatgatatcattgatctttgcctgaggatagctagagatgacgacctagatgacagtcttaggccacgacagagaccccgcatagattag

SEQ ID NO: 23396 - DNA, 402 bp, Glycine max
  Peptide Sequence Number=SeqID_140174
atgtgttttcaggagaagattgagaggggtgcaacgggaagcggttttaacgagcggtgctaccgggcggtgagccacggcggggttcagaggtggggcccgcggaggacaacggtgtatagtggagctgtcatatgggattttcggtgggcatcggtgagtgtgggactggcacacactaatcatgggccttttttgtcgtgtagctggaacgtgggctggagtgttaacaagttcattgtattccaccctgacaaaaaagaagggaagagtgaagaatcacagggcccaatgttgattttcgcatctctgaaaggttttttctggacacaaggagaaaaaaatctattgaattatttagaaaaatatctgatgggttttcacagacatggaatgagatag

SEQ ID NO: 23397 - DNA, 231 bp, Glycine max
  Peptide Sequence Number=SeqID_140175
atgtacatcaagtatggcccaaaatacatcatgaagcatagccagcaaaacatgttatccaatgaaacaaaaccccccacacttattcccaaaacaattccaaagctccaaaattccttaaggcttgtaatgagcttcaaactaaagaaagggaaacataggctcaaagggctatcaaaggaattaattcaaggaagcatcaacaagaatcaagccaaggctattgtgtaa

SEQ ID NO: 23398 - DNA, 275 bp, Glycine max
  Peptide Sequence Number=SeqID_140176
tgaaggttggtgttgagaaggataaagatgcagaggctgtcgttcctgtacccattgacgaggttattttagtggggcagacacttaacaccttccttgcttggccgacacatctcgtgaagtgtttatcagaacagctgtgtctccagcaaaagctccagataggccggatcatgaggtcgatgatccctatatttgatgacattgaccatcccacagctctttttgaagcatttccaggttatgtgggatcctaccgtgttcgaggtgtttaa

SEQ ID NO: 23399 - DNA, 267 bp, Glycine max
  Peptide Sequence Number=SeqID_140177
atgtcagtgaaaaacctcatcgggcgcctaggagtacatgacaagacaaaccacacactagatcgacatagagttaaaggagcactcatatcgggtgtatttacccccaaggcctacacttcgaagagtccgtcagggcctctccctcatgattcaggtccaacccataaagcattctatcacacagactctctctatgaattgtacaaaacacacgactcatcaattgttctcaaaataattttatcttgttgtgcttgtgattaa

SEQ ID NO: 23400 - DNA, 567 bp, Glycine max
  Peptide Sequence Number=SeqID_140178
atgaggattgatcctcaagagtttgcttcccgtctctgcatccctggtaggggttttgttctgaatgcagggggccatccttggaagcttctgaggaaagatctcaccactcttgcacagacatggagtgtcctctcctacaacaacctgactcccacttctcacacctctgatcttaatatggacagagacaggttggtttacggcttagtcacaggcatggacgtgaatatcagagccctaatctcaggtcagatttctaccattgccaagagtaactcttttaggctcggatttccagccttgatcactgccttatacagagctcgaggagttacctctgacagtctgacctatgagagcctgagcccgaccattaacttggcctacattaagaaaaattgttggaatgtggatgatctgacagttaacttcagaggggacaggaaggtaagggctcgagcagcagatgttccttcttcttcggcaccaccagctcctcccacttctaccacgcctacaccagctgcccatgactctcagtgctttgaagctgtcataccctaa

SEQ ID NO: 23401 - DNA, 252 bp, Glycine max
  Peptide Sequence Number=SeqID_140179
atgttgggattcacaagcgattctcctcaaatttcagccaacccgcatcaattagactttgcacctcacgcttcgaggtcatacagtgctcaatggaatgccccagggcttctcgatgacaagcacacgttgcgttcgagtcgtatcctcggaaaaatggaggttaaggaaccttggttggagttatggctaccattgatttatcgagtagatatgggagcaagccatcataggacactagaattagggtga

SEQ ID NO: 23402 - DNA, 507 bp, Glycine max
  Peptide Sequence Number=SeqID_140180
atgggtcagctccagcgacaagccttttgcaaagcttacggtaagatctgggacctagccatggcagagttatcacccacggtggaagagtttgaagagatcctgggatgccctctaggagaaaggaaaccatacctcttttcaggattctatccctctttagctagaatttctaagatagtccaaatctcgatgcaggaattagaccacagaaagcaagtcgaaaatggggtggttggagtaccgaggaaatgtttggaagcaaaagcaagagtcttggcaggtaaaggtgaatgggccccgttcacagacatcctcgtgcttttgatcttcggagggcgactgacgcttttctcgcatttcaaccgcaaggaaagcccggttatcgctatcctagccgatctatatgacaccttcgaccgaagatgtgaaaagagcagtacaaggattgtttgctgtactctggccctctacgtatggttggtttcgcaccttttccaccaagag

SEQ ID NO: 23403 - DNA, 189 bp, Glycine max
  Peptide Sequence Number=SeqID_140181
atgccaatctctccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccgacaaggtcacgtcatcataggtaa

SEQ ID NO: 23404 - DNA, 455 bp, Glycine max
  Peptide Sequence Number=SeqID_140182
atgggatcaagtcaaacgccttcgcttaaaaagaggttctatcaagtcaaggtcaagagcatagggatcaccagtctaaaagagttagggcagttgatgggtcagctccagcggcaagctttttgcaaagcttacggtaaaatctgggacctagccatggtagaagtctccacagaggccattgcctccctcgcccagtattatgatcagccattgaggagaccatacctcttctcagggttttatccctcattagctagaatttctaagatagtccaaatctcggcgcaggaattagaccacaaaaagcaagtcaaaaatggggtggttggaataccgagaaaatatttggaggcaaaagcaagaatcttggcaagtaaaggcgaatgggccctgttcataggcattctcgcactgttgatcttcggaggagtcctctttccaaatgtggatgg

SEQ ID NO: 23405 - DNA, 258 bp, Glycine max
  Peptide Sequence Number=SeqID_140183
atgtggatcaaaaggtcttttaaggttgtaatggggccaaggacaaggcttgtagtgagcttcaaaacaaggaaagggaaacaaggctcaaaaggactatcaaaggaattaattcaaggtaagtccatttggctagaagcttataagaacaaaattgcctcaatcatttccaaatatgcatgtgaattgggacgcatcaacaagaatcaagccaaggctattgtgcaagcaatcaatggggcaaaacacaccaaatga

SEQ ID NO: 23406 - DNA, 292 bp, Glycine max
  Peptide Sequence Number=SeqID_140184
ccagcacccacactagagttgaagcccttaccaactaccctcaaatatgcttacttggaggacaaggaaaaatttctagtaatcatctttgcctcctttgttgctgagcaagaggagaagttgttgctagtgctcaagaagcacaagaaagctattggaaggactttagcagacattcctggtattagcccatctacctgcatgcatagaatacttttagaggatgcagctaagccagtgagggatcttctcaaggaagcttctcaaggaggtgagcttagttatgagaagg

SEQ ID NO: 23407 - DNA, 318 bp, Glycine max
  Peptide Sequence Number=SeqID_140185
atgagtcttcattcttcatctagtgttaatggtgagggttctactcctaaggaccccttgtataagatattagatgagttgagatcccttaagttgtggaaagaaaaacaagagagaaaagaaaaagagagaaaagttccattggctacctttagcttccaagggtatgccctatattggtggacttccctcgttagggaaagaaggattcatggggatcctctagagagtattggaatggtcttaagagtgaccttacgaaggtgcacattctttgataagccgaaagggagcttaagagaagctccaaaggcttag

SEQ ID NO: 23408 - DNA, 186 bp, Glycine max
  Peptide Sequence Number=SeqID_140186
atgtggaccaccgtgggtacttacccgttgaagatcgaagaacgaatgaagaacgtcgaagaacggttgaaacctttgcgaatttcttcacggaaaacgttacggaaacgtttcggaagcgcctcggcttacccgttgaagatcgaggagagcattatcaggacagttgttgtttctattctataa

SEQ ID NO: 23409 - DNA, 270 bp, Glycine max
  Peptide Sequence Number=SeqID_140187
atggagacactcaaaattgaacaatgcaaatcacatattgagacgctcgaaattgaacaacgaaagctttcgaaaaattcaaatggtcataagttatcacacggaggtccgattcaggaacatcacatatcgacacgctcgaaattgaacaacggaagcgctcgtgaaattgaaattgtcataacttttcactcagatgtccgattcaggcacatcagatatcgacacgctcgaaattacaatacggaagctctcgacaatttcatatag

SEQ ID NO: 23410 - DNA, 171 bp, Glycine max
  Peptide Sequence Number=SeqID_140188
atgtcacgaaacttcacggattgtgctacaatgctttcttttgacttctggcatgtctcggaacttcacaaattgcctaacgatgggtgccaagtacctcgaggggtcaaacaagggttgcatcccaacaacggatggtccccggatgaaattaggataaaagggaagtaa

SEQ ID NO: 23411 - DNA, 1093 bp, Glycine max
  Peptide Sequence Number=SeqID_140189
atggcggaaggcgatcagcagtttcctcaacgcgacagcttgccgccccgcgccgcctatcgaatttggaacatgcacccttcagaaccggtgcagcaaggtcatttgccaccgtggcgcacacgctgtttcatcaaccggctgcgcggcgacgaaacgcatttcgaagaaatcgcgatgcgccacaccaccgtctggttcttcccccatcgggaacagatgctgctgatttatcagggcagtacacgcatcaatgaagacgatgccgccgacgtaatgcagctgatgccggctttggaaatcgaaggcgagccccgctccaccgcgcattatcggcaggtgttgacccagcggctggataaggaacggggggctctgcacgcgtttcgtgagcaagagttgttgccggaagcgtgcatcggcgcctggctggatacggaaacgccgacgcagcaaagcccgatggcggaaaatatcgccgcctacgagcaccggcagcgcgaagagcaccgccagcgcctgctgcgtgaaggccaggacatcgatgaactgttcccgctgccgtcgcaagacgcgccgccgaagctggacgagcttgccgaattcgtcgagcgtctggaaagccaggccgaggcgcagtatcaggacatgctcaagctggcgcaagccgagggtatcgatccgcgcaatcccggtggggatcacgtgccgccatccggtgcggaaagctaccagcagcagcgcgatctgctgttccaggaggcgcgccggcatcccgacgcgttcagcgaaaaacagctgggggaaagcgagcgagcgctgcaccaaatgtatttaatgtcggcacaggcgcaaagccctgcgctgcgtttaagcggcgatctggcgcaaatcattcgccaacgcgtcaccgccgccatgctgcgcgataaggatctcagcggtcttgatctcaccggcgccgatctgtccggcatggatctctgccaggctaacttgcgcggcgctttgctggaaaacgccaatctgcgccaaacccgactggtgggctgcgaccttcgcgaggcgatgctggcgcgcgccgatctcagcg

SEQ ID NO: 23412 - DNA, 273 bp, Glycine max
  Peptide Sequence Number=SeqID_140190
atggcaagttcaacatgctttcaacaaatttcttcacaaataactatcacgaagcagaaacctagcaagactacccatcatatctcccaaaaccccatatccacgaaattcaagagggaaagaaagatgcgcttcacgactccgaaaatgccctcctttcgcgatttggagcagaaatgggcaccaaaggttgaagctttgtttggagcttcaatggagaatgaaggagaagagaatggcaacgtgagagagagagaggaaaaaggcttctga

SEQ ID NO: 23413 - DNA, 319 bp, Glycine max
  Peptide Sequence Number=SeqID_140191
tgcacattggcaaatggtcgtcattttgcctaaggaaaatgttgtcatttggttttgttcgttgcataataagccagacaactacctcaaaggcataattaataggtcagtgttgtttttcaatacatttgcattagcattagtcggcactgagtgtgggtattacgtcatgcactggatgtcaactataatcttaggaaatttccagaataattgggaaatgtatttcactgatcctagaccattggaaccagaaagattgaaggcgcttcgcaaccagtgggcaaagtactatttgaaagtgaaaaatgaaacttag

SEQ ID NO: 23414 - DNA, 518 bp, Glycine max
  Peptide Sequence Number=SeqID_140192
gtaagactttcaaagtgactctcgacgggagaatccaggctattcaggaagaatcgcagcaattccccaatcctaacgaagtagttcctccggaatctaatgaacaacaacgattacttaggatcagtttgcgaatttgtggcaccgtagtagaatcattaccaatggcacgctgtgcgcctaagtgcgaaaagacagtgcaagctttgttatgccgaaacctaaatgttaagtcagcaacacttccaaatgccacttcttcccgtcgcatccgtcttcaggacgatctaggcacaaaagccaatgcttcctacgctccagcccttagccctgaactccttagcacaagcactaaggtcgttcgggcggaaaccgagttgcgtactggggttgttgaaggtattgcactaagaaagactcctgccgttgctatgctaaaggtattggaagtgttcagcgaatttaaagacactaaaaaagagcaccgtgctatactggcagagcttcagcaaaactag

SEQ ID NO: 23415 - DNA, 333 bp, Glycine max
  Peptide Sequence Number=SeqID_140193
atgaagatcctaggcctacaagctccaatggagcttacatcagttatagtatccagggttttgggaaccaaggtggtgctctcaagcaactcgattgccaagtcaattaggtgccttcataaagaaagcacctatcaagaaggatgggagaaaatctatgactcccatgttgcaagggcgttgtacaaggagaatgatcaaggcatctatcacgtatttgataagatggatgatgactctaagcacaccgtaatagccaaaggttcaattattgctaaacaacaaaaattcaacaaaactaacctgaaagctttgaaggttgcttcagaatag

SEQ ID NO: 23416 - DNA, 381 bp, Glycine max
  Peptide Sequence Number=SeqID_140194
atgcagagttcacaacgcgatgtgtatcttggagcctacctaaatgggttccactgcagcggacattggcagatggtggtcatcctgcccaaggaacacttagttgtctggttttgttcattgcataacaggccagacaactaccttaagggaattattaatagtgctatcaagggtcttgatgatgctccacagcctaaatcaaaggctcctgctaggtggattgtcgtcaagatgtccaccatcattttaggaagttttagaaataattgggaagcgtattttaacgaccctagaccattggagcctgagagattaaaagcattgcgaatccagtgggcacaattttatctccgagttagagtcaggcctaggatttag

SEQ ID NO: 23417 - DNA, 579 bp, Glycine max
  Peptide Sequence Number=SeqID_140195
gtccgggcgcttcaggcactcaggtcaaccgtggtgcgcgtgagcacgtcgttaaggctgtcggggcaacgtcatggctgcgcgagcgtccatcagaaaaaggccctggccggtctgagttcttgggccgagcagcttgagcgcgagttgatcgccaagatcaaggcccagagcgagtgggccaagatctacggcctgttgaccggcatttgcggcatcgggccgattaatggtgtggcgctgaccgcattgtttacccgtgtccacttcaccagcagcgatgcggtggtggcgttctgcgggctggatccgcggcccaaggagtctggcaggaaagtcgggcgacggcgcttgagcaaacagggcgacaaggccgctcggtcgttgctgtacaacgcagccagctcagcagtacgaacgccacactttaaggattactacgccgcgctcagggcccgtggcctggcctcgacggcagcgttggtggtgatcgcgcgcaagttattgcgtattgcttacggggtttggcgtacagggagagccttcgatccggacaggttgaacctcaaaacagcttga

SEQ ID NO: 23418 - DNA, 429 bp, Glycine max
  Peptide Sequence Number=SeqID_140196
atgcggcccagcacttgtgggcggaatattgaggaagtcggatggcgttacgcaatgtgggaagacgccagcccgtacgatcaggcaggcaagctcaaaggatggaatcggaaggaagagggagcgccgagtcacgaggcagtgacgtggagaaaatcaacgcatgacgcagtacgacaactaaagcgtccaaggcatcgacagcgccaagcactaaatcaatggcgttccacggagcccgcagaacgagaccacgcctatccagcaaaaaaacacgttcagcgcgcccctctccgcaagcgcgcagcgcacaccgttccgacgcaacaaatcgcgtatgcaataaccggccgcgcagggcggccggttattgcggacaacgcaagcctctccgcgcccccgtccgacctgactgcgccgcaaacctag

SEQ ID NO: 23419 - DNA, 228 bp, Glycine max
  Peptide Sequence Number=SeqID_140197
atggaaaacaaggccacattagaaaatattgtagaggaagaaatagaaacttcatcttccacattctctgaggataacctcaacataatccaacaagacgatcaaccatcgtctagggacgatgatgaacgagaaatcaatactctaacaagagaacaagatctcttgcttgaagcaatcaattccatactagatccccaagaaaagaaggttttccggaaaaattaa

SEQ ID NO: 23420 - DNA, 297 bp, Glycine max
  Peptide Sequence Number=SeqID_140198
atgaagaatttccacagaatcgcttacggaagcgtttcggaagcgcctcggcttagattttcttcacggaaacgatttttccaagcaaattcgaaagagagagaagtgccaaaggggctgaaccttttgaaacagctcccccctcccctatttatagaaaaaaagggagggtttcggaaattttacggaagtattacggaagccgcggaagccccgaaaaccatttttcaaaaacgtggaggagcttgccgcccagttgcttcctccttaagcaacccaacttccaaaatgttctag

SEQ ID NO: 23421 - DNA, 153 bp, Glycine max
  Peptide Sequence Number=SeqID_140199
atgtcagctagcaggaagctgaacacaggagaaaaaactgtgctttcgtggatgattgaaactggaacaatactacaacatgagaaggtattgtgctctctcttgactcggtgcacatgcaaggaggattatgaagatagagatgaattgtga

SEQ ID NO: 23422 - DNA, 141 bp, Glycine max
  Peptide Sequence Number=SeqID_140200
atggagttgaacgggggtgggggtcacaacccactctttgaggattcacctagtgagtctggtagtggggccgccactgtgagatttgggctaatctccaatgacactcacgaagcaagatgcaagtgcaaggccgtgtaa

SEQ ID NO: 23423 - DNA, 271 bp, Glycine max
  Peptide Sequence Number=SeqID_140201
atgaaagtcaaacacaagcgttatgcgataaatacactagactcaagcctatatgcaatatggtaccatttttcagtgaaaaaccttgtcaggtgcctaggagtacatgacaagacatgcctcacaatggggagaccagttagagtcacgctgttttgcgagcatgctccaaccatgtgggatcggcacagacttaaaggagcactcaaatcggataaccccaaggcctacactccgaaaaatctgtcagggcctctccctcctgattcag

SEQ ID NO: 23424 - DNA, 489 bp, Glycine max
  Peptide Sequence Number=SeqID_140202
atggcttctcaaggaagttttctcaaagaaacttctcaaggaagttttcttaagaaagcttctcaaggacatcacgtgctctccttcagagggctagatgtcttcgccttcagaggactacacgtcctcgccttcagagggctacatgccctcgccttcaaaggactgcatgtcctcgccttcaaaggacttcatgtcctcgccttcatagggctacacaccctcgccttcagaggactacatgccttcgccttcagaggactggatgtcctttcctttagaggactgcacgtcctcaccttcagagggcttcacgccctcgccttcagagggctgcacgtcctcgcctttagagggcttcacgcccttgtggaagcaatgttttccaagattattttgatgatgcgaaagtctcaagtcaagaatgaagcgtcaagcaagtttcaagaatcaaagagttgttcaatcaaagctagtttcaagaattaa

SEQ ID NO: 23425 - DNA, 1023 bp, Glycine max
  Peptide Sequence Number=SeqID_140203
atggtgatgatggactgggcgccgtttgaagggcgcggcgatattattcaggataacgcgctgctgggcggcgaactggctacgcagtatctgattgatcgcggttacacccgcatcgcctgtattgccgggccgctggataaaaccccggcgcgcctgcgtctggacggttttcatcaggcgatggctgccagtggactggcggtgccgccgggctatgtggtggacggcgatttcgaatttcagggcggtttcaacgccatgaatcagctgctggcgctcgatccgccaccgcaggcggtgtttaccagcaacgatgcgatggcggtgggcgtctatcacgccctgtatcaggcgggactgcgcgtgccgcaggatatggcggtgatgggttatgacaacattgagctggcgcgctatctgacgccgccgctcagtaccattcatcagccgaaagatgagctgggcgagctggccattgatacgctgattcatcgtatgagcgatcccgacgccagccagcaaacgctggtgctgacgccggagctgaaacgccagcgccgacagcacggtaatcacgcccatggtaaagaaggtggcgtggaactgctgcaccgtggtgctctcaaaatcctggtaaaagcgcagcacggcggcgctgaccgccacgccaaaactgatcgacacctgctgcgttaccgccagcacgctattgccgccgctggcgttctcatcattcaaatccgccagtgtgatggtattcatggcggtaaactgggtcgacatcgccatgcccagtacaaacagcgccaccagcagcatgatgatgcttccgtccggcgactgcagcgcgaagctggcgaccagcacgccgatgataaccgtaatgcccaccagcgttttacgatagccaaagcggcgcagcacctgagtcacggtggatttagccagcagcgagccaatcgccgtgggccccatcatgcagccggcgatgatcgccggatagccaaatcctacctgtaa

SEQ ID NO: 23426 - DNA, 851 bp, Glycine max
  Peptide Sequence Number=SeqID_140204
gccatagtccaagcagttattggatgcttctgctagaggaaaaaactaaattgaagactcctgaagaagctatggagcttattgaaaatatggttgctagtaaccatgctattttgcgtgatcggactcaagtacctacgaagagaagcttactagagctttcttcacaagatgcactattggcacagaacaagctgctagctaagcagctagaatcgctgacggagacacttagtaagctgccaactcaattacaagtgactcaaccttcacatttaacagttctgcaggttggaggttgtagcttgtgtggaggagcgcatgaatctggttgttgtatacctcttgaggatgctacaaaggaagtgaattatatgggaaatcagcacagaccagggtttaatgcaggtggatttgtaggttatcagcaaggttccaattttaatctgaatcaagggcaatggaggtcacatcctggaaaacaattcaacaaagaccaagtagcatcatccaacaggcctcaaaatcaagggcctagcctttatgagaggaaaaccaagctggaggagactttggctcagttcattcaagtttccatgtccaatcacaagagcacagagtttgccataaagaacttggagattcgagtaggacagctagctaagcagatagctgaaaattcttctggaagttttggggcaaatactgagaaaaatctcaaagaagaatgcaagagggaaaccatggtggaagatgaagggaggaatgttgatgagcaagaggaaggaagcaccataccctttggtgccatccaagaaagacaaggaatgacacttcactcgtttccttga

SEQ ID NO: 23427 - DNA, 171 bp, Glycine max
  Peptide Sequence Number=SeqID_140205
atgagagttccattcaacacctattggtggccatttgggcattgccaagactacccaccgcatcgtgatgtcaagaagttcatctacgactgtgccactttttgggctaaaagaagagaaggtcaagtagctggtgtctcgctaagcgaggcatatgcgcttagcgagtga

SEQ ID NO: 23428 - DNA, 261 bp, Glycine max
  Peptide Sequence Number=SeqID_140206
atggcctcctcgagcctgtcagaggtggttttgtgcgtcgcatggttggccatggaaggggcaggtcggaccagttggtacgagctgggactaagccaaggtgatggctttgtttcgaggacaagagagacaagattcatattgttattaggaaggaacaatggaaaaaaagaagctactaggccaactcaccaaggcgagtttgcactcgccttggtgagttggttgcttaatgctaaaggtactcactcgcctaggtga

SEQ ID NO: 23429 - DNA, 312 bp, Glycine max
  Peptide Sequence Number=SeqID_140207
atgaggaatctttcaaagataaagggaatatacgtcaaatcaaatattgataaggatagtaaaggaaaagataatgaagataaatatgtaaaggcaaaaaaacatgggggacatcatgcaaataacgagaagggatttgggaaagattatcctaagaaggatatgggaacaccaaagcatccatccaatgtggccaaagatgacctaaaactgatgcctacaattcaaccacatgtagctaaaggaggggaccttcgtataagaggtaaaacaacctttaaaaacacgaagccaacttgtgataaagcataa

SEQ ID NO: 23430 - DNA, 315 bp, Glycine max
  Peptide Sequence Number=SeqID_140208
atgtcacgccatcatgacataggtaaggatcgcgcccacaagacacccagtggacccggaggagtcaacagggccctggggtatccagctttggttatgggcctttgtcagttctacagagagcccgtcgcccccaacaaggtcattaggcccctattaatagggatttcatcgagaagtactgcgcccccaggtaggcgcagggcgaggcatcacagtagtgggcaacagcacaccgccaccatctctagagttcacctcaactcatccacaaaaaggttagagtgttgcctacgacacatggccgaccaatag

SEQ ID NO: 23431 - DNA, 660 bp, Glycine max
  Peptide Sequence Number=SeqID_140209
atgtcctccacttcagaggactacatgtcctccacatcaaaggactacacgttctcccctttggaggactacatgtccttgccttacgagggctacacggcttcaccttttgaggactacacgccctcaccatcagaggattacacgtcctcggcttcagaggactacacgtcctcaccttcagaggactgcacaggactacacgtcctcaccttcaaagggctacacgtcctcgccttcagtgggctacaagctctcgccttcgtagggctacacgcccccaccttaaaaggactactcatcctcaccttcagaggactacacgtcctcaccttcagtggactgcacgccctcgccttaacaggactgcatgttctcacctacagaggactacacaacctcgcctttcgagggctagacgccctcgccttcagaggagtacacatcctccccttgagagggctacacgccctcaccttcgtagggttacatacccttaccttcaaaggagtacacatactcaacttcagaggactatacatcgtcgccatcagagggctacacatcctcgcctttagagggctacacgtcctccccttcagaggacaacatgacctcccctttagaggaatgcaagccctcgccttaacaggactgcgt

SEQ ID NO: 23432 - DNA, 237 bp, Glycine max
  Peptide Sequence Number=SeqID_140210
tttttactcggatgtccgatcgagtctcgtaatccttgtagcgtctaccctgacttatcttccttcaccggaagtggcgtctaccctgacttatcttccttcaccggaagtggcgtcatccaaacctctgtagcctgtatcaaacgatccgctcctactcaggttcacaccaaacgtcggcgggcatttttttcgatcagtaccggtgaatcaggtttttttgccgaggttgcctaa

SEQ ID NO: 23433 - DNA, 396 bp, Glycine max
  Peptide Sequence Number=SeqID_140211
atgacaacaactaacgcccctcagggcgaactggttttacgcacactggcaatgcccgctgacaccaatgccaatggcgatatttttggcggctggctgatgtcgcagatggatatgggcggcgcaattctggcaaaagagatcgcccacgggcgtgtggtaaccgtgagagtagacggcatgaccttcctgcgcccggtggcggtgggtgatgtggtgtgctgctacacgcgctgcgtaaaacgcggcaacacctctatttccattaacatcgaagtctgggtgaagaaagtctcttctgagccgattggacagcgttataaagcgacagaagcgctgtttatttatgtggctgtcgacagcgaaggtaaacctcgccagcttccgcaggcctga

SEQ ID NO: 23434 - DNA, 405 bp, Glycine max
  Peptide Sequence Number=SeqID_140212
aaggtcgaggagcgtccgaaacgcgaagagcgtccggttgaaccacgtgcaacccagccggtagaaaatgcagccccttcaagtccggtgataatcaatacggcaacgaccaccaaaccaacggtcgccgctccagcgggcccgcgcgccgtgagccgcagtcaaccacagtatccgcctcgcgctcagatgttgtgtattgaaggccgcgtgcgggtaaaatttgacgtcacggtggatgggcgcgttgataacgtggagatcctgtcagcgcagccttggaatatgtttgagcgtgacgtgaaagcggcaatgcgcaaatggcgttatgagccaggcaaaccgggtagtgggttggtcattaatattgttttccgcctgaacggcggggcacagatggaataa

SEQ ID NO: 23435 - DNA, 321 bp, Glycine max
  Peptide Sequence Number=SeqID_140213
atggcaaaggtgcagaagacgatgttagtctctgcgtgccatcggacacaattgtgtctggatggcaaaagtgcagaagacgacgttagtctctgcgtgccatcggacacgattgtgtctggatggcaaaaggtgagtggaatgaccataatttgtctctgcatgtcatcgggcccgccacctctggatgacaaaagatgcagaatgaccataatttttctctgcgtgccatcggacacaactgtgtttgaatggcgaaaaaatgtgcggaatgaccataatttgtctccgcatgtcatcgggcccgccgcctctggatga

SEQ ID NO: 23436 - DNA, 261 bp, Glycine max
  Peptide Sequence Number=SeqID_140214
atgggtgccaagtacctcgaagtggtcaaacgagggtcgcatcccaacaaacggatggtccccggacgaaattcgggcgcggatgaccataatttgtctccgcgcgctattggacttgattgtttctggatagtgaaaaaggtgtgggatcaaatggttccccgcatgccatcgggcctgccgcctctagatgacaaaaaggtgaaaaagtgcgggaccaaatggttctcgcatgtcatcgggcccgccgcctctggatga

SEQ ID NO: 23437 - DNA, 2373 bp, Glycine max
  Peptide Sequence Number=SeqID_140215
caaagcctggatgctggagcagaaatcgctgatcgcgctgattgtgctgatcgccgtggttgccagccagagcccgaatttcttcacgctgcccaacatgttcaacatcatgcagcagacgtcggtcaacgccatcatggcggtgggcatgacgctggtgatcctgacctcaggcatcgacctttcggtcggctcgctgctggcgctgaccggcgcggtagcggcatcgattgtcgggctggaagttaatgcattggtggccgtagcggcatcgctggcgctgggtgcctttattggtgccattaccggtgtgattgtggcacgcggcaaggtgcaggcgtttatcgctacgctggtaatgatgctgctgctgcgcggcgtcaccatggtttataccaacggcagtccgatcaacaccggcttcagcgataacgccgatctgtttggctggttcggtattggccgtccgctgggcattccgacgccggtatggctgatggcggtggtgttcgcgctggcgtggtacatgctgcatcacacccgcctcggccgctatatctatgcgctgggcggaaacgaagcggccacgcgcctgtccggcatcaatgttaaccgcgttaaagtcatcgtctattcgctgtgcggcctgctggcggcgctggcgggcaccatcgaagtggcgcgtctctcttccgcgcagccgacggcgggcaccggttatgaactggatgcgattgccgcagtagtgctgggcggtaccagcctcgcgggcggtaaaggacgcattatgggcacgctgatcggtgcgctgattctcggcttcctcaataacggcctcaacctgatgggcgtatcgtcttactaccagatgattgtcaaagccgtcgtcattctgctggcggtgctggtggataacaaaagcagtaagattaaagaaatgaaaaagttaactgcattggccgtcatccttggcgccaccctcagtgctggcgcgatggctaaggatacgattgcgctggtggtctcaaccctgaataacccgttctttgtgtcgctgaaagatggcgcacagaaagaagccgataagctgggctataacctggtggtgctcgactcacagaacaacccggcaaaagagctggcaaacgtgcaggatctcaccgtgcgcggcaccaaactgctgctgatcaacccaacggattctgacgcggtcggtaacgccgtgaaaatggctaaccaggcgaacattccggtgattacgctggaccgtatggcggcgcagggtaaagttgtcagccacgtggcgtctgataaccgcttcggcggcaaaatggccggcgatttcatcgcgaagaaactgggcgacggcgcgaaaatcatcgagctgcagggtattgccggcacctccgctgcccgcgaacgtggtgaaggctttaagcaggccgccgatgcgcacaaattcaacgtgctggccagccagccggccgacttcgaccgtactaaaggtctgaacgtgatgcagaacctgctgcaggcgcatccggacgtgcaggcagtctttgcccagaacgacgaaatggcgctgggtgcactgcgtgcgctgcagaccgcaggcaaaaccgacgtgctggtggtgggctttgacggcaccgcggacggcgtgaaggcggtagaatccggtaaactcagcgcgaccgttgcacagatgccagacaagattggtatgattggcgtcgataccgcagataaagttctgaagggcgaaaaagtgcaggcgatcaacccggttgacctgaaactggttgcctttggcggtaaaggggccaaccaggccgtcgcggctggccgtgccggcgctgacattgcttttattgcgtgcgtgggtgctgatgacatcggcgaacgtattcgtcagcagctgcagcaggaccagattgataccgctccggtggaaaccgtagcgcaggaagccaccggcgtggcgatgatcttcgtgaatggcgaaggcgaaaataacattggcatctactcaggcgcgaatgcggcgctgacgccagcctgtgtggagcgccaccagcaggtgattcgttcggccgatgcgctgctgatgcagctggagtcgccgctggacagcgtgctggccgcggcccgcatcgcgcgcgccagtcacactcaggtgatcctcaatccggcgccggcgacccagctctctgatgagctgctggcgctgatcgacattattacgccgaatgagaccgaagcggaaatcctcaccggcatcgccgtcaacgacgacgacgacgcggcgcgggcagctcaggcgctgcacgccaaaggcatcgataccgtactgattacgctggccggcgcggc

SEQ ID NO: 23438 - DNA, 1332 bp, Glycine max
  Peptide Sequence Number=SeqID_140216
atggaggtggaagttcctaatgaagaggattccaaattcatactgggaagcaatgagaaaccaatgtttgaacgaggttgtggattcgacatccacgaccacacagtgtctcatcgccatgtgtccttcgaactcgaccattcaaacttagaggatgctaatgttgtttcattcaaagtcatgaggatgaaccccttttgggtgtacgacagagaagcgcttcgactcttcagcaagttcaacaaaggtcacttgcaattcgaacacactttattgggtaatgttgatgtcctgatggccacacacttgggtgttgtttttatgccacaaggtctgaggcatttccttggtattgacacatttgaccatggaggctacttaaagggcactggtaagtggattgttcagcaagctgttgaattatcaattgttgctcccactattgaagcatcattggatgcaaggttcctgagtgggttgaaggaggaaagacttgaagctacaaaggtatttaaatcaagtggcattggtgttattgtgactgataaacctgtagacaatcaaaagttgattgatgatgttaggaaggctcttcatgcagccaaaatctgtagctatgcacagggaatgaatttgatctgtgcaaaaagtattgaaaagggttgggatttgaagttgggtgaactggcccggatttggaaagggagagttgtttgccttgctatcaattttggtattaacactccagacctaaatgttggggttgcttatggacgaggagttactgaagttgagagagctctatctaagagacatgaatcacatccaggccaagagttgaaaaagattagtgaatcaaagtcatccattaaagggtttaactttatggatgaaagggtcgtgaatggaaattggagcaaagaacccaatgccaatccagggaacttggatttgaatttttatgaaaggatacatacaactatttcacttcgtgaattagacaccatattaggccagaaaatcaacaagtcctacaaacttttgaatatattagagtttactagtgcaagaaagcagatgtctgtaattgtgaaagatgtggatgggaaactactattacttagcaaagggactgacagggtaatgtttgaacgaattgcaaaaaatggaagggattttgaagagaagacaaagcaacacattagtgaatatactgattctggtttgagggccttgatacttggatatcgtgaacttattgatgatgagtacaataaatttaataaagattttatagaggccaagaacttagtaagtgaagaccaagagtag

SEQ ID NO: 23439 - DNA, 186 bp, Glycine max
  Peptide Sequence Number=SeqID_140217
atgactactaaaaatgattatattgagaataaaaaggtatgtactcttgaagatctatgggatgatgagaagaagaaggcccaatttcattggacattcatattctcaaacctcattgtacaatgggcacaatggttaggtatgcggtggatgactgttttggtttacctctcatatacaatatga

SEQ ID NO: 23440 - DNA, 234 bp, Glycine max
  Peptide Sequence Number=SeqID_140218
atgaattcggttataacagtgttgtatttcactggaagggtatatgaagataatgatggtgtaatatttgaaggtagtaaaaaagcgattcagattaaacgtggaattagtttcaatgctttgaagaaaaaaattggagataaggaaaatatattgccttgcaaatttgtgatgacgaagacgttgagacgatgctggaaagttttaaacaacaacaagaaatgtcagttctag

SEQ ID NO: 23441 - DNA, 308 bp, Glycine max
  Peptide Sequence Number=SeqID_140219
atggctacttcaacctcaaatcgccagtgctactggctactcccaattgcagcgcaaatcgccagtaggactggcgctttcaactgcaaaaaggttgtccctcctgcaacgcttcctgctgcacgtagtctgagcaaacagtcccctaccctcaactcgccagtcaaattggcgagtccaagctcctgcaaggcgccaacagcactggtgacaccagtgccaggtgtcacgtcgccatgggaagcgccaatatgtgctgcgatttgcatgaaatttgccagaggacaacaacccatgtctgatgaggg

SEQ ID NO: 23442 - DNA, 225 bp, Glycine max
  Peptide Sequence Number=SeqID_140220
atggcgtgtattggtttgggaaagagaacagataaaaataatatagtggattgggttggaacggaagcaaccaactgcaagcaagaaaaattggtggaaccaacaacgagacaggaaaacggtgccgtttcgcctctctctgtctttctgtccgagatgacgcaccttgtgctagttgccacatattttcatcaccacacaaatatcttctcttccaccagatag

SEQ ID NO: 23443 - DNA, 474 bp, Glycine max
  Peptide Sequence Number=SeqID_140221
atgggggtatctataaggtttaacattgataagggcggtgtttgggaagaggtggatatggtgttgaatggtacgcgaaggagggaggtgggtgggttcgcgaaaaatgttcgagaagtgactgaggacaaaggcaatttgtgggggtgtaacgaggatgaagatagtgatgctctgggtttgggcaaagtgcttaagttgttggccgaagcaagggagggtgtgaatggtgttttgatgataacaatgatgataacaaaagatgatgacaaaggtgatgacaaaaagctcaaagatcaatcaagaacaattcaagaagttcaagataagaatcaagaagaattcaagactcaagaagaaagtctagagacaagaatcaagattcaaggttcaagatctcaagaatcaagatcaagattcaagactcaagattcacggatgaagagaagactcaatcaagataagtattaccaa

SEQ ID NO: 23444 - DNA, 477 bp, Glycine max
  Peptide Sequence Number=SeqID_140222
atgggagtggccaagacactccactacctacaacaaaactttgattggccgcagatacaggctgacgatttgtcccttgatttcataacaggcctgccactatcccacggttttacggctatcttggttgtggttgactatttttccaagggtgcccatttcggtgctctcccacaccatcactcagcttacaaggttgctcagttgtttttagacatggtgtgcaaactccacggcttcccgtgtagcctcatttctgatagggacccaattctcgcctgtaatttttggcgtgaactctttcgtttgagcagcactaaacacacagaggtcatggaacaacacaacaatggtgcacgtgcgatgatgggagttgtggttattgttgatttgggatggttgtcatccccgacggttgtcttggacaaacttgttgtgttgcctccactcatcaacgaggaagagaaagacaactag

SEQ ID NO: 23445 - DNA, 267 bp, Glycine max
  Peptide Sequence Number=SeqID_140223
atgggtgccaagtacctcgaagtggtcaaacgaaagttgcatgccaccaaaaaatggtccccggacgaaattagggcaggagcaggtggtgatgaccctccttatctggatggagctcagaggttgttacttgatgctatgactgaacaaatgcaaagggtgacaagacaaaataatgaggagctctatggcaggattgaaggaatagagaatcaattgaatcataatgttggaggtcctaatgtcgataggagatggcaggcctag

SEQ ID NO: 23446 - DNA, 510 bp, Glycine max
  Peptide Sequence Number=SeqID_140224
atgccacattttataccttgcaaaaaggttgatggtgcttgtcatgtagctgacttattcttcaaggaagtggatgcaccggctaaagttgattgtgtgaggaagctgcatgagtgtgttaaagctcaaattgaaaagaaaattgaaagttatgctaagcaagctaacaagggaagaaataaagttatttttgaacctgtcttggacaggatcagtgacaatgcttacaaaattaatttaccaggtaagtatgttgtaagtactaatcttaatgcggctaacctaactccttttgatgtaggagatgacttcaaagatttgaggacaaatgcttcccaagaaggagggaatgatgaggacattgaagctcaaggaccaacacaaggactaggaggacctatgaccaaagccagagccagaaagacggaggagaccctacaacaagtggtagcaacaattcttgaagctgcacctgcaatgaatcacattgaaccaaaattatatcaatga

SEQ ID NO: 23447 - DNA, 559 bp, Glycine max
  Peptide Sequence Number=SeqID_140225
gacagagagcttaggggaagcagtaatgggatcatcgccggctatcataagtggctgagagtccgaacacaaggattggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaagtctagcggcgactcacgagcaaaggctagaggatgagtacgccaagatatcagcagaaagggaagcaagggaaaggataattgattcattgcaccaagaggcaacaatgtggacggaccgatttgctcttactttgaacaggagtcaagaacttcccccattgctagccaaggccaaagcagtggcggacacctattccgcccccgaggagatccacggacttctcagctatt

SEQ ID NO: 23448 - DNA, 330 bp, Glycine max
  Peptide Sequence Number=SeqID_140226
atggaaatctatcacacagagctggatgaattcaagggcgagctggagaggtgtaactttcacaagcgcctcaccaacttagttgattgtagcattgacctcgcattggtgaaggagttctacaccgacctctacagtcccaaggggccttcacctaaacaagtcagaatccagggtcacttaataaggattgatgcagacagcctcaatgcctttctagaaacacctgtggtgcttgctgagggtgaatctttgcccgcctactcaagatactacaagatgcctactgacattagagaaattgaggttgcactgtgcatacccggatga

SEQ ID NO: 23449 - DNA, 630 bp, Glycine max
  Peptide Sequence Number=SeqID_140227
gtcctcgccttgagaggactacacgtcctcaccatcagagggctgcacgccctcacctccagaggactacatgtcctcgccttgatagggctacacgccctcactttagaggactacgttaccctcgccgttgagagggctgcacgtcctcaccttgagaggactacacgtcctcgccatcagagggctacacgccctcacctccagaggactacatgtcctcgccttgagaggactacacgccctcaccttgaggtactagttaccctcgccttgagaggactatacgtcctcgccttgagaggactacacgtcctcaccatcagagggctgcacgccctcacctccagaggactgcatgtcctcgccttgagagggctacccgccctcacctggggactacacatcctcaccattagagggctgcacgccctcaccttcagaggaccacatgtcctcgccttgagagggctacacgccctcaccttgggactacacgtcctcaccatcagagggctgcacgccctcacctccagaggactacatgtcctcgccttgagagggctacacgccctcaccttgggtactagttgccctcaccttcagaggactacacgtcctcacctttag

SEQ ID NO: 23450 - DNA, 267 bp, Glycine max
  Peptide Sequence Number=SeqID_140228
atgcaaagacaagatgaaacgaaaggtcagattagcgtttcattctctaccgaaaccgcaagccaagttggaaaattccgctccaatcgacgggttcctctcgttgtggagtttcaatggagaacaacgatgttgtcgaccaaatttcgagaagatccaacggttaacgaaggctgggaagcatttttaccgaggcagcttcatgtagctttctctagaagcttcattaagaggcttcctccagaagcttccttgtggcttctttga

SEQ ID NO: 23451 - DNA, 456 bp, Glycine max
  Peptide Sequence Number=SeqID_140229
atggcggcgctgctcggggcgctgccgctgatgctggcctccggctccggtgctgaactgcgtcagccgctcgggctggtgattgtcggtggcctgctggtgagccaggtgctgacgctcgcggtaagcgctacgtgcagcgccggcagcagcaggcgcggggcgagccatgaacatcacccggctgtttatctttcgcccggttgccacgctgctgctgacgctggcgatcctgctgctcggggcgctgggctaccggctgctgcccgtcgcgccgctgccgcaggtggattttcctaccatcatggtcagcgccagcctggccggtgccagcccggaaaccatggcggccacggtggcgacgccgctggagcgttcgctcggccagattgccggtgtgacggagatgacgtcgaccagctcgcagggctcgaccagcgtgatactgcagtttga

SEQ ID NO: 23452 - DNA, 586 bp, Glycine max
  Peptide Sequence Number=SeqID_140230
atggcttctaggaaaagaaaggcaccctctacacctacccaagccagactttacagatctagattcacttcccaagaggcttgggaaagatacactgatgttattgtgcttaggaatcttttgcttgagaggaatatggtggagttttatgcaaacctctattaccccgaggacaaatcacctaagcaggtgagggtgaggggtcatctcaataagtgtgatgaggatacgcttaacactttcttgaagacccctgttattgtggaagaggggccttatcctcaggagttagctactaagctctgtatcccagggaggggattcgagcttaatgctaatggttatccgttgaagatattgaggaagaacatgaccaccctagctcagacatggagtgttctttccttctctaacctaattcctacctcccatacttctgatgtcaccctagacaaagccaaactcatttatggcatcatcatgaagatggacatgaatgtgaggtacctcatctcccaccaaatctccctcattgctcagcatgatacatctagacttgtattcttggccttgattacaactttat

SEQ ID NO: 23453 - DNA, 483 bp, Glycine max
  Peptide Sequence Number=SeqID_140231
atgaagcagaaagtagtgttaaaggtggatttacatgacgataggatgaagaaaaaagctatgaagatagcatctggcgttacaggtgttgaattagtttctgttaaagtgaaagacaaaaaaatgattttattgggggacattgatccggtgagtgtagtgtccaagctacgaaagtggtgtcatactgaaatagtttcagttggaccagcaacagtggacaacaagaaggttgagccagaaaaagaggacaagaagatcgagtcaccaaaagttcggagcgtattacagagcaagagtctggccaggacctgctcgaatcgaaaagagaggagagtctttaagaaggaattcccaggttcaaaggagtatttacgaagtacaaagctaagacaagaaagaggacttcgagttattgggcaattcgaactggtgtatggacgagtcgaagtcgaggcagcaagagttctggacttagcataa

SEQ ID NO: 23454 - DNA, 249 bp, Glycine max
  Peptide Sequence Number=SeqID_140232
atgggtaatggagatcgaggcgacggttacacagtgaacgttcggagcgtattacagagcaagagtctggccaggacctgctcgaatcgaaaagagaggagagtctttaagaaggaattcccaggttcaaaggagtatttacgaagtacaaagctaagacaagaaagaggacttcgagttattgggcaattcgaactggtgtatggacgagtcgaagtcgaggcagcaagagttctggacttagcataa

SEQ ID NO: 23455 - DNA, 462 bp, Glycine max
  Peptide Sequence Number=SeqID_140233
gggtgcgaatccgtctctgttgacatgaaagacaagaaattgatcttatcggtggaagttgatccagtgagtagtgcagtgtccaagccacgaaaagaaatagtgctaaaggtggagttgcacgatgatagaatcaagcaaaaggctatgaaaacagcctctagcctttcaggggttgaatcagtttctgttgacctgaaagacaggaaaatgatcatattgggaaacattgatccagtgagtgcagtatcgaagctacgaaggtgttgtcacactgaaatagttacagttggaccagcaaaaaaggagaaagagaaggagaaggtgaagccagcagaagtgcctgttcctctccatcaagcctatcccttaatttattatcagatgacaccaccaccatatcctcaaatttactatgttaaaagttacgatgagaatccttgtggctgtgtcatatgctaa

SEQ ID NO: 23456 - DNA, 1346 bp, Glycine max
  Peptide Sequence Number=SeqID_140234
atggaggggtcgtctggatcaactgctaatgactctagcacacgcaagcaaaatcttctgaagagacacaagataaatgaaggtgaaggcacactgagcaagctacctgaaccactcgttagtcacatactctcttttcttccaaccaaagacgcagttcgcaccagtgttttatccaagaaatggcaattccgctggacattcatcacaaagttggacttagacgacactgtgttctataagaggaagagtggtggaaaaatgtactttgtaaacttcgtgtacagggcacttcttctgaccaaaagttcaagtttggaaagtttctcacttgttattgctaacaagtatgatgtgttccttctcaatacttggatatgcaacatcttgatccgggacataaaaaatctttgtattgtcacacaatctgagatgtctttctctgctcatgcatctcattctcttttcaactccaggttattggaagaattggtgctcaagacgatgcattcttttgcgattagggttaccgaaagcgttgttcagtttgaacacctaaaactcctcaagttatctggaattttattttctctggacttcaactcaaaacatctaactcttagtttaccagtcctcaaagtgtttgaaacactaaattgcacttggttaaatgcaaaacgtatcactctgaaagtgcctctacttgagagtgttatcataacgcaagacaccaagcccccgtcctatgtgaagcctcactgtgcattcgagttttctgcttcgcatctgaaagaattcagttattgcggttgtggttatatatcacattattttaagctgttagatacgtcatctgctcataatgcttctcttaatataactgtgaaccaatgtccgataaacagagatccagaaacagaggttcgtgcttttttgcttctcaaacaattcagccaagtgaaatatctcaaattcgagggttgtcaggtactggcacaatcaaaagtggctagtctaccattatttggaatgttgagtgaattggagcttggcttggttagtggtgaagttttattaggcttacttctaaaatcaccggttcttaagactctacttttcgagggaatatctaatttcgacaaagagcttttgaattctgctgctgtgcccgagtgtttgacatctacactccaggttgtgaaatttcataaactgcatggatgcgagcatgagctgtgtttagctaaatttgtgatggaaaatggtttagtgctggagaggatgagtttcttcctagctagccattgcttgggaaaatcgaagattatggaagaatttaaagcaaa

SEQ ID NO: 23457 - DNA, 546 bp, Glycine max
  Peptide Sequence Number=SeqID_140235
atggctagtcagacaccgcatgataagatcaagttatggcatttgagactagggcacgtcaatgaaagaggtttagtggaacttgaaaaacaaaacttgttgaatggccgtttgagtatgttcattgattgttttcagatgaatggtttgtacattcttgattgttctatcgttattgctcttgcatctatggctagtcaaacatcgcatgataagatcaagttatggcatttgagactaggagttaaatttggaactggtatgcatgtttctagtagaccatttgggtatgttcattgggatctttggggtccttcaagggtgaagacacttggagggggactaccaaagagtttctggggtgaagctataagtgccacaatttatgggattaatagatgcctatcttcaactataaacatcaaggcacctacgaaattgtggagtttgatggcaattatgaatcgacatgatatggagttggagcatgtcaaaactgcttttctacatggggacttggaggagactatctataggcatcaatga

SEQ ID NO: 23458 - DNA, 204 bp, Glycine max
  Peptide Sequence Number=SeqID_140236
atgtgtgttgttgtaataaggttaattagacaagtttgtgaagtgctgattttcatctgctcgctaagccaatctgctggcttagcgagccatctgctgagtgcactattcccttggctgagcgcgaggaagaaggatgagttgtgcatgttcgctaagcgagggttcatcccgctaagcgcaccgcttcagtccattcgctga

SEQ ID NO: 23459 - DNA, 246 bp, Glycine max
  Peptide Sequence Number=SeqID_140237
atggagaataagatgccacaatcaatacaaatgtcactcaaaaagttgggcatgcaaaaagacaaaacttctttaagctccaaagggcacatcccaatgggacacaagccatttagaccacaccacacgtttccccataagaacgttgaccattcacacccctacgcacaaaaagtcatgctatctccacacgttgttacacatcattggcccttgtctcgtattggagttcaagtcctttcatag

SEQ ID NO: 23460 - DNA, 1608 bp, Glycine max
  Peptide Sequence Number=SeqID_140238
atggtgcctaaacctatggttttcgaactgggctctgcggtggaagtcagcatctacgacggctcatggttttcaggcaccatcatcggctgcgataactccgacagattcttggtccagtaccattgtaattcggttgagatcgcagttgttagtcttcaccatctccgaccacttcctccaccaaatagccaccaggaattcaagtccggcgacaaggtggaggtgttccacgaccactgctggcgggaaggccatatcacaggagatttagttaatggaaggttcgttgtttctttccgatattcgaaggagatgacgtttccgaaggagcagcttagagaacaccggcagtggatcaatgacaattgggtttcctcaaacagggacaggatcagtgagttgcctgacaacgttcttcttcatataatgaattttgtggacacaaaagatgctgttaaaacctgtgtcttgtctaaacgatggaaggaccttggcaaaggactagttaaactcacattctctccaaacctctttgaacttgggctagttgggacagttgaaagtgctgatctcttaaaggtaaatgggttggttgaaagttttaagaaattcgcatcttgggttttttctagccgagatgactcttgttccctgcttaatcttactattcgccatacatggacggagcctgaacacctagataggatcattaaatatgctgtgtttcacaatgtccagcacttgacattgcgtatatattcaggctttagacccaactttgagtccatccctttaatctttttctctaagtctttgacatatcttgagatttggaatgggtgtgaccttcctgaaataatacttccaaaatctcttaacctgcctgcattaaaaagcttgaagattggatatttcaaatttactgcaactgacaatgactgtgctgaacccttttcaaactgtcttgttttaaattctttgatgcttataggttgttctttgcatgatgatgcacaagtcctccgcatatctaattctaccctttctagattgacaatatttggaggaaaaacttatcaaattgtgctctctactccaaatcttagttcttttactattttggatagtactgtcagtcaccaactcttctccacttgcaatcttcctttccttggagaagtaaatatcgacatgtatagggacggaggttcagatgaaggttggaacgagaaaagttcaataatcatgaaatggctacacgtgcttgccaatgtaaaaatgttgacattatatcctcgtgcctttgaaataatactacgtgaactctcaaatcccatttcattgagacctcaacctccgagttttgttagattggagtcattgacagtgaatacacgtttatatgcaaacatatcagatgaggcaaagaattttacggaatgtccagtttttgtctattttgtacttacctttctcgttgtcctaaatagtctttactcagaaaattataggtttgctatattgcttttttgccaatatgttatttcactctcatctatgggttctaacaaggatgcagtgttactcaagcttgtcctcaaatga

SEQ ID NO: 23461 - DNA, 190 bp, Glycine max
  Peptide Sequence Number=SeqID_140239
atgagttcatattttgaggaaagggcaccttgttgtggaagtcacttttggattttactaagcatgtgttgggcatctgtgttatttgctgctatcacatcaggtcttgctctaggactcttgtccttcagccaggttgatcttgaggtttttgttaaagctgggcagccaaaaatccagaagaatgcag

SEQ ID NO: 23462 - DNA, 735 bp, Glycine max
  Peptide Sequence Number=SeqID_140240
atgggaaactgcttgttggggggcatgtcagatcctgatacaataatcaaagtcacaacatctaatggtggcatcatggaattctatgctcctattactgtgagtttcatcactagcgagttcccggggcatggcatattcctaagccatgacctattttgcaaaccacttagccaatttgatgagttggtggcaggacagtcatactacttactgccacttaacaaccaacctgaacacccttctgcctccggccacatcggtggcgacaaccgagccattcggctaggccatgttcgatctcatagtgttcctacaacaccctaccctcccccatatagaatgtccttggactaccaacaccatcaaggaatgaggtttctcaacaaaacctccacagaacctttctcttgtaggactagtactattaaaaggagcaaaattactactagtagtaaaaggagcaaaattactagtagtagtaaaagcagcaggttctggaaagtgaagcttgtgataactcctcaacagttgatggacattttgtcacaagaggctagaaccaaggagttgatagagagtgtcaggattgtagccaaatgtggtgttgctgcaggtggcattttacctgtatctgctgcagcaagcatagtgtctgatcagtggagcctttccagcagtggtaggagtgcttgtgattcctccaagattgatgcattagtggttgacatgtag

SEQ ID NO: 23463 - DNA, 561 bp, Glycine max
  Peptide Sequence Number=SeqID_140241
atggtggaacaatttaggatgtgtcaatctaagccagttagcacacatttgggtcatcacacaacgctctctatcacacaagctcttagcaccaaagaggaaagaagcataaaaaattctattcgctatgctaatggagtaggaagcgtcatgtatggtatggtccgtagtaggccggatttggctcgtgtggttagcatcattattcgatttatcgaaaatccaagtttcggaggctttaaagtgggtattgaggtatttgaatggttatctaaaaggtggtttgagttacatgacaatcaagataccttacaatcgataatagctctatctacaactcagaccgagtatattgctcttgtgaaaggtgtcaaggaagctatgaggctaaatggaatgattggtgaattaggaattatgcaaggttgtgtgacaatccactatgatagccaaagtgtcatacatttggctaatcatcaagtgtaccatgaaaggattgataagtgccatatttcagatatttttggaattaaaatgttagcacttatctttcgattgtaa

SEQ ID NO: 23464 - DNA, 297 bp, Glycine max
  Peptide Sequence Number=SeqID_140242
atgaagaacggtggaaaatctgcacgaaatcgctcacggaaacgtctcagaagcgttacggaagggaaagagggaggtggttgccacctagctcgcccaggcgagctaggttgcttccaccagaacgcaccgccttctattggaacaccctggaaggcccaagttgcatgccaccaaacaaatggtccctggacgaaattagggtatgacaatatggatgacattcttatagctagctctagtaaggatgagattggcaagctcaaagagaagttgaatttagaatttgagatgtag

SEQ ID NO: 23465 - DNA, 411 bp, Glycine max
  Peptide Sequence Number=SeqID_140243
atgaacctctcatacttccatgggaaggacaatgtaaaggctaacttagattgggaaataaggataaagcaacaacttaaaagaaagtctacttcaaaatcttttggtgttcacacttatccaaagaaagaccaaggtcaaggcatcttaggggacatttatagtagccaagatgaggctactacttcaccttcctttagtgaaagtgaagaaggaaaaggggaagaatctagtgaagaaatctacccccaagaagaaggacaacctttaatggttaaggaggagtgtaaggagataagtgtatcctccaagagcattgcgacacctcttgggcttgaggttattcctcaagtaaagaagttgctggatgagggtttggttcataagagcttaaatccttatgctttgctg

SEQ ID NO: 23466 - DNA, 453 bp, Glycine max
  Peptide Sequence Number=SeqID_140244
atggctaaaaacggaaagttggatcggatagaggaaaggctaagggtcgttaaaggaagtggagattatgccttcgctgacatggtagaattgtgcctagtgcctgatgtcatcacccctccgaagttcaaggtgccagagttcaataagtacaaggggacaacttgccccaagaatcacctgaaactgtattgtcagaagatgggggcgtacgcgaaagatgaaaaactgctgatgcatttcttccaaaagagccttaccggggcagtcgtcacctggtatactaacttggaaccttcccaaatccattcttggaaggacctaatgattgccttcattagacagtaccagtacaattctgatatggctccagataggatgcagcgacagagcatgagaattataagcaattgggcttggatccggaattgggctgaaccggcttggacttga

SEQ ID NO: 23467 - DNA, 555 bp, Glycine max
  Peptide Sequence Number=SeqID_140245
atggatgatgctggaataaagtatattcctagcaatgctttctcatactacgatcaagtactggacacaacaaccatgcttggggcagttccacctagatataattggaattgtggggagattgggtttgatgtttacttcttgatggcaagaaggaatgcatatgtaccagctatggaaaagaccaaatgttttgacacaaactatcgttacattgttcctgaattaggttcagatgttaagttctcgtatgcatcacacaaggttgtggatgaatacaaagaggctaaagttcatacaaaacactcatctaagtgcaatcattcgagcccttgttgtgtcaaacctcccatcatgtatggtgatgtgagctatcccaaacccatgatagttttctggtcttcaactgctcaaagattgaccaaacgaccaatgaagggaatgcttattggccttgttactattttgaattggtcctttgttagagatgaccaaccaagatttgtaagctttggggctgaaaaactatatagcagcaccaaggttctagtttag

SEQ ID NO: 23468 - DNA, 234 bp, Glycine max
  Peptide Sequence Number=SeqID_140246
atgaacagagtctataactttccaaattggttcttacaatggtggaatttctttggtccaattctagagattttgccagagcagtttgattcgtccaaggctgatccagaacaagtgaagctttggtttcaattccatccagaatttctcaaagcagctgatccagagacttctgtgtttttgaaccaaaagtcccatatggctgcatttttagcaggatcaaaatcaaaagag

SEQ ID NO: 23469 - DNA, 735 bp, Glycine max
  Peptide Sequence Number=SeqID_140247
atgaccggccctctcgatgagtcaatctcttgctttctcataagggtagacccttggggttgcacgccctcgccttcagagggttgcacgccttcgccttcagagggctacacgccctcgccatcagagggctacacaccctcgccttcagagggctgcacgccctcgccttcagagggctacacgccctcgccttcagaggattgcacgtccttgccttcagaggactgcacgtcctcgccttcagaggactgcacgtcctcgcctttagaggactgtacatcctcgccttcagagggctacacgtcctcgccttcagagggctgcacatccaccccttcagagggctacacgcccttgccttcagagcgctacacgcccttgccttcagagggctacacgccctcgccttcagaggactacacgtcctcgccttcagatgactacacgtcctcaccttcagaggactacacgtccttgccttcagaggactacacctcctcccctttagagggctacacgccctcgccttcagagggctacaagtcctcaccttcaaaggactacaggtactcgcattcagaggattacaagacctcgccttcaggagactacacgtcctcgcctttagagggctacacgccctcgccttcagagggctacacgccctcgccttcagagggctacacgcccttgccttcagagggctacatgccctcgccttcagaggactaa

SEQ ID NO: 23470 - DNA, 1167 bp, Glycine max
  Peptide Sequence Number=SeqID_140248
atggcactggagggggtttctgtttttatggagaaaatgttcccagaatggctttcagtattattagcagccaccattttggctaccattgcagagattatccctctagccttgtgttctcgatatggtttaagtgttggggcaacattgtctccctttgttcgagttcttatgatggttttcttcccaattgcatatccacttagtaagttgttggattggatttttggcaaggggcatactgctcttttaggacgagcagagctgaagactttagtccatttacatgctaatgaggcagggaaaggtggagagttgtcacttcatgaaactacaataattgctggagctttggacttgacacagaagactgctaaagatgctatgacaccgataagtgaaacattttctcttgacataaactccaaactggacatgcatacaatgggcttaataatgagcaaaggtcacagccgaataccagtctactctggaaaacagacaaatgttgttggtattatcttggtcaagaatttaatcttctgtcatcctgaagatgaaacaccaattaaatatatgactatcaggagagttcccagagttggtgaagattggccactatatgatatcttgaatcaattcaagaatggtcaaagccacatggctgttgtcctcaagtgtggagagaacatcagaactgtagcaactcataccgaaagcaaaactccaggacattgctcttcagttgaactgggagattatattcgcatctcaaccgatgcatccaattggcattcacaagaaacagaatattatagtgcaacactgaagagcatcatgcatcgcgagggtgactcagatcttctgcaaagaagatcagaacaacctgatgcaagttcatcctttgagaatttggagtctcttccaacagcggatgaggaagtgattgggataatcacattggaagatgttatggaagagttacttcagtatcagaatcaaactgcaacatgcaagaagagggtcatcagggtcctccacaagggtttcaagctctcgtcaaaaacggagaagttcagatgcatctcgagtttgctttttaactcctacatatgtttcacccgtttctccttaagcaaaaaagtcacctcccctgtttctccttaa

SEQ ID NO: 23471 - DNA, 993 bp, Glycine max
  Peptide Sequence Number=SeqID_140249
atggaacaagtcattgttggtattaactccatggaaatgatctccgagatggacttatctggtccttcagaaattgactttgggatagaagaaattgatgatgaagataccgaggatgtagatgacaacaatgaagatgaagacaaagatgaagatgagaatgaagattatgattcagaatgggtggctgtgttttcagatgatgatgagcaagaagacgatgatgaaacacttgcagactgggcaaaattggagactatgcgatcttctcatccggtgtactttgccaaaaagttagctgagattgcttcagatgatcctgttgattggatggagcagcctccagcttgtgtggctatccaaggggttataagacctgcttttgttgatgaacattctacaatacagaagcatctatctgccaatcaatccagtgatactgacaaaagtaaatctatagaaagtaaaggggaaaatattggtgtgattaatggtcatgtgcttaattcagaatcttctggagataatgcggcccagcaggttgaaaacaacgggaatagtgtcatcccctttagcgagacttcattttacaaattggtgatgattaagattcaagtgttttctgcacaagggcaacctactgccattgaattagaagactacatgaatgcccaacctgatgttattgcacactctgcttccaaaatcatatctcgtttgaaagctgatggagaagagaccttggaagcccttaagtccctgtgttggagatgcaagggtattcaagtggaggaggcacaacttatctgtctagactcccttggttttgatctaagagtttgttctggaactcagattcaaacactgagatttacattcaagaacagggccacttccgagtacagtgctgagagacaactcaacgatatactatttccaagaattcacccaaagcagcaaaaaatgaagcaaacacatcaaaatgaatgctaa

SEQ ID NO: 23472 - DNA, 429 bp, Glycine max
  Peptide Sequence Number=SeqID_140250
atgatcataatcgaagctcccatcgccgtcagattccacgccaccgccgccattcgctccgccgccgcaccttcacctcataataaccgttcaatgtggagcgccgatgacgtgaacggtgtgcgttatgccgcttcgtgcaggctcgcatgcagctgcggtttcgacgcgccttgggtaagaagtaaaataaattcaggcactccgttcacaagaagaaacaaacttgtaaaaaatagaattagggcatcatcagagcatctgggctccgctcaggatcctctaaagaaaaatgagaagccatcctatcatccatttgaagaagttgccgtgtcaacatcagagaatagtgaagatgctacacttactgcagcagaaacaagtagaacaattattgagagagaaagaagagcttactgtttggattaa

SEQ ID NO: 23473 - DNA, 1236 bp, Glycine max
  Peptide Sequence Number=SeqID_140251
atgttaaaaagagttgttcaggtcctcaagatgcttgcgctgacagattctcctctacttattgctaaaacatttgaagcaattaaaataccaacaagtacacgaggcactgtgttatgtgctgcaaaaggtcaaagaccaagatatccccgagtttggaagacccataaaaaaattgggaccatttccaaggctgccaagcttgttaactctattaaggagctgtcaaatgtcaaagaggaagtttatggagctcttgattcctatgttgcttgggaattagagttccctttaattacagtgaaaaaggctctcaagaccctagaatccgaacaagaatggaagcgggtaatacaggtaacaaagtggatgctaagcaaaggtcaagggaagacaatgggaagctatttcacattacttaatgctttagtagaggatgaccgtcttgatgaagctgaagagctttggacgaagttattaatgcagtacatggaaagcttgcctcgtagattttttgataaaatgatatctatctaccataagaggggcatgcatgagaagatgtttgagatatttgccgacatggaggagctttgtcttcgacctaatattgctgttgtctcgatgattggggatgccttcaaagagctgggtatgctagacaaataccagaagttacatgcaaaatatccaccaccacaatgggaatacagatacatcagaggaaagcgtgtaaaagtcaaagtggaagttcagtctaatcaggtcaacacatacatagaaaggcatgggaatgttgaaccaaactcagacttaaacaagaattatagattatctgaaaagacttcagagatagtcgatcaacaactcagacaggatgcgaatgtaatatccatgaaacctgaacaaatttcaggcataaacaacaattatagatctgaagagacttcagacatgattgatgatcagcaacttggacaggaagcagatgtaatatccatggaacttgaacaaatttcagatgattcatatgacagtatggaacctattttcaatttattgttaatcatagttggaatcattatttccatgtgcatctcctacaagttgttaggagataagagtgaagacactctaggaataggactagaagaacatgttcttaaaaatttcacaaaatgtgagattgagaatctggtgatggccatttcatctacccaaaaattttcatgctga

SEQ ID NO: 23474 - DNA, 384 bp, Glycine max
  Peptide Sequence Number=SeqID_140252
atgagaacccctgagtggctgaaaaaaatatttgcaccgatcaccaagagtgagaggaatggtcctgtatttcgcttttttattgatctagaagatgcagaaaaagacatttcacagagtgaaatgaggaacctaaaggtaggggtgaataagatatcctccacaactaagaaaagtagatacgacaaggataaggaaaaaaataaactcaagcatgcaacaaggctgcccaatctctgcatattcagaaaaaggcaactaaaattaaagctgccatgtgctgcacaccaaataaaagccaaaaacaatagccagtggcaaaggggcaccttcaaagatgttagcatatgggtccaatcaagtgcatcaaagcgcctcatataa

SEQ ID NO: 23475 - DNA, 278 bp, Glycine max
  Peptide Sequence Number=SeqID_140253
ggaagcaaagaggaagcacaaggattcatggaacagcacagagcttaaaaaacaggccaagatacattcacagtgaagaagctaagcaagttgctgccttgtactatgcttcagattctcaaattggagcatgcaagctcaacagcccagagaatttgcatgaaattgaagggcattttggggttgaggttacagtagcagctacaagaagtgaagatacatgcttcattaaggagttcaaaattgaagtaagaaaggatcaagattcaggaaagtga

SEQ ID NO: 23476 - DNA, 213 bp, Glycine max
  Peptide Sequence Number=SeqID_140254
atggcttctaaacgcatcttgaaggagctcaaggatttgcagaaggatcctcctacctcatgcagtgcaggccctgtggctgaggacatgtttcactggcaagccacaatcatgggacctgctgatagcccatatgcaggtggtgttttcctagtttcaattcattttcctcctgactatcccttcaagccaccaaaggtattcatcttctaa

SEQ ID NO: 23477 - DNA, 474 bp, Glycine max
  Peptide Sequence Number=SeqID_140255
atgctgttggggataacatgcgaggaatgtcatgttgaaagcacacaccgtagtgaaaatgaaggaaaacatgacaatgggcacggaaaaatgatgaaccttacttctagtgcggcatttgccttgatggcaatgagcttgtcgaagctccaacttgggttcgaagttggtgtgtctaacttcttgtttgggtgcttcttggtcacgttgatgaagatgagcttcaagttggctccacttgcagcattcttctgctacttgcttcttaacgttcgttccatttctgattttctgcttgaaatgcgtacacaacatgcagatgatgatacagttgaggctaattttctgccccttgaagcaatttctgatgtcttagaagatgaggcaggttttcaaggccttgaaccatattctgatgtcctgggattcagatcctctgccataccttttcaaactgcatgggatcttgcctaa

SEQ ID NO: 23478 - DNA, 1198 bp, Glycine max
  Peptide Sequence Number=SeqID_140256
atgccaaccatgaatccagatagtttcaaattcatagaagccttaataatattaatggttgtttgtgctgaagaggaaataatgtgcattgagagggagagggaagcactcctccaattcaaagctgcccttgtggatgactatggcatgctatcatcttggaccactgctgattgctgccagtgggaagggattcgctgcaccaacctcaccggccatgttctaatgctcgaccttcacggtcagcttaattattattcatatggaattgcctcgcgacgttatatcagaggagagatccacaagtcgttgatggagttgcaacaattaaactatttaaacctcggttcgaattattttcaaggcagaggaatcccagagtttcttggttctcttagcaacctgagacaccttgatctgtcaaattctgattttggcggaaaaattccaactcagttaggctctctttctcatttgaaatacttaaatcttgctgggaattattatctggagggttcaatcccacgtcaacttggaaatctctcccagttgcagcatcttgatctcaattggaatactttcgaaggaaatataccctctcaaattggaaatctctcccagttgcagcatcttgatctcagcggcaataattttgaaggaaatataccctctcaaattggaaatctctcccagttgcagcatcttgatctcagtttgaattctttagaaggaagtataccctctcaaattggaaatctctcccagttgcagcatcttgatctcagcggcaattattttgaaggaagtataccgtcccaacttgggaacctttcaaatttgcagaagctttatcttgaaggtcctactctcaaaattgacgatggagatcattggctgtctaatctcatttccttaacccatctttccttgctctccatatctaatctcaacaattctcatagcttcctccaaatgattgccaagctaccaaaacttagagaactgagtttaattgattgtagcctttccgatcattttatcctttcattgaggccctctaaattcaatttttctagttccctttccgtccttcatctttccttcaacagcttcacgtcatcaatgatactccagtggctgtctgggtgtgccagattctcgctccaagaattgaacttaagaggaaatcaaatcaacg

SEQ ID NO: 23479 - DNA, 2169 bp, Glycine max
  Peptide Sequence Number=SeqID_140257
atgacagaggttactttgaattcaagtgtcaatatcttataccatacagccaaaaaaatctccatgaagttctactccttgcaagcgcatcgtttccttttcatcattgttattctttgtcccctggtcattgctgacttaagttctgacaagcaagctcttcttgattttgctgctgctgtccctcatcgccgtaaccttaagtggaacccagctaccccaatctgttcatcttgggtaggcatcacttgcaatctaaatgacactcgtgttgtttctgtgcggctcccgggaattggactagttggcaccatccctgccaatacacttggcaagattgactcactcagaaatatcagcctccgcgccaacttactcagtggaagtcttcctgctgatattacctctcttccttctctacagtatctctaccttcagcataataacctttctggcaacatacctacctcattgtcgacccgcctcaatgtacttgatttgtcatacaattccttcactggtgctattccaaagacattacaaaacttaacacaactaatcaagttgaacctccagaacaactccctatctggactgataccaaatctcaatgtaacgaagctcaggcgcttgaatttaagctacaaccatttgaatggttctatccctgctgctcttcaaatttttccaaattcttcctttgagggtaactctctatgtgggttacctctaaagtcatgccccgtagtcccctctacacctcctccatcgtctactcctgccccaccatcaactcctgcaagacatagctccaaaagtaaactgagtaaggcagctatcattgcaattgcggttggtgggggtgtgctattgcttttagtagctctcatcattgttctttgctgtttcaagaaaaaagatgatggaagccccagagcaactaaaggcaagggtcctagtggtgggagaagtgagaagccgaaagaagagtttggaagtggggtgcaagaacctgagaaaaacaagttggttttctttgagggaagttcttataattttgaccttgaggatttgctgagagcttcagctgaagttcttggaaagggtagttatggtactgcatataaggctatattggaggagtcgacaacagttgtagtgaaaaggttgaaagaagccgtggtaggcaaaagggaatttgaacagcagatggagattgtgggaagggttggacatcacccaaatgttgtgccccttcgtgcttattattattctaaggacgagaagctcttggtttatgactacatcccaagtggcaatctatctaccctcttgcatgtgaaagcagtaaaatatgatcatataagaaagaaatggaatttgttatcacatgttgggattactctcatgtttgaagtccttcaggataatctcattcctactgtttatgtaatttactttcgtatgggtttatatgtgcttgagtcagctagatcactttcactttcacctaaatcagatctgaatttgatgataggtaacagggcaagtggtagaactccattagattggaactccagaataaaaatctctgtaggaattgccagaggaattgctcacatacattctgttggaggtccaaaatttgcgcacggaaatgttaaatcctcgaatgtcctcctcaaccaagataatgatggctgcatttctgactttggcctgaccccgcttatgaatgttccttccaccccttctagagctgcaggatatcgtgctcctgaagtgattgaaacgcgtaagcacactcacaagtcagacgtgtacagttttggtgtcctccttctggaaatgctgactgggaaagcaccacaacaatctccggggcgtgatgatatggttgatctccctaggtgggtccaatctgttgttagggaggagtggacggctgaggtttttgatgtggagctaatgagataccaaaacattgaagaggaaatggtgcaaatgttgcaaattgccatggcctgtgtggcaaaggttccagatatgaggcctagcatggaggaagtagtgagaatgattgaagagatccggctatccgactcggaaaaccggccatcttcggaagagaatagatccaaggaggaatcaactgctcaaactccataa

SEQ ID NO: 23480 - DNA, 270 bp, Glycine max
  Peptide Sequence Number=SeqID_140258
atgtctattgggtgggttcaggttgcttttcggactaaggtgttccacccaaacatcaacagcaatggcagtatatgtcttgacattctcaaggagcaatggagcccagccctaaccatttccaaggtccttttgtcaatttgctcattgttgacggatcccaaccctgatgatccactcgtaccagagattgcacacatgtacaagactgacagggccaagtatgaggctacggcccgcagctggacccagaagtatgccatgggatga

SEQ ID NO: 23481 - DNA, 240 bp, Glycine max
  Peptide Sequence Number=SeqID_140259
atgaaagaggaaaggttaaagggtatttatagtgcacggggtggtatttgccccattggatatttcacaaaacatttttctcgtgagagtagggttttggaattgaattggagtcattcaagtgaggtagtgagtgtgagtgagtggaggagggtcgtgactgcgtttggtttctgtgtgaaagggttacagaagagtgaaaaccgtcccaactttacacgttggtcaagcttgccttag

SEQ ID NO: 23482 - DNA, 786 bp, Glycine max
  Peptide Sequence Number=SeqID_140260
atgcccaccataccaaagatcttctcctatgtagcccaacaagaacgacagctatcaggtatcaattccttttcaaatctcagtcttgaatcaaaagaaaatatttccattaatgccgtgaaggttacctgtgaattctgcggacgaattggtcacaccgaaagtgtttgttacaagaaacatggggtacccacaagctataaaggaagaagcaaaacctacaacagaaacgggaaaacgtgtacccattgtgggaaaataggacacaccattgatgtgtgttataagaagcacggctaccccccaggatacaagtttggcaacaacaaagtagtaaataacatcatggaaggaaaagctgcgagtgatcaaatgcaacgacaagagtctcatgatttggttcatttttcacctgagcagtatcaagctttgctcgccttaatacagcagccatcttcaggaagctcaatccctactcaaccccaggttgcatccatatcctcatgctccactaacacctcaccaggtatgattctttctctcaaaaccacagactctacctcctggatattagattcaggagccactgaccacgtctcatcttctttggccaactttcactcatatcatcaagttaatcccattatggttaagttaccaaatggacacgaagttcatgctacccactcaggaacagataccaacaccaaagcaaagattggtacagttgaaatatatggggaccctgttcaaaagtttctatgcatgggcatcattattttttaa

SEQ ID NO: 23483 - DNA, 690 bp, Glycine max
  Peptide Sequence Number=SeqID_140261
atgagtgaggtgtttgaagggtacgagcgtcaatactgtgagcaatcggcgaatctttcgcggcaatgcactgcggcttctgctcttgatggagaacaaaagaagcaaaaactttctgatataaaagctggattagatgatgctgacacattgattcgaaaaatggaccttgaggctaggagtttgcagccaagcgtgaaggcagctcttcttgccaagttaagggaatataaaactgatttgagcaatttgaaaagtgaagttaaaagagtcacgtcagctagcgtcaatctcactgctcgagatgacttgttggagtcaggaagggctgatacactggcggcatcaaatgatcaaaaaggaagacttctgatgtctactgaaagacttaatcagtcctctgacagaataaaggagagcagaaaaacaatgctggagacagaggatcttggtgaatttatcctcagagatttgcatcaacaacgtgaatccctactccacgcccataagacgatccatggagtggatgataacattagcaagagcaagaaaattttgtcggctatgtcaagaaggatgagcaggaacaaatggattgttagctccttaatgacagctctgctatgtctcatattggagtgtatgttgcccaacaatgtgacgatgtttgaagagttgtgtgaacaatag

SEQ ID NO: 23484 - DNA, 2241 bp, Glycine max
  Peptide Sequence Number=SeqID_140262
atgaacttggatggtgagacaaatttgaagttaaaacaagggctggatgtaacttcttccttacaggaggactttaaattccgtgattttagagctgtcatcaaatgtgaagacccaaatgcaaatttgtattcatttgttgggagcatggattttggagagcaaaaatatcctctttctgctcagcaacttcttctgagagactctaaacttcgtaatacagactatgtgtttggagcagtcatctttactggtcatgacacaaaggttatccaaaactccactgatcccccttcaaaaagaagcaaaattgagaagaagatggataaggttatatacttcttgttttgtgttttatttctaattgcatttcttggatctattctctttggctttgcaaccaaaggtgaccttgacaatgggttaatgaaaagatggtatctcagaccagatagttccacaattttctttgatccaaaaagagcagctgcagctgctatatttcattttttaacagccttaatgttgtacaacttcttcattcctatctccttgtatttctcaatagagatggtcaaagttcttcagagcatcttcatcaatcaagatatccacatgtattatgaagaaactgacaaaccagctctagcccgtacttcaaacttgaatgaggaacttggccaagttgacacaatactttctgataaaactggaactctgacctgcaactcaatggagttcatcaaatgttctgttgctggggtagcatatggccgcggtgtgacagaagttgagcaagccatgggtaaaagtaatggtttacctatttttcatgagcatattaatggattagaatcaaaattaaatgaaatcagggactctcctgatagaaaagaacctatcaaaggttttaactttacagatgaaaggataatgaatggaaactgggttaatgagccttatgcagatgttatacagaatttttttcgcttattggcaatttgtcatactgccatacctgaagtggatgaagaaacaggaaaagtctcatatgaagctgaatctccagatgaagcagcatttgtaattgctgcaagagaagttggttttaaattctacaaaaggactcagacttgtttgtcaatatatgagttggatccagcttctggcaatgaagttgaaaggacgtacaagcttcttaatgttttagaattcaatagctcgaggaagcgaatgtcggtgatagtgaaagatgaagaggggagaatttttctactctgtaaaggtgctgacagtgtcatgtttgaaaggcttgccaagaatgggaggaagtttgaagagaaaactctggaacatgtgcgtgaatatgctgatgcaggtctaaggaccctagtacttgccttttgcgaacttgatgaagaagaatacaaggagtttgatgataaattttctgaagtaaaaaattcagttgccgcagatcaggaaaccctgattgaagaagtatcggataagatagagaggaatctaatccttctgggtgccactgctgtcgaggacaagctccaaaatggggttcctgattgtatcgacaagcttgcccaagctaagattaagatttgggttttgactggggataaaatggagactgccatcaatattggtttctcttgtcacttgctaagacaaggaatgaaacagattataattcatttggagattccagaaattcaagcattagaaaaggctggagacaagatggctattgccaaggcatcaagggaaagtgtgcatcatcagatatctgaagctgctcaactgctttctgcatccagagggacctgccagacatttgctctgatcattgatggaaaatcacttacttatgctttagaggataatatgaagaacatgtttctagagcttacgagtcattgtgcgtctgttatctgctgtcgctcatcgccaaagcagaaggctctggttactagactggtcaaatctggaactggtaaaacaacattagctattggtgatggagctaatgatgttggaatgcttcaagaagcagatgtagggattggaatcagtggtgtcgaaggaatgcaggctgttatgtctagtgatattgcaattgcacagttccggtatttggaaagattacttcttgtacatggacattggtgttaccggaggatgtcatcgatggtattgccactcaaactagatcccaacattctatag

SEQ ID NO: 23485 - DNA, 2124 bp, Glycine max
  Peptide Sequence Number=SeqID_140263
atgcttcagaaggggttaattcagccaagcacgagccccttctcgtcgccggtgttgttagtccacaaccatgatggttcttggcggttttgcatggattatcgcgctttaaacatcgtcacagtcaaagatcgtttccccattcctacggtggatgaacttttggacgaattaaggggagcacgatgcttttcgaagcttgacttacttcaggggtatcaccagattcgtatggatgccgacgacatttcaaaaacggcgtttaggacacaccatggccattatgagtttaaggtcatgcctttcgggctctgcaacaccccctctttatttcaagcgaccatgaaccctatctttggaccttatctacggcaattcattatcgtcttctttgacgacatcttggtgcagtatctcagacatgttgtcccgcatacaggcgaggcaccagtggctgccaaggtggcggttgtccagcagtggcccacaccgcgatccattaaagctttaagaagcttcttgagcttaacagttttcgagcagctgaaattggcactgaccaatgctccggtgttggctctcccaaactttgacattccttttaccgtggaatcggacgcatctgacagtggtataggcgttgttttggcccagaatggacaccctattgctttttttagaaaatccttcattcccaagcttcttcgcgcctccacatatgagcttgaaggagctcttaactcaggtgatccatacatccaagcagcatatctacttagcgaggccgcagatacgctctctcgtctaccagatacgtcggcaactgcccatatgctcctttttgttccttgtttgacttttctcgatgccttacgccagcaattggacactcatgatgaatattgtcaaaagcgtcaactcattcttgcttcccctgcgaatcatcctttctttttcattactcagggtctcattttgcataagggaagaatttggttaactcgggggttgccaataattactacccttcttttggagtatcatgctaccactactgggggtcatgccggagtagccaaaactttagcccgcttgtcagaaaattttcattgggatggaattcgggacgatgtagctcgatttgtggctcagtgcttggattgtcaagtcactaaatatgaagctaagaaatttgtcggcttgctctgtccgcttcctattctggcccgaccatgggaggacctctcccttgacttcattgtcgggctaccaccttatcacggtaacaccgtaatactggttgtcatcgataggttctccaagggcatccatttgggattgttgccaacctcacatactgctcacatggaactctttggtctcagtggcacgttgctcaagatgagctcagcataccatccacagagtgatggtcagactgaggttttaaacagggtgatagaacagtatctccatgcatttgtccatcaccggccgggaacctggggaaagctcattccatgggttgaatggtctaacaattcctcttggaatgtagccacgggaaccacgccttatgaaatcacgtccggtcgaaaatccttctccttctcggaatatgtggtgggcacttccaaattggacgttgtggatgaattgctaactgaaagggacgccacctttcaagctatacgccggaaacttgaaaaagctcaggagaatatgaagaagtttgcagatgttaaacaccgggaagtcatatatcagattctcgaacgcttagcggaagtagcctattgcttacagcttcctgaaggtgcaccgcattcaccccgtgcaattgatggacaacccatgatcaccctaatatctattatggactcacgacgccgttccaatgatgacaccgcttcgtgggaagtgctggagcaattgtgcgacacatatcaccttgaagacaaggtgcttttccaaggaccagggaatgatagagcagtagagacctcaagcacagacacagggacagggaaggaacttaccaacaaggatgaacagagggtgcagatagtagagaagcccaaccgaaaggtgacaaggcccgcatacttggatgattacgcataa

SEQ ID NO: 23486 - DNA, 195 bp, Glycine max
  Peptide Sequence Number=SeqID_140264
atggattcaccatgtgtaagtttgagtcaacttagtgatggtgtagtcaatgcggatgttgattttcttgaaattacaccaaagaaaaagactgaacggattaaagattgcaagaaggactgttctgctgtgattttatgtactatcaaacatattatgggtgatgaagaatggtggtatacaacctatacctaa

SEQ ID NO: 23487 - DNA, 673 bp, Glycine max
  Peptide Sequence Number=SeqID_140265
atgtctgggggtcctgaaacagcgaggcctcattcacggcgtgacacaatctcttttgatgacagtcgtttgacggctggaggtgggaaacgcgtcggtgcggccaagagacaaggggttggtgggtgggtcgtggtcgtgaggcgtgacgttgttccagcactttttcctcctgaatacgtgcaaggcccacgacttgcgctaagaccaagaggtaagttggccattgctctacatccattggaactaggcaagagctcgcctttccatataaaaggaagcgataatcagccggggaggatgtgtgtgactgagggacaacagggttggctgatggcgtggatggggcgagtgaggagccatgtcaatgagagcaccaaattgataggtgcaggggtctggcttcaagggccagtgcctctagaactaagaaaggagaagagaattagagacaattccaatcaagatggatatggagtagtgctggctggatatgttgaagctgtgattcaatccctgagagacaattccaatcaagatggatatggagtagtgctggctggatatgctgaagctgtgattcaatccctggtctctgctgctctatcaacggttaacataattaccataataggagtcatgcatctcatgcaacaggaaatgatcaacatag

SEQ ID NO: 23488 - DNA, 1450 bp, Glycine max
  Peptide Sequence Number=SeqID_140266
atggaagcatatcttgatgctaacgatctatgggaagcagtagaagaggactatgaagttcctcctttgccaaataatcccattgttgcccaaatgaaaagtcacaaagaaaggaggcttcgaaagtccaaagccaaatcaattttgttcacagttgtatctccaaaaatctgcaagtcatcacaaaaacaagagaatgtacaagctgttgttgaagaggtggatgaagaagaactttttgttgtttcttgctttgctactgcaagatcaacagaaagttggctaattgatagtggttgcacgaaccacatgaattacgataaagaattattcaaagatcttgatgcaacctacaacacaaatgtcagaattggaaacgaagaaaaaatagcagtgaagggcaaaggaaccatcgtgatagaaggttgcacaagtctgaaattaattcctgatgttctatacgtgcctgaaattaaccaaaacttgttgagtgtcagccaacttctaaagaaaggctataaagttctatttgaagataaaagttgcatgattaaagattcagataataaagaattattcagagttcaaatgaaaggcaaaagctttgccttgtatttgattgatgaagagcagcttgctgagcacaaggttgaagacaacacactggtttggcataaaaggatgggtcattttcatcatggcgctttgctctatttgaggaagaatgaccttgtacaagggctgcttgaattagaagagaaatcacctgtatgtgttgcttgtcaatatggaaaacaaacgaggttgccttttccaaaaggcaaatcttggagagcaacaagcaagctacagttagtacatacggatgtcggaggacctcagaaaaccccatctctgaatggtaggatagaacatcaattgacagcaccgtataccccacagcaaaatggggttgtggagcgcaaaaacagaacgatcttggaaatggcgagatatgtgctattctttgaagaagaaaaatggagcaaggaaaatgagaagcttcaagttcaggaggagagcgaagaagatgtggatgaccagccagttagaggaactagatctctctctgatatttatcaaagatgtaatgttgctgtaatggagcctgtagactacaatgaagctgcaactgattcgaagtgggtaaatgcaatgaaggaggagcttgatatgattgaaaaacatcaaacatgggagctcacggagaaacctaaagataaaaatgacattggagtgaaatgggtttatagaaccaagcttaatgctgatggttttgtaaacaaacataaggcgaggcttgttgtgaagggatatgcgcagatgttcgaggtagacttctcagaaactttttctccgattgccaggttggataccataaggttgttgttagctcttgctgcacacaaag

SEQ ID NO: 23489 - DNA, 825 bp, Glycine max
  Peptide Sequence Number=SeqID_140267
atgtctgattatgaagtaacagaaattgaagacccaattactcattttgctttgttttcagattgtgaccctacaacctttgaaagagtgaaatgggttttcaaaacaaaactgaaagaaaatggtgaagtggataaatatgaggcatgcttggtggccaagggttacaagcaacagtatggggttgattacacaaaagtgttttcaccagttggaagacatgatacaatccggtacatggagaatcctacaaaaatgcattttcttgttgctaaaagaatccttcgctacttgcaaggaacaagagaatttgaattgttttatagaagaggtgaaaagtttaatctattgggattcactgatagtgattatgctggagattcagatgatagaaaacgtacttttggctatgtttttatgatggggtcaacaacgatctgttggtcatcacggaagcagcctattatcactttatccataacaaaagcagaatttgtagcagcttcaacatgtgcttgccaagaaatttggctaaggaatattcttgaagaagttcacttcaagcaacaaggtccaactctcatctattgtgataatagttccaccataaagttgtcaaagaatcctattatgcatggaagaagcaagcacatagatgtgagatttcattttttaagggacctatcaaatgaaggaattattgatcttatctactgcaagagtgaagagcaaattgatgacatcatgaccaaaccattgaagttgtctgcatttcagaagctaaggaatttgcttggagtttgcatgcttaatgaatctcattaa

SEQ ID NO: 23490 - DNA, 534 bp, Glycine max
  Peptide Sequence Number=SeqID_140268
atgtctcgcaaagaaaacctcctatgtgaactgcatacaaagaaaggtacttggaagatagtcgtgcgaataactgatatgtggcgtcttaacaaacataatggtcgacaatccattgagatggtgttgatgaaccatacgggtacaaagattgtggcaactctatggcaagaattgttccctgaatttgagcccaagttgcgttgtggtggtgcatatgttattcagaacgtgaaggttgttgatactcattctgactacaaaacaaagtctgtcaaagaggtggacagacctgagattcctcctaatgttcatgccattacttcatttgctgatataatttcaggcgttgcaaaacctgatactttagttgacaagtattccctcagtgtacagaatataaagcatggttcgaagttgtatgtgaatggtgacattgtagaaatccaacagttccatgatagtttacgtgtgccattttatattggcggtctagatgatgagggtggtgtttctcagtcacagtctacctag

SEQ ID NO: 23491 - DNA, 564 bp, Glycine max
  Peptide Sequence Number=SeqID_140269
atgccacgtacaagaggtggtgaccgcaccagacctactacatctgtgtgtaggcacaaaagatgtgtagttgcagatgaggagcaagagatttacgaagctaccgaacatgttgcagctgatgatgttgcacctaaagatgttctatttggtggtggacctgaggataaattagtccttacaaaatctgatgatcacatggcttgtaaattatgggatgacttggatgtagacgagaggtggttgaattttgcataccacttggtcaggccaaatgagacaattagtgggccctcaggttgtgctacagttaataaagatgatattcctattgtcccaccagtgataccagacataagagatgtaccggagtcaacttcccaacataattcagtttatgacatttgtcataaggctgcggaacccttgcaagagatgatttacttaaggatggtactcatggtagaaatattagtagaggatgaggtggtagaagagtttagggtagttggggagaccatggacaagcttagagattacctttgtaaaaacttattggcatga

SEQ ID NO: 23492 - DNA, 474 bp, Glycine max
  Peptide Sequence Number=SeqID_140270
atgactaggaggattactttaaggaacctcgtgctggaggacgtcgggacacaatactctgataaatatgaaggttgcacaagggggagagggagggggagggggaaggttacggaccggcggtgccggaaggaagaagaaggtcgtgtgagaggggagggggagggaggaaggtcgcacgaaggggaaagggaggaggagggggagggtcacgagctgctgatgccggaagggagagggaaggtcgaacgatggggtagggggagggagaaaaatttttttccaaattcaaggctacacgagatcgttattgacgaaataggagggtcttcgacaaaaaagaagcctcgagtagtctttgcagttgaagaagatacgcacctcattagttcatggctcaacatttcaactgatccaattgttggtgttggtcaaggaaaagaagcgttttggttgagagtcacagaaaattaa

SEQ ID NO: 23493 - DNA, 204 bp, Glycine max
  Peptide Sequence Number=SeqID_140271
atggactgctgcaatactaaactactgaaatatcatacagatccaagaaaacttgagagactcgccagtgttgaactggctactctctccaatcggaggcctgcggaaagattggatctcctacgcataagagacactgctgagaggattagacggggcctgatatttctccgacaagaagaacaaggctgcagaattcagtaa

SEQ ID NO: 23494 - DNA, 324 bp, Glycine max
  Peptide Sequence Number=SeqID_140272
atgtcatgcttagtgcatatgccatttgaaaggaagactaatgaaccaattttgtttactgaaaattgctctaaaaggacaaagatttcgacatctaggacatattcgtcatcatctaatccagaaacaccggtcaaagctgatacaccgtctccaattgttcttccaatggggcaaaaggcagtcaaaaggaagagtaaggggaaaggagttggagcatccaccaatcctgttgatctgactagtgcggaggaagcagtgagggaaagaaatgttatcaacgccaaactagtagccttaagggagaaagaattggaaaaatga

SEQ ID NO: 23495 - DNA, 247 bp, Glycine max
  Peptide Sequence Number=SeqID_140273
ctggacgcttgatggcttgtcggtcactgacccagtactttgcttacctttggctctggacttggtcgcctattgctcggccatgggtcgtaagcaacgctctaacctttttgtggatgagctgaggctactgtggtgtttcgccctgcgcctgcctggagacgcagtacttcttgatgaaagctcgattagtaaggggcctgatgcccttgctggaggtgacaggcactccgtagaattgacagag

SEQ ID NO: 23496 - DNA, 165 bp, Glycine max
  Peptide Sequence Number=SeqID_140274
atgactgggtacctgactttattacagtgcgtcattgatgatgcgtacgacgaaacgaccccacgtgcctcccagtggcttactatgaaggctcatatgaaagggataacaggagtatcataccgggcacgtttaaatgctttgacaatcgcagacgtgtgctag

SEQ ID NO: 23497 - DNA, 269 bp, Glycine max
  Peptide Sequence Number=SeqID_140275
atgaggagcgcaggttgcttgagcaaacagaccaatggcttacacccacattccgctttcaaaattgccccatgtgtggcatcccttgtcaatgtcaggatttacacacgattctcctcaaatttcagccagcatcaattagacctcgcaccctacacttcagagccctacaatgctcaatggaacgccccggggcttctccgtgacaagcacacgttgcgttcgagtcgtattctcggagaaatggaggttgatgaaccttggctaag

SEQ ID NO: 23498 - DNA, 761 bp, Glycine max
  Peptide Sequence Number=SeqID_140276
gcaaatctgataagcctgctttcatcaatgcaaaaactagggcaaacgaagaggatgagaatgagggagaaacccttgctatgactgtcattcctacacggtcaaatttctcatcagcccaacaatgtcattactcaaccaataacagactacacgtcctcgcctttagaggactgcatgtccttgccttcagagggctacaagtcctcgccttcagagggctacaagtcctcgccatcagagggatacacaccctcgcaaacagagctgcacgtccttaccttcagagaactgcacatcctcgccttcagagggctgcacgccctcgccttcagaggacaacatgtcctcgccttcagaggcctacacgacagcacgtcctcactttcagaggagtgcacatcctcgccttcagaggactgcatgtcctcgcctttagagggcttcaggtcctcgccttcagaggactgcaagtcctccccttcagagggctacacgccctcgccttcagaggactacacgtcctcgccttcagagcattacacgtcctcgccttcagaggactggacatcctcgcctttagagggctacacatcctcgcctttagaggactccacgtcctcaccttcagaggactccacgtcctcgccatcagaggattgaacgtcctcaccttcagagggctacacgccctcgtcttcagaggactacacgttctcccctttagagggctacacatcctcgccttcagaggactacac

SEQ ID NO: 23499 - DNA, 171 bp, Glycine max
  Peptide Sequence Number=SeqID_140277
atgtgcgacttgccaatgtcaaagttgtctcttctttgttttcgaatccagactaaggcttgggtctttcatttgggccctgtggaccagccaatgcgtataagcttgggctttcttaacgtggctcatttgacgactcagtacatggatgtcacgagtctattggcatag

SEQ ID NO: 23500 - DNA, 342 bp, Glycine max
  Peptide Sequence Number=SeqID_140278
atgctagcaaaggcaattgctaatgaagctagtgttcaagtttcattaatgtctcaatgtcaaccatcattcacatcaaaatggtttggagaggatgaaaagaacattcgagctctgttcacactgcctgctaaggtttatagtatgattggacagaggactagaataggagagcatgaggccatgaggaagagaatgaaagacatggaaaagaagcaaagagaagaagaaggccagagctccgaagatgcttcaaacaataaagacaaggaagaacaagaaattaaagcgaggtctttaaacatggaagacatgagacaggctaagagtcaggtagggtga

SEQ ID NO: 23501 - DNA, 1002 bp, Glycine max
  Peptide Sequence Number=SeqID_140279
atgccaaccattaatccagttggtttgaaattcatggaaggcataataacatttatgatgatgatgttgcaggttgttgtttctgctcaagaccatattatgtgcattcagactgagagagaagcactcctccaattcaaggctgcacttctggatcactatggcatgctctcttcttggaccacttctgattgctgccaatggcaagggattcgctgctccaacctcaccgcccatgttctaatgctcgaccttcacagtttaggcctcagaggagagatccaccagtcgttgatggagttgcaacaattaaactatttaaacctcagttggaattcttttcaaggcagaggaatcccagagtttcttggttctctcaccaacttgagataccttgatctgtcacattctgattttgaaggaaaaattccaactcagtttggctctctttctcatttgaaatacttaaatcttgctgggaattattatctggagggttcaatcccacgtcaacttggaaatctctcccagttgcagcatcttgatctcagggccaatcaatttgaaggaaatataccctctcaaattggaaatctctcccagttgcagcatcttgatctcagctacaattcttttgaaggaagtataccgtcccaacttgggaacctttcaaatttgcagaagctttatcttggaggatcatattatgacgatgatggtgctctcaaaattgacgatggagatcattggctgtctaatctcatttccttaacccatctttccttcgactccatatctaatctcaacacttctcatagcttcctccaaatgattgccaagctaccaaaacttagagaactgagtttaattcattgtagcctttccgatcattttatcctttcactgaggccctccaaattcaatttttctagttctctttccagacttgatctttcctggaacagcttcacgtcatcaatgatactccagtggctgtccaac

SEQ ID NO: 23502 - DNA, 1569 bp, Glycine max
  Peptide Sequence Number=SeqID_140280
atgggcatcgggatccctttgttgttacatgatgcaacaatcaacaaaacatttggtcactatgtgagaattttagtgaacgttgatttagccagggacttgcatgatcaaatcttgattgaaaggaaggactatgctttcttcgttgatatagtatatgagcatttggctttgttttgttcctcttgcaaggttgtagggcaatctcatgacaattgcaagaagaaagagaaagatgttgttttccgtcaggaccctcaggtggaatccaagaagaagcatatcgatcaaccccaggaaaagaacaaggctattgttctgcaaaatgacaataatgatgcagtgggagaggtccaaaaatttgttgtttctagtattgtcgatatccaagatgatcttaactcttgtaaggaatcgttacatctagaatctcttgtgatgaaggctctagttgaagatgtcagtacccaacgtattgctgaggatattggcaatattaaaggcctttggggcgatatttcccaacagaagaaactcaagaagaagtccaaggatactaaggctcggacctctgtccctcgaactcgttccagagctggccccaaaaatcatacggatgaaggccatttacttgaacgcacggctgaaccatgggttgattcctctacagttccaactcaattctggaagaatttaaacctcaaactttttgctctcaatgatcagggtgaaaaacctggcccagcttcctttcgatttcagaagatgtggttggagcacaacgactatgaacaacttgtctctactacttggaaccaatccattgctggttgtccaatgtttgtattgggtagcaagcttcgtctctcgaaacaagcctttcgctcttggaataaatgttgttttggcaatgttcatgataatgttaaagcttgtcaagatgtggttaatgttgtgcagcgtgatattgacacttcggtttactctgatgagttgaaagatagggaatctcaagctcagattgaccttgaaaagctttatccatgcagaggaaactttttggaggaaaaggctaagaggatgtcagttcttcaaagtggggatgttatgatggaatcccaagaagctctggatgcctggatggatttggggaatgttttttccaaaggttctggcatattgttggttaatctgtctttcaagttgttcttcaacgctttcaacaggtttaaaatcattacggaagtcttaactgatagacttgcaaaaatagcccccaagatcctttaccccgatcagagaggctttgtgaaaggaagacatattagtgactgcatttgtattgcttttgaagtagtgaaccttctgaaacaccgttctattggagttcttagtgcttttgggtttgatcataaatttgttcagtggattcttgctcttctgcattttgcaaagctctctttcgttgtgagtagcaaggcagcaggttattttatcttgtcaatgggggattcatcaaggagatcccttattccttcttctcttctgtttggcagaagattcttgtag

SEQ ID NO: 23503 - DNA, 234 bp, Glycine max
  Peptide Sequence Number=SeqID_140281
atggccactttttggatgtttccaggcttgagctcgcctaggccagcatctggcttacctgggccatggaatgccttcatccttaagcaaccagctcttctgggcgagttgataccttcagctccatgcaagggaagggtttcaaggactgattctggtgtaagctccattggagcttgtaggcctaggatcttcttcattaatggattcctttgcttcttggaagatgaatga

SEQ ID NO: 23504 - DNA, 516 bp, Glycine max
  Peptide Sequence Number=SeqID_140282
atgataggtctaaaggaatatattgtagccaatccggcactcctccaacaatatgcaactactatccattcccaaatctccaatgcttctatgcccaaccctgaatttgtagatgcagaaatccaagatgagttttatgatgcaatttctgctgagtcattatcatctgatgaagaaagtgaagaggataaggaactagatcaggtttggaacaaagaaaaggggcataaagtcaaactaaagaatgtttcttgggccatgacaacattagctttgaagcgaactacaggtctaagcaaagaattagatcccgatgcaagttctattacaattgatgtgagtggcaagttcggctctttgtgcaaaggtgttgatgagaatgacacaaattgttggacttctcctagtggtgaaggatttatgattagaggaaagaactatctaaaagataattctaagaattcttacaagcaatcaaaagcaatctcagttcccatcccagaaaaagggacttag

SEQ ID NO: 23505 - DNA, 3009 bp, Glycine max
  Peptide Sequence Number=SeqID_140283
atgactcttgaagagcttgtcaaaatccttaaagttcataagcaagaccttgctcaagataacggaataaagaaagggaaatcactatcaaaaaccaaaatgcaaccatgcatccaaggagtcatcgtccaaagcctttgtcaaagatatggtgaaacaagaacccctccaggttcaacaaatcatccaaaagatccttccacaagaaagagaaaagttcaaatctactataagtacaagaaactagggcacttcatgtcgaaatgtcctaaccttgcaaagccaaaagataagaaaaagaaattcttcaagtccaaaaagaggagcctcatgagcacttggggagacttcgacgattcctcgtccaatgaggatagtgaggaagaagccaacctatgtctaatagctgatgcgtccaccagtaaagcaaaatcagcattggacgtgagtttagacaatgaggactctcagcccaaggatactttcaactctgatggtgaagaggtaatatttgaatctagagaagacttaattaaaggatacaatcaactcttatttgcctctgcttgcgtcactaaagcttatagaaaattaaataaacattttcaacatcttgaaaaagagcatgaggatctcaggaaagctcataaagttcacttagttgattttgtcttggaaacctctttgcctagcagtgaaaaagatacttgtgtttgtgaggaagtcaaagcactactagacgaaaaggtattcagtggacgaaaaactcttcttaaggattttcaagacatggaagaaagggtaaaatcattaaccacaacttttgaagatttagtagaaggacacaaggaaatgatcaaacaaaaactcacaaatgcaaggacctccttgaaagaagtcatagtttgttatttatatggaaaagtaggtcatgaaactcacaaatgcaaggacctccctgaaaagggaaacccatcaaagggttcatcaagtgcttaccagcacccatatgctaaccaaagaaaagaacccaaaaagatttgggtacctaagagcaaaataattcttgttatagatctccttgatagccagaaagaaacaccaatcatggaaaaccttggaaagcttgactccaaatgtgattctaaaatcttactcgaatactctgaatcatccaaggcatatagagtgtacaactctagaaccttgactgcagaagaggccattcataagaatgatatatgcatgcttgtagaacttcccaaaggtaaatcaacttttggagctaagtgggtgttcagaaaaaagctggatgaaatgggtaaagttgtgaggaataaggctaggcttgtagcaaaaggttactcacagcaggaaggtatagattacactgaaacctttgctcctatttctcgtcttgaggcaatatgcatattactatccttcgttgttcatcatgctatgatcttgtatcaaatggacgtaaaaagtgtgttcctcaatagtattattatggaagaggtctatgttgaacaaccccctgagtttcaaagttctatctaccctcgtcatgttttcaaattaaataaagctttgtatggactaaagcaagctcctcaagcttgcaagaaacaaggaacaatagctctatcaacagcaaaaacaaagtatatatcagccacaagttattgttctcaactcttgtggaccaaatatcagcttgaggactacaacttgtttgagagtaacattcctatcctttgtgataatattgctgccattgatctgtctaaaaatcctatcatgcatttgcgtgccaaacgggtagaaataaaacatcatgtcataagggtgttcagaagggttaatctcgttaagagaaaggcttggcatgctccctgtggaatgaagtttcaaatctatgtgaaagacttcaggaacaacccaccttttgcttcatccaaagaaggtgaagttgtacaaatccccagacctacaccaatgtctatcattgctgcaaaagtctcagtgaaagacaaggagcctaaggtttacattgaacacttcttcaacatcgattcatcggagattgttggctacgtcatcaaggcacgcctcatgttatgttgcatccaccatttctttgaagaccctaaggtggtggtgcctgaactcatctgcgagttttggaggacagccaaggacaatagcattgagaaggacatctatcatagcattgtcctaaccaaagtcctagaggctcatggagtaataaggaaattcttgtacgagactcctaaagaacagactcccccagtggatgaatccattctttctgaaatccaccagaaatttagactcaacactggacgtgatgaccagttgaacgtagtatggaaaactactaatgaagaccaagtagtggacgtagacgcaatggctactcaaattgaaaaaagaagtaagaagaagatggatgcactttcgtccaaggctgctcctacaccccaatgtccaccaccctctctagttgctcccaaagcaacaggtgccatggcccatgtctcaagaagggcagtgtctaagaagcaacaaccatcatcaactacagatcacttaagagagctaagtgaaactgatgatgatgaagatggcttggtgtttagaaaatgcaaggttgcaccacctttggatgatacctttatgcctcaagtgaagaagcgtctcgtaaatgagcaagttgatgttgctgctgctcatgaccctcaatatgctaaaatccctcccattcgagaacaaacctccacaatccaacagtttgaacacagtttaagaagaactgggattattcacctcaagaagaagaagataactaagtccaatgatgatatggacgatgaagttccactacaagcacctccatcacccatccaccttaaccgcttcgtttatcaaggaccacttgccatagaccccaatctctccgaagaagatcttgcacggttatga

SEQ ID NO: 23506 - DNA, 555 bp, Glycine max
  Peptide Sequence Number=SeqID_140284
gtaattggaggtgaccctcttctcaagctcatagcagttgattggttaaaagtcgacaaatctatagacagaattgcactacaccatagaagtttggttcagtctgaagcagggaaaaatctcccatttgtcttcgtactcaatctacaggttccagctaaaccaaactacagcttggtcctatattatgcatctgacagacctgtaaataaagattctttattggctaagtttttggatggaaatgacatgtttcgggactcaagattcaaattaattccaagcatagttgagggatattggatggtcaagcgagctgtaggaacaaaagcttgcctactagggaaagctgtcacttgtaaatactttaaacaagataatttttttgagatagatgtagatattggatcatcctctgtagcaaggagtgtcattggccttgttctaggatatgtcacaagcctagttgttgaccttgcaattttgatagagggaaagggattctcatatgatctagggtcaaagatgtttatctatacattttttatgggataa

SEQ ID NO: 23507 - DNA, 213 bp, Glycine max
  Peptide Sequence Number=SeqID_140285
atgaaagtttgtatggaaatggccccgaggaagcttgcctcaaagagatctaggaaggataaagcggctgaaggaaccagttctgctctcgaatatgacagccaccgttttaggagtgctgagcaccagcagcgctacgaggccatcaagggatggtcattcctccgggagcgacgtgtccagctcagggacaacgagtataccgacttctag

SEQ ID NO: 23508 - DNA, 336 bp, Glycine max
  Peptide Sequence Number=SeqID_140286
atgggcgtggatgctgatggtgatggtatgtcttcgatctcgggtttgacctcgatgacaaagacaccggtaacttggtcggggtcgagggagaatagtggcttgcgatggtttgtggtgttggttagtggtgggtttcttggcaagttgcggtggtttccttcgatgacgttggtgtggccacaacggtgtcgtcgtcgttggctcagtgctggaaacgaatcgaggtctgaagaggagactagaaggagggaagactttgacatcgaggtcgtcatcggtgttggctccggtggcgccgacgattggaggaggattgtgaaagagaaagcggtg

SEQ ID NO: 23509 - DNA, 390 bp, Glycine max
  Peptide Sequence Number=SeqID_140287
atgttggttttgttagcatcctatgccacacatcgaatagggctttttgctctctttggaccttttgtgttgggcttggctaccccagaggggcctccattgggcactgccatcactaaaaagattgacagttttgttaattgggttttgatgcctacttttgtgaccacatgtgcaatgagggtggacctgagagacttcatgaattggagagaaaagatgaatggaggaattggtgaattcacggtgcaaaccctggcactttgcctcctttgtgcagcaacatgcaaaggcgtggtcgaaatggctggatactctttggtaagagatgtcatgcaatttaaaggagagtgttgtttgaaagagtatgtcaagagactatgttactag

SEQ ID NO: 23510 - DNA, 513 bp, Glycine max
  Peptide Sequence Number=SeqID_140288
atgaattgcgttttcgttcatgtgtcctccaccttcgagtttggagccatgcgcagtgattgcttagtgcaattccccattcacaatctttttcggagccccatgaattgcattttcgttcatgtgtcctccaccttcgagtttggagccatgcgtagtgattgcttagtgaaattctccattctcacccttttgcagggcctcatgaattgcgttttcgttcatgtgtcctccaccttcgaacttggagccatgcgtagtgattgcttagtgcaattctccattctcaccttttttcggagccccatgaattgtgttttagttcttgtgtcctccacctttgagtttggagctatgcttagtgattgcttagtgcaattctccattctcaccctttttcacagacccatgaattgcgttttcgttcatgtgtcgtccaccttcgagtttggagcgatgcgtagtgattgcttagtgcaattctccattctcaatcttttcggagccccatga

SEQ ID NO: 23511 - DNA, 255 bp, Glycine max
  Peptide Sequence Number=SeqID_140289
agaataaccaagaaccctaatgtgaggctcactgtggttaggtttctggctttgagtgttgagttgaacacaaaggattggcagggaatgcttgacactgagattctgaatgatatagaggagaagaagaagtgtagtgagtatccagaactttgggtgttggaggatttgttggcttcaatagatgatgttggcaaggcttctgtgtttatcatgcagcaacagagaagagaacagacaaggatgcttgaataa

SEQ ID NO: 23512 - DNA, 450 bp, Glycine max
  Peptide Sequence Number=SeqID_140290
atgtcgataaatggcttgaatcctattacttacggcaagaaattgaaaacggataatcgaaaacagaaaatcttgagaactattcgaaactcagaagaattacgggaaggggccattgaacagctggaaaaagcccaagcccgcttaaggaaagtcgaaacggaagcagatcgttttcgggtgaatggctattctgagatcgaacgagaaaaattgaatttaattaattcaatttatacgactttggaacaattagaaaattacaaaaacgaagccattcattttgaacaacaaagagtgattaatcaagtccgacaacgggttttacaacaagccttacagggagctctaggaactctaaagagttgcttgaacaacgagttacatttacgtactgtcagtgctaatattggcatgtttgggacgatgaaagaaaaaataactgattag

SEQ ID NO: 23513 - DNA, 477 bp, Glycine max
  Peptide Sequence Number=SeqID_140291
atggattatcggggacttaatgccattactgttaaggataggtttcccataccaacaattgatgagttgggaggcgcttgttatttctcgaagttagatgtgttgcaaggctatcatcaaatactaatgagggagaaagatgtgagcaaaatggtgtttaggactcaccatggccactatgaattccgggtcatgccttttggattgtgtaatgcgccaccttccttccaagctaccatgaacaacgtgtttcaaacttaccttcacttgggtggaatatttgggccatttggtgtcaagagagggggtggaaacactacaggagaaggttcaagcagtgcaacagtgtcccattccttgatcagtcaaagctttgcacggtttcctcgggttatccgaattcgattattgcttcatcaagggctatgcgtccaatgttgctcctctaacccaaatcctggcaaagggtcactttaa

SEQ ID NO: 23514 - DNA, 1029 bp, Glycine max
  Peptide Sequence Number=SeqID_140292
atgcttcagccacattacatagctcgttccgtagcactcctattcatggagatggttggaaagttgcacgggatgcctcgtagcttggtctcagaccgtgatcctttgtttatcagtcggttctggcaagaattgtttaagatgagtgggacaacactgcggatgagttctgcatatcatcctcagaccgacggccaaacaaaggtggccaatcgcgtcgtggaacaataccttcgagcgttcgtgcatcaactatcatcatcttggggaaggttcctgctttgggctaaatggttgtataacatatcacaacattcaagcactgacctgccaccatatgaaatcactttcagaaagaagccaccaagcattcctcagtacatcgcggggacatcacaggttgaggttggagacgattttatgacaaatcatgaggctgtgtttattagcttgcgcaagaagctattgaaagcgcaggagtccatgaaacagattgcggatgctcatcgcaaggacaatatttttgaagtgggagattggcttttgattaaattgcaaccgcgccatcaagtttcggctacgggagaacccttctctatgctagctaagctcttctatggacccttccagattctccaaaagattgacatggtggcttatcgggtaaaattaccaaaaggttgtcgcattcaccccgtgttccattgctttcttttcgagccttttcagtcttcttcaacccttcatgagcccttggtggagctgccacccatggtgaaagataatcagaccgtgatcaccccacttatgatacttaacactcgattaccaccaaaagaaacaagttgggaagaatcggagaccttgaaggtagagtatcacctagaggacaaagtgtttttcgatgaaggaggaaatgttagcaggaaggagaaggaccagttgtgcaccataccactcacgaaaaataacaacccgagaccaagacgaaagataatcccgccacgacaccttgctgatttcatttaa

SEQ ID NO: 23515 - DNA, 258 bp, Glycine max
  Peptide Sequence Number=SeqID_140293
atgtcattgccttgcgctgttcatgtgtcctccatcttcgagtctggagccccgcggatgtctttgcctagcgctgttcgccaattctccattctccacttttactcggatccccatgaatgtcattgcctggcgctgttcatgcatcctccacccaaagagtttggagctatgcttcatgattgcctaagtgtggaccctctagtgcaatcctccattctcctcttttttcggagccccatgaatgtgtttgcctag

SEQ ID NO: 23516 - DNA, 245 bp, Glycine max
  Peptide Sequence Number=SeqID_140294
atgacgaagcgcggaggagaagagaatgcaaagggacacaacctcgttactggaatttttgccacttcaccaaagatgttgggtgtaccagcagttgggttggtgcccaaagaaatgcccaataaaaaattcatgtctagaacaagttccaagcccaaacccaaaaatctcaaatctgtcagtgatagcatcgatccaaatctcgtcgatggctacattgatccaaactttgtgaaaatcgtcaa

SEQ ID NO: 23517 - DNA, 156 bp, Glycine max
  Peptide Sequence Number=SeqID_140295
atgtggaaggaaagcctgcggcatcaaagagagtccttaggtgactgtgtatctgaggcaagagggatgaagaggctggcacaaaagcttctgataggagtattgatgcggagaaaggaagggctagaaaagctgcagttgaggtttttctattga

SEQ ID NO: 23518 - DNA, 144 bp, Glycine max
  Peptide Sequence Number=SeqID_140296
atggggaaagttatcgaagctttcatttgtaacgctgaaagagattgttacatgttagcaaaagaaggagaaaaagaaaaagaacccttgatctctaaaccatctataatggtcattgtcctcaaatcacctaattacaattaa

SEQ ID NO: 23519 - DNA, 342 bp, Glycine max
  Peptide Sequence Number=SeqID_140297
atggcaagtggtgcttattgccttcaaatctttaaatttatacttgcggatcaagttgatccacatgatttgcgaatcaagttgatccgtgagcttcgtgcggatcaagttgatctcgatggaagacggaagcttacctcgatgaagaacgaaagaatggagctcgctgaagaagaagaagaggcactcctaggaagacggaggaagacacgggagaaaacggacgaagacgcgggagaaagaaacagcagctcgtgggagaaggaagaagacgcggatgaaggtggaagaagaagaagaaaagcctcgtgggagagaagaaaagaagccctgggtgcctga

SEQ ID NO: 23520 - DNA, 219 bp, Glycine max
  Peptide Sequence Number=SeqID_140298
atggctagcaattcattggatgccaaactccttgtaggtcaagaaaagtgtgcgaggtatggagggggaggaaggagaagacaagttgagacaaatcttcatgatgatgtgtccgaaaatggaagaagaggcatcccttcatgcaagaagaatgtggaattgcccagtttcgtgggacatgaccttttaggctggatagctagagctgaaaaattctga

SEQ ID NO: 23521 - DNA, 390 bp, Glycine max
  Peptide Sequence Number=SeqID_140299
atggttagaatcagaagattgtatcggcctttaggcagagttttagaaagagtcttaagtagacatgttagtggtgatgaggaaaaagtcccccagcatcgaaggccaacaacatcaatatgtaaacaatgggcagttgcagctgtcgtagaggatgttgagaatgtggataatgctgctaatgagcctcacaaggagcctcatgatccagttacaaaggatgaacgtattgagttgaagttggcttctcatggaagaaagttggagaaatttggaaggcctacacttgagattgaagacatcgtggttgctataggattaagttctctgattacatgtttattggagacaagtgacaagagacttttatctacttttgcggggaggtga

SEQ ID NO: 23522 - DNA, 342 bp, Glycine max
  Peptide Sequence Number=SeqID_140300
atgtgggaagttgttgggcttaacatgtgggaagttgctaggctttggagtttaattaagccaaaattttatcaggcaaaacgaaaaactaaggaatcaggtaaacactactccaaacatctcaatctctctcattatgcaattcctcctcaaatggatctatgcttgaaagatctctcaactgccaagagaatttcagacaacttatgcacacttgcaatggacaaaaccacaaaggaagtacttgaacatcaatattcaggaagtctagaagcaaaggaagcaaaagcatatgccttgctccgtgctataaaatgggcacaagagttaaacatctcaaag

SEQ ID NO: 23523 - DNA, 636 bp, Glycine max
  Peptide Sequence Number=SeqID_140301
atgtcccatcttttggaatttgggatgatcgaccctctcaatgagtcaatctcttgctttctcaaaagggtggacccttgggtactagtaccctcaccttccgaggactacacgtcctcaccttcagagggccgcacgccctcaccttcaaagggctgcacgccctcgccttcagaggactacacgtcctcgcctttagaggactacacgtcctcgccatcaaaggacaacacgtcctcgccatcaaaggactacgcgtcctcaccatcagagggctgcacgccctcgcctttagagggctacgcgtcctcaccttcagagggctacatgcacgccctcagaggactacgcatcctcatctttagagggctacatgccctcgccttcagagggctacacgccctcaccttcagaggactacacgtcctcacctttagaggactacacgtcctcgccatcagaggactacacgtcctcgccttcagaggactacacgccctcaccttcagaggactacacgtcctcacctttagagggttgcacgtcctcaccttcagagggctgcacaccctctcctttagtgggctgcatgccctcgcttttagagggttggacgccctcgccttcaaagggtga

SEQ ID NO: 23524 - DNA, 1971 bp, Glycine max
  Peptide Sequence Number=SeqID_140302
atggggtgcgtgagctcgaagcaagcggtgtcggtgacgccggcgattgaccactccggcgcgttccggagcaatgcgggtggtctggccgagccggagaagaagaggagcaagaagaggaccgagtctggtggagcgagtcagagcgaggtaggtgagtcggggagaacgagttccaattgcgactcgctcagcttcaggctggggaacctccacaagtacgtgcagggcgaacacgtcgcagccggctggcccgcctggctcagcgccgtcgccggcgaagccattcacggctgggtccccctccgcgcagacgccttcgaaaaactcgagaagatagggcaggggacgtacagcagtgtgtttagggcgagggagcttgagacggggaagatagtggcattgaagaaggtgcggttcgacaatttcgaaccggagagtgtgcggttcatggcgcgtgagatactgatcctgcgacggcttgatcaccccaatatcataaagcttgagggtttgattacttcgaggttgtcgtgtagcatttacctcgtgtttgagtacatggagcatgacattacggggctcttgtcttcccctgatatcaagttcactgaaccgcagtttttacttggatattttgggtacataaagattaagtgctacatgaagcagttattggttggtcttgagcactgtcacttgcgaggagtgatgcatagggacattaaggggtcgaatcttttggtgaataatgaaggggttttgaaggtggcagattttgggttggcaaattttgtcaatcctgggcacaggcaacctctgactagtcgtgttgtcaccttgtggtaccggccgccggagcttttgctcggttcgacagattatggtccagctgttgatctctggagtgttggctgtgtctttgcggagctgcttgttggaaagcctatacttcaggggaggacagaggttgaacaattgcacaaaattttcaagctctgtggctccccaccggatgaatactggaaaaagtctagacttcctcatgcaactttatttaagccacagcaaccatatgatagttgccttcgacagtcctttaaagatttgccagtgaccagtgtacatctgctacaaacccttctttctatagaaccatacaaacgtggaactgccacatctgctctatcatcagagtatttcaaaacaaaaccttatgcgtgtgacccatcaagcttgccagtatacccacctagcaaggaaatcgatgcaaaacacagggaggaatcaaggaaaaaaattagcggacgagtgcgtggaactgaaacaagaaaaccgtcaagaaaacctctgggattcaataaactagccccagcagaggatttggcaagtcaaactcagacttcccataaggtcaatgctagatctttccgtgtccttgaagaggagaggactaaaataggtgacaaagcacaaaagccatcaagtggtaaacctgaagatgcttctcatgtgaagaatgcttctcaaggagatattcccctttctggaccattacaagtttcaacatcaagtggctttgcatgggccaaaagccgtaaagatgacacttcatttcgatcccattgtcgaactatttcaagaggacatactttcaatccattagaaccttgtacattaaattcaaggaataatttggacaccagaaaccaggaaaataaggagttttctggaggatgcaccaattctaggggccatgaccttcttgaaatttctaaactttcaatgcagaatcaatggagtaagtttgatcgcccagattcatttgatgcttcagatgagtaccattcgcaagaattgtctatcgccctttatcatagagaagattcagcttccaagagaagtaacctgagattgatacaggttactcagggaaagagggaatcaggaatttattatgcagggaattaa

SEQ ID NO: 23525 - DNA, 273 bp, Glycine max
  Peptide Sequence Number=SeqID_140303
atgacggtttccaaactcagaaatgatgcaaagggttcctctcggtgtggggttttaacggagaacaacggcgctttgtggtggctaatggtggctgtggatgatggagaaaaagcttgtcacgttggaaatggttttggaagaaagaaaggagaagaaatggcatttttccaaagctacttggactacaaggctcaaaacgcacaagtgagcaatgctctcggaaatggaaacgtcgcgcacactccagacatcttctcaaagatcccaatg

SEQ ID NO: 23526 - DNA, 99 bp, Glycine max
  Peptide Sequence Number=SeqID_140304
atgagtatctcatcctccaccgcttcaaccagaatcagatatccaattgtgagaccacctgcaatcatccaattcagagcagctttccacaatgaccag

SEQ ID NO: 23527 - DNA, 297 bp, Glycine max
  misc_feature (131)..(131): n is a, c, g, or t
  Peptide Sequence Number=SeqID_140305
atggaagccaatgcggttacaattgccgctaccagcattgttgctaaggtgaacccgatgcccccatctggcctcaaccaaatgaatcatccaaccttagatatgataggcaaagatttgggaagtagggncggcccccattatgcgcaaaacaagcatgccttcccaccatatggcttgcctctcaactatacgccacccaatgtggcgtacactcctaataagaatgtcaataactccattcctatacccattgagagccaacaaccccaaactgatcatgcacctgtctcttaa

SEQ ID NO: 23528 - DNA, 1515 bp, Glycine max
  Peptide Sequence Number=SeqID_140306
atgaaagaagctgtagttttctaccctgcacctctcataggtcacttagtctccaccatagaactatgcaagttcatcctcactcaccaaccatccctctctattcacatcctcataaccatagcaccctacgacacatcctccacttccaactacatctccaccgtctccaccaccctcccttccattactttccacaccctccccaccttcacccccccacaaacccttctctcttcctcactcaaccacgaaaccctcttgttccatgtcctccaccacaacaaccctcacatccaccaaaccctactttccctctcccaaacccacaccctccatgccctcatcgtagacatcttatcctcccaatctatttccgttgcttcacaactcaacctcccttgttaccttttcgtcccagcaagtgcttcactcctcgctgcttttctctaccacagcacactccatgaaacctaccacaagagtttcaaagatctcaacaacacctttctcaacattcccggtgtcccaccaatgccagcgagggacatgccaaaacccttgctcgaacgcaacgatgaagtttacaaaaactttttgagttgtagtcttgcagcacccaaagccgcaggccttatcgtcaacacgttcgaagctcttgaaccaagtagcaccaaagcaatttgtgacggtttgtgcttaccgaattccccaacctcacccctttattgtttgggtcctctagtaaccaccactgaacaaaaccaaaacaactccagcgaccatgaatgtttaaggtggctggacttgcaacctagtaagagtgtcgtgtttctctgttttggaagcttgggtgtgttttctagagagcagctatgtgaaatcgctatcgggttggagaaaagtgaacaacgatttttatgggtagtgcgaaaccccgttagcgaccaaaagcataaccttgctttgggaacacaagaggaccctgatttggagtttttgctgccaaagggtttcttggacagaaccaaagaaaaggggttagtcgtgaaaaactgggtcccacaagcggcggtgctgagtcatgactcggtgggtgggtttgtgagtcactgcgggtggaactcggtgcttgaagcggtgtgtgctggggtgcccatgatagcatggccgctttacgcggagcagaggttcaatagggtggtgttggtggaggaaatgaaggttgcactgtggatgcatgagtctgcagagtcgggttttgtggcggcgattgaggtggagaagcgagttagggagttgatggaatcggagagaggtgagcgagtcaggaaccgagtcagggttgcgaaggatgaagccaaggctgctacaagagaaggtgggtcttcgcgtgtggcattagacaaacttctcaagtcatggaaagaaagagacaaagttatgtctgaccagagtcacatgcaatgtaagttgctaccgtcttcttttttgtttgggaaatatgagaattag

SEQ ID NO: 23529 - DNA, 1589 bp, Glycine max
  Peptide Sequence Number=SeqID_140307
caaagcctttccaattgctgaaagtgatggttgcctttggaaagaagttgaaagacagacaaattcaagaatggcaaggatattacataaactacaaactcatgaagaagcgagtcaagcagtatgcccaacaaattcaacttggagcactagatcggcggcatgtactcaaggatttctcacgaatgctggataatcagcaacaaggactcttggcatgccagataacaaagcttggagaacaacgtgatgctcttcaggaggagcctgaaataagcaaaataattgaattacgagaagcttatagagcattgggacaagatctattaaagcttctcttttttgtggagatcaatgctattggtttgcgcaagatattgaagaagtttgataaacgctttggctatagattcacagattactatgtcaaaactcgtgcaaatcatccttactcccagctgcaacaagtgttcaagcatgtgggattgggagctgttgtgggggccttatctcgcaatcttcatgatcttcaggaccgtcaagggagttacttatcaatttatgatcaacctacccttcccctccaggcaggctgctggttaggtatccctgtagcagcacatggttggtggggatttttcatcatatatacttggtcttgtatgcaggatccagtcgtggattcaataaatgcagctgttgataggttaaccaactcgacaaacttccttaactttttggggcagcatgcactcattatgcaagaagagctgcctagccctactgaggaacatgttgatgatcaacgataccattttatgtctcttctcctgaacctggcaaacacatttttatatatggtcaatacatatattattgtcccaacagcagatgattactctatgagccttggggccgcgccaacagtttgtgggattgtgattggggcaatggctgttgcacaagtgttttcatcagtgtattttagtgcatggtcaaacaagtcatactttaggcctcttgtattcagtagcatagttctttttcttggaaatatcttatttggttctgccagagctgttaaccggcgatatatcagtgattgtgtgccgttaaaaatccgcatgcaagcatcagcaggttttgttagtgctagtgctcttggaatggcttgtggtcctgcattagctggcatactgcaaattaattttaaaatttccaagcttacatttaatcagaataccttgcctgggtgggttatggctgttgcttggctgatatatcttgtatggttgtggatcacttttaaggaaccttctcgtgaagctgaagaggatcactccccacatcaatcaaatgatgaagtaaacaatgcacttgagaaaggcttaaaacaaccattactgattagttcagagaataaggtagatgaagatgctgaccaagattgtgatgatagtgaagaagcaccagaggaatctcgccagccagtgaattcaattagaatggcatacagactccttacaccttctgtaaaggtttgtgagcaacttcctgtcaccgctattatattggatttctatctataa

SEQ ID NO: 23530 - DNA, 567 bp, Glycine max
  Peptide Sequence Number=SeqID_140308
atgggaacggagaagggagcaatggaagactgggtggatatgtgcgtccggtgggagattgagtcgataggcgaccagaccaatgcgttcaacaatttgaaatgggccaaagaagcgcttagagagttttgggtggcacggtccggtgaccgacgtctgtcgtcttgggcgcagcttgacatatacccattgcccctattcgaagtgcaattgttgacgagactcaagcaaggtttggacaacttcgttattcgtcatgcccgtgacataatcgaggattggatagatactggtgccatgtggatggttgatcatgaacgaagcagcggaggtattgctcaagtattcggttcatcaccttcgtctggccatcggactgagggtgacggtgtcaatgaagaggccggcgaccctgaacgctgtgaatcccgtgggaagagcacccaaatgcacccccttcaagaacctatctaccacaaccatgatgacagtaaatccgttagaggtaacacattctttaataaacctcttaacatcctattgaaggttgagccagaaaaaacttga

SEQ ID NO: 23531 - DNA, 1827 bp, Glycine max
  Peptide Sequence Number=SeqID_140309
atggctgaccacggaaccaggaaaacaacaactgatcgccttgaagaagccattgtgaggctctctaatggccatgcttctatcaatgaacgttacaacgaccttgcgggcaaggtagactccattctagagcaccttcgttccaacgattccggcaaccacacaaacacacctgccacaaaccatcatagccatcaatgcaacacagttaaactagatataccgcgttttgatggacgcgatccattaggccgaatcttcaagatcacgcagcttttccaatatcaaaatgcacctgaggaagaacgaatcacagtcgcatccctatacctcgacggcgccgccttaaactggtgcaagggtcgagtgttactcttcatcactgacgaacagtcacaaatcaatgaggccattgaacctgaaccacaagatgatcagacagcagctcacgggaactctccaaaaccgataccggaggcggtctgctcacacatcagtcttcacgctcttggtggactaccctcatcggaaaccttccgaatctttggcaccattaaaaaagcacgtctcacagtcctgattgatagtggaagtactcataacttccttcaaccacgaatcgcgcaattccttaaacttcttctacaaactactcatcccctccaagtaatggtgggcaacggttctacgttagccagtgaccaggtttgtcctgaaactcaggtcactatccaaggtcaccccttcgtggtctccttccacttgctccagataagtggtgcagatgcagtgttagggatagattggttgaaacacctgggtccagttacgactgactacgcagaatgcatcatgcattttaaccacctgggtcgagatatcacactcaaggcagatgttaatcttgggcccgaaccagcctcagcggccgaactgaagcacttcatccaaacgggttccacttcggccttataccaactacacctcctacccacggaccaacccgacccaaccacgaccctacaccctttcatctctgtggaacacctccttcaccaatatgagcacgtggttcaccgtatcacccttcatcccttcactaccccaatatccgttcgaccttaccgctatccacacttccaaaagaatgagattgaaagacaagtctcggacctcctcgtcgccagactgatcagatcgagtaccagtccttattcttcccccgtactcttggttaagaagaaggacgccacttggcggctatgtgttgactacagagccttaaactcagtcaccattcgcgaccacttccccattccgacaatagatgaattgcttgacgaattgggccatgcttcgtggttctcaaagctggacctccgacaggggttccaccagatcttgatgagtgaactagacatcgagaaaacagccttccgcacccataatggccacttcgaatatttggtgatgccctttgggctctgcaatgcaccttccgctctgcaatgcaccttcaacattccaatccgctatgaaccaactcctgcaaccattcctacgaaggtttgccagagtttttttgacgatatattggtttatagtgattcgttatcctcacatttataccacctggagattatatttcaagccctccaacacgctgagttttaccttaagcattctaagtgcctctttgctcaagaatccattgaatatctcggccacatcgtgtctggcaagggtgttactccagaaccctccaaggtccaagctatgttgcagtggccaccaccaacttcggtccgagaactacgtgcattctaa

SEQ ID NO: 23532 - DNA, 300 bp, Glycine max
  Peptide Sequence Number=SeqID_140310
atgaagcgaagtagaattcatgaagtcaatgacgagggctttgaggttcgaggctttggcgagggtttggagggcaacggcgaggttttgcgtgctgtggcgggtgagttcgatggagaggatgtgagaggggagggaaggagtggagggggggagtgtggcgaagggggcgtggtggaatgtgatggcgggggtcgtggcggtgacggtggcgatgtatcgagcattagagttgcaggagacgctggtggtggaagaggtggtggttggagtgaggatgaggatagtgatggaaagtga

SEQ ID NO: 23533 - DNA, 474 bp, Glycine max
  Peptide Sequence Number=SeqID_140311
atggaggaactgagtctggacgagttgatgccagaagggtttctggagaggaccaaagagaaggggctgataaagagaaactgggccccacaggttcagttactgagtcatgactcggtgggtgggttcgtgactcactgcgggtggaactcggtgttggaagcagtgtgtgaaggggtgccgatggtggcgtggcccctctacgcggagcagaagatgaatagggtgattatggtgaaggaaatgaaggtggctttggaggtgaacgagaacaaagatgggttggtgagtgcaacagagttgggggaccgagtcagggaactgatggactcggtaaagggaaaagagattagacaaagggttttcgagatgaaaaaaagggctgaggaagcaatggctgaaggtggaacctcgtgcgtcacgttagataagttggctatcaagttgtggaaaggaaacatgattgacatctaa

SEQ ID NO: 23534 - DNA, 207 bp, Glycine max
  Peptide Sequence Number=SeqID_140312
atgcccacccaaaccctaacaccatattctccaccacccacgaccaccggtggccaccatgagccgccgttgcttgccgctgaacccccacaccaagaggaacgttttaatcagagtggaatcctcagaatccacctcaaggaaccttgcgtttggactgatgagcgtgaacgagagagacctttgagtgccgcgaagaggaactga

SEQ ID NO: 23535 - DNA, 333 bp, Glycine max
  Peptide Sequence Number=SeqID_140313
atggttatcgatgctgaagttcagaaggcaatagccagactggacttgggtggagtccacaaaggtatgctccttgacctaacaaggaatttaaggaatcgcctaagtgttggtagtttaactgctaaagacagaatgctagtgtacctcaaaacctacattttcacaacaaggtccaacaaccatacacaagtgactaatgatgatttacagattgtgtatggttttaaatcagatttcaccaaagcatctagtgatatcactgaaaggcatctcaagaagcttaggatgaggtttattggtcacgaatggatcatggttgaagctcaataa

SEQ ID NO: 23536 - DNA, 1581 bp, Glycine max
  Peptide Sequence Number=SeqID_140314
attttgagggttttcggtctagctggatctgaaattgaatcatattcgtcttctggggatgcggctatggtgggaaaacatggttatgaacctgaaattggagccttgaaggataatcaattgcagaggatgcgcaattgtacaaaagaattctcatggatagggttgccatgggcgtgtaagaaaagaagaaagcactatcaggcatataagagaaatggttttcagatatccgtgcatgattttatatttgttctggcagaagaggacaagcgtctagttgcctacttggaagacctttatgaggattccaaaggcaataagatggttgtggatgcgctgattaagggttattggaaacaggaaattctcaggtacatgtatacccaattggactcgaagtctagtgggagttccaggcaatcagatgatgacctggaacttgatgaaaatcatatgactaccgtttttatcagacctaagaagaggctgcgccttaccaaagcagatgatgccaaagaagcagttgatttggttggccttaaaacagaaaatgtgaataacagtaagaataataccaaaatcaatactggaaacaattctgggaaactgattgggcacacaaacatgacagcaaccattaaagggacaaatgaacatgcttcacaccatttagttgtaggttccctagtcgaggtcctctctcaagacggtgggatgagaggatgctggttcagagcttctgtcattaagaagaataaagataaagtcaaggtgcaatatcaagatattcaggatgctgtcgatgaaaccaagaagcttgaggaatgggttttagcttccagaattgcagtgcctgacaacctgggtcttcgaatgcgtgggaggaccatggtccggccagctccaccatccaacaaacgagaactatcgtgggtcggcgatgttggttttgttgttgatgcttggtggcatgatggatggtgggaaggcattgttgttcaaaaggactcggaatctaattgtcatgtttatttcccaggggaaaaagtggtgtcggtatttggtcctggtaacttgagagagtctcaagattgggtggggaatgagtgggtatttgtgagggaaagacctgatcttgtggcttctgttttatctagcttgaaaacaaaacaaaactcatgcaaatccaattccaataacatccaatcaactggagcaatcaccagagatggaatacaatttgggcaatcggatacttgcttggattctgataaggatagaccaagaaaagctgaagtggttccagaccttttgaagaatgttttgtcatcccagttaaggtggaagaccaccagaaagaggaaacgtggaagaagcagcgcctcatatcagaagccacggtgcactgacacccatcagaaaaggtcaccgaatgttatgaaatcaaatgctcctgacagttttttgatcccggcatcattgaaagttgatcatgatgactgcaagtatgttggggatccttccatcttcagttcttcagttgtgccttctttaactaacatggttatgtgtaggtga

SEQ ID NO: 23537 - DNA, 420 bp, Glycine max
  Peptide Sequence Number=SeqID_140315
atgcctaagtggttatctgcacaaatgatttctgttaaccctgacctgggaagtcaggtgggagggggggggcaaatgagcccgttaacgggcagagacttacatcatcttctgcaccttttgtcatccagggatagcaagttgagtggctggcagagataccttatggtcgtccgcacctttcgtcaaccaggggcaaacgagctcattgacgcacagagacttacgtcgtcttctgcaccttttgtcatccagggacagcgagtcgggtggcaggcagagataccttatggtcgtccgcacctttcatccaccgaggcgaacgagttcgacggtttttactctcgtcgtccggagacattcaagcccgacgacgcacgagattcttctctgaggggcggggacgatcaagttcgatag

SEQ ID NO: 23538 - DNA, 420 bp, Glycine max
  Peptide Sequence Number=SeqID_140316
atggaagcttgtggtaatgtagtgaaccaagcaaggaaattcgtacatccatcacggtcgactatgacaagctttgtctctgctgtttcacaatctggaagccatgtgtctaatggctcatctgataattctttgtggtatatatgtttgagctacatgagtgaaaaaggtctagatattatgagcaagcgaggcttatttggaaatcataaggtgaaacctcttcaattttatgagcattgtgtctatgggaagcagcatcagacaaagttcccaaaggggcctttgagagttccatcaccgggaggggcaaggtatttcctctccatcatcgatgattactctaggatgacatgggcatccatgatgaaccaaaaatatgaaactttcaaattttcaagcattagacgattcttatga

SEQ ID NO: 23539 - DNA, 183 bp, Glycine max
  Peptide Sequence Number=SeqID_140317
atgtatccgacggtggagattgcctctgacgcaggaaaggcgaaggaagttacgcggggaggggaaagagaaataaaaaacgcaaaggaaagtcgatggtggtgcccggaattgccggtggagaaaggaaagaatgggaagactcgatctttctgggttccagctggacacatgccaaagtga

SEQ ID NO: 23540 - DNA, 474 bp, Glycine max
  Peptide Sequence Number=SeqID_140318
atgggtgaaatagaggaggtgcaagagtggatgaaggccgacatagaggccatgaaagagcaaatggacacaatgatggaggccatgatgaacatgaagaagataatggaggtcaatgcggctgtagttgctgctaccagcgctattgctgacatggactcgactaccccatccggcctcaaccaaataagtcatccaacctcggatatggtagaacatgcatgccttcccaccatacggcttgcccccaactatacaccacccaatgttgtgcacactcctgatgaggatgtcaataactccactcccatacccattgagagccaacaaccccaatctattcatgcacatgaagcaccccaagatcacaatctagcagacttcgaaccttacctcggatatgccactgaggggcaagcagttggtggcgtacccctgccaagcactttggaggggcctcagtttcacccataa

SEQ ID NO: 23541 - DNA, 189 bp, Glycine max
  Peptide Sequence Number=SeqID_140319
atgcatggaatgggtgaagaaatttttcttattgagcctatcgctccccctgttacaggaactcctgacccttatccaagtgatgatgccacaaagtctatgattaatgagcggatatatggttggcttagtggtgaagctaactctaccaaaaagtctcatgtctccgagattgattcccttgaatga

SEQ ID NO: 23542 - DNA, 249 bp, Glycine max
  Peptide Sequence Number=SeqID_140320
atggccttgattccagtagaagggaaaccgaggttggataattccatccttaccatccttgattgtgaagagagttccccacattgctttggactacaaaaggatgagaaccttagcttgggaggagttattactagatcaaggttgaagaaactacaagaggacattaatatgaagatgaactcacttatggagaaggaagaggaaggggctttgaagataataaattttagccaactctttgattaa

SEQ ID NO: 23543 - DNA, 336 bp, Glycine max
  Peptide Sequence Number=SeqID_140321
atgaaggttgatcaaattttcaattgccataactatagtgaagaaaaaaagaagataagattggcaagtatagagtttgaaggttatgctcttgtgtggtggaaccaacttcaagttgacgtggataggttgagaagacctagagtggaaacttggttagagatgaagaaggtttttaaagaaagggctgaaatggaagaaactcaagaagacactatggctagattcttgcatggtttgaataaagatatccaagatgaagtggtgcttcaaagctacaatagcatggatgaactcatacaatggagactcaaaggcatatggaagggttgctga

SEQ ID NO: 23544 - DNA, 420 bp, Glycine max
  Peptide Sequence Number=SeqID_140322
atgcttgggtttgatcacataaaggagttgcttgcttgcgatgatgacttctctaggttgtatgaattgtgtgagaaaaatgctcacaatggattctttagccatgatggatttctatttaaagataagagattgtgtgtgactaagagtactttatgtgagttgttgattagggaagctcatgacataggcttgatgggtgactttggggactttgttgggaaagcttggcaccaagctttttttctccacaacttgccatccctaaaccgatgggcaaaccaaagtgttgtttatggatttaacctaatgtctcctcttgatttgattcctttgcctaatgttgattctatgttgaatggagatgagcttttcaaagcctcttttattagaaacttgcatgagaaggtgaaggcttag

SEQ ID NO: 23545 - DNA, 366 bp, Glycine max
  Peptide Sequence Number=SeqID_140323
atgcatagcataggggtcaggggccctttggaacaacccccctcggcctatttattgaaaaaaagaagtggtgcttgccgccgagctcgtccagggttacaggaatttaatggaagcattacagaagccttggaagccatttttcaacaaaatcaaggaggaggttgccacccagctcgccaaggcgagctaggttgcttcctcctaaagcaacccagcttccaaaatgttctagaagtgcatagattcgaaaattgctatttacacccctatcttgataagttcagcccttgtttttgtgttttttggatgttttccttccgaaacctcatggaactgtatggattccacgacgatgggtgttaa

SEQ ID NO: 23546 - DNA, 1389 bp, Glycine max
  Peptide Sequence Number=SeqID_140324
atgaaacctaacgaaacatttcctatttccgccatatctccaaaggtagcacatgagttctatgactctatacgtgggaagacattcaataaaaccaaggtcattgtttcatctcacaactatcagcttactccttcaattgaggatcttggtaaccttgtagcaagaatacaagcaacgggagcagacattgtgaagattgcaacaactgccttggacatcactgatgtggcacgcatgtttcaaataatggtgcattctcaaatgaaattgttgggaagttcaattgaggaagagaggccaaatatgctatcaaggtggatatcttcagaaataaggaccaatgcaattgcgaccaatgttccatttattggacttgttatgggtgatagggggttgatttctcgtatactttctgcaaaatttggtggatatctcacttttggtacccttgagtcaggagttgtttcagctcctggtcaacctactcttaaggatctattgtatctatacaatttaagacaactggctcctgatacaaaagtatttgggattattggaaagcctgtcggtcacagtaaatcacccatattattcaatgaagtcttcaagtcaattggtttgaatggtgtttatctatttttattggtggatgaccttgccaattttctcaggacttactcttctacagattttgtgggattcagtgttaccattcctcacaaggagacagcacttaagtgttgtgatgaggttgatccagtggctaagtcaataggagctgtgaattgcattgtaagaagaccaactgacgggaaattgattgggtataacactgattatgttggtgctattactgcaattgagaatgggttacgaggtaaacataatggtagtagcacaactatttctccattagctggtaagctgtttgttgttattggggctggtggtgctgggaaggcacttgcttatggtgcaaaagcaaaaggagctagggttgtgattgcaaaccgtacctatgaccatgccagaaaacttgcttatgcaattggaggagatgctttagcccttgctgatttagataattaccatccggaggatggtatgattcttgcaaacacaacatcaattggaatgcaacctaaagttgatgagacgcctgtttctaagcacgctttgaaatattactccctagtttttgatgctgtctacacgcccaagattactagactcttgaaagaagcagaagaatcaggagccactattgtaacaggattggagatgtttatggggcaagcatatggacaatatgagaatttcaccggattaccagtgatcggttatctttgcaacacaatcaaagaatctaatggcgaggtactttaa

SEQ ID NO: 23547 - DNA, 180 bp, Glycine max
  Peptide Sequence Number=SeqID_140325
atgagccctcaatacacgttgatcatttttttgatatccaagaactcaagaagggatgttgagtttgcaaattgcaaggttattgagttcaaggtccagggaaccacagtggtgctctcaagcgagttgattgccaaggccactgggtgccttcgtgaaggaagcacctatcaagaatga

SEQ ID NO: 23548 - DNA, 639 bp, Glycine max
  Peptide Sequence Number=SeqID_140326
atgttaaaatggatccaaacgacagttaagttagccgaatgggacattattggagctgaaaacgcgggagatttgaaaatcggatgtcattttgtccttgcgattctggtcaattgcctcgttcaaatgggagcgctccttcaccggcttcaaccagtgcccggtgagctcttggaagggatgagagggagagagttgaggagtgataaagagctaggaagggtaaacatggaatgtctactttcttcttctcaaagtttcttgatgactttagggaggaaaaatgtggagaattttctagaaataggggaggagcttgaaaagcatctagataacattaggattgatagtattaaaatgcatgtcaaaatcccattcttcagaaaagatcgtgacccaaatatggacatgaagtttgatgacaagggtaaagatgtgatgaaggtagggaagtttgaggggtctacagggagtgataggtataataatacgactcataaagggggacaagtttcatttgcacaagtggtgcataatggaccaagtcgtaacaatctggacaacaagtttgaagataaagggaaaggtacgatgaaggtaggggaggttgaggggactagaggggggagaaagatataa

SEQ ID NO: 23549 - DNA, 387 bp, Glycine max
  Peptide Sequence Number=SeqID_140327
atgggtggaagcaatacttgttcaacatgcaaatgcaaagaccgttattcgcttcctaaagaaaaacatcttttcaaggtttggcacaccaaggctggtgaacacaggaagctccaacttcctaaattagaggaattgaggtttcaagcttataagaatttcaagctttataataaaaagcttttaaaaatggaatttcaacctggtaagctgaaatctaagtggtctggaccattcatcatcactaaagtcatgccacatagagttgtgatattggaggatccagccacaaagaggacatggactatgaatggcagcaaaatcaaacactacttaggtggtgatgttgaaaggctcaccactgttatccaattgcaggaggcttga

SEQ ID NO: 23550 - DNA, 456 bp, Glycine max
  Peptide Sequence Number=SeqID_140328
atgagaggtacgccatcggaggaaaccatcatgcctttcatcgcacaaggattcaacgaagctaatacgaagatacttcaaaagattcgtaaggcatggaataaagtggggaaaaaagataaggagcttaaaggaagaagaaatggtgtcataggcagctatcacaaatggctgaaatctagagtgcaagggatagcttggctcaaaaagctaaagggtctgaatggggaagagacagaagtgctcaaggaaagtgaagaggtgcaagtcttgaaggctgagttggaaaagacaaaagtagcaaaggagaagctgaaggtggtagtcactagagttaggaaagaatgtgataggctggaagatatcaacatgtttgcagctgaagcgctagagcaggaaacaaagaaagccataaaagaaaagtggagtagaaacaagttttgggggctttgttag

SEQ ID NO: 23551 - DNA, 360 bp, Glycine max
  Peptide Sequence Number=SeqID_140329
atgggggacatagaagaggtgcaggaacaaatgaaggccgatatggaggccttgaaagatcaaatgacctccatgatggaggccatgttaagcatgaagcgaaagatagaaagcaacgtggctgcagcagccgccaccagcgccaccgctgaggcagatccgacccatccctctaccataatccaagcaaaccaacccatcccggacgtgttgggtcaaggaggagagcgagcatccgctaagcgcaacactcagtggctaagcacgaggaagaatccagaagaagatgagctgtataggttcgctgagcgcatcactccaggccatcaagcgcaccgcttctgctcatccgctaagtga

SEQ ID NO: 23552 - DNA, 460 bp, Glycine max
  Peptide Sequence Number=SeqID_140330
atggctctagtgactggtcccttcctagggaggattgcatcaaggagtcaggcctccggcttcgatcatgaggctatcagtcagttgctatgcatttcggggcaggactttgcccagagcgtagcggggagacgagtgcggatcatgcgcactagcttcaccaccatcacacagatctggatgacattgttgcttagcaacattctccccaacgaccataactcggacctccccctgcagaagtgtcagttggtttatgccatcctgactcaggtgagtgtccatgtcgcccaattgatctctgatcctatttaccagtttgcagggattacgcctttgagacacccaatggacctagagaagtccaatagggccctggggtttcctgctctgattacaggcctctgtcagttctatggagttgtggtcacccccattcagctcatccgggctcccatca

SEQ ID NO: 23553 - DNA, 387 bp, Glycine max
  Peptide Sequence Number=SeqID_140331
atgggtgtcatcatcaaaaagtgggagaatgtgaatcatgcatgttttgatgatttcgaaaagaaatcacttgataatgaatgtcatcatcaaaaagggggcggatgtgaatattgctttaacaaacaaagacttgcttcaagattaactaaagatcaagccttgcctcaaaacaaagtgtttccaagacatccaaggctctgcaagagagagatattccaagagaacttcattgtcaaattctctctcaacaactcttgggaaacacttgtgtcgcaacgtgccattcacgggcgagcgagggcgaggctcacgggtgcgctttccaaaggaggaaagatgcgcggagtcgccaccaacgtttatttgtggaaagggatcctctag

SEQ ID NO: 23554 - DNA, 402 bp, Glycine max
  Peptide Sequence Number=SeqID_140332
atgggtggagtctacaagttcgaagaaacaactgatgggtacagcaagatgcaaacctataagggaatgcttcttgaccctgcaaagaacttgaagaatctcctaagagtaggtggcctgactaccgaggacaaaatgcttgtctacctcattacctacattctcactccaaggtcaaattgtatacggtctaaaattaggtatcaagatgaattgggtattgttgatagaagacatcatattaatgagttgtcaatggacgaagatgctaaagctaaagctccacaagagcctgcacatcaatggagtccttttgagttaattatgattcataagatggatgctatgcttcactccatcaagagaactcaactaaagttcacagttcgctggagaacataa

SEQ ID NO: 23555 - DNA, 429 bp, Glycine max
  Peptide Sequence Number=SeqID_140333
atgtctatgatgggagagttgaacttcttccttggactccaagtcaagcaaataaaacatggaaccttcctatgtcaaaccagatattgtacaaaactaattaagaaattcgacatggaaaagtgcaaagagacatcaactccaatggcatcatcaacctattttgacttagatgaaaaatgtaaatcagttgatgagtcaagatatagagctgttaaaaggatcattaagttccttaagggcccaaccaatgttggcttgtggtatcccaaagggtgcaaactagataggaaaagcagaagtggaacatgccatctattaggaagatctcttgtatcttggaattgcaagaaacaagcttgtgtagcactatccactatagaagctaaatatattgtagctgaaagttgctatgctcaaagtctctag

SEQ ID NO: 23556 - DNA, 366 bp, Glycine max
  Peptide Sequence Number=SeqID_140334
atgcctttcaaaatatgtatgtttgtaggtaggggttgcgcccacaagacacctagtggacccggagaagtccaacagggccctgcggtttccagctctagttacgggcctctatcagtcctacagggtgcccgtaccccccggcaagggatcgcgcccacaagacacccagtggacccaaagaaggccaatagggtcctggggtttccagctctgattacgggcctctgtcagttctacggagtgcccgtcacccccaacaaggtcatcaggccccctactaatcgagatttcatcaagaggtactacgcccccaggcaggcgcaaggcgaaacaccacagcagcctggggatggccagcaatag

SEQ ID NO: 23557 - DNA, 543 bp, Glycine max
  Peptide Sequence Number=SeqID_140335
atgggagcatgtacaattacaggggggatgtttagtaccgattcttatagtactgttcggggcgtggataaactaatcccagtggatgtctatttgccgggctgtccacctaaaccggaggctattatagatgctataacaaaacttcgaaagactaataccaaattcattaaaaaattcaggagaagcaaaaaaatgcaaggtcgtttgtcttcttggctagtcaaacatggactaattcatagatcattgggtttcgattaccaaggaatcgagactttacaaataaagcccgaggattggcattccattgctgtcattttatatgtatatggttacaattatctacgttcccaatgtgcctatgatgtagcaccaggaggactattagctagtgtatatcaccttacgagactagagtatggtatagatcaacccgaagaggtctgcataaaaatatttgtcgcaagaaaaaaatcccagaattccttccattttctgggtttggaaaagtgcggattttcaagaaaaggaatcttatga

SEQ ID NO: 23558 - DNA, 240 bp, Glycine max
  Peptide Sequence Number=SeqID_140336
atggcgatatatgttgcaatgaagcccacaaagttcgacttggaggagccccgggagcagatccacaagacaagtggctcagggttaagggacctattaggatgcccactaaggctcttcacatcactaccaggaagtccctttgtggtgaaggcagtggcttcattaagggaaaccacaggagccgtagtgaaagtgagtcctcacagggcaatcgtctatggacccgaacctgggtga

SEQ ID NO: 23559 - DNA, 458 bp, Glycine max
  Peptide Sequence Number=SeqID_140337
ccaggaaacattctgcagaaacctctaagtcaggtgacatggagttcagagaacctgaggagttatgctctgagcctctaagagtccaacagcaactcttagacgatgaaacacgtgcccttcaggtggaattgactagtcttctcaatacaggtcaagaaaccgaaactaacatggtggagatgtctgcactaaatcacctcatgtctacacatgttttgcatcaagctcagcaaattgagcatctgtatgatcaagctgttgaagctactaagaatgttgagcttggagtttgtccttatattgaaccttgtgattccaaaactcagaagagcaatctggggattgctcttgttggagttggttgtgaacaaaacaaggttgatgttagggtggacaataagcttcgaaagactagtgaaatagtacttgggttgagtggagcctacatagactga

SEQ ID NO: 23560 - DNA, 324 bp, Glycine max
  Peptide Sequence Number=SeqID_140338
atggccttaagaaagagacacgcttccacctccaaacctcaagaaccctatgactcatctcggtttgtgtctgaggttgcctgggagcgatacgagcagaatgtccatgccaggaacatcctcccagagaagaatgtggagttggccttctcccagtatgatgagttcctctgggagctcgagaggcaatgcaaggtgtgggggaagctgatcaaattcaatgctgctactcttaacaaatttttggagaccctagtggtcttagatcttggggagaggtactcggcttactcccgattctgcagcacctatctagacccatag

SEQ ID NO: 23561 - DNA, 141 bp, Glycine max
  Peptide Sequence Number=SeqID_140339
atgccagcagacacgcctatggaagagcatgaagagggaggcatagcaaagacaggaattgacgaggattatgtagcatatgtcactatggatacttctattccacctcaggatgacccaactccagctcaggaggattga

SEQ ID NO: 23562 - DNA, 585 bp, Glycine max
  Peptide Sequence Number=SeqID_140340
atggatgggtcggctggtgctgaaggggccggaggtgttggagctggtgctggtgctggtgttggtgttggtgtgggagcagaagctgaggtggaagcatctgagagagccctagccctggccttgcgggacccgggaaatgtaatcgtcggatcatctgggttccaggactcaaaggtgagtgagtctgggacaactcctctggcaatgcacaatgttgtgatcaatgcaagaaagccaagtctagaggagttggactgggccatctgggagatctggcctgagatgatcgagcccacgaaaggacactctatgtctaatccaatatggccagtgaggcagatccgctcagcgagtggcatccgcttagcgagggatacaactcacttagcgggttgggaaaccctacaagaggataagtcagagatgtgttcacccagcatgcagccagcccacttagtgaggacattgtctcttctcgagctcaacgcactcagtctcgctaagccaaaattcacttactcagcgcaagaagaagagcaacagatagagcttaggttagaagtagtgaagtttagggtttag

SEQ ID NO: 23563 - DNA, 345 bp, Glycine max
  Peptide Sequence Number=SeqID_140341
atgaagctgaaggtatatgcggaccgcatgtcccaaccatcccgtgcgattctcatattttacaaagtgaatggaatagattttgaggatgtcaaagtcgatttatcccaacatcaccagctatctccccaattccgagtgattaaccctttaatgaaagtccctgctgttgttgatggaaggttcaaactatttgagagacatagattttgtgcaatggctgaagagagacaagtcatcggcttccacactggtgatgcgtggaagggcaactctagaatgcaaaagactccaaaaaactggtcagtaccaaaacttcttcatttgctttttgcaccttcctag

SEQ ID NO: 23564 - DNA, 513 bp, Glycine max
  Peptide Sequence Number=SeqID_140342
atggcatctgaattgaatttgaatatgcggagtgatggttatgtaaaagttaatgatttgctaaagctgaatctgaagacatttgctaatattccactgagatcgcacactattgatcatattagggaggctgttcgaaaagataataagcagcggtttagcctcttagaagagaatggggagctactaatacgtgcaaaccaaggccacacagtaaaggtcgttgaaactgaaagtttgttgaaaccaatcctttccgccaaagaatttccagtttgtttgcatggaacctacagaaagaacctagaatcaattctaggatctggtctgaagcgcatgaagagattgcatgttcatttctcttgtggtttaccaacagatggagaagtaattagtggaatattaagaatattaaggagggcgagccctggtgcagcggtaaagttgtgccttggtgacttgttggtcatgggttcgaatccggaaacagcctctttgcatatgcaagggtaa

SEQ ID NO: 23565 - DNA, 201 bp, Glycine max
  Peptide Sequence Number=SeqID_140343
atgacaaagcatgaggcagaaccaaatgaggaagaggccaaaaggccaaaaatggaaatcagcaggccacgataccttgaagattatgttgtcccccctggtagtgcatttgaattcctccaaggcatacactaccaaaatctgttagatttttcatctagaatttgtagcagaacatctatatatatgagaaagatgtaa

SEQ ID NO: 23566 - DNA, 1101 bp, Glycine max
  Peptide Sequence Number=SeqID_140344
atggcggcggcggatgtgtgcaaaacgacgtttagaactcatcatggccactatgagttcctggtgatgcctttcagcctctataacaccccatcatccttccaggctactatgaacatgacctttggcccttatttgcgtaaattcatcatcgtcttctttgatgatattttaatttacaccaaatcattctcgaaacacctcgaccacttgaagatagctcttcagaccctccgagatcacaacttcttcctcaaactatccaaatgttcactcgcaacccaacaggtcgaatatttgggtcatatcgtctcgaagcgaggggtggaacctgtacctgccaaagtggaagttgttcatcaatggccgacaccacggtttgtcagagccttacgtggcttcttgggcctcttcgatttttacccttttgttcgaaattgcttcgtgagtccacatctttggaatcttaaggaactcatggcgcaagcaattcaaacccctaagcaacatacatatctcgcacgattattgggttatgatgatactattcaatatcgtgttggcaagtcgaatttggcggcagatgccctggatgcatctggctaccatagggagctcagtcaataccaaccatcctcgtcgaatttcattccacacccaccaaaggacgcatgggggatgcccgtcaatatgttgccaattgcatcacatgccaacaaacaaaatatgatcatcggtgccaaccaagattactttgtcccttacccattccggcatgaccatgggaagaaacttaccaaagcacaacaacgaatgaaacagttcacagatcaacggcgtcgagatgataggggcaattgcatatcagttggacttgttggcaacctcaaagatccatccagtgttcgactgctccttattaaagtcgtatcagtcagccacaacagacatcccctggaattgtcggctctatctgaagacaatcagcccttcatcacaccactcacaattctagacacaaagtgggaaaggaaggcttcagggaagcaactattagtattggttcaatggtcagggctattcccgaaagacacttcatag

SEQ ID NO: 23567 - DNA, 387 bp, Glycine max
  Peptide Sequence Number=SeqID_140345
atggggagcaatcaccctcatttgacaaaagaggatcttttccttatctatcttatgataattgaatacttcatagttgatacccaagaagtctttcgttttgttgaagttgaatttgaagtgaagaccaaagtcttgaagcaaatggcgtacatcaaatctgaagaaattggagttggatggattgagaaaagcaaagaggatcaaacaaaacaacaagatgcagaggaaaatcctatgagcccctttgagcagatgatgttagccaagatggacaagctcatgagggtgcataaggaggactatactaagcttaaggagtactttgaaactatctttgaaaggataaatgctatgagagcaccacatcatatggatgatatttga

SEQ ID NO: 23568 - DNA, 165 bp, Glycine max
  Peptide Sequence Number=SeqID_140346
atggatacttggagacgaagactatatatagaagaagctttgaagaaacaatacacgaacagttcacaggaaaagatccagatggcagataaccaacgtcagttcatcactaagggagcatctctcacaagaccactaggcttcactggagaatactgcccttaa

SEQ ID NO: 23569 - DNA, 498 bp, Glycine max
  Peptide Sequence Number=SeqID_140347
atgcaggaatcagatggattagatgactctggtggatccacaaatggtgaagtggtcctcatgtctagaaagttcaaaaaaatgatgaaaaaggagggaaattttcaacactcctctaggcgaaaagattccaaattcaaaaagacgaacaaggaggaaaacaatgagatcatttgctttgaatgtagaaagcctagacatatgaaggctgatatgtccccaactaaagaagaaaagatacttgcaggacaagaagaggaaaagtctgatgatatccttggtaggaaaagacaaaggtttaagctgatacttcgatattggatggtcacgatacatgacgagggaaaggtctatgttcctagagctaaaccacatgaagaaggagcaattgcctttaaaggcataggtaagggaaagatctttggtataggtaaagttggtattcccaattctagtattgaatcgaagcttaggtcgtatcccaacagaatagtgtaa

SEQ ID NO: 23570 - DNA, 210 bp, Glycine max
  Peptide Sequence Number=SeqID_140348
atggatggaccattggacaaagatattatgcttcagaaaatattgaaaccagaaaggcgttccctgaaagaagaaaatgctggaggcttgtctaccatctgtttgaaggaaaggatgaacaacgagaaaaagggggatgaacgaagggatgatggtagtgacccctcacatgatgagcaatggcttcacctgctgctctctagcaagtag

SEQ ID NO: 23571 - DNA, 471 bp, Glycine max
  Peptide Sequence Number=SeqID_140349
atggctagtccattatacattcactggattacagtcaaaaggattttaaggtacttgaaaggaactgttcttcatggtcttcatctaagacctgctgtctcaggtcagccttatactctaagagccctctgtgatgcagattgggcttctgatgttgatgacagaagatccatttctggtgcagcaatttactttggcccaaacctcacatcttggtggtcccgcaagcaacaagtggttgctaggtctagaacaaaagtagaatatcacaacctagctcagaccactgctgaaacctcctgtcaagttcccttctgcactcctatcatcttctgtgacaaccaaagtgcagtgaccattgctcacaatcctatcctttatggaagaaaaaaacatatggagattgatgttttctttgttccagataaagttctgaccgagcagctcattgtacatcatccctgttcttga

SEQ ID NO: 23572 - DNA, 360 bp, Glycine max
  Peptide Sequence Number=SeqID_140350
atggcgtattccgagttgtggccctcattattggaaaatcatttggtggtggccatacccgggaaggtcttccagccaccataccctaagtggtacaacttggttgccaagtgtccataccatagtggagccccccgtaacgccattgaagagcaagggacgtcgggggcaaagaggttagaagatgtggctacatctagacgcttcatctaccagtcgctacaagcggcatgcatggtctcccgtggcggagacgaaagggacgaatgtttgttttacctcaaggagtcacacgacatggaaacctgtcccgcggtggaagaattgcttcagtggctcatggactgggggcagctcgaa

SEQ ID NO: 23573 - DNA, 300 bp, Glycine max
  Peptide Sequence Number=SeqID_140351
atgttacagcaggaagaagaaggttcatccttaaagaaggaagaaacaagttctgctgaagtagaagaagaagaagatcccttgtaccaaaacgaagatgattgttttgccattaaagtcccggtcaaaactacttgtcttgtaacaaaaagtcaaatagttccgatcaaaactaccggcaactaccggtctcagatttttggctatataaggagtcctcaaccatgttgtgaggtaccctttcatttggccatttttctggtttctgaagagaggtgctctgaaagaaaacttttgtaa

SEQ ID NO: 23574 - DNA, 201 bp, Glycine max
  Peptide Sequence Number=SeqID_140352
atgtggggtgggacatcgccagtcgggagcgaccttgaatggcaatcccaaaggaagaaccacttcaaaatgggttttccctttgtcggcggaattcgagttttagcattcgttattcgctctccctttgaggagattctgttgtcctcttcttcgagggaaaggatgaggattctcttcatgggccaaggttcgaagtag

SEQ ID NO: 23575 - DNA, 261 bp, Glycine max
  Peptide Sequence Number=SeqID_140353
atggcagaattacttagatgccctttgcctccgcataagttgaagcctggtagatattgccttgatgctagtaatggaaacaccgaggtttacatgaatggtcgagagatcatagaacttgaattgagggtactcaagactcgggtctgccaccagatggttcaagatatcaacaacacaggctgtagctatttcccaaagctcggaggattttggaaaatgataaaatattcttatatgataacacaaaaagtgatgtga

SEQ ID NO: 23576 - DNA, 511 bp, Glycine max
  Peptide Sequence Number=SeqID_140354
caatccccaagagactcaacgtaaggatgcacatgccaaagttgagtatgtgaaaagattgtatgaccaagtgaaggtgcaaattgcaaagaagaatgaaagctatgtcaagcaagcccacaagaaaaggaaggaagtggtacttgaacacggtgatgatcctgaacatttgaggacaaatgttttccaagaaggagggaatgatgagaatcatgaaactggccaaatacaggctaaaggcccaagtggagaaggacgaaggcccaagtggagaaggacaaagcccccaaacttatcttccttcatcggaagtggcgtctaccctgacttatcttccttcactggaagtggcgtcaaccaaaaactctacagcctgtatcaagcgatccgtgccccgataaaagcttaccttgagtaccctcaattcaagttctatgatctctcgaccattcatgtaaacctcggtgtttccattactagcatcaaggctaagtttcccagtgaaattcaa

SEQ ID NO: 23577 - DNA, 336 bp, Glycine max
  Peptide Sequence Number=SeqID_140355
atgtttcgtgatgtttcgaaaggaaacgagccaaaaactcaaaatggagggggtgagctgatcaatttagggggggtgctatttagccttgggcccatcaggaatcttctggaggaagcaacagctcgcctgggtgagcatgttgcttcaagcttaagccaccagctcatatgggctcaagcgagctgggcggcaagctcctcctccatttttcctataaaatggcatttggaggttgaggggaaggggttcagcacctttggcaatcagatttcacttaaattagtgaggagaagaagaaagaaggagaaaatcaaggtcgaagtgcttctgtaa

SEQ ID NO: 23578 - DNA, 148 bp, Glycine max
  Peptide Sequence Number=SeqID_140356
caacttcatgtcgacgatgctgtcgatatgttggtggaattactcgaggtcagcgttgcagaggcaagagctgagacgattcaatgtcatggatcttatgttcgactattatggttgcgagatgtgtatcagacgaaaattgaggcaa

SEQ ID NO: 23579 - DNA, 138 bp, Glycine max
  Peptide Sequence Number=SeqID_140357
atggagagatgcatgatgcgatcaaggaacaagccagagttaattaggcaagctttgaaaagtgctgtttttcatcttctcgctaagccaatccgttggcttagcgagcatctgctaagcgcaacactcattggctaa

SEQ ID NO: 23580 - DNA, 339 bp, Glycine max
  Peptide Sequence Number=SeqID_140358
atggcgaaaaggtatgaaatgaccataatttgtctccgcatgtcatcgggcttgccgcctctggatgaccaaaagaatgaccatagtttgtctctgcgtgccatcggacacgatcatctccaaatggagaagaggtgcggaatgaccataatttgtcttcacatgtcatcgggctcgccgcctctggatggcaaaaaggtgtgcggaatgaccataatttgcctccgcatgtcatcgggctcaccgactttggatgacaaaaggcgcaaaatgaccataatttgtctctgcgtggcatcggaaacgattgtcttcggatggcgaaaaggtgcggaatga

SEQ ID NO: 23581 - DNA, 300 bp, Glycine max
  Peptide Sequence Number=SeqID_140359
atggagcaacatcaaataaaagaattatctcctccaagttctgccaacattgatcttgacaagagaatatcagaaaatagaaaatctttgcaagatataatgtccatgagatgggtatcagaatcagataatgtgttcacaattcatgcaacaatcaatgaaatcaacggttccgttggaattatgttgcatgtgagaggtgccaaaagaaagttacaaaagagggaaatcaatacatttttagagaatgcaaacaactatccaaaggcccaacaacaaggtttaatgttttgtatataa

SEQ ID NO: 23582 - DNA, 300 bp, Glycine max
  Peptide Sequence Number=SeqID_140360
atgtcggctcatggaggtggtggaggaggaggagttacggtttctgggctgaggttgagagcgaatagagctcaaaccatgcagttttatgttgttggacgtatttataatctgcagatctcacgtagcaagcatgtcttgctaagcaggaatccattttcggtgctaagcgtgaatttttgtgctgagaacaattcctctagggtaggaattgcattgagcacaacatttcgtgctgagcataattcctcttgggttggaattgcgttgagcgtaattcctctttggcaaataccaacg

SEQ ID NO: 23583 - DNA, 1170 bp, Glycine max
  Peptide Sequence Number=SeqID_140361
acccagaacgtgagagcgaaccacaggaagctcgtcgtcacgttggcgatcaacgtgttgacgaggacgttcgcgaaagcccgggtggctgcggtgcgctgcatggcttcgaggcatgacccggcaatccggggcttcgccagcgacaactactccggcatccaccccgaggtcctcgcggccatcgccacagccaacggcggacaccaggtcgcctacggcgaagacgcttacaccatgcggctgcaggaggtcttccgcgaccacttcggcgacggcgtgcaggcgttcccggtcttcaacggcaccggcgcgaacgtcacagggctgcagtcgatgctcccccgctggggtgccgtgatcgcggcgtcgaccgcgcacatcaacgtcgacgaaggcggggcgccggagaagatcggcggtttcaagctgctcacggtgcccaccgacgacggcaagctcacccccgagctcatcgaccgggaggcgtgggggtggggcgacgagcaccgcgcccagccgctggtcgtctccatcacgcagtccaccgagctcggcaccctgtactccgccgaggagatccgtacgatcgccgaccacgtgcacgagcgcgggatgaagctgcacctcgacggggctcgcctgtcgaacgcggccgccgccctcgacctgccgctgcgtgccttcacccgcgacgtcggcgtcgacgtgctgaccttcggcggcaccaagaacggcgccatgctcggcgaggcgatcgtggtgctgaacccggatgccgccgtcggcctgccctacgcccgcaagttcaacatgcagctctcctcgaagatgcggttcgtgtcggcgcagctcatcgccctcctcgacggcgacctgtggctgcgcaacgcccgacacgcgaacgcgatggccgcacgcttgcggtccacgatcgaggcgggcatcgccgacggctcgatctcgggcgtcgagttcacgcagccgacgcaggcgaacggggttttcgcgacgctcccggcgggagtcgccgacgagctccgcgacgtgttccgtttctacgactgggacgcgtcgcgccgcgaggtgcgcaggatgtgcggcttcgacaccgaagaatccgacgtcgacgcgttcgtcgccgcgctctcccgcctcaccacgcgctga

SEQ ID NO: 23584 - DNA, 417 bp, Glycine max
  Peptide Sequence Number=SeqID_140362
atgccacccaccaggcaccctctagacccagataagtctaataggaccctaggatttccggcattgatcacgggcctctgccagtcgttcggggttcccgtcacccccagtaaggtgatccgactgccaatcactcgggccttcatcgagaagtattgcatgcctaggcaggcgcagggtgatgcacctcaggccgcagacgcaccgccaccacctcatcaggccgatcccgttggatcactaggcatggagcgttatctacagcacttggttcgccagcaggcggccaaccaccgggggcagagcagtttggggctgaggtcgcatggcccggagattggcccgaggcccaggcaggggaggagcccgcaggatcccccggtgaggcagaggaggcccgtatggatgaagaaatga

SEQ ID NO: 23585 - DNA, 237 bp, Glycine max
  Peptide Sequence Number=SeqID_140363
atgtgtgtatatgatctttgggtagcaggaatacttcaagaaatgacttcgaaaaagctttccatgaagaggtctaggagagacgccgcagcggaagggtccagtgccgcccctaagtttgatagccactgtttccggagcgccgagcaccagcaacgcttcgaggccatcaaaggatggtcgttccacagagagaggcgcgtccagctcagggaggatgagtatacagatttttag

SEQ ID NO: 23586 - DNA, 288 bp, Glycine max
  Peptide Sequence Number=SeqID_140364
atgaggaaaagccttcagaaatatgtgatcctcctggacatctggtggtttcatggtggagcaaataatatggaattatttcagatgtttgtgcgggtcttcacctgcaaggccatgaaactttggaagcaaatggatcagtccaattttaagaacatatgggacatcctcatcagggtattggatgcacaagctttcataggatcaaagggttgtaagtcagatggattgcctctagtcatacactatattcagcatgcacaactagttgccttcttatgcaagtaa

SEQ ID NO: 23587 - DNA, 192 bp, Glycine max
  Peptide Sequence Number=SeqID_140365
atgtcggtgaaaaacctcgtcgggcgcccaggagtacatgataagacaaaccacacattagcaagtcaagttactctcactaggcttaaaggagcattcaaaccgggtgtatttacccccaaggcctacactctgaagagttcgtcagggcctctccctcatgattcaggttcaacccagaaaacattttaa

SEQ ID NO: 23588 - DNA, 1029 bp, Glycine max
  Peptide Sequence Number=SeqID_140366
atggtgtggaggacactgtctgtgagaaatacgtcatcagcaaggaaaaattggcccagttttgccagactcacagagacccttcttgggagcaatttgaaagattattgttttatttttacaggatttgtgcaaaaaggcacaggccatccagaagcagaacactgcccccacgttttgtctcatgagggttatgactatttggagcagaagctcctggctgagaagacgaagaagaagctggaggaagttgcacagtcaggaagcgttgatggcgtcatcgaccctccatccccggtcagacgccacgtgaagtggaagatggcccgcacgaagaaaacaggagagatggcgattgaggccgcaaaggaaattgctgagaagatcctcatggcatccttcagccagatgcagtcccagatgcaatctcagggacttgcactgcctcccgagcctctggttggtccctctgatcctcgaataagcacaaagggaagttgtgttgatccctcaggaaacgatcctgagacgggtgactcagataggtgcggcttgtacatcgaagcagatcctacccgcctggttgccctggggagagtttatgagggatccattgttgtctataacactcctttgttgcttggccaagtaaaggtgggtgtggaggaggttacaaatgcagatgctccagttcctgtacccactgatgaggtttccttagtggggcaggcacttcacaccttccttgcttggccgacacatctggtcaagtctttatcacagcaggtagctgtgtctccggcaaaaccacctccaaagcccgatccggaggttgatgatttgctttatctgatgacattgaccatcccagagcttttcttgaggccttatcaggttacatgggatgccatcgtgttccgggtctttaatctagatttcccgctctacataaagcacgaagacctctccgaaatcgcacacggtggtcaatgtctcagtatatcagtgttacagttgtggattttgtaa

SEQ ID NO: 23589 - DNA, 264 bp, Glycine max
  Peptide Sequence Number=SeqID_140367
atggcagagccgtcatggagaaagagagagcaaatttccgccatggagaaagggaaacaccaccatgcaagattcagttgccgagaaagggaaacgtccactgaggattcagaaagagagcttgagggtttgttggggattcagaaatggagcttgaggatagagggtttgttgggtattcagaaagggagcttgagggttttggagagaggattttgggttttgttggacgggagagtttttagaacggttccccaaacttga

SEQ ID NO: 23590 - DNA, 393 bp, Glycine max
  Peptide Sequence Number=SeqID_140368
atgaagcaaaatcttagaaatgaagtgaaatgtcaaattgtaaacatattggaagaattatcaagctctgaatcacctattaactcaagtgctcagtttgatccaacgagtagaggaacaaaagttgatcctaaatatgacaccgtggaaattcaaatggataaaagatataatttggttgacgcattcatcattgcacataatgtaagacaagtgcattatgtgtcgtatccagtaataagaagggacaaacatgatttgggaggcggtgttgaagaagtgaatcctgctaatctgttgccaaacgaaggagaatcaaataattttgaagaagacaatgaaggagaattagaagatgactttgaaatttacaattctgaagagggggactag

SEQ ID NO: 23591 - DNA, 825 bp, Glycine max
  Peptide Sequence Number=SeqID_140369
atggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggttactcgcccgtgactcgcacacatgtcagactccttgtccgtgtttcaagacgggccgaatggggagcccacaggccgacgccaggagcgcgcagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatcctt

SEQ ID NO: 23592 - DNA, 303 bp, Glycine max
  Peptide Sequence Number=SeqID_140370
atggcccacaccaagaaaactggtcaaatgacgtttgaggtagcaaaggaaattgctgacaagattgatccattggtagagcaagaaaatcctccccgtttggttaccttaggaagactttatgaggggtcgacaatagttcatagcatccctttgcgccatgatcaagtcaaggttggtgttgaggaagttagagatgcagatgctcccattcttgtacccactgaagagggagctgtgggaccagcgaaacctgcagataggtcggtgatcaaggccgtacccgaatcaaataaacattaa

SEQ ID NO: 23593 - DNA, 327 bp, Glycine max
  Peptide Sequence Number=SeqID_140371
cggttcagaattgcgctaagcgcacgagcatgaacaagaccacctatttaagcttgaaatcagattttgtgaagagagtttgggctgggattcagagctttgcatgttgtcgcaacgtgcccttttgcgggcgagcgagggcgaggctcacgggtgcgctttccaaaggaggaaagatgcgtggagttgccaccaacgaaggtattagcacctctcacgtcgataaaagcggggcttttgctcctacgtaccctcctttggagagaaaatcagacctacgtagttctttcttatgtgtgaatcaagtgattccttttactttgaaag

SEQ ID NO: 23594 - DNA, 204 bp, Glycine max
  Peptide Sequence Number=SeqID_140372
atgacaagtcaggtctcacaatggggagaccagtcagggtcactctatttagcaagaatgctccaaccatgtgtgatgagaatcctgaaactggccaattacagactaaaggcccaagtgaagtacgaaggctcaagtggaaaaggacaaagcccccgagtggagaaggatgatgatgtgaaccttacggggcggaacgtttga

SEQ ID NO: 23595 - DNA, 201 bp, Glycine max
  Peptide Sequence Number=SeqID_140373
atggagattgagtataagtgcaaagttgaacgtgttaaattgcgagatacacggttagatctaaatccgggaggtgagaccctgacggattcttcggattctaggctttggggggtaaagacactcaatttgagtgctcctttaacctatgttgatcatatattgttggagcattctcacaagcagagtgaccctgactag

SEQ ID NO: 23596 - DNA, 445 bp, Glycine max
  Peptide Sequence Number=SeqID_140374
atgacccttgagtcagttgttgagctggaaaacggcaagatggttatggtcagcgaattcttcaatgaagacgatccggactttgaccactcgctcgaccagaaaatggcgattaactgggtagaaagctgggaggttgtgctggccgatgaagaacaccactttctgacccgcgacgatgcgaacttcgtcaaaatggtcttcacgctggataactactcgcggctgctggatccgctctattacgatgtgctgctgcactcgttgaatatggcgctgctggcgaccctcgcctgcctggcgttgggctacccgttcgcgtggttcctggcgcgcttgccgcaaaagcaccaaaggctatctgaacgagttcctgctgtggttgggggtcatcgatacgccggtacgcattatgtacacgccgttagcagtgattatcggcctg

SEQ ID NO: 23597 - DNA, 693 bp, Glycine max
  Peptide Sequence Number=SeqID_140375
atgccttgttttgatgacaacattgaacctattcacgatacaaatgatgaggttggaatgaatgttgatgaagaactcgtgcagtgtattgaacctattttttacactgatgatgaggttgacacaactgttaatgaggagcttgtatcggatgatctgagtacattgtcaatgccatgtcgtaccattctaagtccccattcttcaaaagattatttgcattgtactgattcaaggatgaatcttttcaacaagggagagaatgatgtagaagtgtggtgcaaccatgggctaaaaagggatcaaagaaggaaagaggatagtttaaaggacattgctcctattagttatgttgccaccaatgttaatactctaccaaaagatagagtccaagccattgcgactcaagcaatgttgaagcaatgggaagaaacacaagagttagtgaatcaagcaataatgaagcagagagaagagacgcagatagagcttagagcatatgctgagcaacaatccccttccctatttctctttgatgtaagatccattggagcttgtaggccaaggatcttcttcatcaatggattcctttgcttcttggaagatgaatggaagttgaatggagaaggaagagagagagaggagatgccacttcaaggagaagatgagtctagaagaagctcaccaccatag

SEQ ID NO: 23598 - DNA, 498 bp, Glycine max
  Peptide Sequence Number=SeqID_140376
atgctcgaagactcggcaagttccgggcgtagtagtagtacctcagcggtcaatcaaccgcttccgggggaacaagctatgcctcccgctcttcctgttatgcaggaagctgctaatcgggctctgccctacccctatcaaaataatgagattatagggggggacagtgttgaatccatccaacggaggcttttggggagattcccctctccttcagcccatgagattcaaatggcccggattgaagccgaagacctattcgaggtcaatgtcgatatttgtcaggtcatggcgggccttcacccaagcggggattggatgggacggggggctagagctctggataatcttcgtaccgccactggagaggagtccttaagtaagctccttcgaatgcgggaggacctacagactgcgggtttgcagtccgcaaccttccggcaattggccgacagagtggcattccgggcggatggagatcaacactctgccacctag

SEQ ID NO: 23599 - DNA, 255 bp, Glycine max
  Peptide Sequence Number=SeqID_140377
atgtcgatcatccatcctggcgggcattctcgaactcatgccaagtccccaactgctttccgggcggcgatccatcgccggcaatgtctacaccatcaccatggtgtgccggaatcgctatcgcgtattcgattgccctgccaatgcccaccttgccatgcagctcctcggatcgatggatcgggaaggcctgactgcatcacttgcctggatcatcatgccggatcacattcactggctggctcaacttcgtag

SEQ ID NO: 23600 - DNA, 315 bp, Glycine max
  Peptide Sequence Number=SeqID_140378
atgaccttcgatgctcaccacaagccgccatttcttgccgttgtacctgggcatagagaggaacgctttaatcagagtggaatccttagaatccacctcaaggattcagtagagaaacaagccctgaacccttctttcatgctccatgtagagcttgtaggccttgggtcttcttcatcaatggagtgttttgcttcttcaagatcaatggtagcaaaatggagaaggaggaaaggtgattggagatgccacttcaaggataagatgagtcaagaacaagctcaccaccataggaagccatggataagagcttga

SEQ ID NO: 23601 - DNA, 1374 bp, Glycine max
  Peptide Sequence Number=SeqID_140379
atggttctaggcgtgtttttcctccttgttcttattggcctccatgatggtgctaagtgtgttcttgtttattgcacgcgtctcctctgccttttgttctcctccgcaatggtgctaggcgtatttctactctgtgctcgtggtactagggttgcaattgcctgtttgactgatccttcgtcctttgaagccttttgcggtaccattgtcgtcgcttgtgaaggtatttgggagatcatgtctgacatggaagattactttccttatttggactcggacaaaggaaatgtggatatctttgtgcattttatggagaaacctagtgaatcatgtgtagttcgcaaccaggacttggaaaaatttggcattttctatgcacataaagatgtttatcactttgcagaccaattgaaattgccaccatgtaatttgtacaccctttggtttaagtctagtgttggtggtaaaatcctacccctcaaggatgatgtaggtgtgttaaagatgtattcaaagaaccaaaatcagagatatatccatttgtatgcttgtagaaataatgatgagttttggagaaaacctttagctatcggtgagaagttgattgaacccattagtgtggcagttgaacctgtgaatgaaagtgtcagtgtgaatgaaaccataggtgaagttatgaatgaagtgttgaatgatgttttaaatgaaggtatccatgtgagcttcaataaagatctaagtggaaagaataatgctgaaaatggaagggaatatgcaaatgagcaggttcatgcaaatgcacatgaagaggtaactcatgaaaatgttaaaggtcaagatgaggtctttgtgaatgatgaggatgagactttcaatgggcctcgcaatgtcaatgggtcgtcaggtaatgaatatgaccatttcaatgatgaagattgtgggagtgagatacatgacaatgatttcttgagtgactttgaagaaattattcatattgttggaaatcatcatcattctaatgatgagattattgaaatctacaaggaaaatgggatttttggaaaatcgcatgagatcccacaaaatggaaggatacatctagaagttggtcaattgtttatggatttgaatcattttaggcaagttccgaaggatttttctatacaagaggggtttcagctaaagagaattaaaaatgtaccatctaggggatttgtgagagggtgcaaaccttgggtgggtattgatggatgccatttggaaggaccttttggtggggtcttgctatctgttgctgccttagatggaatcaagggcatgttccctgtagctattgcaatggtggagattgaaaacaaagattcatggacttga

SEQ ID NO: 23602 - DNA, 306 bp, Glycine max
  Peptide Sequence Number=SeqID_140380
atgacttcgtcactcataaagatccaaggtgaacaggtcctcaccaacgattttcaggacctttcaatcaaaaatggttcgctcaaaggtaaccctccatctctcaacaccctgtccacatccagtagcagaaactccatcatcgtcaatggaatccaccggttcatgcggcatgagcccccgcagcgcaacggccttgttgttcggagccaccatgttcatggtcatggtcaccatggtcatgttgcgaagcctcatcacagcgacaaagtagctagtgccaccgttaacatcaaggttgtgtga

SEQ ID NO: 23603 - DNA, 2070 bp, Glycine max
  Peptide Sequence Number=SeqID_140381
atggcaagggtggagaatgtgggaaaagagaagggtaaaacgggaaaagtaatgggtagtggtcattgtcacgcagacccggcttcaagtgtgagccacatgaagaacttgaagtggcacaagcaaatttccaacagtggcaacaagttggggagaaggctttcgcttggggagtataaccgtgcagtgtcatggtctaagtatttggtgtcaccaggggctgagataaagggtgaaggagaagaggaatggagtgcagatatgtctcagttgctcattggatccaaatttgcctctggaaggcacagcagaatctatagaggggtttacaagcagaaggatgtggcaattaagctgattagtcaacctgaggaggatgaggacttggctgcttttcttgagaagcaattcgcttctgagtttattgctgcttgcaagaaacctcctgtgttttgcataattactgaatatttggctggaggttctctgggaaaattcctgcatcaccaacaaccaaatatacttccactcaaacttgttctgaagttagccctcgacattgcgcggggaatgaaatatcttcattctcaagggattcttcatagggatctcaaatcagagaatcttcttctgggggaagatatgtgtgtaaaagtagcagattttggtatctcatgcttagaatctcagtgtggcagtgcaaaaggattcaccggaacttaccgttggatggcgcccgaaatgataaaagaaaagcatcataccaagaaagtagatgtgtatagttttggcatagttctgtgggagcttttgacaggaaagactccattcgacaacatgacaccagagcaggcagcatatgcagtttcgcacaagaatgcaagacctccattgccttctaagtgtccatgggcatttagtgatctcatcaatagatgctggtcaagcaacccggataaaaggcctcattttgatgagatagtgtcgattttggagtactacaccgaatcacttcagcaggatccagagtttttctcaacttacaaaccgagtcctactagtagtaacacaattctggggacaaaaccatgtagttcaagatctaaggcaacacccacaccagagcttggatatgtgagtctaggtgaaccacatcaagagtacaatcttgtcaaagataaagatcgttgcaccattaaggacaacgatatgagtttgaagaatcggctaagttggttgtttttgcacttttcacttgtgctagagatccttgtatttttcaagaggaaaccttcagtattagaaaaagaaggggaaaagatcaaggctcacttggtatcaaaggggtatgcacaacaaaagggggttgattatcatgagattttctctccagtcgtaagacacacttcagtgctagccttggtagccagttgtgacatgaacttggagcagatggatgtgaggacaaccttttttcacagtgatctagagaagcaaatttatatggagcaaccaaaaggtagtctccaaggtagtggtacaagcggtttgactcttacatgtttcggattggctacaggcgatgtaagtatgattgttgtgtttaccaaaaatgttgacatgaaggacttaggtcctgccaagaagattctagggatggggattcatagggataggaaatcaagacaattgtggctttcactgcaggactatgttgagaagacagatgctgaggtgaagtacatgtcaaaggttccctatgtcaatgtagttggttacttgatgtatgttatggtttgcattagaccggatttggcacatgctgtaagccaagtctacaagttcatgtctgacctaggaaagcgacattgggaaagagtaaagtggatctttagtgatcctttagttgtgggatatgtggattctaactatgctggtgatttagatgacaaaaggtctacaaggtatgtttttacttttggagggctagtgaaggagttgggcattgagcaaggtggagttcagttgcattgtgatagtcagagtgctattgacttgacaaagaatcag

SEQ ID NO: 23604 - DNA, 117 bp, Glycine max
  Peptide Sequence Number=SeqID_140382
atgactatatgctgtagagaagaggaacattacatcaaacatatagtgaaggaaggagctttgagcgggattcctcaattcaaagaacactttggccccttaaaccatctctattag

SEQ ID NO: 23605 - DNA, 234 bp, Glycine max
  Peptide Sequence Number=SeqID_140383
atggaatacttacttgttggtgatgaacaaaagcgcaaaacggaatcaaaaaatgcgaaaaaggatgaccctagggctgcaaattcgtcaatcccgtgggggaacattaaccatgtcccctccttccccaaggtcggtcgtgaccccatccccacttgcatccgtccctgtgtacctgcaagtaagaaacaacctggtgtggccaatcttgaccacatcgctgtcttaccttga

SEQ ID NO: 23606 - DNA, 807 bp, Glycine max
  Peptide Sequence Number=SeqID_140384
atgaacaaatcgcagtcgaagaactccaagtcctcgactcagttcgactcgccgctcagcttctactccccgatgcacggggacggtaccgagtcgccggagtaccggtcgccggaaaactggccggagaagcgcgacaactccatggccatcgtgaccgccggcaagctcaagcagttcacgccggagaagcgcgcagagcaccggaagccgccggaaaatccgccgtcgacggcggtgatggtgttcaacgcctcgtcggcggaggaggctcagaggccggcggcgaaggcggctccggtgatcggaggagaacggagatcgaggtcggcggcgacggaggagacggttagcaaggcggcgctagggttccggctgagcgaggttgtggtgtgtctgatttcgttttctgttatggccgcagataagacgcaaggttggagtggtgattcatttgatcgctataaagaatataggtattgtttatctgtgaatgttattggatttgcatactctgcattacaagcatgtgatctgacatgtcaaattgccacggggaaacgcttaatcagtcaccaccttcgcaaccactttgatttcttcatggatcaggttctggcatatcttctgatatcggcatcatcatctgcagcaacacgggttgacgattggatatcgaattgggggaaagatgagttcacagaaatggccactgcttctattggaatggccttcctcgctttcgttgcctttgctatcagctcactcatctctggttacaccctatgcaaccgaagctccatgtga

SEQ ID NO: 23607 - DNA, 222 bp, Glycine max
  Peptide Sequence Number=SeqID_140385
atgacaattctcagaagattcggacctccactgcaatggaatgtagttgtgcttgacaaaggcatcggtgacaagtatgtcactctcccttggtacaaattccttcaagaaggtgattttagccatggagacgagctctcattctactataggcgtgctgagaagatctgggaggttgtcatcaggcatgcaattgattgggatgatagtgatatagattag

SEQ ID NO: 23608 - DNA, 1917 bp, Glycine max
  Peptide Sequence Number=SeqID_140386
atggcggtggcgggtgtgtcccaagccatctcctccaccaccgccaccagaaccccctcttgcatcgatttccactccaaaaaacctttccttttgggcctggcccactctccccagcccaacctctcaatctccgccagaaggagccgcaacacccactgttgccgctgcaccctcaattccgacgacacctctctcagctgggattggaaccgatggtgccgccacttctccgacattgaacaggccgaaaactttgcctctgtcctcaagtttcaacttgatgatgctattgagaaggaggactttgaagaagcggttaagttgaacagggctctatcagaagcaacgtccaaggacactgttgctgaaattatggatcagttgaaggcaagagcagcacaatttagtgctatagatgatgaacggtatcatgatgcttcgagattgtgtaaatgcactggaagtggactggtgggttggtgggtagggtactcaaaagcctcagatgacccctttggtagaattatacatataagtcctggtatgggtagattcattggcaagagttacagtcctagacagttgatgcgagcatctacggggactccaatttttgaaatttatgtggtaaaaaatgctgatgacacgtatcatatgcaggtagtgtatttacgacaagccaaaggaaagtcaaggagaaaccctcaatctatacctgctaaaggcccatccaaacctgaggtggagaatgcatcttcagttgaggtgcaagaacctgaagagaagattgagagaaatgatgagaaaaacagtaatatcgagggagtaactgaggagggcattaaaagtgtcataaattttcttaaagaaaaaattccaggattgaaagtcaaagttatgaatgttaacgttgaagaggaagcagcagaaaacaatgattctattaagcaattgatggaggaagatagtaatgaatctggctccagtgagaatcacgaagaggaagttaataatctagatgaacctgatgcggtcactctagaaagagatggagatgtcacagaagaagaaaaggattttgaaatgaagctttttattggtggggttgtacacaataatgaagatactcctgtcaaggatgaatttatacgtcttccagctgaaataaaaaatattgaaaaggattcttttgtctttcattttgctagtggaaatgtagattatggtatcaaagaagataaaattcccaacatcaaagtagcagccctagcagcacaaggaatctccgagcttatgcctcctgatgttgctaatgcattttggagttctgacaaagtctcttctaaggtctccaaaagcatgcgtgatattgtcagagttgctatgagtcaagcacagaaaagaacaagattatctggggatacaaattttagccggattatctgttcaagaggggattctgatccttttgatggactctatgttggtgcatttggtccttatggcatggaaatagtgcatttgaggcgaaaatttggacattggaatgaagtgaacaatgaaaacaacacttcagatgttggattctttgaatatgtagaggctgtgaagttaactggggatcttaatgttccagctggccaggtgacattccgtgctaaaattggaagaggcaatcgcaacaccaaccgagggatgtatcctgatgatttaggagtggttgctagttataaaggccagggaagaatagctgactatggttatcgaaatccaaagtgggtcgagggagaactgctccaacttaatggcaagggcatgggaccatacatgaaaggtgcagatcttggtttcctttatgtcgtgcctgagcaaagttttctcgtcttgttccaccggttgaaactacccgagtga

SEQ ID NO: 23609 - DNA, 201 bp, Glycine max
  Peptide Sequence Number=SeqID_140387
atggtattccctcaaacctcaagaaagaacatggtagcagcaccatacagtctacatagcttgaagttgctgtgcctcagcaacatagagtgcattataacagatctaaggacagccaagcataaatctgacagcgaaagaaagcagaattcactaggcaataggcatctagaatcaataaacagcaacaaattctattaa

SEQ ID NO: 23610 - DNA, 228 bp, Glycine max
  Peptide Sequence Number=SeqID_140388
atgttgcctggagggggccagaaatggggcttccttatctggttactttttagctactgtggactcctctgtattgcttgcttggcaatgcggaagtggttaaaacgaagacaagcacgcatgttaggtgctcaagagggtatccctgtatccgcatttgggttgagttctgtaatatttgttaatgttcaaaataactggtgctatgatgagtctatgatgctttaa

SEQ ID NO: 23611 - DNA, 267 bp, Glycine max
  Peptide Sequence Number=SeqID_140389
atgaaggaagaaagattgggatttgacacaaaccatttgaaattgacgcctctgatggccatagtgggcgaaattggagtggggtgtttcatgaagcgagttggtgttattgtaattgaacatcgaagaagaagcacagagaaggtgcaatctttattaactagagatggctcacaagagcgcttacatcatattgcacaaaggccagaacctggtgagagacttcctctaaccaatagttctcatgaaaatcaaaagcaagtctag

SEQ ID NO: 23612 - DNA, 390 bp, Glycine max
  Peptide Sequence Number=SeqID_140390
atggcgtcactgtcgctgagccaaattgcgtctttgattaacaatgattccaacgttgatttacataattcagcgattttcaccaaagttttgaagctttcaattaagcttgatgacaaaaattccttctgtggaatccacagagtgttgaattgtcaccatgcgcatgagatttgggacaaaatccacacccattactatgccacacttaaggctaaggtgcggcaactcagatccgaactgaaaaccacaaagaaagctgattccttgattgctataagagagacaatatctgatcaagaattgcttgatgttgtgatcgatggattacctgaggagtacaatacctttgtgatgatgatgcatgctaggcctgataagtttttataa

SEQ ID NO: 23613 - DNA, 1765 bp, Glycine max
  Peptide Sequence Number=SeqID_140391
ccccaaagcctcactcattcgctattggaacactcgcgtttccaataaccttccaatccctcaccttcttctctcaaaagcttcaactctcacaccacaccattacgctattctcagcaaacttctgaaccaaaaacctaaacctaatgaaaaccttcaccactctctctgctcctcaccgaacttactttgttccttcgacgacacaccgttcgctcaaacacacaaaaacgacgacgggaacttcgccgtttacagcaacaagcgcttcgccaactacggatcctcccgagtcggcggagtcgactcgttcaagaactactccaacggcctaaacgcgaacaacgacgcgttccggcggtacagcgccgcctccacacgccgcggcgagcagttcaagaactacgccgacaacggcaacgtcgccaacacgaacttctccagctacggctccaccgcgaatcaagcctccgccgagttcagcaactacgacaaaacggtgaacgttccgaatctcggattcaccacctacgactccggcgcaagtaatcacaaactctcattctctagctacgggaacgaaacgaactctggatcgcaaactttcacgagctacggaaaacgcgttcgcggcggaacgagcgagttcgcgaactacgccgacgacgcgaacattctgcagtcggagttcagcagctacggagacttgaccaccggagcgagcaacgactccttcaagttctacagcttcaacggcaacaatccgcgacacgttttcaaaagctacggcgacggatccgccgccggagttgacagtttcatcagctaccggaatcgcgccaacgtcggcgacgactcgttccagagctacgcggtgaggtcgaagtccggcgccgccacgttcgcgaactacggcatgtcgtttaacgtcggaaacgacagtttcactgagtacggaaagggagcaatggggaaaacgtctttcggttttaaatcatatgggttaggccgcgcgtttaaggtttacaacaaagacggcgcgtcgttttcggagtatcgaaatttcagcgcagccaggggcaaagttgtaaataagtgggtggagccgggtaagttttttagagaatctatggtaaaagaaggaaacgtgattccaatgcctgatattaaagataaaatgcctgcaaggtcgtttttacccctggcgatcgcgtcgaaattaccgttctcgtcttcaaggattaatgaaatgagggaagtgttccacacgcgggaggggtcttctacagagcgcgtgatggtaaaagcgctgaaagagtgcgagagggcgccgagtaaaggcgagacaaaacggtgcgtttcatccgcggaagaaatgatagggtttgcggtttcggttctgggtcccaatgttgcggttcggagcaccgagaatttgaacgggtctggatcgagtgtgatgattgggaaggttcactcaatcgacggtggaaaagtgaccaagtcagtgtcgtgtcatcagagcttgtacccttacttactgtattattgccacagtgtacccaaagtgagagtttacgaagctgaaattcttgacgtggacactctggagaagatcaatcatggggttgccatctgtcaccttgacacgtcagcatggggcccacaacatggggcgttcttggcgttggggtttggccctgggaaaattgaagtgtgccattggatattcgagaacgacttgacgtggaccactgccagttga

SEQ ID NO: 23614 - DNA, 249 bp, Glycine max
  Peptide Sequence Number=SeqID_140392
atgcccccaaccctagccctctgtcactcccctttgcgaccatcatgcctccgtgactgtcgtgccactgttgcacctctattgtcagcccacgtcgtcgccaggtcttcaatcaaactcgtgaagaacttgcactttctcggattgacatacaccatgaaggaaagtggtttcaaggtactctcctttctccaaaaatattttcttctttactatcgctgcattgccacacggttaagcgttggttaa

SEQ ID NO: 23615 - DNA, 705 bp, Glycine max
  Peptide Sequence Number=SeqID_140393
tagtcttcgggcgtcggctcgctgcggcgcgggccgtagccgccgacgtcgccacggttgtcgagcgcgtggccgttgcgcacgcccgcctgcaccagccagaaggtgttgtcatggatctgcccggccagcgcggcgttggcgccccaactgctgtcggcggtgtcgtagtcggtcttggccagcgcgccgaaggtcttgccgtcggtcagcaggtcggccgggctgagcgtgtacaggtcggccagtccggaaatggcccccgaaccgcccgagccggcgtcggcgccacgcacgatgtccaggcgcgacagcgtattgaagtccaccgcctccaggccacccttgacgccccgggcgccgtcgtcgagccacggcagccggatgccatcgacccgcgtcagcacgcggtcttggtcgagcccgcggatgttgatgctgttgttctggcggctgaagctcacgccgggttcggcgcgcttgcccaggtcgctccagttcttgatctgcagatcgtccatgcgcttgcggtcggtgcgcgtttcccatgccggcgccgccaccgcgccttcgccctggaccgtgaccggcgcgagttgcgcgacacccggctgcgacaaggcctgcaacacgaatacgccggggctgcgctcgcgcgcggccaggccgctgccggccagcaggcgggcaaagccgtcagccacg

SEQ ID NO: 23616 - DNA, 1044 bp, Glycine max
  Peptide Sequence Number=SeqID_140394
atgtctacaacacaaaattcaacatgcaatattcatcaggggagtgacttggctgaattgttgcagaggaaaaaattaataatttgggacgaagctccaatgtgtcaaaaatttagttttgaggcagttgacaaaagcttaaaagacatcatgcacaacaacagaccttttgggggaaaggttattgtttttggtggtgattttcgacaaatactacctgttgttccaagagacataggtgatggcaaacttggccaacctaacgatggacattgcgaaatcaccatcccagatgagtttcttataatggattttaaggatcttatccaagcaattgttgatgcaacatatccagatttattacaaaactacaacaacacagatttcttgcaaaagagagttatcctagcctctacaaaagatgttgtagacaaaataaatgattatgtcctgtctttgtttcccggtgacgagaaagagtattgtagtgctgatagtgttgacaaatctgatgaactactcaatcatacttttggagtactaacacctgagtttcttaagaccttgaaaacatcagggatacctaatcacaagctaagaatcaagattggtactcccatcatactactccgaaatttggaccaggaagatggtttatgtaatggaactcggctaattgtcaccaaacttggaaccaatgtagttgaagcagaggtaataactggaccgaatgtaggtcataggacatacataccaagaatgaatatgtgtccttctgattctccatggccattcaaattaattagaagacagtttccattcatcatttcatttgcaatgactataaacaagtctcaaggacagtccttggcacatgttggattatatttgcgaaacccgatattttgtcatggccaactatatgttgcactttcacgagtgcaaagtaaaaaaggactatgtattcttattcatgataaacaaggcattgcaaaaaatactaccattaatgtggtatacaaagaagtatttgcaaacttataa

SEQ ID NO: 23617 - DNA, 265 bp, Glycine max
  Peptide Sequence Number=SeqID_140395
gtacagtgcacggactcatactgtctctcgcccaacctttgctcaagagttcggacactcgcctttcgatctccttagtttcttgtgggttgtgtcgcaacgtgcccttcgcgggcgagcgagggcgaggctcacgggtgcgctttccaaaggaagaaagatgcgcggagtcgccaccaacgtttatttgtggaaaacatcggaaaaatcgaaggaaaccggtcaaaatgaaaattctaagttcgggagttatatttacgcttga

SEQ ID NO: 23618 - DNA, 399 bp, Glycine max
  Peptide Sequence Number=SeqID_140396
atggacatgagcattggtggtttgatctttggacagatgaccatgatggctcagtctaactcttctcgcttaggcttcccaactttaatcacaaccttgtgtagattgaggggagttggatctgatgctcttacctcctacgagaacctaagaccggtcattgacttagcctatatcataaggaactgttggaatgcgaatgaccaaacggttaattttcctgaggcaaggaagaccaagctcagagcagctgatgttccctcttcctttgcaccaatagctggcatctctacatcttctacttcagccccacctccagctttagcagacagatgtgccatcattttcttctattttctaaaccctttttgcaccattttaattactgattggtcttaa

SEQ ID NO: 23619 - DNA, 315 bp, Glycine max
  Peptide Sequence Number=SeqID_140397
atgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 23620 - DNA, 171 bp, Glycine max
  Peptide Sequence Number=SeqID_140398
atgaagaagagagtagcaagcaccagcactgagtcctctaaacttgatcgcaaaaccattgaaaagaaccgcagaattcacatgaaatccctctgccatcagctttcttctcttattcctcccaacctcaagcctgccaaatccaagaagtttgaaggtttgcaattgtaa

SEQ ID NO: 23621 - DNA, 513 bp, Glycine max
  Peptide Sequence Number=SeqID_140399
atgtcagttctagaattgtacatagaaaaggatgttggtggtagttctatgtttcattctgcaaattctgttacatgtggaaataatttatctaatgagttggaactgccaagaaatgtaagcaatttacattatgatgatgatgattattatcttgtgtctaactcatatgttaaagagtctttagacgaagatgataatgttgatgatatatctgatatagacgatgaagtcatcgacatgattcaaccaataacaattgttcacccaacagaaggtgtagaagaaattcaaaatccattttggaatgatgttttgcattataacaatatcaattggagtcatcctgatgaagaggacatttgcagtttggagatgccatcgagttttaatgttggacaagaattatatgttggcatggattttgatagtaaagatgtgactgttagacttaatgtctcatgtgagagacatgtgacttatgagaagtttctagagctaactgctacttga

SEQ ID NO: 23622 - DNA, 1332 bp, Glycine max
  Peptide Sequence Number=SeqID_140400
atgaacagaacgcattctccatcttgcaacccttcgtttctcgactgtggtaccatcaccaactacgaaaggcaagcttggttcaaacgaaccagagttctcagtgattgcgatgccctcaatgacaaaaacgagtttcagtttggaatgttcgctgatgctttcactgatcatgtctcctcatcaagattctttcagaaatacttttactgcctctggtggggtttgaagaatctaagttcatacgggcaaaatcttcagactagcacttacagtggtgaaacattgttttccagtttcatatgcatcgcaggtctaattctgtttgcgcatctcattggtaacatgcagaattatctgcaatcctcaactgctaaagttgaagagtggagacttaaacagaaagacacagaagagtggatgaatcaccgtcagcttccaccagaactgcaacaacgtgttcgcaggtttgttcaatataaatggcttgccaccagaggagtagacgaagaagccattttgcgtgctttgcctctggaccttcgccgccagattcagaggcatctctgtctcgacattgttcgtcgagttccattttttggccaaatggatgaccagcttctagatgcaatatgtgaacgccttgtttcatcgttaaacacaaaagacacattcatcgtccgcgaaggagatccagtgagagaaatgcttttcatcatcagagggcaagtagagagttccactaccgatggtggaagaacaggattcttcaactccatcaccctaagacctggtgatttttgcggtgaagaattgctaacatgggccttgatgccctcctcatcaagtctcaaccttccatcttccactcagacagtcaagactctcaccgaagtggaagcatttgccctaagagccgaagacctcaaattcgtcgccagccaattcaagcgcctccacagtaagaaattgcagcacgcttttaggtactattcgcatcagtggagggcttggggggcacattttatacaagctgcgtggagacgccaccgcaagaggaaattggcgatggagttgctggagaaggagaacttgtactacacaaatgtaatggaagatgatgatgaagaagaaggtagtgcaggtgagagttcaatggcagggcatgctcagaattttggggccacatttttggcttcgaaattcgctgcaaacactaagaaaggggcagttaaaaaggtgactattaatcttccagatgctggtagtttgaagatgcctaagatgttcaaacccacggaacctgatttctcaatattccatgatgattag

SEQ ID NO: 23623 - DNA, 1092 bp, Glycine max
  Peptide Sequence Number=SeqID_140401
atggctgtcttcaattcattgcataaaacttccacaagattttttgttcccacagggagaaactctggcaagtggggaaacgttaatagattcagcactgcagcagcagttgaggaattaatcattccacaagttccaataacatacactaagcatttgataaatggacaatttgtggatgctgatgctgcttcagggaaaacttttccaacatatgacccgcgcacaggagaagtgattgctcgtgttgctgaaggtgatgcagaagatatcaaccgtgcagtatcagcagctcgcaaagcctttgatgaaggaccttggccaaaaatgactgcttataaacacagtgatgaacttgcagctctgaagacatggaacaatggaaagccttatgaacaatgggccacttctgaattaccaacgtttgtgcgtttgtttcgttactatgctggacaaatcataccttggaactttcctctcctcatgtttgcttggaaagttggaccagctcttgcatgtggaaatactgtcatccttaagactgctgaacaaacacctttaacagctctctatgtggcaaaagccggtcttccaccaggtgttttgaatgtagtttctggctatggtccaactgctggtgcagctctagcaagtcatatggatgttgacaagctagcattcaccggatctactgagactggaaaagttgtacttgaattggccgcaagaagcaatttgaagcctgtgatattgaacttggagggaaatctcctttcattggggcaatgttgctgtgctgggtctcgtacctttgtacatgagcgtatctatgatgagttcttggagaaagcaaaggctcgtgctttgaaacgtgttgttggggatcccttcataaagggtgtcgaacaaggtcctcagaattggctcaaagggcttctttgtccagcctactgtcttctcaaatgttcaggtattaacaaattagcacaagtgattcacaaaatctacaataccttgaagcattttctaacccgtgctaataatcaggatgacatgttgatagcaaaagatgaaatttttggccctctataa

SEQ ID NO: 23624 - DNA, 153 bp, Glycine max
  Peptide Sequence Number=SeqID_140402
atggtatttgaaagttcttcagagtgggatgacaaggaggaagggaaagaagtgactcaacagtgggaggatgattgggatgacgatgatgttagtgatgatttctctcttcagttgagaagggagttggagagcaacaccgagaagaactaa

SEQ ID NO: 23625 - DNA, 315 bp, Glycine max
  Peptide Sequence Number=SeqID_140403
atggaggaattctgcacactaacactagcaggaccatctcttggaatgacaagatttgtgaaggtgtacaattcatcatgtcccatagtgccctgcagcagcactttccaggagtcatatgacatgatggatggtgcaaaagtcaagaatccagataccaagtatcaaagccagatagtgaggcctgtaatgattgtggacatgcagcagttgattgcatgtgactttggtcaacatttctacaatactggtgtgaaggaacaacttcaaaatatggaaagaggcattggacatggaatggaagcattaagatag

SEQ ID NO: 23626 - DNA, 723 bp, Glycine max
  Peptide Sequence Number=SeqID_140404
atggccacaatgattgaggtcgtgatgagcatgaagaagatagtggaggtcaatgcggctgcagttgttgctaccagtgtcgttgctgaggtggacccgacacccccatctggcctcaatcaaataaatcatccaatctcagatatggtaggtcagggaggcaaagagttgggaagtaagggtggcccccattttgtgcaagttcagaacaagcatgccttcccaccatatagcttgcctcccaactatacaccacccaatgttgcgcacactctcaatgagaatgtcaataactccacccccatactcattaagagccaacaacctcaatttgatcatgcacgtgtctctcaacccatggaagagacacatgaagcaccccgagaccacaatctagcagacttggaaccttacctcggatatgccactgaggggcaagcagttggtggtatacccttgccaaacattttggagggcgctcaatttcttccacaaccacaaacctttcattttcacggtggggagagtccctcttgctatggtggaaagggggaaattttttttcatataaaggaaaggctgaggaccattgaaggaggtggagattatgctttcgctgacatggcagggttgtgcctaatccctgacatcgtcatccctccaaagttcttggtgtacgatatcgataagcacaaggggattacctgcccaagaatcacttga

SEQ ID NO: 23627 - DNA, 102 bp, Glycine max
  Peptide Sequence Number=SeqID_140405
atggatgcagaaaaggaagaggacctgaaccagtccatgtatttgctcaaggatcgtaggccaagagtaagagaaaccctgctccattttcttggtttatga

SEQ ID NO: 23628 - DNA, 303 bp, Glycine max
  Peptide Sequence Number=SeqID_140406
atgagaattcaagggactaaccgcctaagaattctttgtcctaacacattgaagggtacatcctttgtgggacaagtagaaggtacatctacttgggttgttatactgagaacaagagaggatacatctcttgtggatcagttcaagtggagggtacattcacttggttgttcaaagaaaacaagggagggtacatcccttgtggatctttggcttgtaaaggattttacaaggttgaaagaaatctcaagaaccgttggttgcttggggactggatgtaggcacgggttgtggccgaactag

SEQ ID NO: 23629 - DNA, 1152 bp, Glycine max
  Peptide Sequence Number=SeqID_140407
atgggctttgatccaaagtgggtaacttggatgaggatgtgtgttgaatctgtgaactttaatgtgttggtcaatggagaggcagtgggacccatttcaccagggagaggacaggggaacccacctcaggtctttccatcatcttccagaaatctgaatttttttagcagaaacacaccacccagcatcaagcaacaaatctctggacaactgcaagttacagattgtctgggaacagggaaataccttgggatgccctctatgaatgtgctcatcaaatcagtatctcaagctattcttgcttactgcatgagtgtttttctcctcccttctacccttcaagatgagatccaaaagatgatgaactcattctggtggggtagtaatagaaactatgggaaaggcataaattggctaagttgggagcgtctaacaatcaggaagaaggatgaatatgggaaaactgccaaagtttggaaggacccatcgccacgatctactgatggttcattcgtcaccaaccccattattgatgcagaggatgtcactagaattctttcaatgccaacctatttcagggatgaactagacaagcttacatggatgtttagtagagatggattttacacagtcaaatccgcatactttcatgctacacagagtatggtagacaactcaagtctgcgtgaagaaggacggcttctaacaaagggtgttgattgcccacccacttgctctttgtgctcacattatattgaaaacgattggcacatttttgttggttgtgagcatgcgaagaaggcttgggaggaggtatcgctctggaacaaaatacaggaagttgctgtaactggggatgacatgaaatcacttatattcacatcattaaaagcattcaccactgttcaaacagatacctttggtttctttggaagcgacggccttcttccacccatggaagctgaagatcgagctctatctcaagttataacttggttactgaacaacaacttcaccaaagtcatcctggaaattgactgtcagcagctagtggacaccatcaacacgagctatttccaaaaaaatgaagttggagatatcctaaagctctgtgtttctaaatgttcaagttttgaaaactgttcaatttag

SEQ ID NO: 23630 - DNA, 3687 bp, Glycine max
  Peptide Sequence Number=SeqID_140408
atggacattgatttcaaagaataccaattgcgctgcgagcttcgcggacacgaagacgacgttcgcggaatatgcgtgtgcggcagcgagggcatagcgacgtcgtcgagggaccgaaccgtcaggttgtggtctctggacgacagccgcaagttcgtgagttccaagattctgttgggccacaccagcttcgtgggacccttggcatggattcctccgaattcggagttcccgcatggtggggtcgtgtctggcggcatggacacactcgtgtgtgtctgggacttgaagaccggtgagaaggttcacactctcaagggccatcagctgcaggtcactggcattgcctttgatgatggggatgttgtgtcctcttctgttgattggaatgggcaatctgtagagtggtgggaggctcataaggcaccagttcaagcagttataaagctgccttcaggggagcttgttactggttcaagtgactctactttaaagctttggagaggaaaaacttgcttgcatacctttcaaggacattcagatacagttcgatgcttgtctgttatgtctggtcttggaatcctatctgcatcccatgatggttctctcagattatgggcagtaagtggtgaagtgctaatggagatggttggtcatactgctattgtttattcagttgattcacatgcatcaggacttattgtcagtggtagcgaagaccattttgccaaagtttggaaagatggagtttgtgttcagagcatagaacatcctggttgtgtttgggatgcaaaatttatggaaaatggtgatattgtgacagcatgctcagatggagtagtacgcatttggaccgtagatcaggataatgttgctgaccagttagagcttgatttatacacttcgcaactttctcaatacaaagctagtagaaagagggttggaggattgaaactggaagagttaccagacttggaggcactgaagatcccaggaactactgatggccagacaaaagtagtcagagagggggataatggggtggcatatgggtggaacatgaaagaacaaaagtgggataaaattggtgaagttgttgatggaccagaggaatcaaatcgccaattttttgatggtattcagtatgattatgtgtttgatgtggatattggagatggtatgcctacccgtaagttgccatacaatcgatcagataatccatatgatgttgctgataaatggctactcaaggagaatcttcctctttcttttcgtgagcaaattgtacagtttattcttcaaaatactggacaaaacaatactacttttgatgcttcatttcgcgatcccttcactggctcccatgcttatgtaccaggacaaccttcacgtatgtctgatatttctgcgaaacctactttcaagcatattcctaagaaagggatgcttgttttcgatgcagctcagtttgacgggatccttaaaaagatttctgagttcaattgtgctttacagtctgaccaggaaaagcagaacttgtctttgactgagctcaatgtttccagactgggtgccattgttaaaattctgaaagatacttcacattatcattctagtaaatttgcagactctgatatagccttgttactgaatctgcttcgatcatggcctatggcaatgatatttcctgtcattgatattgtaaggatgctagttcttcatcctgatggggctattttacttcagaagcattttgaagcagaaaatgttgaagaagggtgggcagttctaagagcatccggatttttcttccgtgcttgctatgctgtgctattgattgaaacaaaggatcaagaaggtcaatctcaagttctatcggcagctcttgagattggtgaggatgaaaatgttgaagtcgaccccaaatttcgtgctttagttgctgttggatcactgatgcttgaaggtcttgtcagaaaaacagcactggattttgatgttgtgaacattgcaaaagcagccaagggttctaaggaaggcaagattgctgaaatcggatctgacattgagctattcaagccattctcaaattcaagccatggtgcaaagagagctcacactcttccactcaccatcagctgcaagctgaaaaactctcaagaaatgaaaaacaaagggaagagtgtgtcacagaagattgtgttatcagaggcttcccctccaccactcacagaggatgataagaacaatggtgatagcaaggatgttccagagagctcaaagaagaagggagggctttctggggtggccaatatgttgagaaggaagactttgcagattctctctaatttgccattggctattggggaaatgtttgctgttgcttctttaatggctttaggcacatttattgatcaaggtgaagcccctgacttttatttccagaaataccctgaagatcatcccgtgtttggattttttacttggagatgggttctcacccttggttttgatcacatgtttacatcccctatatttcttggagtgttggctctccttggtgcatccctcatggcctgcacttacacaactcaactccccctcatcaaggtttcaagaaggcctaagttgtttcatagatggtcatttttgcactctgctgaggccatacgtaagcaagaattttcagaatcattgccaagagcatcaatccaagatgttggtactatattgatgggagctggatacgaggtattcttgaaaggaccatctttatatgcttttcaagggcttgcgggtcggctggcccctgttggagtccatatagcattgctactgataatggctggaggaactcttagtgctactgggagcttcagaggttcagtcactgtgccccaggggctgaattttgttgtaggtgatgttctggctccttttggctttctgtcctctccaaccgatgcttttaatacagagattcatgtcaacaaattctccatggattattatgagagtggagaggtttcacagttccacaccgatctttcccttcgtaacatggatgggaaagaagtaatgaggaagacaatcagtgtaaatgatcctttaagatacggtggtatcaccatatatcagacagattggagtatttccgctctgcaaattcttaaggataatgaaggaccttataacttagctatggcacctctacagataaatggagataagaaactttttggtacttttctaccggttggagatattaactctcctgacgttaagggaatatctatgcttgctcgtgatctgcagtcaattgtcctttatgacaaggaaggaaaatttgcaggagttagacggcctaattcaaagctcccaatcaatattgatggctcagaaattgtcattgttgatgcaataggaagtagtggcttggaattgaagactgatccaggtgtgccagttgtatatgctggatttggtgctctaatgatcactacttgcatcagctatttgtctcattcacagatatgggctttacaagatgggacaacagtcttcgttggagggaagactaacagggcaaagatggaatttccagaggagatgagccgcttacttgataaggtccctgaaatagttgaatcaaatctacctaagcatgctgatagcattagtggttag

SEQ ID NO: 23631 - DNA, 552 bp, Glycine max
  Peptide Sequence Number=SeqID_140409
atggccagacaatcttggttagacacattccctgactgcaagctcatgaatactattgcaggagtctctgatcattcccctattattatggccctttttcgtcaagaaacgttgaagaagatgaccttgacacagttggaaggaatgggaggatttaaatctgcttctttcctaagaagaattattttggagacagagacccaaagttcactgataagggatggggatgctaatacaaaaaaaattcatgctattgcaaatgctagaaagaagaagagtttcatttcaaagctttctaatgacggcgaggatattatttctaatcatagtgatctttgtaaccttgctcgaaactattttgaatccctatatagctacaatgatgttgatgttgcagtcactgttgatcatgttgagccaaaattgactatgtttgataatgtctccctcgtaactccttttgaaaaatgggaattcaaggaagctgcttttcagatgcactctaataaatcccctggaccagatggctttaatcctactttctacaaatga

SEQ ID NO: 23632 - DNA, 801 bp, Glycine max
  Peptide Sequence Number=SeqID_140410
atgcgaaatatttgttctctctatcttgcagcaactgttgccaaaatttggaaaaggaaggaagaagcaacattgctagccagtggacttccatacacagtgagtgatagaccaggcaacatgcatgaagcccagcacggaaggcctcagaggaaggtaattgcagagacaaatgcaccaccaactcccatggagaaacttcttgcaaagataccttctcaacgcccttacatttcttcacccaaggaaccggatattgcagctgtcagtgttccagatccctcggctaatgttgtggctgtctatgatgatttaaagccgccatcatctccttctccatctcagcctggtgatgggaaacaaacaaagatcagtgagacagtgccaaaaccaagtgctttagattctccaagtagcgtgctaggagtacatggcatctctcagacaacatctttatctgaaatggagaagcctctttttccttatgtagcatatcctgacttaaagcctccaacatcatctcctaatgcatcaactataccattttccacatctgctggtgacggggtgccagagatagccacagtttcaagcaatggaccagcccaactttcaatagcagatgaaccaaaggaagaacatctcccagaacccaagtcaagatcactctcaccttataccacaacttctgaaaagtctatgccacagttcatatcgaggatggccagttggtcactcaaatatgaagagaagcatttctgcgaattgaaaatttcagcaatggcgtttatttttctatga

SEQ ID NO: 23633 - DNA, 429 bp, Glycine max
  Peptide Sequence Number=SeqID_140411
atgtacctcactgtccgtgagccaactctaccagtggcacccgcaacaaatactaagttgtcatccttagaatctgttttctcagaaattccctcagcggtgcaagggtacctcgtgaaatgggaaaggttgacatgggaggcaaaaggtttctcagtggcttctctacatgacaaagaggagggaatggtgactgtgataagtgactgtacggagaaagcctccatagccaaaggtagaaggatgtctcttagattgagaatgagatggggaattgttaattttgtgaatagttttgatcgtgtatgttatccattggcaccaatgtcattctctactgtgcgtgaatgtgaaatgatgattgatgcccatacccacatgtgtgactctcaagtcttgaggagttacatagattcaccacaatcataa

SEQ ID NO: 23634 - DNA, 330 bp, Glycine max
  Peptide Sequence Number=SeqID_140412
atggaggctttctccgtacagtcacttatcacagtcaccattccctcctctttgtcatgtagagaagccactgagaaaccttttgcctcccatgtcaacctttcccatttcacgaggtacccttgcacctcaagagccacaaagcacaaaatccgttgcaccaatgctcaagcttcaggttcaacaaaatctagtactagtaccgctgagggaatttctgagaaaacagattctaaggatgacaacttagtatttgttgcgggtgccactggtagagttggctcacggacagtgagggagcttataaagcttggatttagagttagctag

SEQ ID NO: 23635 - DNA, 861 bp, Glycine max
  Peptide Sequence Number=SeqID_140413
atggaggctttctccgtacagtcactcaccgcaaccaccattcccacctcctctctgtcacgtagagctgccactgacaaaccttcggccacctcccatgttaacctttcccatttcacaaggtacccttgtaccacaaagcacaaaattcgttgcaccagagctcaagcttcaggttcaacaaaatcttgtacgggtactgctgaggggatttctgagaaaacagattccaaggatgacaacttagtatttgttgctggtgctactggtagagttggttcacggacagtgagggagcttataaagcttggatttagagtcagagccggagtgcggagtgctcagagggccggtgcattagttcagagtgttgaacaattgaagcttgatggtgcaaatggaggggtacaagctgtagagaagcttgaaattgtggaatgtgatttggagaaaccagaaacaattggatcggcgttagggaatgcatcaacagttatatgtagcattggtgccagtgagaaggaagtttttgacatcactggaccctttcgaatagattatctggccaccaaaaatctaattgatgctgcaactgttaccaaagtaaatcacttcatattggttacttcactgggaacaaacaaaattggctttcctgcagctatcctcaatttgttttggggagtcctagtttggaaaaggaaggcagaagaagcactgctggccagtggacttccatacacaatagtgagacctggaggtatggagcggcctactgatgctttcaaggaaactcataatataaccctatcaacggaagatactttatttgggggtctggtgtcaaaccttcagctataa

SEQ ID NO: 23636 - DNA, 972 bp, Glycine max
  Peptide Sequence Number=SeqID_140414
atgtcgcctttgaaggagattgtggatggtattcacagtcaactttctgttagatttaggagatgggttgttgtagcaatatgttgttgtgtggtctctgtagtgctgaatcgttcctttatagtgggatcatggctagcgaattatagtaactattttatggttgcatggcttctacaagcttgtaatcaagtgaggagggatgctacatgcttcaattcagacttgatgtcgaagcagagtaattttggctcctttaaattaaaaggggttcactttggaaggaaaagtttaggttctcaaccatttgagtcaacagttgatattatggttcgtgtttctgagtataacaatatccgcagtcagcttaatgctatcaaccgaaagcaaactggaagtatgttctatttctttgctgatctacttgactatttcagcttagcagtccgtgatctttccaacttggtccccaggtcttctaagaagttgtatgaggataacgaatatgctctttatactgtaacactcttcagtcgtgttgcggataattttagaactagtgcacgtgaaaaagggttccaaattcgtgactttgaatacagtccagaaacacatgagaaccgaaagcaggagttagataaattggtacaagatcaggaaagattgagggcttctctgttgcaatggtgctataccagctatggagaggttttcagttcctggatgcacttttgtgctgtgcgtttatttgctgagagcattctgagatatggtctgccaccatctttcttggtaatatactcttctaaaatcaaagtgcagtctaatgacccctgggattttcaaacactgatcactgagtattgggtattccaggcatgtgttttagctccttctgtaaaatccgagaagaaagtacgttctatccttgaagggttgactgatagcacaaacaggcaagtggcttattaa

SEQ ID NO: 23637 - DNA, 735 bp, Glycine max
  Peptide Sequence Number=SeqID_140415
atgttgctttcattgttgcctcttataaatgggaatatatatgctctgattttcaaattgattgctgaactcttggcagtcatggccaagaatcgtgatctttcatattgtaaaatagtggaggcaattgcagagacaacttcaccgctgactcccatggagggacttcttgcaaggataccttctcaacgcccttacatttcttcacccaagaaaccagatattgcagttgtcagcattccagatccccctgcaaatgttgtggctaaggaacctaaagtagccactcaacaagaaactgcacaacctaaaccagtggcaaatcagccactttctccctatattgtttatgatgatttgaagccaccatcatctccttctccatctcagcctggtggtgggaaacaaacgaagatcagtgagacagtgccacaaccaagtgcttctgatactccaagtagtgtgctgggagtagatggcgactctcagacaacatcgtcatctaaagtggagaagcctctttctccttatgtagtatatcctgacttaaagcctcccacgtcaccatctcctaatgcaccaactgtatcagtttccacacctgctgcagctggggtgccaaagatagacacaatatcaagcaatggaccagcccaactttcgacagcagatgaaccaaagaaagaacatctccctgaacccaagtcaacaccactttcaccttataccatgtga

SEQ ID NO: 23638 - DNA, 1083 bp, Glycine max
  Peptide Sequence Number=SeqID_140416
atggctctccccgactcttcttcccgccgcaactccctgatcccctctttcatctactcctcttcctccaaaacgctccctctacaccacatgctcaactccgcctccgccgccgccccctccccgccgccggaaaacctccacgccggatcgcgcggcctcgtgattccctctcccagcgagtcacgcaagatcaagattcccaagatgtactccctcgagttctacgccgcctgcgccaaaggtggaatcctcagctgtggcctcactcacttggccttcactcctcttgaaatagtcaggtgtaatatgcaggggcttaaggagcagggattcagggcctttttccgtggctgggtgcctaccttgcttggttacagtgcccagggtgcttgcaaatttggcttctatgagttctttaagaagtactattctgatattgctggcccagagtatgcaagcaagtacaagaccttgatctaccttgctggttcagcatctgctgaggttattgctgatattgctctttgcccatttgaggctgtgaaggtccgtgtccaaactcagccaggttttgcaaggggtttgtctgatgggctcccaaaatttgtcagatccgaaggaaccttagggctgtacaagggattagtgcctctatggggacgacagattccatacacaatgatgaagtttgcttcgtttgagaccattgttgagctgatctataagcacgccatcccaacaccaaagaatgagtgcaccaaaggcctgcaacttgctgtcagttttgctgctggaaatattgctggtgtactttgtgcaattgtgtctcatcctgctgataatcttgtctcttttctgaacaatgcaaaaggagcaacagttggtgatgcggtgaagaagcttggcctgtgggatctctttacccgtggtcttctcttccgtattgttatgattggaactcttactggagaccaatgggttatatatgatgcattgaaattgtttgccggattgccaaccactggtggtcctgctcctgcagctgctctagcttctgatgctgagcttgcaaaggcatag

SEQ ID NO: 23639 - DNA, 195 bp, Glycine max
  Peptide Sequence Number=SeqID_140417
atgctttacagctacatgaaagaggagtggaatttgagatctgagtttgtggggcaggggaggagtgattcatgtgagaaagtcaatcttattgcatactggaagaccgaggatgaagtaggtgccgggatggctggcctagcaggtgatgccgatgctcacccctatgtgtctttcaccatcaatgttgcttga

SEQ ID NO: 23640 - DNA, 642 bp, Glycine max
  Peptide Sequence Number=SeqID_140418
atggaaactgcagttcagtttttgaattatagttgcagactgcagaggatgatgatgacgtggatccttatcctagtgtggcgtaacggtgctttggctggttcccttgaaacggtttctttcgggtgggacatgtggaatgtggcaaaatcaatagagagcttaatctatcaatcaatagccaatccaaatgaccctagaaggaaggagctagagctgatggagaagcaaaagtggatgattgatgaaaaggccaaggcccaggtccgagctgagctttattttgggctgggcttcttgacggtccagaccctcgggttcatgaggctcactttctgggaactaagttgggatgtgatggagcccatatgcttctttgttacctcattcggcttcgctcttgcttatcttttcttcctcaagacctccacagaacccacctttcagggcttcttccatcaccggtttaaggccaagcaagagcgtctcatgaagacacacaactttgacatgagtaggtacaacgagctatttaaggcatgctatacaaattatcatggtggtgccaaatttgaatcttcttatcccttccactaccttggggagacacatctaactgatctaagagccttgcatcgttga

SEQ ID NO: 23641 - DNA, 117 bp, Glycine max
  Peptide Sequence Number=SeqID_140419
atgacaccaataaagggttggatggtgaaaccgcaagatggttcaggtcgcacaagcaaggataaagcagtagactgcaattatttcaagcagctgattagacccctaaacatttga

SEQ ID NO: 23642 - DNA, 401 bp, Glycine max
  Peptide Sequence Number=SeqID_140420
acataaaagtgctgcaagctgatatgctagagctaccttttgaggatgaatgttttgatttggttattgagaaaggaactatggatgtattgttcgtggacagtggtgacccatggaatccaaagcctgaaactatattcaaggtcatggccacattgaaaggtgttcacagggttttgaaagctggtggcacatttatctcagtaacttttggccaggtttcaaaaattgttagatgtgttgtgtctcttttaatgagtattgctgtgattgattctaatctatctaaaattcatgccagccacatttcaggcgccctatatttaatgcaccagatttcaactggtctgttgagtggactacttttggtgaaacctttcactattttgtctatgttctga

SEQ ID NO: 23643 - DNA, 747 bp, Glycine max
  Peptide Sequence Number=SeqID_140421
atggctctaatcccaaactcaaaaacctctgcactcttccacctgctcctcttcttattaggcaatgtagcatatgccacagtgtttaccctggagaatcattgcagttacacagtttggcccggcacactttccggcaacggcgctgcccttctcggcgaaggcggtttcgccctggcacccggttcggcggtccagctcaccgcgccggctggctggtccggccgcttctgggcccggaccgggtgcagcttcgacgcctccggaagcggaaaatgtgtcaccggagactgcggcagcggactgaagtgcagcggcggaggcgttccgccggcgactctggcggaattcaccctcggaagcgccagcaacggcaacaaggacttctacgacgtgagcctggtggacggttacaatgtgggcatgggtgtgcgggctaccggcggaaccggtgactgccagtacgcggggtgcgtggcggacgtgaacggtgtttgcccggcggagctgcaggtgagagacggcagcggcgcggtggtggcgtgcaagagtgcgtgcttggcgttgaatacggcggagtattgctgcaccggcgaccacaacacgccgcagacatgtccgccgacgcattattcggagatattcaagaatgcgtgtcccacagcgtacagttacgcatacgatgatgcgtcgagcacttgcacgtgttctggatcagattaccgtatcacattttgctccacgtga

SEQ ID NO: 23644 - DNA, 552 bp, Glycine max
  Peptide Sequence Number=SeqID_140422
atggatatcgatagatactttaaatgggtattcgttatccatgggtacatgtatttttttactcactcgttaatggtgactgtggtcgttactgttgacggcgctgacggcgtcttcgtcggagttggggtcagtgttgatggagaggtcgatcgagccccagtcggcgccgaagaggacgttggtagggctgacgtggaggcggtggagcaagatcatggcgtccccggggcggatgtagtgctgcacggcccagcggaccgcgtaggcgctctcgtcggagaggtcgacggccacgccgattttgcggcgtgcgccggcggtgggggtgggggtggcggcggaagaggggtggtgatggcgcggggaggaggggtggtggattttgatctgcgggagctgcgggtcggaatccagtgtgggagggttctggtggtggcccaagttggtatcggtgatgccattggagagaaggtcagaaactcagaagtcagaaggaaggtgattgtgatggggaaacaaaagattcggagcacacggaaaaatgaatga

SEQ ID NO: 23645 - DNA, 773 bp, Glycine max
  Peptide Sequence Number=SeqID_140423
atggaagtttgtgagccagtcaaatctgaaaatagattaaagcaccgccccttgaccctattagtagcagttgtaggattgcggcttttcagcatacgttgtagtaggaagacagtgtcattcatctttggactttggctgtctctgtggccctctctatttgaaaagattaacaaaactaaagttgtgttttctggggatggtgttcctatgaaggaacgtgttttacttattgctaatcacagaactgaggttgattggatgtacttgtgggatctcgcacttcgaaaggggagactgggatgcataaaatacatccttaagagcagcttgatgaaactacctatctttggttggggattccacattctggagttcattgcagttgaaaggaagtgggagatagatgagcaaatattgcaacaaaagctttcaaccttaaaggaccctcaagatcccttatggctagctctttttcccgaaggaaccgattatactgatcagaagagtaaaaatagtcaaaaatttgctgctgaagctgggctccctgtgctgacaaatgtattactaccaaaaacaaaggggtttcatgcttgcttggaagctctgcgagcctcattagatgcagtatacgatgtgacaattgcatacaagaatcagtgtccttcctttctggacaatgtttttggtgttgaccctccagaagtgcacctgcacgtgcggcgtattcctgtggaggagattccagcttccgaaaccaaagctgcttcttg

SEQ ID NO: 23646 - DNA, 300 bp, Glycine max
  Peptide Sequence Number=SeqID_140424
atgcatttgctggttgtggaaagagtagtgcagaatgagttctggatttttgtatctgtactagagacttccagtaaaagtttcgagtcgatccaacggttaacgaatgggaacgaaggaaatgtttctggggtattgcttgggaggattgatggggacccggtgttgagagaaacgaggatatgggctacgtgggagtacgtgagctcagttggaggtgggcaacaggggatggtgggtttatgcccgatttgtggatgtggaaaacttgttgtgcaccatcacccgaccgccacctag

SEQ ID NO: 23647 - DNA, 309 bp, Glycine max
  Peptide Sequence Number=SeqID_140425
atggaatcatgcaatgtgaagaacaagtcaagtggaaaaagaaagatgtctagtgaggacacaagaagttacttcgcatggaacttggaaatggagcatgtgctagctgatgtgcttagagatcaaagaaatttgggcaataaaggtgatggaaattggaaagcaatagcatacagtactgcagctcaaagtttgtcgaagcattttggagttcacctcatggcagataatgttaagaactgttttaagctttggagaacatggtatgaaattgtgagtgacattcttagtcaaagtggatttggctga

SEQ ID NO: 23648 - DNA, 564 bp, Glycine max
  Peptide Sequence Number=SeqID_140426
atggagaataaagatcctaaatcatggagttctgcacatatccaccagtctcagtggcttcaaacaaccctatcagatggtgacaattctccaaacctagaaggcatgcatggcaaatggagaggagacctcgtccagatgcttgaagaatttggccaatcttatcgtgtattagccgtagcatataaccaactgaagttcaaaacatctcatggtgactttcatttagaatctttatcatcttctggtagatcagaaaccatttgtgctatctgcaacagaagagcaacaggtaacttggaggataaaaaacttgaggagtgctggaatcaccatctggattggaaccaccatccaaaatattccgtggagcattctgatatcaaatttgatagtagtaaccttggcattgatcttttaaaccagcaaggggatgagtgccatgaattcttatcagctgatctatgcagcatgaaattcaaatcagaacttgaatggagacactcaaatggaagacagaatgataaaattttccaccacagaaaatgttttaaagaagattga

SEQ ID NO: 23649 - DNA, 228 bp, Glycine max
  Peptide Sequence Number=SeqID_140427
atggcgtttttcacttctctgtgccatgccgtgtggaccatgctgcagtccctttggtcatgtgacattcacatggtgaagctaacaagtaacaagtgcaacattgcaccacattttactgttgttggtctagaagaatgtgtgcgcaagcgcgaatatgctaaaagagtattctcagacaataatgagagactaattcttctggaggcatacaaatcacttgagtaa

SEQ ID NO: 23650 - DNA, 1995 bp, Glycine max
  Peptide Sequence Number=SeqID_140428
atgacgatgactcagtctgtgttcagaacatcatcaactgcacggaccaaaaccgcgaacctcacgagcatgttcggcaaatacgtggacaaaaccagcgtccatagttggaacaccgtaatcgcggacctctctcgaagcggagattcagttgaagcgctaagcgccttcgcctcaatgcggaagctgtctctgcacccgaaccgctccacgttcccctgcgccatcaaggcctgcgccgcgctctccgacctccgtgccggcgcccaggcccaccagcaggccttcgccttcggtttcggccacgacatcttcgtctcctccgcgctcatcgacatgtactccaaatgcgcccgcctcgaccacgcctgccacctgttcgacgaaattcccgaacgaaacgtggtctcctggacgtccatcattgccggttacgtccaaaacgaccgcgctagggacgcggttcgcatctttaaggagcttctggttgaggagagtgggagtctggagtccgaggatggtgttttcgtggactcggtgcttctggggtgtgttgtttcggcgtgttcgaaggtggggcggaggagtgtgaccgaaggtgttcatgggtgggtgatcaagagggggtttgaggggagtgttggggttgggaatactttgatggatgcttatgcaaagtgtggggagatgggtgtggcgaggaaggtgtttgatgggatggatgagagtgatgactattcttggaactctatgattgctgagtatgcgcagaatggtttgtctgctgaggctttctgtgtttttggtgagatggtgaagagtggcaaggtcagatataatgcagtgacgttgtccgcggtgttgttagcctgcgcaagttcaggagctttgcaactggggaagtgcatacatgatcagatggatttggaagatagtgtgtttgtaggtacttctattgttgatatgtactgcaaatgtgggagagttgagatggctaggaaggcatttgatcgcatgaaagtgaagaatgttaagtcatggactgctatgattgctggttatggaatgcatggctgtgcaaaagaggctatggaaatcttctacaagatgataaggtctggagtcaagccgaattacattacttttgtgtcggttttagctgcttgcagccatgctggtatgttaaaagaaggctggcattggtttaatagaatgaaatgtgaatttaatgtagaacctgggattgagcattattcgtgcatggttgatctccttgggcgtgctggctgtcttaatgaggcttatggtttgatacaggaaatgaatgtgaagcctgattttataatctggggttcccttcttggggcttgtaggattcacaagaatgtggaactaggggagatctctgcaagaaaactattcgagttagatccaagtaattgtgggtactatgtgctactctccaatatttatgctgatgctggaaggtgggccgatgttgagaggatgaggatattgatgaagagtcgtggattacttaaaacccctggatttagtatagtggaactcaaaggtcggatacatgtatttttagttggagacaaagagcatcctcaacatgagaagatttatgagtatttggacaaattaaatgtcaagctgcaagaacttgggtatatgccaaatgtgacatcagtgcttcatgacgttgatgaggaagagaaaggaatggttctaagagttcatagtgagaaactagctgttgcctttggaatcatgaattcagttcctggatcaataatccaaatcataaaaaatcttagaatttgtggatgggttgtgttcgtgtggggactattggtgacagaaattgaaataaagggagtcagaatctatggtgtaggatatgcattgcttctccatcatcaatgcttgacattgcacataactagatataacatctctgaaagtacacatctatcttcaaaacgctga

SEQ ID NO: 23651 - DNA, 1722 bp, Glycine max
  Peptide Sequence Number=SeqID_140429
gctcttcctggagcctttcctgcagttgtagctggagctgttcgtactctctttgagaggattgctgatttggatatggagtgtcggacgcgtctgatcctttggttctcacaccatttatcaaacttccagttcatctggccatgggaagagtgggcttatgtcctagacctcccaaggtgggcccctcaacgtgtctttgttcaagaggttttggagagggaagttcgcttgtcatactgggacaaagttaagcagttgccttgcaaggcaacttacaaccagaatcatgcatcagtgaaaccttctctcgaccctatctgtttctgcaagcccccaaccataatcagagcagagaaggtagaaccctctgtgctgttctcttaccctcatgctttggtctgcctggcacagtggagcttacaacagagtagagagacagactggagcttgcagcagaggagagaagcttctcttctatcacatctaagtattgaaaatgcacctggtttagaagaattgcttcctccaaagggtgggccgaactttagttttggtgcagaagatgataaagaaagcaatgaacatgtactgtctggacagctcaacaacatggttaaaggaaaggcacctgtccgtgaaataatctcatggattgatgaaagtgtgcttccaaataatggtctagaagttaccctcagagtggttgtacaaactcttctcaatattggatccaagagtttcactcatttgatgactgtcttggagagatatgggcaagtctttgcaaaattatgtcctgaccaggataagcaagtcatgctgatagctgaagtgagttctttctggaagagtaatacccaaatgacagcaatagctattgacaggatgatgggttatcggcttgtttcaaatctggctattgtgagatgggtcttctcagcagagaatattgagcaatttcatatgtcagatcgtccttgggagattcttagaaatgcagtaagcaagacacacaatcgtatttctgatctaaggaaagaaatattatctcttaaaaagaatatttcatcatctgaagaagctgccaaggaagcaaaagcagagttagatgctgcagagtcaaaacttacactagtggatggtgaaccagttattggcgacaatcctgctaggttgaatagattgaaatcacatgctgaaaagacaaaggaggaggtggtgtctcttcaagaatctttagaagccaaggaagctcttctttcccgagcaattgaggaaaatgagacaattttgcttatcaaacatatgtttgaagtgctggcattgtttctcttgttgtacaaaagcttctcaaacgtgttgacagagcgccttcctgaaggatctagaacactgcatgagttgaagtctgcacaagttgatgtggtgatggcagtggaccctgaagagccatcgtcaatggaattagacaaccagaatcagagacctcaaaacagtcatacaaatggcgagaagaaaggtggtgcttataatgtaggtgaaaaggagcagtggtgtatcaccactttgggctatgtgaaggccttctctaggcagtatgctgctgagatatggccccatgttgagaagttggatgcagaggtattgacagaagatgcacctcttctttttcggtcagctgtttattctggtcttcgaagaccaattcacgaggcttga

SEQ ID NO: 23652 - DNA, 258 bp, Glycine max
  Peptide Sequence Number=SeqID_140430
atggtgggaagaagagtacttggttctggttggataggtaggtggaggaggccactttgtgttcaatatcctagattgttcttgatagctaatagaatggtctcggagatggaggtagaatctttttcacaaggaggaggagttacttatcaatatcaagatgaatatggattaatgtggacaaaggaagtaagcgaagtgtatacaatacaatctaactataactatggtggaggatgtattgaatgtggaggatga

SEQ ID NO: 23653 - DNA, 567 bp, Glycine max
  Peptide Sequence Number=SeqID_140431
atgtctttggaagatgtggaagtaaggaaagggctacaagaagatttttggaggaatgttatgctcaatgaatctttgctcaaacaaaaatcaagattcaagtggctcaaggatgatagatttggagaggaggattgggagagacctcctttggatgaagtcaactttaagaagatttctagtgaggacaatggcatgctaataagtaggtttggggatgaggaaattaaagaggccatttgggattgcggaaactcaaaaagtctgggatcggatgacgttaattttaaatttattaaggaattttggcacatcttaaagggtgacattattaaattccttgatgattttcatggttccagtaattttactacaggttgtatgtataaggtggtgactaaagttttggcaaaaaggctacaaaaggtggtggatgaaactagaaggaaaaagaaaaagtgcatgattcttaaagttgactatgaaaagatgtatgattcaatatgttggaaattccttttctacatgatgagaagattatgctttgataagatttggattggttga

SEQ ID NO: 23654 - DNA, 444 bp, Glycine max
  Peptide Sequence Number=SeqID_140432
atggtggtcatgaagagcattttaagaagttttgaacttgtatttaggttgaaggtggattttcataaaagtagatttggagggtttggggtggagagagaagtggtggagagattcgtaaaatacttaaattgtagagtattatctttttcctttgtgtatttggaaattcccattggagtgaatcctacaaggttggagacatgggaatctataattgctaaattcaagaagaatctcacctcttggaagcaaaaacatttctcctttgccgaaagaatttgcctaatcaattcgatgtcagcaggaacaatggtaatcgagatatcaatactggttatggtggcggtggtagtgacaatggtggtgataatgacggtggtaacaatagtgataattaggaatgacaatgggtggggttgggcatggataagagctacctga

SEQ ID NO: 23655 - DNA, 273 bp, Glycine max
  Peptide Sequence Number=SeqID_140433
atgaggaaggatttcagtgaaactaatgaaccacattctgttcataatctggaaggacatggccaaaaggcaaatacattccaaaaatcacaagctcattggttaggaatgagggcagatgagattccacttttggacatggctgagcgaaagggagaagaagaagaagaagaagagaaagcgaacaatgtgatctttgtaatcggaggaggggttttggggtctgagaggcccccagcaaggatttcagctttcaaccctaacagtgagaag

SEQ ID NO: 23656 - DNA, 429 bp, Glycine max
  Peptide Sequence Number=SeqID_140434
atgagcagtaaggttcttcaaccaagctctttggtggctgtgttcgaaacatttttatcatcagctgccacaacagtagatgaggagaaagggaatcccttatggcagccatgtgctgacttttacataacttgcattttatcatgcctcccatggggtggagcagaacttactgagcattggtcgatgccttgcattgatatagcagttgagcaagttcctgaagatatcgagagagtgatggttggtgtagaagcttacttgagcatcagaaagcatacatcagatactggcttatccttttttgagaatgatgatgaaaatggggaaggtcttactgacaaggactttttggaagatttatgggatagaatacaggttttatcaagcaacggatggaaggttgacagcgggaatgtcttaaagtaa

SEQ ID NO: 23657 - DNA, 198 bp, Glycine max
  Peptide Sequence Number=SeqID_140435
atggggaaatctagggtgaaccaccaccaatcaagtggtgtgccggtggagaagtttgtaaatatgctgctgaagtttgttgaaagtggtatatgggtggatctgaccacaccctcgtatacgaaatcgccgcccccaatgcttcttaaaccgacacaaatacaactccaaaagaaaaacatgaagacaacttcttaa

SEQ ID NO: 23658 - DNA, 889 bp, Glycine max
  Peptide Sequence Number=SeqID_140436
ttggttgtgtggtggagctactggccgagagcatacttggtcaagtatagctggtcatagctgtggtcgatacaaagagcaagaaaagacagctgaacgtgcaaagagggatctatatcgttatatgcattatcataaccgatataaagctcacacagactcctttaagattgaaagtaaactgaaagagactatacaagggaagattgccatttcagaagaaaaagattctacactcagagattatagctgggtaaataatggactctccagacttttcagatctaggcgagtcctatcatattcatatgcatttgcattttatatgtttggagatgagctttttaaggatgaaatgacagatgctcaacgggaaataaaacagaacttatttgaggatcaacagcaacagcttgaggcaaatgttgaaaagctctctaaaattttggaggagccttttgaaaccttttcagatgataaggttgttgagataaggatgcagatactcaacctttcaacaattattgacaaactttgtcaaaaaatgtatgaatgcattgagaatgatctattgggttctctcaatcttggcattcatagtattgctccatacaagtcaaagggcatcgagagggcatcagaactttcagttggctggaacaacaaatttgactttgtggatgctcatcagaaaatgttactgagtgaaaaggattattgtatatatgctgcaagcgtaggtgtaacagaagaacttgatcgaccatctggatcagggagttcagacgataatggatgttcttctcgtaaacgtgctagaaaagagggtcttggaggtggtggtttttttgatctaaacttgccagcagagtttgtagacagaaattga

SEQ ID NO: 23659 - DNA, 177 bp, Glycine max
  Peptide Sequence Number=SeqID_140437
atgtctggtgttcttaaacatggaaacaaagaaaaagacagtttaaaggcaacggggttcccactttgcagcaagagattaagcctgacaagtgacaaaacagtcccagacaattccaactttcttatagctggtttcactgttttgtctgacggctgtcttcccagttatcagtaa

SEQ ID NO: 23660 - DNA, 171 bp, Glycine max
  Peptide Sequence Number=SeqID_140438
atggctattggagcatttaaaaaagtaacatgtgggatatttacagataatcaaggtacccccttcttcggcctagacatcactttagagcaaatggaccaaaaatttggagcaagaggaaacgaggacccctttagccaagggagagatcttggtcggaaattggcatga

SEQ ID NO: 23661 - DNA, 1776 bp, Glycine max
  Peptide Sequence Number=SeqID_140439
atgcatgaaataaagtggcgcgattctggttccaagcaattcaagttcatggacccaacagtttcaatttcaagtcacaagcgctccaacagtgacccaatgaagaggagagtcatgggagatggattagggagcatcagtgaagcttcttgtcagcctgaagtggatccgggggaactaaagcaaaacattgaatccaagaagaggcaataccataatatggatcttcaaagttctttgactcaagagattcttcagcttcaaaaacgactacagcaacaattcgtgatacggcgcgcattagagaaagcatgttatgtgcctttttcacaggatgctacaatagaaaattcaatacccaaggctgcaaaggaactgattaaggaaattggaatattagaattagaagttgtgcatttggaacaatacctactttctttgtatcggaaaagatttgatcaacaaatttcaactctatcaaccaaggaaagaagattggaattagcttcagacactaatcaaggaacatccgcagtgcctggaaatgatgctatctctgacaaagaaatttcagttgtgcactgtagtaatgtcatttcacccagaaattcatctgggtttaagcttaaggaatgcaataaccagttgggagcagaaactggtttagactctagtattcatcgatgtcactccacactatctcaacgaacaacatgctcaattgaagcttctcctgggaacattgagaccaaagctgttgttgactcttaccattctctaccattatccatgttggaggtaaagtataatgaaaaccagaaaagtggtggcatccttttatttcttatgcatacctctctaatatctggcttccaaaatttatttcaccagcaagctcagtatgctaaatcaagttcaaccagcctggcagagcatcttgggagtagctatgttgctaatgttccagaaacaccaaattggctttctgaggagatgattaggtgcatatcggctatatattgtgaacttacagagccaccttctcttggtcataaaaatgctccatcacctatttcattctcatcttctggtaacgagttatctacacagagccagtgtactaagaagggatcacattggaaggagcattcatccttcaatttaaactccactaaccctttccacgtcagagggtccaaagaatttagtggaccttattgctctatgataaggatacagcaattatgcacagatagtcagaaattaaaagaaattgagtacatgctacgaaggtttaggtcacttgtttctcggctggaagatgttaatcctagaaatatgaagcatgaagaaaaacttgccttttggattaatgtgcacaattccttagcaatgcatgccttattagtttatggagtttcagccaaccatgttaaaagaatgtcttcggtactgaaggccgcatataacattgggggacatactctaagcgtagacctgatacagaacttcattctgggatgcagattgcctcgcccaggacaatggctgaggttgtggtttccttcaatgacaaaaccaaaggttagagatgcaagaaaaggatatgctatacatcgtccagaacctttattactctttgctctatgctcaggaagccattctgatcctgcggtagacttctggtctttttgtacttatttcatatttgtcaatgttgatatgtactctgatacatataatgaaagaaaatatgaaataacggaactaatttaa

SEQ ID NO: 23662 - DNA, 237 bp, Glycine max
  Peptide Sequence Number=SeqID_140440
atggttgattcctttgcaaaaaattcaggtctaggagcatctgatttggtggagatggttaagccttatctacccgattctcaaatgaagagcattcaagagattcatccgtgtatgtatgtgggtagaataatcgtctgtctatccatatctatccaagacttacatttgatggtaagcactgatgtaatgtgcaagaaagaaatgtgtctgcctcaaagcataactggtgaataa

SEQ ID NO: 23663 - DNA, 1197 bp, Glycine max
  Peptide Sequence Number=SeqID_140441
atggctccttctcagccacctcattgggccccatctccatctctaacaccaacaccaatcctccacaagtctttctttcccccaccgtcaaactcgccggcggttgacttcagtccgcccttgattgcaatggtcgtcgtcgtcgccgccgctttcctcgtcgtcacctactcccgcctcatcgcgcgccacctcagacctcccatccaccgcctcctccgccgcttccgtcgacgccgcttcctcccatcctccgtcggcgacctcgagtccttaccctacgagtctccctttgatggaccgcacgtgttctctccttacggtttggacgaaacggtgattaaaacaattccgttttcgctttacaccgcgaaatacgacgctcgttttgacgagtctcgcaacgactgcgccgtttgccttctcgaattcgaagacgatgattacgtgagaacgcttcccatttgttcgcacacgttccacgtggactgcatcgacgcgtggcttcgctcgcacgctaactgtcctctctgccgcgccggagttctctgcaccgattcacctttcactccgatgatggctgccagaatccgaccaagcttcgacgacgacacaattctccaccgtatcagtatagatcctctcatcgatccgccgctgctgcctgcggcggctatctcctccgtgccggagattactccctgcgtcgacgagaattctccaaggaggaaccagaaccatgcaaacgtgaattcagaggattgttttagggattttctgctgaagagatcgtactcgttcggatttgaacggagtctggcgtcggagaggatggtgatggaaccggcgacagcgtcgccgtggcggtaccggagagggagtagtagtttctggagcaagaggccttcgccgtttggatcgttggggaagccgagggtgttttcgtttaggtattatagaggaatgaagtcaccgttcttccggcggaggggattttttccgttgtcggagtcgagcgtgaggtacggcggcggcggcggcggcggggggagctcgtcgcggcggagcaagtcgatagcaagtccgatgtttctgcggtcgtcgggggtgacgtcggcggcggcgttctcgtcgagcaggctgaggtgcggggatcccgaggcgcttctttcgccggagaggtttaacgggaggtga

SEQ ID NO: 23664 - DNA, 252 bp, Glycine max
  Peptide Sequence Number=SeqID_140442
atggggttggtcataccatggagtttcacattagcattagtagatggatattccgttctggtcaaatgccccattcgtcaaccaggaatactgttgattatcgttgtgggagattgggtattatcaaccctcatactagcagcagcttgctcaacagctagtgttgtggatctccttctcaacacccatgggtctttttgccctccaaagctttgtagcagcatgagaaatatcaggggggcaggattttaa

SEQ ID NO: 23665 - DNA, 909 bp, Glycine max
  Peptide Sequence Number=SeqID_140443
atggaagaggaaggcatagggttagtgttggcgagagccacagaactccgattaaaaatcagcaattgcatccaaagagccaccgccaatggtccctcgccgcacgctgacgacgacgacgacgatgaagccaccgaacgccttctcaacatttgcgatgcccttgaagccttggagacccagctctcttccttgcagaactatgaggatagtagcattgagcttgtattagtgcttgttctgcaacaacaacaacggtacgaaagagaaattgccttggctgagattgaaagcagccgtaaaatgttaattgacaagctcaaggagtacaaaggtaaggaattggaagtgatacaagaagcttccacttttgctagtgaaacagtggagcccaacaatgatctactacttcctccatatcctagccgccctccatactctgtgtctatggacaaggaatatctctcacagattccttccgtgaataagtctggtcgcaatgggttaatcacacttgatccaatgattgaggctaacaagaatctcagtgaaaaagagcaaaatcatgttgaaaatggggctaaaaattcgagaaaaggattgggattttttataacttctgcagccaaagcaatgctcacggtagttggtgtggtatcaatattaagtttgtctggttttgggcctaagttgggcgttcgtttcagtgtgcaaggctggcgtcacagagtagaaaatgaggagagatctacaactaaaaatgggggtgagagaccaaatattcagtgtccaccagggagaattctagtgtgggaaaatggggaagctcgatgcctagtgaaagagagagttgaaattccattttcagctgttgctgcaacacctgatataaactatggatgtggttga

SEQ ID NO: 23666 - DNA, 1464 bp, Glycine max
  Peptide Sequence Number=SeqID_140444
atggcgattcaaatccttaaacagttttcccaaactctgagaccaaaaccttggactctgttcttctctttctcttgttcaaacgatgcttcccagagtttagtgacagacgctgtttccattctcacccatcaccgttccaagtcacgttggagcaatctccgttcagcgtgccccaacggcatcacccccgccgagttttccgaaattaccctccacatcaagaacaaaccccaactcgcccttcgcttcttcctttggaccaaatccaaatccctctgcaaccacaacctcgcctcgtactcctccatcatccacctcctcgcacgtgcgcgcctctcctcacacgcttacgacctcatccgaaccgcaattcgcgcttcccaccaaaacgacgaggaaaattgtcgtttcaactcgcggcctctgaacctcttcgaaaccctcgttaaaacctaccgagactccgggtccgctcccttcgtcttcgatttgttgatcaaggcgtgtttggattccaaaaaacttgacccttctattgagatcgttcgaatgttgctctctcgcgggatcagccctaaagttagcaccttgaattctttgatttctagggtttgtaaaagtcgaggggtggatgaagggtatgcaatttaccgcgagttttttcggttggatgaggaaaacaacgaaatttctaaaaggggttctggttttagagtcacccctaatgtccatacttataatgatttgatgctgtgctgttaccaagatggtttggtggaaagggtggagaagatttggattgaaatgaagtgtaactataaacccaatgcttatagctatagtgtgttgatggctactttttgtgatgaagggagaatgggggatgcagaaaagttgtgggaagagttgagaagtgagaaaattgagcctgatgttgttagttataatactatcattggtgggttttgtacgattggagatgttggaagggctgaggaatttttcagggaaatggctgtggctggtgttggcaccactgcttcaacttatgagcatcttgtgaaggggtattgtaatattggggatgttgattcggctgttcttgtttataaggatatggctaggagcgatttaaggcctgatgcatcaacccttgacgtaatgattaggttgctttgtgataagggtagggttcgggaatctctggagtttgtgaggtgtgcagttggtaaatttgatttgattccaatggaaaagagttatgaggccttgataaaggggttgtgttttgatgggaggatggaagaagcgttgaaggttcaggcagagatggttggaaaaggtttccaaccgaattctgaaatatatggtgcttttgttgatggatatgttagacatgggaacgaggagatggcagaagctttgaggaaagaaatgctccaaaatcagatgcagagctaa

SEQ ID NO: 23667 - DNA, 1974 bp, Glycine max
  Peptide Sequence Number=SeqID_140445
atgccggagttgtactctgtgaaggtggaagaggcaaggcctgcaactcatgaaaagccatcagcaggtcctgtctacaggtgcatttatgccaaggatgctttgactcagttaccttctcattttcaatctccatggcaattcttcagggacacgacaacgaggtgccccagcaacccaatgctgggtcggcgtcaaaaatccgattccaaggtgggtccctatcaatggatcacatatcaggaggcttatgatgctgccatacgaatgggttccgccatgagaagccgtggtgtcaatcctgtaacacatcttgctttatttaagatactacgtattgggaaatacggataccgttgtggcatatatgggtccaactgccccgaatggataattgcaatgcaggcttgcaatagctatgcagtaacctatgtcccattatatgacaccctgggtttgtgttttgttcctttcccaatcactctcaaggatagcaagattccttctgttttgtcatgccttgatcggtggtcaagtcttaaaactattgtgagttttggtaatgtttcaaccacacaaaagaaggaagctgaggagcttggtgcatcttgcttctcgtgggaagagtttctccagatgggaaatatcgatttagaccttccaccgaaaaagaagactaacatctgcacaataatgtacacaagtggaacaacaggcgaacccaaaggcgtcattattaagaatgaggctttcatgactcaagtgttgtctattgaccaaatacttaatttaactgacagagtgggaacagaagacgacgtgtacttttctttccttcctcttgctcatgtatatgaccagataatggagacctattgcatttataagggctcctcaattggattttggcaaggcgatgttggattcttaatggaagatattctggcactgaaaccaactctattttgtggtgttcctagagtttatgatcgtgtttatgcttacttctgcacttctatcctagtgccaactaatctagaatctactgacagcaagttgggatatctggagaagggtcttccccaagacaaagcagcacctttgtttgataagcttgtgtttgataagataaaacaagcattaggtggacgggttcgcctcctattatcaggagctgctcctttgcctaggcatgtggaggagtttttgagggtcacttttggagctactatgtcacaaggatacggtcttaccgaaagttgtggtgggtgtttcactggaataagtaatgtgttttctatgatgggaacaattggagtccctatgacaaccattgaggccaggcttgaatctgtgccagagatggggtatgatgcactctccagtgaagcccggggagaaatttgccttagagggaataccttgttctctggttaccacaagcatcaagatcttactgaagaggttatggttgatggttggtttcatacaggtgacattggagaatggcagccaaatggagccatgaaaattattgatagaaaaaagaatatctttaagttgtctcaaggagaatatgttgccgtggagaatattgaaaacaaatacttacagtgcccccttataacatcgatttgggtccatggaaacagttttgaatctttcttggtggcagtggtggtccctgaaagaaagggccttgagtattgggcagtgaagcataattctacagatgatttcaaatctttatgtgaaaatccaaaggcaagaaaatacattttggatgagctcaacaacactggtcagaaacaccaacttagaggttttgagctgctaaaagcagttcatttggaaccaattccctttgacatggagagagatctgataactccaacattcaagttgaagagaccgcaattgctcaagcagtataagctaatcaggaagtattaccgtattgataatttcaattag

SEQ ID NO: 23668 - DNA, 420 bp, Glycine max
  Peptide Sequence Number=SeqID_140446
atgtaccctcccttgttctctttgaacaacctagtggatgtatcctccactagaactgatccacaagagatgtactctctcttgttctcagtcacaacaacccaagtagatgtaccctctacttgtaccacaaaggatgtaccctccaatgtgttaagacaaagttctcagacgggagaagggagacacaaaagaattcaggcggttaatcctttgttcttttggaaaagggagaatagagacacaaaaagaattcagacggtttggaaaaccagaaaacttaagaaagtttttgcaaaggaagaagaagaagaagaagatgttcaaagagattcaaaggttgtaaaagaatatgtggaaaagttttttgtaaaggttgcaagtgttattgaaatgcaaatcaaggtcttgcttttatag

SEQ ID NO: 23669 - DNA, 198 bp, Glycine max
  misc_feature (191)..(191): n is a, c, g, or t
  Peptide Sequence Number=SeqID_140447
atggaagtaggtgcatctaataggatgtcgttcatcgagggaaagataggtataaatgaaatggctccaaagaaactctcaacgaagaggtctagaagagacgccacaggagaaggatccagtgctgccccagagtttgatagtcatcgttttcggagtgccgagcacgatcagcgcttcgaggccatcangggatga

SEQ ID NO: 23670 - DNA, 213 bp, Glycine max
  Peptide Sequence Number=SeqID_140448
atggcttgcaaccacattccagtggaagcaaagattgttttggattcaaaaagcgattctcctcaaatttcagccagcccacatcaattagactttgcaccttatgctttagggtcatacagtgctcaatggaatgccccagggctcctccatgatatgcacatgttgcattcaagtcgtatcctcggaaaaatggaggttgaggaaacctag

SEQ ID NO: 23671 - DNA, 216 bp, Glycine max
  Peptide Sequence Number=SeqID_140449
atgaaggttcatatcagagatgctcgaaattcaacatggaagcacatgccaatttcaaacggccataactttggactcggatgtccgattcaggtcaataatatagtgagacgcacgaaattgaacaatggaagcactcgagaaaatcaaatggtcataacctttcactcggatttccgattcagacgcatagtatatcaagatgctagaaattaa

SEQ ID NO: 23672 - DNA, 129 bp, Glycine max
  Peptide Sequence Number=SeqID_140450
atggctcttgttatcaaatttgttgataagagtggatatgttagagtgttttttagatgtcttacatggaccaaggatatgatggagctagcaatatccatggagagtggaatggtttgcaaactttga

SEQ ID NO: 23673 - DNA, 585 bp, Glycine max
  Peptide Sequence Number=SeqID_140451
atggctgattttcttgctggtagtggaaagaagcatattgttgttctctccagcttagattttggaaaatggcaaaaagttgacatgtcaaggaaattgcattgcgatacttcccattctgatatatctattggctattatattagtggtttgcagatttattacctttctagttccaacagcaatggaacagatgaaaattgtgaacagcttgggtggaagaaacttcaagagtatgacccttctcaaatgcattggaaatatcttagtgatttagctgaaggaaatgtaactgtggaagatattacttcggtagaagatgagctagaagaagaaaattattatgctagcttgccttttgctgcacttttttcttttctcaaggctaaaggtttgaaggtcacctgcttgttatgttattgctcagaaggggacaacatatcggatgcttttcagttaggcgatgcagtatgtaaacttctccagctgagtcaccctactactggaattgaaggtggcaaatggcgagttccactttcttggatgagtgtatatggaccacccccagatgtgtccatcttctaa

SEQ ID NO: 23674 - DNA, 261 bp, Glycine max
  Peptide Sequence Number=SeqID_140452
atgttttgttcctttttcacttgttttctggcactagatccggagatctctccgtgctacacgccgtcgatctcaagcccccacatattggtgttggggttcaggatctggtcgtcgatgccggagaattcgtcggcgacggcaagcatgtcggagaatgacggaagtgttgtcgaagactctgggagggagagtacagagaggaagaaaggaagacaaagattggatgaggaatggtgtacaataaaattttgcacctag

SEQ ID NO: 23675 - DNA, 1153 bp, Glycine max
  Peptide Sequence Number=SeqID_140453
atgacaaacgcacacggtggcgccatgttagtagagcgaaatacaaacagcaccgtacgcagacaaaaattcggagccttgttgcactccgaaccgacgtcgctttccacctccaacaacgacgatgatgaattctcccataaccaacaacggcacagcaacgccagccccagaaactacgccgatagcagcaccacaagcagcaacaatgcctctcccaacaccatgtctccgtggagctaccaacccaacaacaactcttcttctcctctcgataaatctccgtggatattgccttcttcaccggcgataaaccacttccaccaccaccatgacgataccgaaaacggcctcttcggatctatcgtccgccaggagggccacatatattccctcgccgtttccggggacttgctttacaccggctccgacagcaagaacataagagtgtggaaggatctcaaagacttcgcgggattcaaatcaagcagcggattggtgaaaacgattgttatctccggcgggaagatcttcaccggccatcaagacgggaagatcagagtgtggaaggtttcgtcgaagaatccgcgcaaccataaacgtatcgggagcttgccgacgttcaaagagtacgtgaagagttcgatgaatccgaagaactacgtggaggttcggcggcaccggaacgcggtgaaggtgaagcacttcgacgccgtttcgagcctgagtttggacgaggaggaagggttgttgtactcggggtcgtgggacaagacgctcaaggtgtggcgcgtggaggattcaaagtgcttggattcgattaacgcgcacgaggacgccgtgaacgcggtggtggcggcgttcggagggtgcgtgttgacgggctccgcggacgggacggtgaaggtatggaggaggaagaacgacgggaagaaggccaagcacgtgctggaccgcgttttgctgaagcaggagaacgcggttacggcgctggcggtgaaccgtttggcaaaagtggtttattgcggttcttctgatgggttggtgaatttctgggagtgtgaccagaaaggcgggttctcacacggcggcgttttgagggggcataagctcgctgttctctgtctcgctgcggcggggaaccttgtcttta

SEQ ID NO: 23676 - DNA, 961 bp, Glycine max
  Peptide Sequence Number=SeqID_140454
gtggattcggctattcctcacccggatctatcaggtgttagcaatgacagtggaaacagcaacggcaatggtcatagtactaaaagttttgataatggcaataacagcagaaccactgatgatggtgctaaaaacaatgatgataacactaaaagtgaggacaatggcaacaacaataaccacagtgctaaaagcaatgacggtggcaacaacaatcccaacaacaatgacagagctaaaagcattggcaatgaaaacaaagattgcgacaatgataatgctaaaagcattgtcagtggcaacaacaaccgaaacagtgatagcaccaaaagcagttacaatggtagcaacaaccccaacaatgatggtgcttatagcaatgccaacaacagccacgacactaatagcactaaaatcattggaaatggcaacaacaacaacaacaacaacattgatgatgcttctggcaatggcaagaaaaacaacaacattgatggtgcttctggcaatggcaagaaaaacaacaacattgatggtgcttctggcaatggcaacaacaatcgcaacattaatagtgctaaaagcattggtggcaacaacaaccgaaacagtgatagcaccaaaagcagttacaatggtagcaacaaccccaacaatgatggtgcttatagcaatgccaacaacagccacgacactagtagcactaaaatcattggaaatggcaacaacaacaacaacaacattgatgatgcttctggcaatggcaagaaaaacaacaacattgatggtgcttctggcaatggcaagaaaaacaacaacattgatggtgcttctggcaatggcaacaacaatcgcaacattaatagtgctaaaagcattggtggcaataaccgcaacagtgatagcactaaaagcggcgacaatagcagcaacaaccgcaacaatgataacactaacagcg

SEQ ID NO: 23677 - DNA, 258 bp, Glycine max
  Peptide Sequence Number=SeqID_140455
atgtctgctatggtagaggtatgggttggggagctgacaaagcttcgagaaaaagttcttgcccgcaagcctttcttattatccaaagccaaagaaggatcagaaaggaaccaagaagaaaaggaaactcaaactgcggtggttaagagagacactactaatggaaccatgtctgaggcaacgtactttatagaaaatgcagataagaatttctctagtactttagaaggtgattctgtgaatgtctgtttatcataa

SEQ ID NO: 23678 - DNA, 480 bp, Glycine max
  Peptide Sequence Number=SeqID_140456
atggaaatagcaattataaccgcaacagtgatggtcctaaaagcaatgtcattggaaattacaaccaaaatagtggtggtaaaagcagtggaaatggcaatgaaaagagcaatagcaaccgtagcagtggtggtgctaaaagcaatggcaatagcatccaaaacagcaacagtaatcgtaccagaagcaatgccaatgccaacaataattacacaaacaaccccttccaaaacaatagcaccggtgccggtgacactcgaaacaggaacgagaggcagttgcaaagtagaaatcaatatttggaagcaatgtgaagaaagagtaaaggcaggaaatgaagatagaaaagaggtggaacttacgcgggatagtgaaaattggacggttgggttgggtgtggtaatagtaacagggggggggtgtttgggccttaagaaaagggatggcctagttaggttccctccgaagtggagcacttga

SEQ ID NO: 23679 - DNA, 11283 bp, Glycine max
  Peptide Sequence Number=SeqID_140457
atgcaaggcattcagcaacaccagcacctcgctgcactcgtctccgctgcactccccaaggatgactccgccgccgacccctcccctcgtctcgccgccatccactctctccaccgcgccatcctccaccctcacaactccctcctcctctctcactccgccactttcctcgctcaggccttctcccaactcctctccgacaaatgctacgaggtgcgccaggcagccgtcacggcctacggcgctctctgtgccgtcctcgcttcgatccccgtcgccgcctccaacggccggcagaaccacctcatgctcgtcgaccgcttcatcggctgggccttgccgtcgctcaacaccgccgtcaccgtcgacggcactaaggaactcgcgctcgaaggcctccgcgagttcctcaacgtcggcggaaccgacaggtacgctttgccgattctgaaggcgtgtcaggtgctgcttgaggatgagagaacctccctggctttgttgcatagacttattggtgttattactctgatttcgttgaagtttttgaggtgctttcagcctcatttccctgacattgttgacttgcttctcggttgggcgttggttcctgatttagcccaatccgacaggcgtgttattttggatagcttcttgcagtttcaggagcattgggttggtagtcttcccatgtctctgaggttgcttaccaaattcttgggggacatggaggttttgcttcatgatggaactcccggtacgccacagcagcttcgccggctttttgctctgctttcttgtttttccacgattctgcagtccactgcttcggggttactagagatgaacatgcttgaacagatatgtgagccgcttagtgccttgttgccgcgattgctgaggtgtttgtctatgattgggcagaaatttgggtggtctgagtggattgaggattcttggaagtgtttgactcttttggctgagatattgcgggagaggttttcgagtttttatcctcttgctattgatatcttgtttcagagcttggagtttggagcaactgtgcagcgggcagggtttaggaagattagctctttccaaattcatggggttttgaagactaatctccagttgttgtcattgcaaaagcttggcctcctttcgtcttcggtgaagaagttattgaagtttcatgcggcgatttctcagctgcgattgcatccaaatcatttggtaacagggagttctgcagctacttatgttttcttgcttcagcatgggaatacagaagttgtcaacgaagccattgcctccttgattgaggaactgaagctgttgaagattgtaataggaaataacactggtcattcagatgaatctaattctgttgtagatactaaagcattttcaaaacctgaattgttggcattgatcaagtttgatttgaaagttctattagcgtgtgtttccatgggcggggataacagtttgattggacaaaaggatgttgcttcattgtatcttagtaggtcagaaaagttggtgtcctttattacaaaagagatgaatccttttgaattacccattcaggctttcattgagttgcagatcactgttgtcaaggcactggagaggctaaattcagttgagttcttaatcaagtgttctgatagagaacagaactgtaacaaagcttttgttgagtttccaactaaaacggaggacagtgatgatcaattcagtaatgggtttttggctgtgattactgagcatttggagaagtatagcaagctccttataaaagcctttcatgtttcttctcctctggcaattaaattagttgctctagattggggacaaaagttctgtgagaatgtaatggcttttaataagatcttaggcacaagagatttctcccatgaagaatgcaagtatgctggtgtaatcatgaacttagttttctcacttttaggtggtacatttgagagagaaccagaagtaaggtcacatgttgcaaaaactttggagatgtttatgcaagcaaaacttttgcatcctgtgtgtttttatcccttagctgaagtgatactggagaaacttggggatccagctacagaaatacaggatgcatatgtgaaactacttgcccatattttgcctactactatatatacatgtggcctctatgattatgggagatttaggcctgttgaccctgtgttaggcaaaaattctaacatgcactggaaacaattatttgccctgaagcagttgccactgcaacttcactcacaacagcttgtatcaatcttaagttacatttcacaaagatggaaggtacctctttattcttggatccagcgcctcattcatggttgccagagttcaaaggatgcttttttaagtctgcctgaggaaacaggaaattttggtgctaattctccatggttggatatacaagtggacgaggacatacttcaaaaaatctgttctgtcaataatttagctggtgcctggtgggctgtacaagaagctgctcggtactgtattgctacaagactacggactaaccttggtggccctacccaaacatttgctgctctagaacgcatgcttttggacattgcacaccttttgcaacttgataatgaacaaagcgatggaaacttaagtatgatagggtcttctggtgctcacttgctaccaatgagattactgttggattttgtcgaggctctaaagaaaaatgtatataatgcatatgaggggtctgtcattttaccacctgcttcccgtcagagcactttattttttcgagcaaacaaaaaagtatgtgaggattggttttctcgtatatgtgagccaatgatgaatgctggattggctgtacattgcaatgatgccgttattcaatattgtacacttcgtttgcaggagctcaagaatctttccgtgtcagctttgaaggaaaaatctagggctcaggtaactgataatctccataatatcaaaggaaggtatagaggagatgtcttaaaagtattaagacatatttcactagctctttgtaagagttctgatccagattctttgattggtctacgaaaatgggtttcaattaccttctcctccttacttggggaggaaaaccagtcctccagtgagggtggaactgctggacccctttcttggataagtgggcttatatatcaggcaagaggtgagtacgaaaatgctgcggctcactttactcacttgctacagacagaagagtcactcagttccctgggttctgatggtatacagtttgtcatagcacgcataattgagtgttatgcagctgtatctgattggagatctcttgaaacctggctattagagttgcaattgcttcgtgctaaacatgctggaagaagttattctggtgctctgacaatggctggcaatgaagttaatgcaatccatgcattagcacgttttgatgagggtgattatcaggctgcatggtcaagccttgatttgacgcctaaaagcaacagtgagcttacccttgatccaaaaatagccttgcaacggagtgagcagatgcttctgcaatcattgctcttccagaaggaggaaaaaagtgataaggtgctgcatgatttgcagaaagcaaggtcaatgttggaggaaccactttctgttctgccacttgatggcttagctgaagcaacacctcttgcaattcagttgcactgcattttccttgtagaagagaattgtaagcttaaagcaactcatgagaaggccaaacaaataccatcaatactaaattctcttaaatcactgccatcttctattagtaaaatccgtcaagattgtaatccatggctgaaagtccttcgggtttatcaaaccatttccccaagttctcctgttactctaaaattctgcatgaatctgcataatttagctcgcaagcaaaataatcttttgttggcaaatcatctgaacaactacatcaaagatcacgtatctgcttgccctgaggagagacatcggaatcttctggtcttaaacttgcagtatgagagcattttactacagtatgctgaaaacaagtttgaagacgctttcacaaacctttggtcatttttgcgtccctgcatggtttcttcaacatctagaatacctgatactgaagagaggattctgaaggccaaagcatgcttgaaactcgcagattggctgacacgggaatattcagactggagtccagagagtattgttctcaagatgccagcagattttgaaatggctgaatcagctacacttggcaaagatggcaatgaagaaaatataatttgtaaatcgaatttgggttctatcactgaggaaattgttggtacagcaacaaaattgtcttctcgtatttgccccaccatgggcaagtcatggatttcttatgcttcttggtgctttaagcaagcccgagactcactccttgttcagagggaaactatcctccattcttgctcattttcttccatactagttccagaaattttacctgagagatttaagttgactaaggacgaggtgcaaagaattaagtcattggttttgggtctttttcaggacaacattgatatgaaaggtttcatagatgaacaggaagagagaagctcttggcttgattctgcagagcactcaattagtagcaatcctctgctgacattggtttggaatatagtgaatattatagaaactgccgcaggggcaccaggtgcagaaaactctggtggtgaatgtctttctgctatggtatcttctcaattgaagatttgtttgttaaacacaaattttgggctgggagaatttgacataatatctgcattggatgattttgttgatatttggtggtctttgaggaggagaagagtgtccttgtatggacatgctgctcatggttacacacagtatctttcgtattcttcttcccctatttgccatagtcagatgcatggttctgaatacgaggctttgaaccaaaaaactggcagctacaccctgagggctacattgtatatattgcatatacttctcaattatggtgtggagttgaaagatactcttgaatctgctcttttggttgttcctttgttgccatggcaggaagttacgcctcaactgtttgcacgtgtaagttctcatcctgaactagtgattcggaagcaattggagggcttactgatcatgctggccaagcaatctccctgttctatagtgtacccgacactagttgatgttaatgcttatgaagagaaaccttcagaagagcttcatcatgtgttgggttgcctgagagaactttacccccgattggttcaggatgttcagctgatgataaacgaacttggaaatgttactgtactctgggaggaattatggctcagtactcttcaggatcttcaaacagatgtgatgaggcgaataaatgtgctgaaagaagaggctgcaagaatcgcagaaaatgtcacacttagtcagaatgagaagaacaagataaattctgctcgatattctgcaatgatggctccaatagttgtggctttggagcgtcgtttggcttcaacgtctcgaaaacctgagactcctcatgaagcttggttccaggaagagtataaagaccaactgaaatcagctatagtatcctttaagattcctccggcatcttctgcagctataggtgatgtgtggcgaccttttgatagtattgctgcatccttggcatcatatcagaggaagtcttctgtttccttgcgagaagttgcacctcatttagctttgctatcatcttcagatgttccaatgccaggtcttgagaaacaaatgaaagtacctgactctggcaaagcaactgatctccaaggggttgtcactattgcttcttttcatgaacaagtcactatcttatcaacaaagacaaagcctaagaaactaggtatacttggttcagatggtcagaagtacacatatctccttaaaggacgagaagatttgcgccttgatgctagaattatgcaattactgcaggctataaatggttttctgcattcttcttcttctgcatgtagcaattctcttagcattcgctattattctgtgactccaatcagtggtcgggctggcctaatccagtgggtgggcaatgtagtaagtatttatagtgtatttaaagcttggcaaacccgtgtccagctagcacagtttttggcattgggccctgcaaatacaaaatcctcagctcctccacctgttccccgtcccagtgatatgttttatgggaagatcatacctgcacttaaagagaaaggaatcaagagagtgatttcccgaagggattggcctcatgaagtcaaatgtaaagttcttcttgatctcatgaaggaggtgcctaggcatcttctttaccaggagctatggtgtgctagtgaaggatataaagctttcagctcaaaaatgaagaggtattctggaagtgttgctgcaatgagtatggttggtcatgttttggggctgggcgacagacatctggacaacattcttatagatttttgtaatggggatattgtacacattgattacaatgtgtgttttgataagggacaaagactaaaaattccagagattgttcccttccgtctgacccaaatgattgaagcagctttagggcttactggaatagagggtagcttcaaatcaaactgtgagacagttattggcgttctaaggaagaacaaagacatacttttgatgttattggaagtatttgtttgggatccacttgtggagtggacacgtggtgattttcatgatgaagctgcaattggcggtgaagaaagaaaaggcatggagttggctgttagcttgagtctatttgcatctcgagtacaggaaattcgtgttcccttacaggaacatcatgatcaattattgactagcctgccagctgttgaatcagcacttgagagttttgctgacattctaaaccactatgagcttgcctctactctatactgtcgagctgaccaggagaggtctggtcttatattgcgtgagacatctgcaaagtcgattcttgctgaagcaaccagtaattcagagaaaattcgagcttcttttgaaattcaggctcgggaatttgcccaagcaaaggctatggttgctgagaaagctcaggaggcaatggcttgggctgagcagcatggaaggattcttgatgctttacggtgcaacttaatcccagaaataaatgtttcttttaagctgaataacatggaagcagccttatctcttacatctgcagtcactgtagcaggggttccactaactgttgttcctgagccaacacaagcacaatgccatgatatagatagggaagtttctcaattcgtagctgagttgggtgatggactaacttctgccacaacttctttgcaagcatactccttggctctgcaaagaattctaccattaaattacctttcaaccagtgcagtccataactgggcacaagttctacagctatctatcaatgccctgtcatcagagattctctctcttgccagaaggcaggcttctgaacttattgcaaaatttcatgtagatagcattgattctatcaaatgcagtcatgatgatctttgtttcagagtggagaagtatgcagtagaaatagaaaaattagaaaaagagtgtgctgaaatagagagttctattggctctgaatcagaatcaaaaactaaagatcgctgtttatctgctttcatgaaattcatgcagtccattggtcttttaagaaaggaagatgtgatgtcttctgttcaatctagacctttaggtgagctagaagaggagagggaaaaggcactatcaattctcaatattgctgtgagttcactttataatgacgttaagcatagaatacaaaatatatataatgatatgtctggaggaagaaatcaatacaatatgttgcagaatgactctggaactatttttgctgagtttgaagaacaagtagagaagtgtaatcttgtgacagagtttgttaatgatctatgtcaatttattggaaaggacactccttctgttgatattaacaaagttcgttcaaagttttcttctgaaagtaattgggtttccattttcaaagccattttgatttcctgtaagggattggttagtcaaatgacagaagttgttctgccaaatgtaatacgagctgctgtttcattaaattcagaggttatggatgcatttggattgatctcacaagttcgaggatctatagaaactgcactggagcagcttgtggaggttgaaatggagagagcatcactgattgaacttgaacagaattattttgttaaggttggtcttattactgagcaacagcttgctcttgaagaagctgcggttaagggcagagatcatctttcatgggaagaggcagaggaacttgcatcccaagaggaagcttgtagagcacaactggaccaacttcatcaaacttggaatcagagggatgtaaggacttcttctcttataaagagagaagctgacattaaaaatgccctggtttctgtgaattgtcaatttcaatctctagttggttcggaagaagaaagggagctacatattttgagaagcaaagcactattggctgccctctttaagcctttcttggaactggagtccatggatattatgctgtctgcagctgatggttcagttgcattgccctcaagtaaatttcatactttggcagatttgataaattctgggaattctatatctgagtatgtctggaaagttggagatctattggataaccattcattctttatttggaaaataggcgtcatagattattttcttgatgcatgcatacatgatgtagcttcgtcagttgagcaaaatctaggctttgaccaatcactcaattttatgaagaaaaggcttgaaatccaacttcagaaacacattggtcattatttgaaagaaagaattgctcctagtttactgacttgtttagataaggaaaatgagcacttgaagcaacttacagagtcatcaaaggaacttgctttagaccaggtgaaaaaggatggggctgcgaaaaaggttttacttatgcttgaagaatattgtaatgcacatgaaactgctagagcagcaaaatcagctgcttctctcatgaaaaaacaagtgaatgaattgaaagaagctctacgaaaaactgcacttgaggtagttcagatggaatggatgcatgatgttagtttgaacccatcatataacagaagaatcagatttgagaagtatcttgatactgatgacagcttgtatacaatcatcttaaacctcagcagatctaaattaatggacaatatacaatctgccgtgtcaaaaatcacaacatcaatggattgtctacagtcttgtgaacgaaattctcttatagcggaaggacagcttgagagagcaatggcttgggcgtgtggaggtcccaattccagtagttctggaaatacttcaactaaaaattcaggaattcctcctgagttccatgaacatattaagactcggaggcagattttatgggaatctagagaaaaggcatctgatattgtgaagttatgtgtgtcagtgttagagtttgaagcatcaagagatgggtttttgcttataccaggccaaccatatcccttcaggagtagtgttgatggtaagacatggcagcaagtgtacttgaatgcactaacaagattggatgttactttccattcttatacacgtactgaacaagaatggaagcttgctcaatgcactgttgaagctgcttccaatggattatatactgcaactaatgagctctgcattgcctctctaaaagcaaagtcagcttcaggtgatttacaaagcacggttctttcaatgagggattgtgcatatgaggctagtgttgcactgtctgcttttgctcgggtttcaaggatccatactgctctaacttctgaaagtggttctatgcttgaagaggttctagcaataactgaagatatacatgatgtttataatctggggaaagaggcagctgctatccacctttctcttatggaaggcctttcgaaggcaaatgcaatcctttttccacttgaatcagtgttgactaaggatgtagctgctatggctgatgctatagctcgggaaagtgagatcaagaaggaaatatcacacatccatggacaagctatatatcagtcgtattgtttaagaatcagggaggcttgtcatacctttaagcccttggcaccctctctgacgtcagctgtgaagggactttattcattgttggctagactagcaagaactgctaatgtccatgctggcaatctgcacaaagcgcttgaaggaataggagatagtcaggaagtaaaatcagaggatattgctttgtcaagatcagatggtggtggtggtgatgctgttgaatttgatgataaagaaggggaaagtctctctaggtccgaagatgataagactgatgattttattggcttttctcgactttctttggaagacaagggatgggtatcaccaccagatagcatctactgtagtagctcgggatctgacatctcattagctgaagttagtcttcctgatagcttgaatgattcagcaggaaataaagacctgctttcacaggggtctggtagcagaatccccacaggttatatgcataccactctattgtctcaaactgatgtggaacaaatctcaccttttgagttgtcagaatcttctcctgtggaaactgatcttaatcgtgctggttctgtgaagtcaattaatgaggctactgaacatgctgaagctatatctttatcaggtgataaatctgttgccatccctggcaactcccaaattccatcgaatgagaacctagacaaatttgatggtgaagatgaactgctgtctgcaaaagaagttaaaaatgctgctgaacatcatgaagctcctgatccctacataaatgccaatactcgtgttggaaggggtaaaaatgcttatgccttatcagtattgaggcgggttgaggtgaaaattgatggtcgagatatctctgaaaacagagaaattggtactgcagagcaagtagattatctactaaagcaagctactagtgtagataatctctgcaacatgtacgaaggttggacaccatggatttga

SEQ ID NO: 23680 - DNA, 945 bp, Glycine max
  Peptide Sequence Number=SeqID_140458
atgttttgtgaaacaaatcagataccagcagaaaatgttattgtgaatggagagcctcttgattgggataagctcactttgcttttgacctgttcaaacccaccaaaaggattgaaacccggtttctattggtatgataaagcatctggattttgggggaaggaaggtcaacggccaagtcaaattatttgcccacggttggaggttgggggcaacttggagagaaatgcaagcaatggaaagacaaatgtaactgtaaatggtcgagagattaccatagaagagctctggttactgaagtgggcaggagtgccctgtgatggaacaactgacttttggatgagtcatgatggatcatacatcgaagtgggacagaaaaatgtcaaggggcatatatgggagaaggccaagcttctgtataatgttcctctctctgaaaatgagcgccaaaacatcaagctggtaattcaaagcaacttgtataggtaccttgggttaatactggaggcgcgagaaatttttgaagaaagtttgtgcgagaaaactaacggacagcattttgatgaatcaacttcttctggtaacttggatgcaatatttccagcagctgcacgtgaatatgcgccactggtggaggaactgtggagggatgcagccattcaggccacatacaaaaggataaatgaaataaaatatctaccaagaagtgcgagttattttctagaaagggctgttgaaatttccaggatagattatgaacccttggacatggacatcttgtatgctgaggggataaccttatccaatggcctttcttctatggaattttcatatactgtgacaggtcatgaggactcattggaccctgagtatgaagatgatccttcactcaggtaccagctcaccagagtacatccaaaaagccttggagaaaactgcaagtga

SEQ ID NO: 23681 - DNA, 216 bp, Glycine max
  Peptide Sequence Number=SeqID_140459
gcggaggtgggatttgaacccacgacttatggagagaaatacagaattgggtgcttgagcgcagctaaagctatacctacgagtataccagctacgctaaccagcgaagctggcaccactgtcatttgggcaaccgcctacggcctgctacggagacagcgcagcgggtacggcaatatccgcgaagcagtctacgcgagcgggacctgcttcgag

SEQ ID NO: 23682 - DNA, 1260 bp, Glycine max
  Peptide Sequence Number=SeqID_140460
atgaagagcggagtaggttttgtcatggctttgatttatcataccatcacatatattgttttgcagataggaattcttgggaagagggagccaagattcttgccattgaactttgatacgatatcatgtcaattatctgtcggtaacatttccgttggggtgggatggagaaggtggaatgactctggtagtcattccgtaaaccaaaaagaaacacgtccaggttgccccacacctcaccccctcccttctctcttccactctaaccacccttcgccgcaacccccagctggtccttcacctcctctcccatcttcacaaccaccctctttccctcgtcgtctgcgtcctctatcgcctcccgcctactgtgaactcaagaagcccaatgaggccttggagtgtttctacttcatgaaggaaaatggttttgtgcccaacgttgagacttgcaatcagatgttgagtctgttcttgaaattgaacaggactcagatggcttgggttctgtatgctgaggagtttattgggcactgcttgagagggaagttccaaagggctcgtcggatctttcaaacgatgatagataaaggtcttgagccggattgcttacgtataattcctttatttctgggttgtgtaaagaaggaaggcttgaggaggcgtctggatgagatgataagtaaaggcataatggcatctctggtcacctacaatttgtttattcatgcactgtttatggaaggaaggatgggggaagctgataatatgataaaagaaatgggagaaaaagggatgatgcctgatgttgttactaataacatattgattaatgggtattgcagatgtggggatgcaaagagagcctttgggctttttgatgaaatggtgggaaaagggattcagccaacactggggaaagtggaggaagctcgcctacttcttgatgagatgaagagaagggggatcaaacccgatcttattagttacaatacactcattagtggttacagtaaaagaggcgatatgaaggatgcttttggagttcgtgatgaaatgatgactacaggatttgatcctacgattctcacttatgatgctcttatacaaggtttgtgcaaaaaccgagaaggtgagcatgctgaagagctcctcaaagaaatggtaagtaaaggcatccctcctgatgacagcacctacctatctataattgaggcgatggaagcggttgatgacttggaggaaaatgatgataaatga

SEQ ID NO: 23683 - DNA, 2622 bp, Glycine max
  Peptide Sequence Number=SeqID_140461
accttgaagagtttcttaggccttgccgacttctaccgccggttcatcaaaggctacgcaaccattgcgtcccctttggttaaggcaaccactagtgatgcactccgatggacggcggatactcaaactgcttttgatcgtctcaaacacgcgttatcatcggctccggtcttggccctgccggactttaccctgcccttcacggtggagacagacgcctacggggttggcatgggcgccgtcctttcgcagcagggacaccccattgcctacttcagtaaaccatttagcgccaagctcctccggtcatcaacatatgtccgtgaattgtttgctatcacggcagccattaagaaatggcgtcaatatctcctcggacatcacttcatcatcgtcactgaccacagaagtctgaaggaattgctcacacaggtaatccagaccccggagcagcatacctacttggctcggttgcttgggtatgattatgaaatccaataccgggccggtgctcataatcaggccgccgatgctctctcccgattgccggaaaccactgcttctctttgggtgttatccgttccttgtctgacattcttcgaggaacttcagcagcaattacagacccagcctgattatgtccgaaagcgccaagatatcatggagcaaccctccaatcaccctgcattctctatctcgagtaatttgattctccataaggggcgtatctggctcccagagggatttcacttgatccccactttaattgccgaataccattccacacccacagggggtcacgccggaatcgcgaaaacagttgctcgggtcttggagaatttttcttggcctaagctccgggaggatgtcgcacacttcgtgaccaattgtgcagaatgtcagtgcaccaaatacgagactaagcgcctggccggattgttgtgtcctcttccggttcctttccggccatgggaggacctttctctcgatttcattacgggtttgccggcataccatggacacaccgtcattcttgtcgtcgtggataggttctcgaagggagttcatctgggtacgcttcccacagctcacacagcattgacagtggcctcgttatttgtcgacatcgtggtcaagcttcacggtgttcctcgaagccttgtatcggatcgagaccctctctttatcagtagattctggaaggagctcttccggcgcagtggtacccaactccgcatgagcaccgcctatcacccccaaagtgatggccaaaccgaggtactcaataggattattgaacaatatttgagaagctttgttcaccggcgaccccacacttggggtaaataccttccttgggcggaatggtcacataatacgtcttggaactcagccaccgggacaactccttatgagctcaccttcggaaggaaaccattcaatttccttgagtacattgctgggacctctgctgtggatgctgtggattccttgttacaagatcgtgatgaaactttccaattggtccgccggaagcttttgaaagcccaaagtcgcatgaaggaacaggctgaccgtcatcggcgcgacgtatgctacaatttgggtgactgggtttggcttaaattgcgaccccacagacaaacatcagctaaaggtcctcagagctctgcggggaaactagcaagaaggtactatggcccattcaagattactgaagccatcggcaaagtggcttatcgactgcagcttcccccggatacgaagattcatgatgtcttccattgctctctactcaaaccgtttcatggtcatttggacaccacttccttcgcgcctctacctgctcaatttcataatgatcaaccccttatcactccggcagcaattgtggattatcgcagaaccccttcaaaagcttgggaagtcttggttcaatggcatggcttatccccagatgatacgtcttgggaggattggtctgctttgcttaatgactatcaccttgaggacaaggtgatttcccaagggccgcgggatgatagggaaaacacagatcacagagcaggggtacaaagagaacattcagcagagcttataccaaatgcttttgtgaggttgccacagttacaaggaaggatccctgaggatgtaatcctcagaaatgcaaactttcttgtcttcaagcatgaccgtagtaatgagttcaaggtagtaatccttgaatcatcaacacagtgtcaaaagcctgtggtaaagatggaggaggagaatgaacaagagcaagcagcagcacaacatgttgaggactgtgacatagaggaggaggaagacagttcttccaaggatgagaactatgatggcagtgattctgatgatgatgaagagagtgaagaagaattcagtgctggattcaagcgtcaaagtcatcatagaagagcttgcaaaagggagtctgcatcaaattccaaccccaatgctgaagatcttcttccagaatatgtatttgatccagaaataaggaatgagatcgaaagagatgatacttgcttctgtgaagttatatcaggggaagagcaaggagtaagaacactaagggtgcatgttgctaggaggagatga

SEQ ID NO: 23684 - DNA, 111 bp, Glycine max
  Peptide Sequence Number=SeqID_140462
atggtgatgaaaggtgatgccaatggtagagataatgattgtgaagcatatggaacaagagtagtgttagtaagggatgacaatggtaacaagcataagcccgataagtag

SEQ ID NO: 23685 - DNA, 309 bp, Glycine max
  Peptide Sequence Number=SeqID_140463
atggacattaggatgaagagaggactcgcaagcttaatcaagacgccaatagagagagggtggggtaatgggttgcgctgtttcaactcttcttcttcggtgttgaagggcgtcaccacccccactctgcttcagcccagagtgcttctctacgacgccgtttctcacctctgccaccgagaaggaatcgcgcccttacctttcgtttcctattttttcttaaccacccaaccaaccttatatctccgtgaagccgcaattgcttttgcagagactccaaagaccttgacgatgtggctgaaattgtag

SEQ ID NO: 23686 - DNA, 2022 bp, Glycine max
  Peptide Sequence Number=SeqID_140464
atgaccgaaccacctccttcttccgccgacaaattggaagagcttctcgtccgcctcacccaccaacaattatccctcaccagcaaaattgacgatctcatacatcacgtttcccctttgataccactcgccccgtccttctcctcacctttgcctcgtcaattccctgctcctgtaacccaccatagaatgaaattagacgtaccacggttcgatggtacagatcctttgggctggatttttaaaataaaccaattcttcgagtaccacggcacccccgagtacgagcgtttaacgattgcatcgttctatatggagggccgcgcactctcttggtttcaatggatgaccagcaatggtcacctcacatcttggcctgtgtttctccaggctttgcaatcccggtttgccccttcgcagtacgaagaccccacaggggcgctgtgcaaactcatgcagaaagggacagtagctgcttaccaggcggagttcgaggatctttcgaatcgtgtttccggcattcctccagcggtactcctcagctgcttcatctccggcctccttccggaaatccgccgcgaggtgcaagcgcaccagcccctgaccctctctcaggccgccggcctcgcccgcctgcaggaggaaaaactcatcgaccacagacccccaccgccaccccctccccaccgccctcgccctccgccaccttctccctcgaaccccatttcacttcgccctaaccctcttccccctcttctcacgccttcccctcgacccccacccccaccgccacccttcaagcgcctcacctccgacgagatagcctctcgccgtgagcgagggctctgcttcagctgcgacgagaagtaccactgggggcaccgctgcgcctctcgggtattcctgttgctagctgaagaggaggataaccctaacccacctcttatagagccattggaccacatacccgaacccgctcctgacccgcccgatacccatgacccgtacccggcccaactcagtttaaactccttagcgggccacttagcccctgaaacgctccgtttcgtagccaccatttccgaccgtgacgtcgtgctcctggtggacggaggaagcacgcataacttcatccaactgcaattggtctcccaattgggcctgcgtcccatgtctacgtcacccctccgtgtcatggttggcaatggccaacaattagaatgcaattcgttgtgctccgctgtccctattactattcagaccaccacatttcacgttgacctttatgtactaccaatctcgggtgcaaatgttgtccttggagtgcactggctcaaatctttgggcccagtgctcaccgattacaatcacctgacaatgcaattcttctatgaaggcaacttgattcacttacagggggacatggatgctgccctgagttcactttcttcgttacaatttcgcagactgagtcgtaagaacagggatgggctctattaccatatcaccctcttacccaatgttgacacctccacgcaggacttgcctccaagtatccttactttattgaccaaatacgataccctgttccaccctccgaacacactacccccaacccgtgacaccgaccaccacatacatctccttccccaagcacctccggtcaatgtccgcccataccgttatccccattaccaaaaacaggagattgagtctcaggtggattcaatgttgcaaaagggccttattcagcccagctctagccccttttcctctcctgttttgttggttaagaagcaggatggttcatggaggttctgcgtcgattacagggcactgaatgcgttgaccgtgagagaccggttcccaattccgacgatcgatgagttactcgatgaattgggtggcgcaaggtatttctctaagcttgatttgctccagggctaccatcagatacgcatgcaccctcccgatatccctaagactgttttccgcacccatcatggccattacgaattcaag

SEQ ID NO: 23687 - DNA, 1946 bp, Glycine max
  Peptide Sequence Number=SeqID_140465
acgcctccggggttggcatgggcgccgtcctttcgcagcagggacaccccattgcctacttcagtaaaccatttagcgccaagctcctccggtcatcaacatatgtccgtgaattgtttgctatcacggcagccattaagaaatggcgtcaatatctcctcggacatcacttcatcatcgtcactgaccacagaagtctgaaggaattgctcacacaggtaatccattccccggagcagcatacctacttggctcagttgcttgggtatgattatgaaatccaatactggaccggtgctcataatcaggccgccgatgctctctcccgattgccggaaaccactgcttctctttgggtgttatccgttccttgtctgacattcttcgaggaacttcagcagcaattacagacccagcctgattatgtccgaaagcgccaagatatcatggagcaaccctccaatcaccctgcattctctatctcgagtaatttgattctccataaggggcgtatctggctcccagagggatttcacttgatccccactttaattgccgaataccattccacacccacagggggtcacgccagaatcgcgagaacagttgctcgggtcttggagaatttttcttggcctaagctccaggaggatgtcgcacacttcgtgaccaattgtgcagaatgtcagtgcaccaaatacgagactaagcgcttggccggattgttgtgtcctcttccggttcctttccggccatgggaggacctttctctcgatttcattacgggtttgccggcataccatggacacaccgtcattcttgtcgtcgtggataggttctcgaagggagttcatctgggtacgcttcccacagctcacacagcattgacggtggcctcgttatttgtcgacatcgtggtcaagcttcacggtgttcctcgaagccttgtatcggatcgagaccctctctttatcagtagattctggaaggagctcttccggcgcagtggtacccaactccgcatgagcaccgcctatcacccccaaagtgatggccaaaccgaggtactcaataggattattgaacaatatttgcgaagctttgttcaccggcgaccccacacttggggtaaataccttccttgggcggaatggtcacataatacgtcttggaactcagccaccgggacaactccttatgagctcaccttcggaaggaaaccattcaatttccctgagtacattgctgggacctctgctgtggatgctgtggattccttgttacaagatcgtgatgaaactttccaattggtccgccggaagcttttgaaagcccaaagtcgcatgaaggaacaggctgaccgtcatcggcgcgaagtatgctacaatttgggtgactgggtttggcttaaattgcgaccccacagacaaacatcagctaaaggtcctcagagctctgcagggaaactagcaagaaggtactatggcccattcaagattactgaagccatcggcaaagtggcttatcgactgcagcttcccccggatacgaagattcatgatgtcttccattgctctctactcaaaccgtttcatggtcatttggacatcacttccttcgcgcctctacctgctcaatttcataatgatcaaccccttctcactccggcagcaattgtggattatcgcagaaccccttcagaagcttgggaagtcttggttcaatggcatggcttatccccagatgatacgtcttgggaggattggtctgctttgcttaatgactatcaccttgaggacaaggtgatttcccaagggccgcgggatgatagggaaaacacagatcacagagtaggggtacaaagagaacattcagcagaggtgcagaatatggaaaagcccaaaaggagagtaatgaggccagcttaccttcaagattatgcgtaa

SEQ ID NO: 23688 - DNA, 1023 bp, Glycine max
  Peptide Sequence Number=SeqID_140466
atggtgaatggtctactcctgaaaggagctgatatgatcgatgacataaagttgaagctggaggagcagtgtcctcaaactgtgtcatgtgctgacacattggcatttacagccaacgaggtaatgaccatggcgggtttgccccctcggaaacccctcggtggccgtagagacgcgctggtttccctttccagtgcggcagacgccgacaacctccctttgccagactggaccatggatcaaatggtaaaactcttcaccaaaaagggcttcaacatcgaagaaatggtgatcctactcggtgcacattctatcggcatggctcattgtgacttgttcatccaaagggcatacaacttccaaaacacagggaaacccgaccctacccttaccgtcgaagcggttgaggaattcaaaaaggcatgccccaatgttaatacacctaagtacaggaacccccctgtcaactttgatgcaacaccaactgtgcttgataacctcttctacatggaaatggtcgagagaaacagaacttttctcattacggattcccatttgttgacagatcagaggactttgccacttgtgcaacagtttgcacatgaccctagcttgttccccaggagatttcctgaggtcatgcttaagctcggttctttgaatgtcctcacagggaatgaaggcgagatcaggaagatttatgtgggacttcattacttgtgtcatatgctcccaaacggtcaaacccctacccaagagcagcaacgtttcaaatttgaatcagccgtatgtgttaataacccctacacaacgttgctctcattgcctttctgggttcaattatgttttcatcggcttctaaaaagtcatgccatacggatccatggattgtggacagttcaaaactgcagtttggtattaatccatagcaacgttgctgctacaggaacagatgtcagagaaatgaaatgtagcaagaggagcttgaaggataattgttgtagagggggtgagggagtttga

SEQ ID NO: 23689 - DNA, 123 bp, Glycine max
  Peptide Sequence Number=SeqID_140467
atgaaagcaacccagatttggagactggcagatatggagcttgcaaggctgagaatctcaaatggtggcctattcatcacgtctctcactgttaaggggcatgaatctgtgatccagaaataa

SEQ ID NO: 23690 - DNA, 309 bp, Glycine max
  Peptide Sequence Number=SeqID_140468
atgagcatttatcaattatattttcaccactctgctgctttctacgtggttttgtgtgtcaatctcattgtgagttctgactctgcagctgcattgcgagtactgtcgcacttgccactaccttactctgcttttagtgcgctctgcgtgattccatctccactcagagatggtgtctacaattatgtagcaaaacgaaggtacgaatggtttggtaaggctgacgattatttggttttgcaagagaaagagctgcttgagcgtttcatagatagggaagaactgatgagtcgagataaggattcctag

SEQ ID NO: 23691 - DNA, 531 bp, Glycine max
  Peptide Sequence Number=SeqID_140469
atgttggggaagccatccggaaacttgctgaagtttcagttgcacagaaattattctaaccgtaatggccatttccaagttccaaaaattgcatccacggttacatcaactccaacacaacagagcaatttagcaaaatgggggcactcgaagttgatgaaaaacagagacaagaaaagcaacgaacccccaagagatgttacgaagttcaatggaatcagtttgcgcggcgattttctcggcgagaaccttggtctcggggcagtagaaaagcacgactcttttggcatttttggtggggaattgggaagcggaggtgacagaggagacagagaggaagggagaagaagggttggtgatgtgagaattggcggagtctttgctcatgtcggagacgcgctcgatggtccagccacggtggctctcgaagcctttgatctcgcacctcagattcgaattgaaagagaaaaaggttctgttttcgttggaagagaggcgaagcagagagtgagagtgagagggtttgtttga

SEQ ID NO: 23692 - DNA, 780 bp, Glycine max
  Peptide Sequence Number=SeqID_140470
atgctgcaaccgctggagcagctcggtgcgatttgtcgccagtacggcgtgctgttgtacactgatgtcaccgcatcgctgggcggcaacccgctggaaaccgatgcctgggggctggatgcggtctctgccggcatgcaaaagtgcctcggcggtccgtccggcacctcgccgatcaccctgagcccgcaaatggaagcggtgatccgccagcgtaagtgtgtggagcagggcatccgcaccgacgcacatcaggacggcgtcgacgagatgatctactccaactacttcgatctcggcatgatcatggattactggggaccggagcggctcaaccatcataccgaagccacctcggcgctgtttggcgcacgcgaatgtgcccgtctgatcctgcaggaagggctggataacggcatcgcgcgccacaagctgcacggtgatgcgctgctgaaaggtattcagggcatggggctggaaacctttggcgatctcagacacaagatgaataacgtgcttggcgtggtgatcccgcagggcatcaacggcgaccaggtacgcaaattggtgctggacgatttcggcattgagatcggcacctcgttcggtccgctgcacggcaaagtgtggcgcatcggcaccatgggctacaacgcgcgcaaagattgcgtgatgctgacgctgagcgcgctggagtccgtgctgaatcacgtcggtttccgcaccactcagggcgcggcgctgcaggctgcctgggaccactacgggagccacgcatga

SEQ ID NO: 23693 - DNA, 222 bp, Glycine max
  Peptide Sequence Number=SeqID_140471
atgacacagtcagacattcatagagataaacatgagagagcaactaacactacacagcataatcaatttgtcgcccatgatagctcacattccaccgataatgatgcagttgttgcagaaatcaaactactcatggacaaatatgctgaaagaaggaagcgtaggcaaagtattttacaagaacggaaaaaacaacgttcagctactaatggtagtacttaa

SEQ ID NO: 23694 - DNA, 183 bp, Glycine max
  Peptide Sequence Number=SeqID_140472
atgagtacgccaagatatcagcagaaagggaagcaagggaaagggagtcaagaacttccccgattgctaaccaaggccaaagcaatggcggacacctactccgcccctgaggagatccacggacttctcagctattgtcagcatatgatagacttaatggaccatatgattagaaaccgctag

SEQ ID NO: 23695 - DNA, 306 bp, Glycine max
  Peptide Sequence Number=SeqID_140473
atgcggcagaaaattgccgcggacatattgagccaccatatcgcctcgacccactccctgtccttttgtgcctggctgaaggttccgccacgctggactgaggacggccttgtacgtgcgctgacgaaccagaatgtcgcggtaaccccatcagaaccattcattgccggacccggccatggcggcggcatccgcatatgcctcggcggccgcctcaatcatgcaacccttatcaaagctctgaccacggtgcggcagaccttcgaacaactgccgcccgtctacgatatcggctcgatcggctga

SEQ ID NO: 23696 - DNA, 819 bp, Glycine max
  Peptide Sequence Number=SeqID_140474
atgacaatcatgaagagcgaaaacccgtccatatccgccgaaaaaagcccgcttccggtctcgctggccgcgatagagcaggcggccgcgcggcttgccggacaggtggagcgaaccccgctggtccgctcggacaatctgtccgaacgctgtggccatcccgttcatctgaagcttgaaacccttcagcctatcggcgccttcaaactgcgcggcgcgatgaatgccatattctcgcttgacgatgaggcgcgcaaacgtggcctcgtcaccgcctcgacaggcaatcatggccgggccgtggcctacgctgcagccaaactcggcattcccgccaccatctgcatgtcggcgctagtgccgacaaacaaggtggaggcaatccgcgcgcttggcgccgacatccggatcgtcggcagatcacaggatgacgcgcaggaggaagtggagcgcctgaccagaagccatggcctgaccgctatacctccgttcgatcatagcgacgtcgtggcgggccaaggcacgattggtctcgaggttgtcgaggacatgcctgaactggcgacaattctcgttccgctatcaggcggaggccttgcgggcggtatcgccgttgcggtgaaagcgttgaagccgagggcgcgggtcatcggtatttccatggagcggggtgcggccatgcatgcgtcggttaaagccggtcgccccgtctcggtccaggaggaagaaacgctggcggattcgctcggcggcgggattggactggcgaaccttgtgacctttgcgctttgccaggcattgcttgatgacatcgcgctg

SEQ ID NO: 23697 - DNA, 291 bp, Glycine max
  Peptide Sequence Number=SeqID_140475
atgccacccaccaggcaccctctagacccggataagtctaacagggccctggggtttccggcgctgattatgggcctctgccagtcattcgggtcagcaggggcatggttccgctccttttgctgccctactccggagcagtttggggttgaggtcgcatggcccggagactggcccgaggcccaggcaagggaggagcctgtaggatcccctggtgaggcagaggaggcccgtatggatgaagatatgactgacttgctcggtttcttgggaggaagcggagccacgtga

SEQ ID NO: 23698 - DNA, 291 bp, Glycine max
  Peptide Sequence Number=SeqID_140476
atgtcattgcctagcaccgttcatgtgttctccaccttcgagtctggagccccgcaaatgtcattgcctagcgctattcatgtgtcctgcaccttcgagtctggagccccgcgaatcgacgttcatgtgtcctccaccttcgagtctggagccccgcaaatgtcattgcctagcgccgttcatgtgtcctccaccttcgaatctggagccccgcaaatgtcattgcctagcgttgttcgccaattctccattctccacttttttcggagccccatgaatgtcattgcctag

SEQ ID NO: 23699 - DNA, 696 bp, Glycine max
  Peptide Sequence Number=SeqID_140477
atggatcctacactaaaatttcacaaatcttctggtattcctttctttgatcctactgtttacaagaggcttatggggcgattattatatcttactcacacaaggcccgatatttgctatgctgttggaaaattgagccagtatttaaaatctccaacaaacattcacatgcaagctgcacaccatattctgaaatatctcaaagacactgttggcagaggcctgttcttctcctcttcatcttccacttctttaattggattcagtgactcagatttgggagcttgtcttgacactcgaagatccatcacaagcatatgtttcttcttaggaacctcactaatttcttggaagaaagctaaatatcgggctcttgcacaagcatcttatgaagcacaatggttattgttcttactaaaggatcttcatattgagcatcctaaaccagttgttctctactgtgacaatcaagttgccctgcacacagccgcaaatcctgttttccatgaacgaaccaaacatattgaaatcaattgtcatgtggtaagagacaaggttcaatctgatttgattcaccttcttcccatctccacttatgagcaattggcagacattctcaccaagcctttacatgctggtctcttcaatcatattcattccaagctaggaatgcttgacattcacattcgagcttga

SEQ ID NO: 23700 - DNA, 171 bp, Glycine max
  Peptide Sequence Number=SeqID_140478
atgaatgaggtctcttcttggggtggtgccgccaacggaattagcggcatagacgtgccgccactaacagaagcgggaaccgcagggggtgccgctattgacagcagcgggacaggggtgagcgagggtatcgtcattgtcttaacagagctcccaagactcaattcataa

SEQ ID NO: 23701 - DNA, 1344 bp, Glycine max
  Peptide Sequence Number=SeqID_140479
atggctgacaatgttgttgtcaataatgcagcttttgcaaacttgttgaatccctattatactcatcccaatgagaatcctagtgttgctattattgctcaggttctctatggtgccaattaccactcgtggtcatgtgctatgctccttgccttgaaaaccaagaaaaaggtccagtttgtggatggttttttgcctcgccctgctcttaatgatcctaatttcactatatgggatcattgtaataccttggtggtttcatggcttcatcattcgcttaatctagatatcttgcaaaccattatgtggatggagactgcattggatatctggaacactctcaagaaacgttattatcaaggagatgtgtttcgcattagtgatttacaagaagaaatctatctgcttaaacaagtggataccagccatgctacttatggcagaggtagaggtcgtggaggctatacatcaggtggcagaggtcgaggtcatatggtagatacctgctacaagaaacatggttaccctcctcacttgcatagaggaggtgctatcaaccaatactctatggatgatcaagaaattgaagataatttacaatctcttggacaaaaagagcaaacttctcaagcctctccctctcacaccactaatcaactggttagctttcataagaatgggaattcaggtattttctgtgccactcttcatgcttatagttccaacataaactcttgggttctgaatagtggagctactgatcatgctatccaatctgaattatcatctcttattaagactaacacctggaagcttactcctttacctcgtaataaaaagccaattggctgcaagtgggttttcaaaatcaagttcaaagccgatggatccattgataggcacaaggctagattagtagccaagggatttacccaaattgctggtttggactacattgaaacttttaatcctgttgtaaaaatgactacagtcagacttgtgttatcactagctgcttctcagggttggcatctccatcaacttgatgttaacactgcttttttgcatggtgatttaaatgaggaggtatatatgaagattccacctggcttgacagttaataatccagctctggtttgcaagttgcaaaggtctttgtatggattaaaacaagtcagcaggcaatggaatgccaagcttacttctaccttactcgattttggattccaacagtccaaggcagattattctcttttcactaaaaggtctcctactggccttaccattgtccttgtttatgttgatgatttggtgcttactgacactgatcttgctgaaatctag

SEQ ID NO: 23702 - DNA, 537 bp, Glycine max
  Peptide Sequence Number=SeqID_140480
atgatggggaacaaggtgcatgacattggtgtcacaggagtgatgatgagtgccttagtgttgatgatggtgtcaaagggtgtgagagctcaaaactgtggaggatgcaaacagggtccttgctatagcacaggcactgccaaacccaacgatgatgattccgtcgccgacatcgtcacccccgagttcttcaacgccataattgatgaagcagaagaccattgtgctggcaagaatttctactcacgagatgccttccttgatgctctcattgcctacaaccactttgctaggactgcctcttcttatgactccaagcgtgaaattgcagctgcttttgctcatttcacccacgaaaccagacgtttttgctacttaggagagattgaaggtgcatcaaagaactattgtggcaaaaccaccaagaagtacccgtgtgcccatgacaaaggttaccatgggcgtgaacccatccaactatcatggaacttcaactacgcatgggagagctggattggatacggtggtggccagtga

SEQ ID NO: 23703 - DNA, 351 bp, Glycine max
  Peptide Sequence Number=SeqID_140481
atgaattcctcaaaggcatgcacccttttgaatttgatcatgcttgttgttatgttggttgcaatttttattagccaaagtagggtggaggcaagggttttatctcattcggaggagtttgcatttgcaagagctaataaccttcaaacatacagttcatcagcctatgaacaagccaagaaaaccatggggttttggatgcagcgtttggcttctggacctagtcctaaaggccctgctactttttatggatttaatattgatgtgaatatcgttttggctaacgattgtcatacaaaagccatcaactacctccttgctcttcctgacctcttccactacataccttga

SEQ ID NO: 23704 - DNA, 264 bp, Glycine max
  Peptide Sequence Number=SeqID_140482
atgtatggtaccgggaaagcacaacttgctcttcagaaaggtgaagaggatcttgctcgtgaagcacttaagaggcgtaaatcttatgcgcttaagttgttagaatctttggatgacgacacgacagacttcacagtagctgactctttaaagtgctttcatatgtacatttcaactcatgataatgccagttctttgaaagctcaacttgatcaacaaaagactgttgttgagaatcttgtctctaatacaaggcaaaaatag

SEQ ID NO: 23705 - DNA, 529 bp, Glycine max
  Peptide Sequence Number=SeqID_140483
gcttttcatctttcaacagcaaaaagtttatacggataaccactcaggtatttccgcccgtcagcgtgactcaaaagtcagtatgacagatcttgtgagcgcggaagatgacgtaaactccgcgtgtcaacagcgtgactcaaaagttagtatgacagatcttgtgagcgcggaagatgacggcgcagaagacgacctttgtctctgcgtggtatcagccttttcgtcttacagacagcaaaaagtttatacggataaccactcgggtatttccgcccgtcagcgtgactcaaaagtcaatatgacagatcttgtgagcgcggaagatgacgcttttcgtcttacagacagcaaaaagtttatacgtataaccactcgagtatttccgcccgtcaacggcgcagaagacgaagttagtctctgcgtgttattaggcttttcgtcttacagacagcaaaaagtttatacggataaccactcgggtatttccgcccgtcagcgtgactcaaaagtcagtatgacagatctt

SEQ ID NO: 23706 - DNA, 1116 bp, Glycine max
  Peptide Sequence Number=SeqID_140484
atgaacaagcgccaagaagatttgcgcaacatagctactaccctcgactccagattcaatcagaccctcagaaatgttcaagggttactcaaaggtcgaagcatacccggtaaaatattattgagccgtagggtagatcctcccgataactcaaactcgaagatatcctcaccaaattacaaaaggagcttttctcacaatgatgctggtacaagtgataacacatctggggcagtagaggaggagtttcagagtaaaagcaaaccaattagtattgccaatgccaataagctaaaagtgtcgacctcccttggagggagcccacccgaagaattccacaagtctaccatgggtgctagagctacagattctgcaagaattatgaagttcaccaaggtgctttctgggacggtggttatattagccattaagccttttggaaacctagggttatctaccacaataaaacatttcctccttgaaatctatattgtagacaagttgcgggaattagcttggagtggtgttccagacaatatgcgtcctaaagtgtggagacttctgttgggatatgcaccacctaattcagatagaagggagggagttctaagaaggaagcgccttgagtatcttgactgtatttctcagtattatgatattcctgatacagaacgttcagatgatgaggtcaacatgcttcatcagattggtattgattgtccaagaactgttcctgatgttccattcttccagcagcagcaagttcagaaatcattggaacgtattctttatgcatgggccattcgacatcctgcaagtggatatgttcaggggataaatgatcttgttacgccatttttggttgttttcttatcagaacattttgaaggggatatcgataattggtcaatgtctgatttatcttcagatataatctctaatatagaggctgactgctactggtgcttgtcaaagttgcttgatggtatgcaagaccattacacattcgctcaacctggaattcagaggcttgtttttaagttgaaggaattggtcaggaggattgatggtaacacttttctaaggacattttgttttcctccaagcattgtataa

SEQ ID NO: 23707 - DNA, 771 bp, Glycine max
  Peptide Sequence Number=SeqID_140485
atggcctcctctctgcttctccaacttggttctacttgtggtaaaagtccctcttttgctcctcctcaaagcattttggttgacaaacttcgaagattagtgattaaagtcaagtcctcagagacaagggaatgcaccacagctatgtttaatgccaattcacgtagagactttcttgggttagctttaggagtctcgggtctcttcatcggttcgctggatgcaaatggagctggtttgcccccagaggaaaagcctaaactgtgtgatgacacttgtgagaaagagcttgaaaatgtgcctacggtaactactggatcaggtttgcaatacaaggatattaaagttggacaaggtcctagtccaccaattggatttcaggtggctgctaattatgttgcaatggttccctccggacaaatatttgatagatcttcacttttaaccctgattacaattatatgtgtactatcatgtttgcactttgataaaaatgaatttgaagcctttgaagatgacataggcagttcactggagaaaggtcagccttatatttttcgtgttggttctggtcaggtgatacaaggacttgatgaaggtattctgagcatgaaagtaggagggaaacgtcgactgtacatacccggatcactggcattcccaaaaggccttacttctgctcctggaagaccaagggtggctccaagcagtccagtcatatttgatgttagtttggaatacataccggggcttgaagtggatgaggaataa

SEQ ID NO: 23708 - DNA, 348 bp, Glycine max
  Peptide Sequence Number=SeqID_140486
atggcggcgaaacttcaaatatttacgggattgccccccgcgccatttcaatcttcctcctccactctctgcgtactcaagaagcctctcactacctccttcttcggcactgcacgagtggaagttctgaaacttcgagtgatgaggattgcgaagcctgcgcgcggtggaggtgctctcggtgctcgcatgaacctctttgacaggttcgccagagttgtgaaggtgaaaaaagcactgaaacgacagtcgcttagctttaatattctcattgtcgttgtcgttatggtgttggcatctcaaaagcggttggaaaataaatacaaggctgcacaacaagccttctga

SEQ ID NO: 23709 - DNA, 305 bp, Glycine max
  Peptide Sequence Number=SeqID_140487
ggcgcccgttctccccagcaagttcatgtcgtcgtggcatagggagtgcctgtcgcccccagcaaggtcatcaggtcccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 23710 - DNA, 543 bp, Glycine max
  Peptide Sequence Number=SeqID_140488
gtgtttcctacctatgaggacgtattgcaatgggctcgtattattgcgtatgatattggttttgtgactgtgataatgaggtctgacacatcaactagaaagaaaggaaggatcttatccattttaattggttgtgagaggagtggaaagtatagaccacacaagaaagatttagtaccgacgacacatccggatgcaataaaattaagcaatgcatgtcatttggtattcctcataaacagtacatacaaaacaaatagatacaaactgtctttacttgacattgttggtgtgacacctactgggatgacatttttagctacattttcctatttggagggtgaatgtataaaaaatgttgtttgggctcttaaacggtttagaggtatttttttgaaaagtgatgcaatccctcaagtgattgttattgacagagattcaacattgatgaatgtagtgaaaaccatgtttcctgagtcaactaacttgttgtgtcggtttcacattgataagaatgttaaggcaaaatgtaaacccttgcgg

SEQ ID NO: 23711 - DNA, 666 bp, Glycine max
  Peptide Sequence Number=SeqID_140489
atggtgcctgtggaactgttgtggcggggaatgtccctagttgtgatgcttgctgctctggttccctttcgcccttcgaccgtcgtacacgtgattgagactccgcaccttgctcgcttccttgttggccgacaggcctcctacttgactcggaagcaacctgggcatttcctatactatactggtagcaggatcggccaccccggccccagcattgctctaattggagctctgagctggagcagtcttgctttggctcccctgaccgacctcaggcctccagatcaagtgcgcattcccatactgtgccacagcaggaagggggttggcggagccacgacagcgagattggcctccgcggctatatgcgaagatccttcagcaggagggtgtctggtcccttccgccgtagtcttcgtgtttgccatgaagagtaccatccaaatggacctacggatgagatctcaaaccgctcttcctggactaactgccagaaaactacctgagaatgaacctggtcatgtccttccgtgcattagtttagagcctcagaaggtctcccctaggtcatctctactctggctcaacacttccctgacttacgcgaaagaatcatcctcagaaaacaagcatcccggatggttgagctcaagcgaagcaccctga

SEQ ID NO: 23712 - DNA, 225 bp, Glycine max
  Peptide Sequence Number=SeqID_140490
atgggtgacttggctgggaagtttcaagcccaagacaatgattttctgagcctttggaatgtgttgggttttgaactcccaggaatgcctttcctggctgcattaaaacccactattggagctgaagcaatagaatcagctttggttgtatggggattgggttcaacaactattgatcttgagtcacccatctatgggttgctttgtgactcaatatgggtctag

SEQ ID NO: 23713 - DNA, 321 bp, Glycine max
  Peptide Sequence Number=SeqID_140491
atggccttggggaggtttgagaatgttgttgcggttgcagaaaaggctagcatcttagattgcagtaatgctgaaggccttaagtatgacaactccaactatgttctatattgcaatagggcaatttcagatggaactgaaattatgcagtacatgttggattctataatatatcagagggaaagttgccaagacattaaacaacatgaaaggttactacttactagtatagctactcagattcaaacatattcaagctggagttgtgtgccagtgtttgattttatcatgggatcaagaacattgcattctactgaatga

SEQ ID NO: 23714 - DNA, 222 bp, Glycine max
  Peptide Sequence Number=SeqID_140492
atgaaaaagcgaaagcttaaggaagagaataagaggaaagcacttgaagcagagagtgcaaaagaagagctgttgttgagaaagcgccggagagaggagagaagagacaaataccggaaggaagacaagcagaataagaaaattcggagagcagagggttgtcttgattcctatgcctgtgcccctctgctccatctcattatgcatgatgtaaaatattaa

SEQ ID NO: 23715 - DNA, 213 bp, Glycine max
  Peptide Sequence Number=SeqID_140493
atgtggaccactacggctttcgaagaagttacggaaacccacggattgcgcaaaaacacctcttttcgacttccgccacattacggaatttcacggatcgcgcaagcctgcttccttttgatttctgagacgcctcgggacttcatttactgtgcaacaaaggacgccaagtatctcaaagcggctaaccaaaggttgcatgtcatccagtaa

SEQ ID NO: 23716 - DNA, 909 bp, Glycine max
  Peptide Sequence Number=SeqID_140494
atggatggaatgctttcccacgaagaaaactgcttaggacatgcagactttcttgtcttcaagcatgaccgaagtaatgagttcaaggtactcatccttgaatcatcaacacagtgtcaaaagcctgtggtaaagatggaggaggagaatgaacaagagcaagcagcagcgcaacatgctgaggactgtgatatagaggaggaggaagacagttcttccaaggatgagaactatgatgacgacagcgatgacagtgattttgatgatgatgaagagagtaaagaagaattcggtgctggattcaagagtcaaagtcatcatagaagagcttgcaaaagggagactgcatcaagttccaaccccgatgctgaagatcctcttccagaatatgtatttgatccagaaatgtgtattcagcgtgagaatcatttttttaaagcaaagctctacagaactagacccaacgaattgcatattccaggaaattccattcaagaattttcccttacttttcctgaaaattatgttacccttatatgttgtcaaccctgccagcgcaaggacattccaatgaatgaattgggagattatcatcataacttgacacaacagacacacatccgcaaaaagtatcaggaagtgacaggaagagtgtgtaggtggcaagatcgaatatgcatcaagggttgggcaagcttttctaaaaggaataagattgaaagaaatgatacatgcttctgtgaagtaatatcaggggaagaccaagtaaattttgtacggaggatggagtgtgagagctcagctagggttttggaggaggagtctgaacaggaggaggatttgctgcaacatagccgcgtgatggagaaacggaaggctgatgaaaataagatcaaggctgatcgatga

SEQ ID NO: 23717 - DNA, 336 bp, Glycine max
  Peptide Sequence Number=SeqID_140495
atggcggcgcagctaatccatgatcgagtggagatggagtgcctagagggagcttgggagaccctcgaaggcaacatgaggtgccgatttcggggcacgattcgatttacgactactttattggtgcatccagatgaacccgcgcgcacgcttcagcgtactgtggagtggatactacccacgcctacaccataccgtctagtggagccagtccaagtgatcgaggtaacgtcatccgaggaagaccctgaggacgtcatgtcggcatccgaggcagactcttcggaggatagtggccctggagagatggcgatcagcggaggctcttcatcatag

SEQ ID NO: 23718 - DNA, 474 bp, Glycine max
  Peptide Sequence Number=SeqID_140496
ggtgaaatcgtcaaaacactacattttatggtgtcgcctgttaggagaaagcgaagtgtggagactcgaggcttagcgcgacgtcggcaaactgttgatgcagcaccgtacagtttgcctctgatgccaaaacgagaacatggaatgtattacacaccgccggtattcacccaagaaccatcgcagatggcgcccatgtattcatacccacatgattttcaaccagggtacaatatgacaggcatatttggatcctctcctccttcagggggaactccttcattcacccaaaataatgaactatcaaccccaaatgccccacttagtggtccgtggaatgtacctggaaatatacccgacatggatgacttattaggggtcgatttacgtcatgatttctctaccgaggctggtgaagtggatgaaagggggaatcgtagaagaagaaatcctgatagggcagctaggaattag

SEQ ID NO: 23719 - DNA, 289 bp, Glycine max
  Peptide Sequence Number=SeqID_140497
tgatcaaggggttctcatgaaccctaaaagactaaaggtcattcctgagtggcccactccaccaacaccacttattaagttggtgagaaaccatgttccttcatgggaagatgcccaggaaatgggttttcagaccttaccttacttcaacataccaaacaccacaaatacatatgtttttgttctttttacaagtgttgagggaaggagcccagagtatgaagaacctcgggatttgaggtcaaatcctttccaaggtggagggaacttgatggaagctttcttgtga

SEQ ID NO: 23720 - DNA, 3633 bp, Glycine max
  Peptide Sequence Number=SeqID_140498
atggaagaccatgtttcccctgagggaaaggaagttagctgttgcacacctcctggggctcagttggaggaaccaacatcggtagacggtggaatgaaaaaatctgcttcagaggacatgtttagcaacttctcagagctcatgaactttgatacctatgctggttggagcaatagcccatccatgactgatcagagtttggctaatgtgttttcatcgttttccttggcgccatatccagtacctgatgtgttgaatttagtggagcatggaaatggtccattctttatgacagaagatagtgaaattcacaatgatatggaaagtgctcctagttgtggggagagaattatatttcagcagatggactttcaacttgggttcttagatgaagcaaatgattcaaatagcttagattcaaaacaaaaacctaatggcacatctcaggaagttaataccacagacatgtgcaattacataatctcaagttcaccaggtaggtcacttgatgatagaatgctgagggctttgtccttctttatggaatcagctgatgggggaatgttggcacaagtttgggtgccaataaagcatggtgatgaattcatcttaagcacaagtgaacaaccttatttgttagatccaaagcttgcagggtatcgtgaagtgtcgagggcatttacattttctgcagaaggaaagacgcaatcatgtccggggcttccagctcgcgtgtttatatcgcacgttcctgaatggacctccaatgttggttactacaataaaactgagtacttaaggttggagcacgcaaggaatcacgagattcgtggatctattgctcttcctatatctgatgtgcactctcaagtgccatgtgctgtattggaactagttactacaaaggaaaagcctaactttgacagagaattagaaattgtttctcaagcactccagtgtctatcaagtaacaaaagagctgctttgactgagataattgatgtgttacgagccgtgtgtcatgcacatagattgccactggcactgacatggattccctgttgttacagtgagggaataagaaacgaaactgacagaatacgaatcaaagagggtcatacaagtcctaatgaaaaatgtgtactatgtattgaagaatcagcttgctatgtaaatgatggagctgtagaaggatttgttcatgcatgcgttgaacatcatcttgaggaagggcaaggtattgctgggaaagctcttcaatcaaatcatccgttcttctatactgatgtgaagacatatgatattggtgaatatccccttgttcatcacgcacgcaaatataacttgaatgctgcagttgcaattaggctaaggagtacctacaccaatgatgatgattacatattagaattctttctgcctgtgaatatgacagggagttcagaacaggaacttttattggacaatctctccagtaccatgcggagaatttgtaagagtttgaggacagtttcagatgctgagttaacaggaatagaaggttcccaaggtgggtttccaaaggaaaaagtctcaggtttttttcccatgtccaggagaaactctcagatagcattcataagcgatgaccatgattctgtcctgaagatgtccttgaaggcatctaacatgagaaataatggaattgaagccgttcatagtcagacaatgaatggatcaagaaagcaggtagagaaaaagagaagcacagtggagaacaatgttagtttgagtgttcttcaacaatacttttccggtagtctgaaggatgctgcaaaaagcattggtggtgagaccccgaaacaacatggaatttcaagatggccatcccgaaagataaataaagtgaatcgttcgttaaagaagatacagactgtgcttgattctgtccagggagtggaaggagggctaaagtttgatccttataccggggggtttatagccggaggatcaatcatgcaggaaacggaagcacataaatatcttgtgtttcctgagaaaagttctgtgaaagatcctaagcctgcaacacaaaaaaaagtctcagtagctccagcacctgccagcactattgagaattcaacaattaagttgaatgatgatgaaggtgtttgtctggtgggaaacaagcttgtgcactcaagaagtattcctaactccaacagcggtgagggagaattgaagaaagacaatgtttcttctgatgattcaaaatcaatgaccatgaatgatggatcatgccataaagcttgccattggaaaaagactaaggattgtcctgaacaaacttgttcaatgtccttggtaactgatgaggttgaagttggtgtagatagggtagaaggagctgatgaacataaccatcctacttcttcaagcactacaaactcatccaatggctctggctcaatgatgcatggaagctcatcatgctctcatgagaaccaaaagtattcaaaagttaaatcaaattgtgttgatagtgggtcaaaaatgattgtgaaagctagctacaggggtgatactattcgtttcaagtttgatccatcttcaggttgtttccagctatataaagaagttgcaacaaggttcaaattgcaaaatggatcattccagctcaaatatcttgatgatgaagaggaatgggtgatgttggtgaatgactcggatttgcaagaatgtacagaaattttggatgacattggaacacgttgtgtgaagtttcttgtccgtgacgtgccttgtgttttaagtagccatggcagcaacactccaccaaaaccttgggagaaagcagcatcatcatctgggccagcaccttttaaacccccatcagcaggtagcacaagtgatgtagttgaggcttcagggactgcaaaacctggcgaaatagttccagcttccgataagactgcaactgtcaataggaatgctcttgggagaccccttcccacaaggccatgggagcagaataatggaagtaccagctatggaggttatggttccacaatgaattataattctggatatggatcttatggtggagtgggagggttgtatggcggaggaatgtatggcagcagtatgtacaggggaggatatgggggcctctatggttcctctgggatgtatggagggggaatgtataatggtggctttggtggtccaatgggtggttatggtatgggtggtggtggtccttatggagctgaagatcccaataatccgtacggagttccttcatcgcccccaggattttggatttcttttatgcgtgtgatgcaaggtgtggttaacttttttggccggatttcaatgctcatagaccagaacacgcaggctttccatatgttcatgactgcacttcttcagctttttgatcgttctggtgtactgtatggagagctagctagatttgtgttgcggttgcttggaatcagaactaaaccaaagaagattaaccctccaggtccagatggacttccactacctgggcaacacaattcctctgtaaatcagaacttcattgagggaacaaagcctgctccaagtggttcttgggacaatgtatgggaaaatgacgccaaaaaatga

SEQ ID NO: 23721 - DNA, 1869 bp, Glycine max
  Peptide Sequence Number=SeqID_140499
atggcacatcatagaggcatcaccaacaaagacgcgaatgaaaacctcaagcagaacaagaaaatgagcccgcccaacaaatcaaagggaatcttttactggaaaacattcaagaggctcgaagtctcatctgatacagtccagccacactgtggaccattcctcggctttgctggagaaaaagtagagaccagaggctatgctgacctaatgaccatttttggccaaggccaactctcaaggagtttcaccgtcaagaaaacgttgaacgaactcggagccatcgtctccacactacatctcaagatgatattcctaactttgacgggacaaatcataactgttaagttagaccaaaagcagacccgacaatgctatgctaaaaacctaaagatggctccgtatcctcccattagggagccaagcaggcctcatccaacagtgggtggtagtagtcaagtcatgagcgtaggcgaagtgtccctaatccaaaccctgacagtctatgaagcaagtctgggagaccacgagggtgtattcaacatagaaccacgtgatgacactgttgacaaaggcctaaaacctattaaagaacttatcaagaatgccaacctatttgcgtggcaaccatctgacatgccaaatatccatcctagcattttataccacaagctagccatctgtccccaggccaaaccagtgtcacagaagaagaggaagaatggagaagagcgatgcaaggatgcataccctttgcccaacatcgataggctagttgacggcgtgtctgggttccaagtactgagtttcctggatgcctattcagggtacaatcagatcaaaatgcatgcctcgaacgaagagaaaacaacattcattaatgaggatgttaacttctgcaacaaggtctatgttgacgacatggttgccaagtcctatggcatagccctacatgtggcagacctagaagagttcctcccaaagcttgtcgaaaaagcaaagtcactctacaaactactcaaggaaaatgagccattcatatgtgacaaagcctacaaacaagccttcttgtccttcaagaagacaattgtcacaccaccgatcctaagtcgacccaggccaggagcacctctactcctatacctcttagtatccaacgaggttgtcagctcacccctcgtacaagaatacatgaaacaccaacttcccatctatttcaccaactgcatcctccacaatgctgagaagcagtaccagataatagagaaggtgttgagaaagcctgagctgagtttgctggcaatgactaaaccacccccagactggtggaacctctacgtggacgacgcatccaacatgaaggaaagtggggtaggtatcatccttgaaggcttggacaacgtcactttagagcaagctctcaagctcaacttcaaagtctcaaacaatcaagttgagtatgaggcacttatagtaggcttaaagctagcaaatgaagttggggccaagaagctaaggtgctacattgactcgcagcttgtccaagggcaagttgccaacaaatatcaaaccaaggagacagtactacccaggtactaccacactgcaaaaactctaattgatgactttgatttctttaagatgtaccacatccccagagagagcaacaccaaagaaaacctgctctccaagctggccagcaccaaaaatatcgggaatctcaaaaccatcatccaagagacacttcaagctctaaccatagacaccaaggaggtcatggcaggagaagaggaggaaccagattggatgaccccctataagaatttcctaattcggggggttttgccaccaggcgaaaacaaagcctga

SEQ ID NO: 23722 - DNA, 1502 bp, Glycine max
  Peptide Sequence Number=SeqID_140500
ggggtcaacctgctactaggtttaaccctaatgatgaagttgttgaggtctcccccaatgtgccttcctctattttggctaagtggaagcatgatgatggtgccagggtgtcaggctataagaagtcaaggccccctttcaaccttcgtgctatgaagcaagcaggtctaccatcggccatccaagatactgttgttgctcatgctcctctgacccttccttctctacttgttcaggaggtttttgcttctcctcctattatggttactgcaccggtctctttggtcggtcctattgtggctcatctgtccaccattgtgatgaccacgactgctccaaaaatgctgcctcatttttcttcagctccaccagttccccccttagttgtgttggcattttcctcttctcgccccagtctttctccagagaagtctggcgattctagaggaaaatggacaaaggcactaggaggcactaagcaagtagagcgtcccaaggtggccaatgccactgtcgcctttgatgatatcgtgattgctgacctcgaggcccaattgaaagagttggagtccaggctggatgagtatgagcttagggcatcaaaggcgagggaggccaacaaagagcttcaagaagagctgatggtgttcaagaaagcggtcgtggagcagcataaaaaaggcttttataaggtcgtcaagcaagtcgagttcttcgctgaggatcttgacttgggtctttttgactcattcaaggaagtaaaggatggtgaactgcctgacaaggaggaaatagctattgcgaaggaggatgctggcgagacgaaccttgggtttaacgatcctttggagaagcgagactcaccaaggggggacgttgggttttatgagcttttggagaaacgagattcaccaagggtgaaccttgggtttgataagcctttggagaagcaagactcaccaagggcggaccttgggtatgaagagcctttagagaagcgagactcaccaagggcggatcttgggtttgacgagcctttagagaagcgaccaggaatgcatccgtcctgggttttggcgaggcttactaatggcagaccttggttccaccctcatgttctctttgttgtgttgttcttggaacaacaacctccttgtcgacagttccccaactttgatggggattatggcatctctgttacccttggacttgttgagtctggtgcgcagggcgttaaggataaccctattagctgccttcgcctgaccattagtttgggggtgttcgacagaggttacaatgtgcttgacacttggcattgtcaaaaattctttgtgaacttttctacctcgttggctgagatttcttgtaatggccttgtgatgcaatcctaccccgcaagggcattggctagaagactccaagtagattgggctagagatccaaggaaaggccctagggttctcatgagccttagggtagatttcgagcccatgggctaa

SEQ ID NO: 23723 - DNA, 660 bp, Glycine max
  Peptide Sequence Number=SeqID_140501
atggaccgggaagtcattccaatcggaggttcctcctcagaggagacacaccatggagcttctaatagcgagtcctcatcctctgagaggttggcagacttgcgcaatgttagcggaggtacttctcacctccgaagaagggcgcgaccttttgctgcctctctagacagggaacccgccctggtcaccatgatccttcccccttctgcttctgtgggaataagaaggagtggtggcaaggacattagggtttctccccgcactaggcgtagccataatgttgggtcgccttcaacccttccagcggttgctggctatgaatgggtaagggacaaagttttgaaataccggtccttcattacttttgcggtgagcgtcaatgcattgcaaggtcaactgaggttggcaagcctagaagaatcttgcaagatggtcgctcaggcttgtggaagtgatgattttcccttcctaagagtagcgtcagggaaaataggctgggtatccctaaacaaggtgtccaagaaactcttagaatttaactcgaacgtgtttcaccacttcaaggactgtatttttaaggtcctggcaactaacattgtggttgatgggttgccactgatgttcaaccgagatagggaatcccacttcttgttctactag

SEQ ID NO: 23724 - DNA, 183 bp, Glycine max
  Peptide Sequence Number=SeqID_140502
atgaattggtgttatagtcgttgccgccacaatgaccttcattgtcatcattgtcactgtcgccaccgttgcgctggcccagtggtggaggtagcaaagatgatggcaatgacagtcataatagcagtggtaaatgatgctcatggtggcgacaatgacaatagtgatggtggtggcagttag

SEQ ID NO: 23725 - DNA, 396 bp, Glycine max
  Peptide Sequence Number=SeqID_140503
atgacatcctcaaaaccagtacgtactcctctgacaatattcattcttctattagaactcaatactattcagtcaaaattagagaaagaatacatgtcttgtgttccttatgcaagtgttgtaggtagtctcatgtatcttaagggtacaactgatattgaactcatctaccatggagacttgtcttgtgcttttgttggttactcatattctgactatgttgcaaacttggatgcaaggagattcgtgactgggtatacattcacgattggcaactctcttgttagttggaaggcaacacttcagcccacattggctttatccactacagaggtagaatacatggctcttgcagaagcaaacaaaggaaggaatctggctaaagggttcaattag

SEQ ID NO: 23726 - DNA, 480 bp, Glycine max
  Peptide Sequence Number=SeqID_140504
atgagtgtcatcatcaaaaagggggagaatgtgaatcatgcagaagaatcaaacaaggttgcttcaaaggataaacattgcttcaagattaatacaaggttgcttcaacaaacaaagccttgcttcaagattaactcaagatcaagccttgcctcaaaacaaagcgtttccgagacatccaaggctctggcaagagagagatattccaagagaacttcattgtcaaatgctttctcaactactcttgggcaaacacttgcaaatttattgagagttcatccaggaacttcgaattatattatccactctgaaggagagaaatctttctgttcttctcagaaagttaattgtaatcaagagattggttgtctcttgaattgtgagtttcctgaacacaagggaaagggattccttgggtgttcagaagttgtaaaaaggatttttacaaagatagtggaaaatctcaagtgggttgcttga

SEQ ID NO: 23727 - DNA, 384 bp, Glycine max
  Peptide Sequence Number=SeqID_140505
atggaagatcttgaagatgttgtgatcttcacatcaagggttcaagggaagagtaaaatttttagggaaatgaatgtgctagtgtttaaagttgtccaggaaatgccatttaccatgacggataaaatcacccacattggcttttacagtgcgaaacagataatcattaagtgttttgatcaagaatgcgaaaaataccataaaaaggggggcaaaagggtcttttccttggttttcctggaccctaactcgcccaggctagcctctggcttgcctaggccaccaaatagcttcacggtgaagaaatcagctcgcttgggcgagctcattgcttcaacactaagtttcagctcgcctgagcaagctgcaactgccccaaagtga

SEQ ID NO: 23728 - DNA, 615 bp, Glycine max
  Peptide Sequence Number=SeqID_140506
atgttggactacatccattttgactgttggaggccttcgagagttccatcattaggaggggcaaggtattttccacccatcatcgatgattactctaggatgacatgggtattcatgatgaaacataaatttgaagctttcaaaactttcaagcattggatgattcttatgaagaatcagacagtaaaagatgaagacatagtaagaccacatattgtatgttatacttcacaacaaaatggagtagctgaaagaatagacaagaccttgttggaaaaggtatttggatgtccaaaatactatcacgtaagtgaaggtaagctaaagccaagaagggtttctttatgggctatggagatggagtcaaaggattctaagtctggtctccatctgaaagacaggtacattagaagtgcctatgactcatgtgtttatcatagcaaggtagaagatggttcctacatctatctaccactttatgtggacgacatgctcataacatctcaaaatttgttggtaattcagaagctgaagtcactacttagtagtgaatttgagacgaaggacatggaaattgttgaaaagattatgggcatggagattaagagggattga

SEQ ID NO: 23729 - DNA, 258 bp, Glycine max
  Peptide Sequence Number=SeqID_140507
atgatgttgtttgctaagacagcaattgctatgcttggagatttagctgatactttgggtagtaatactggtcccttgattcagcagaaggcggaaacaattttgacacaaacaaattttgttcataaggagttcatgccattgcaagaagaggagttgagtatgaggaagattaaattcaaggctttcgatttgggtggccaccagattgctagcagagtttggaaggactattttgctcagcttactgaaacttaa

SEQ ID NO: 23730 - DNA, 279 bp, Glycine max
  Peptide Sequence Number=SeqID_140508
atgaggttatcacagggtgacgctattaagatctcggtggcatggggcgactctgcgcaatgctactcagatctcaaccaaggaagaggtggtgcatgcagatttgggtcttggcttggtggtggaagtctcgtgctcgtggatctgattagggtggtcacaagcggaatgggtgaagatggcaatgtagcacaccaacaacgttggtataaaggggagattgtggtgtgtttggtgaaaatggtggtggtttgtggtggttttggtttttgtggttga

SEQ ID NO: 23731 - DNA, 351 bp, Glycine max
  Peptide Sequence Number=SeqID_140509
atggggaacggtaatgctgattcattgttacggaagttgcttacggatatattggcagttacatcagtactgaagatgaaagcaattgcgaagtctaaagccaaagaagaggagaagaaagtagaggctggggtaactttctttttggtacaaataactggtcattttctcccagaggaggatgacaagtttcttgagaaagttcaagctgctgtggaagaagaggagcgtgaagctttggctgcagttgaaacagatgctgctaaagatgcaattgcaactgccgaggaatccaggaaagctattcagaatcaagggaaactatcaaaaagaggcaatgatgatagtgaa

SEQ ID NO: 23732 - DNA, 375 bp, Glycine max
  Peptide Sequence Number=SeqID_140510
atgacttcgacattgccacattctatggcgggtttgagcaacctcttaagttgggattttgtgcatgcaaatatggatttggtgaacaagttgtgtgattggggaatttgggatatgaggaactcgatgagaggaggggaacgagcgcgaagtgaagaaacggtggccgacgctgcgatatctccgactgaaacctcagatcccacaaaaacaacagatatgggagagataatggagttcatgtatttcatggtcgtggtctcctccactggtcgcaacctcggccacctccgcgactatgacgacacaaagccacaaactttgcccttaaactccagctcaaacaacaccatgttaaagtttcttcgaccatag

SEQ ID NO: 23733 - DNA, 699 bp, Glycine max
  Peptide Sequence Number=SeqID_140511
atggctaacccttctgggaatcacgaagaagagcagacaacccatgttgcgtcgtcgtttaacgggaatttggcacccgacacttcgcccaccgcgctcgccatgaagcacaaccccggcatagccctcgattggactctccaagaacaaactattctcgaagaaggactctctctgtttgcgtctgaacctaacctcacacgctatgcaaagatagcacaaaatctaaataacaagacagtccgtgatgtagcactgagggtcaggtggatgaataaaaaagaaaattgcaagagaaggaaggatgattttccaaggaaaagtaaagacaaaaaggtttctgatcctgcagtgaggtcatctcactttactgctcaacccaatgtttccccatatgctcttgctatgacaatgatggacaacgatgatggcatctctcacatagctattggaggccccacaggtgagctcttagagcaaaatgcacaggccttgaatataatctctaccaatcttgctgctcttcagtttcagggtaatgtcaatcttttcagccaaacgagagacaacatcgtcaaaattttgaatgacatgaatgacatgcaagaggcaatgaagcaaatgccacctcttccttttaagatcaatgaaacaatattcaactccatactttccaaaacaaatcaacatatgcaataa

SEQ ID NO: 23734 - DNA, 363 bp, Glycine max
  Peptide Sequence Number=SeqID_140512
atgtattccttaacatgcacaccactttcttcttcttcttattctcatcacaccactctaaaaccaaacctcaaccctcttctgggtgcagatgcaacttctaggccatgttctctacccttgaaaagaagaacatgctttactaccaaagccattctctcatccacaagagaagatgtcttgaagcatttcaacgaacgacgagctctcaagggtggagcaactctcttggatatagcatgtgaccctgagttggtaaacctggccattgacttaacttcttgtccgtatgctgtaagagataaaatcatccatcctatcaaagttgaggtacgtcgttctcttaatttttctggaaaataa

SEQ ID NO: 23735 - DNA, 141 bp, Glycine max
  Peptide Sequence Number=SeqID_140513
atgcctcgttacaaggacgagtcccctgcagttcgggtctacactgtatatgtaatcagaggcttagagcttgaggctgtggtctctttagatcttctagctgatgtcatggggaaggctctcgaattggggagcatatga

SEQ ID NO: 23736 - DNA, 1269 bp, Glycine max
  Peptide Sequence Number=SeqID_140514
atggccaatggtaacaacattagtcatttcttcaagctcttgcttttccttctaactttccactcttgtctcgctgagattttcttccaagagagattcgaagatggatggaagagccgttgggtgctatccgattggaaaaggagcgagggaaaagcgggtaccttcaagcacacagcagggaaatggtctggggatcctgatgacaaaggtcttcagacatataatgacgccaagcatttcgccatatctgcaaagataccggagcttagtaacaaggacagaaccctggtggtgcagtattctattaggtttgagcaggacattgaatgcggtggcggttacatcaagcttctttctggttatgtcaatcagaagaagtttggtggtgatactccttacagtttgatgtttggaccagacttatgtggttcacagacaaagaagctccatcttatactatcataccaggggcagaattacccgattagaaaagatctgcaatgtgaaacggataagttgactcatttctatacatttattctaaggcctgatgcctcttatagtatccttgttgataatcgggaaagagattctggaagcatgtacatggattgggacatccttcctccaaggaaaatcaaggatgtcaaagcaaaaaagccgtcagactgggatgatagagagtacattgaagaccctaatgatgtcaaaccagagggatatgattcaattccagctgaaattcctgatccaaaagccaagaagcctgttgactgggatgacgaagatgatggactatggaagcccccaaagattcctaatccagcgtacaaaggaccatggaaatgcaagaaaatcaagaaccccaactacaaaggaaagtggaagattccatggattgataacccagaattcgaggatgatcctgatctgtatgttctcaagccaataaagtatgtgggcattgaagtgtggcaggtgaaggcaggttcagtttacgacaatatcttaatttgtgatgacccacagtatgcaaagcaagttgtggatgaatatatggctagcaacagagaggcgctaggaatcatagtatctgcattctcattatgtgtaaaatctcaggctgaaaaagaagcttttgaagaagcagaaaaagaaagaagggctcaggaagacgaggaggcacgaagagcaagagaagagggtgaaagaaggaggaaggagagggatcataaatatggaaaaaggaggcatcgtcgaaggtaa

SEQ ID NO: 23737 - DNA, 1239 bp, Glycine max
  Peptide Sequence Number=SeqID_140515
atggagcaaaagactcttgatgatagacacattgtgtatgctaaagttcaaatgatgtttttggaatgctatcaagcatggcgaggagcttttgttatgtatccttggtctcttgttaagcgtgtaaaaaggtgctgggataaaataaaaacctggttgaccaataattttcctgaagctgaggccactctttgtaaaggtgctactgaagctgacattcaggagttggagaatgtattaaaggtgaaattgccacttccttcaaggatcctttatcgttttcacaatgggcaagaaattgcaaaagcagatccagaaactactacatatggcagttctttgggtctaattggtggctactccttctatagtcatttggtgaatgtttatctattacctatacgtcagataatcctagaaacaaagcaaactaggcgtcacttgagctttttaagaagatcaaagtatgttctcgtggctgcttcatccacatacagtagaaagttatttttcctcaactgtaccaatggtcaactatatgttgggaccagggatctacttactgaaggagacataatcccttgtgtacctcatgatctgattaatttacatcaggaattgaatatttcagagcaacaagatgccatgctactgtggttagaagaacatggtcgccgtttagaacatggctttatcaaacttcatgacaaaggaaatggcaaaagcattaatcttttcccagaagaaccccctctttgttcaatggctgttactaatggtgtgaaggttcgtgcttctgcattggttatccctgagttgattgatcttcaagatgaccttgaaaagtacttatttgcttattcaatccgcttgtcccttgaacctcaagggtgcactattaatggaatgtccttcagctcctgccagctccattggaggcactggatcatccgagctaatgatattgttatatctgatgtcaatggagaagctgttataggacaggtgctcaagaatttgtctatcagagtcgcatgcatctaccaacaccatcaggttccattgaaggttcttttacatttatacccggcagatacttggtggaacttatgggatgaaatgaagatccagtgggagaaaatttcagataggtggtttagattggcagacccaaaaggagatccttttctagctacagtggctcgtttcccgctccagcttccagactatattttctga

SEQ ID NO: 23738 - DNA, 3087 bp, Glycine max
  Peptide Sequence Number=SeqID_140516
atgccgcttccggcgaaaccgatgagggatttcgacgagtcggctcctccgtcgaacaatctgtgggtggggaatctggcggcggacgtcaccgacgccgatctgatggagctcttcgccaaatacggcgcactcgacagcgtgacgtcatactccgctcgcagttacgcgttcgtgttcttcaagcgcgtcgaagacgccaaagccgctaagaacgctctccaaggaacctctctccgcggcagttccttgaagattgaatttgccagaccggcaaaggcttgtaaacaactttgggtgggtggtattagccaagctgttacaaaggaagatttggaagctgaatttcataaatttggtacaattgaggattttaagttcttcagagacagaaatactgcatgtgttgaatttttcaatttggaagatgcttgtcaggctatgaaaatcatgaatgggaaacgaattggtggggagcatattcgtgttgacttccttcgttcacaatctacaaaaagggatcagttgcttgattatgggcagtttcaaggaaaaaacttggggcctactgatgcttattctggacagaaaagaccactggtgagggtcctctgcaacatgcatctagttgcaagtttatcacttcattgcctcagtcctgctcatttgtttgtcattgccttgttggatcattcacagcctccaatggggagaaaaggcgacagtcaaccaagtaatattttgtggattggttatccgcctgctgttcagattgatgaacaaatgcttcacaatgccatgattttgtttggtgaaattgagagaatcaagagtttcccttcgagaaattattctattgttgagtttagaagtgttgacgaagctcgacgtgcaaaagagggccttcaaggacgcctttttaacgatcctcgaataacaattatgtattccatcagtgacctagtacctggcagtgattaccctggcttttttcctggaagtaatggaccgaaacctgatgtattgctgaatgaccatccatttcgaccattacaaatggatgcatttggtcataatcgtccaatgggtccaaataattttcctggacagttaccacctagtggtattatgggaccaaacataccaatgcgaccttttggtcctcacagtggtgttgaatctgttatttctggccctgagtttaatgagattaatgcgctccacaaatttcaggatggtagctccaagagtagcatgggtccaaactggaaaaggccatctcctcctgcaccagggatgctttcttctcctgcaccgggtgctaggcttcctacaagatcaacctcgggtgcatgggatgtgcttgacataaaccatattccaagagattctaaacgttcaaggatagatggacccttgcctgttgatgaaggcccatttcctttgaggaatatagatgatcgggggttagctctagagcagacatatgggattgacccagctattgatggaggtggttctggtccatatgtaaacattcaaggaaagagtcaccttggtccagttagctcaaggattacagctggagtacatggtgtcgcccaacctgatattgatcatatttggcgtggagttattgcaaaagggggaactcctgtttgccgtgctagatgtgtaccaattgggaaaggaattgggactgagcttcctgatgttgttgattgctcagctaggacgggattggatatactcacaaaacattatgctgatgcaattggttttgatattgttttctttctgcctgatagtgaagacgattttgcttcatataccgagttccttcgctatcttagtgcgaaaaatcgtgctggtgttgccaaatttgttgataacaccaccttattcttggtgcctccttctgattttctcacaagagttttgaaagtcactggacctgagcgtctgtatggtgtggttcttaagtttccaccagtgccaagtagtgcacctatgcaacaaccatcacatttgcgtgtaccaactactcagtatatgcagcagattcctccttcgcagactgaatatggtttgattcctgtaaaagaggaacatattttaccaatggattataacagaccgttgcatgaggattccaagcttcctgctaaaccagtctatccaccaacaggtggcccccctccagttcattctgggcctccagattatgctcctaataatactgttgctgggtcccaagctggagttgcattaacacctgagctaattgcaactttagcttcttttcttcctacaactacacaatcacctgccactgatggtgccaagtcagctgtaggttcctcgaccatgaagcctccatttcctcccatgacaccaaatgatggaaatcaatctcatttatggaaacaggataatcaaattgcagatcaatccactcatcctcctcaacagttgaggagcatgtataacattcacaatgctcactatcagccctatccaccagcatctgctccttctggcaatccttctcaagtggtctctggcagttctcatatccaagatactgctgccagcatgcagcagcaaggtgctgtttcatcaagacacatgcctaatttcatgatgcctactcaaagtggacaggtagctgtatccccccatgccagtcagaattatcaagttgaggtctcccccagcaatcagaaaggttttggagtggtgcagggaacagatgcctctgttttatacaattctcaggctttccagcaacctaataacaattctctggctttccaacaacccaataattcttttgccttatctaatcaagttaatagtactaatgcttcacagcagcaaactgccatgccatatacagtggaccaggtaaacccggacacccccaatcagcaacttcctatgtttggagtcagtcaaggacaaacagaggtagaggctgataagaatcagagataccagtcaacgttacaatttgctgccaatcttcttctccaaatacaacaacaacagcaacaagccccaggaggacatgggccaggacaatga

SEQ ID NO: 23739 - DNA, 1044 bp, Glycine max
  Peptide Sequence Number=SeqID_140517
atggcggtggtggacgatcgcttcgcggatttgaaccctaagacgtgcgtggttttaggcggcagaggattcctcggaagatcgttggtgctcaggctgttgaaactcggtaactggatcgtccgagtcgccgattccgctcagtctctccaactccaccactccgagtctctcctcgaacaagctctctcttcttctcgcgcttcttacttccacgtcgaccttctcgataaacggagcattgtcaaagttctagaaggttcctctgttgtcttttatatggatgttgccggcgtcgatgtgaataacttctatacttgctataagcttatggttcaaggtgcaaagaatgtcattagtgcttgccgggaatgtagagtgagacgcctgatatataacagttcggcagatgttgtagttggtggtttgcatgatattcgtgatggagatgagtcgttggcgtatccgtggaaaactaacaacacgttaagtgaccttaaggctcaagcggaagctttgatcctgagtgccaatgacattgatggcctattgacatgctctcttcgtcctagtaatgtttttggacctggtgacacagaatttgtgccatattttctcaaattagcaagatatggtttttcaaagtttattatagggactggtgataatctttcagatttcaccttttctgaaaatgttactcatgcccatatctgtgcagaagaagccttaaatttccaaacggtttctgtggcaggaaagacatttttcatcacaaatctcgagcctatgaaattctgggaatttctctcacttttgttagaaggtcttgaatatcaaaggccattcatcaaacttcctgctaagttggtgcaatatattctctcagttttaaagtgggtacatgaaaagttgggatccagatacttcagttatcctttattagttcacttttttcagttagcttcatacacccgaactttcaactgcatggcagctcagaaagatattggatactcaccaatagtctccctcgaggtttaa

SEQ ID NO: 23740 - DNA, 1044 bp, Glycine max
  Peptide Sequence Number=SeqID_140518
atgaaggttgttggggggtggaggaagacaaaggcaaaggcgttaaaaggtggtgggaggggggaaaagcaaaatcgttttcaagcatacagtagagaagaaagagtgtatgaaagaagtgggttttgcgtgtggccagatgcgagacaactttgcttagggaaaggtcttctatatggatttatgcgattattttcaataccattaaaaacattgcgtggagctagtcggtcgctgagagtaaatcaattttgcagtgtagtgaatctatcgtcctcattgcagatagaattggttccatgccttagggacaattatgcatatcttttacacgatgtggatacggggacagttggtgttgttgatccttctgaagctgcacctatcatagatgcgttgagcaagaaagatttaaatttaacttacataatgaacaccaaccaccatcctgatcatactggtggaaatgcagagttgaaagaaaggtatggtgcaaaggtaattggttcagaaatagacaaggaaagaatccctggtattgatatctatttgagtgatggagataactggatgttcgcaggccatgaagtgcatatattggccacacctggtcacaccgaaggtcatgtaagcttctactttccgggttctggggcaatttttaccggagacactttgttcagcttatcatgtggcaagctcttagaaggaacccccaaacagatgttatcttctcttaaaaggatcatgtctttgcctgatgatacaagtatttactgtggtcatgaatatacatcgagtaattcaaagtttgccttgtctatagaacctgaaaacaaggaacttcaatcctatgctgcccatgtagctaaccttagaaataagggcttgcccacgattccaactacggtgaaagtggaaaaggcttgcaatccatttcttcgcacatggagcatggaaatccggcaaaaactaaacattgcaaccacagcagatgatgcagaagccctgggtgttattcagcaagcaaaggataatttttag

SEQ ID NO: 23741 - DNA, 369 bp, Glycine max
  Peptide Sequence Number=SeqID_140519
atggtggaaaatagacttaggtggtttggacatgtagagagaagaccggtagactctgtagtgaggagagtagacgagatggagagaagacaaacacttcaaggcagaggaagatccaaaaagactataagagaggttatcaaaaaggacttcgaactcaatggtttggatagaagtatgtactatgagaaaataacaagcattaaaattaaccttgtcccccaggaaccgattccaatagaggaagtgtttcagcagctaaaatggtcaagagcagttctaacatcagatgaaggggccaaccggttccaagtctttccaaacaaattggaagagaaaaaaacgttggggacatgtcttatattgtaa

SEQ ID NO: 23742 - DNA, 2496 bp, Glycine max
  Peptide Sequence Number=SeqID_140520
atggaggacagaaataaccatgatgaatgttgggaaagcaacagtgtagacaatggtgctgaatccatggaagaagtagatgaactagacgtaattatgcatgataacatgaatgggggttttgaaccttgcgagccagcatcagggatgtcatttccttccaaggaagctgttaaatcattttataggcagtatgcttctagaatgggatttggttccaaaggaactcgtgtgccaaacactttgaagacattgcccacaatcaagaataattgtgaagccaaaattacagtttccttcaaagatggactgtggtacataatgaaagcagtacttgaccactcccatgaacttagccctacaaaggcaatgatgctccgagtaaacaaaaacactagcatgcatgtgaacagaacaatagaaatcaatcatgaagcaaaggcagtgatgaacaagaccatccaatctcttgcttgtgacgtgggagggtacagaaatttatcatttgttgaaggagatgtgaaaaatcatgttctgaaggaaagacatacaattggtaaggaaggtgatggtaaggctctaaggagctattttttaaggatgcaggagcaaaattgtaatttcttctacgatatagacttggatgatttttttcgtgtgaaaaatgtattttgggctgatgcaagaagtagggcaacatacgattcatttggggatgtggttacttttgacacaacatatctaacaaaaaagtatgacatgccatttgtttcatttgttggcgttaatcatcatggacaacatgttttattgggatgtgctctactctctagtgaagacacagagtcatttgtgtggctgtttgaatcctggcttcgttgcatgtcaggcaatcctccaaaaggtatagtgactgagcaaagcaaagcaatccaaaaagcaattcagctagtctttccaacaacccaacataggtggtgcttatggcatgtaatgaaaaaaatccccgagaagttgaaaacaaacactgaatacaataagaatataaagagtgccatgagaagtgtagtttatgataccttcacagaagctgaatttgaagatcaatggagtcatttcataaaaggattcaacctacaagacaatgaatggttgagtgagttgtacaacgaacgaagtagatgggttccaattttcttaaagaaggatttttgggcaggaatgtctaccactcaacaaggtgaaaacgtacatcctttctttgatggatatatcaactcaacaacatctttgcaacagtttgtccaactgtatgatattgctctctatggcaaggtagaaaaagaatttgaagctgatttacgatcattcagcactactattcattgtgggtcaaattcaatgattgaaaagcaattccaatctgcttatacccatgcaaaatttaatgaggtgcaagctgaatttagagcaaaaattaattgttctgtatcccttagggatgtggaaggtagcatttgtacttatgatgtgttggaggacataatagttgaaggacaaccaaaggaagctatttttgagacattcgctcattgtatttgcacaagaaagggtgaaacaagtgccgtcaaaccacaaatgcaaaggtatgacaatttatgcaaggactttaatgagattgcagaacttgctgctgagtttgaggataactgttcaaatggttgggcatcacctcctggagctgcattcaaggttagaggtcctgagtatttaacaacaaaagctaagattcctgctggtgattatctgctcaatcctcttggatttgattggattaaaagttcagtaaaaatgggtgagatattgaagcattcgaatagccaagttaggaaggtcattgataatgagtttccagctggtgacaaaccttttgtctgggccttcaatattcaactcccaaccaaggataactacagtgcggtggcatattttacaaacaaagagcctattactgaggggtctctaatggataatttcttgaaaggtgatgatgctttcagaaactcaaggcttaagatgattgccaacattgtcaatgagaatttcgtagaagaagtagatattgatattggatcttccatggtagcagctgctatagttcatttggcatttggttatgtgacaactttgactgttgatctggctttccttattgagagccaaactgaatcagattttccagaaaatctcttaggtgcattcagattttctaacctcaatcctgcttcagctagacaaattgatccatcatccgttttgagcactggtggtttacaaaaatctttatctaaaagattgtggaagtcaatagggcagattcttcttcctggttctaaagaggatgactctacttctggctcacaaaatactaaaactgtagatcacaaaaacgtccgagtgacttcaagaaatggtgagtttttggaatttttgtga

SEQ ID NO: 23743 - DNA, 216 bp, Glycine max
  Peptide Sequence Number=SeqID_140521
atgcccaaagacaattatgataatgggatacacctgatattgatcacccatgcaaaactccttaggattcctttcgagtccaagggtagccttcgcttagataaattcttccaggatcagcccttgccattgagtatcagtgggatcaacaaacccgtgacatcactctatgaccttaagttaagaaagtttcacttggtcgtataccaagtgtaa

SEQ ID NO: 23744 - DNA, 321 bp, Glycine max
  Peptide Sequence Number=SeqID_140522
atgatagtagacacattaccagtattctactatgaaaagatggtgggctacacaccttcaagctttgatgatttagttttcaccgacgaaaggatcaaagtaggtatgaaaagaggcaaatttaatcatcttgcttggacgaatgagaaaactggggaaaatgaaaagggtgagaatgagggagaaacccatgttgtgactatcattcctatacggccaagtttcccaccaacccaacaatgtcattactcagccaataacaacccttctccttacccaccacccagttatccacaaaggccatccctaaatcaactataa

SEQ ID NO: 23745 - DNA, 243 bp, Glycine max
  Peptide Sequence Number=SeqID_140523
atggagatctccaacatgtggacgaatccgtttgacgtgtctcttaagcatggtgcagcagcaagaacaaggcgaatccacaaaatgacacatagcaattggggctttgttaggaaatatgtatgtgggggtcaccaccacaacatggagtttgtaacggctccggcttcatgtggattcacacatcagtatatcctcaaggataccaatggtaccaccactagccttcccaatgcttcgtag

SEQ ID NO: 23746 - DNA, 283 bp, Glycine max
  Peptide Sequence Number=SeqID_140524
ggcatacaagagactctctgctgttggattttgggaggatagcaagaaagcatcagtagaggcacaactcaagaaaatcgaggaaaacttggaaaaaaagaaggccgaatatgttgagaaaatgaagaataaagttgctaaaatccacctgttagcagaagagaaaagagcagttgttgaggctcagaagagggaagaatttatcgacttagaggagacagcttcaaagtttcgtagccgtggagatacgccaaggagattctttgcatgctttagtggctag

SEQ ID NO: 23747 - DNA, 255 bp, Glycine max
  Peptide Sequence Number=SeqID_140525
atgaagaacgaacgaagaacgatgaaaaacggtggaaaatcatcacgaaatcacccactgaaacttctcggaagcgttacggaaacgcctcagcttagattttcttcacggaaacaatttttctcactaattttaagggaaaataaggaggtggttgtcgcccaggcgagctgggttgcttccaccagaaggcatcgccttctgttggaagatcctgtaaggcctgattgctatttgtacacccctgtttactaa

SEQ ID NO: 23748 - DNA, 171 bp, Glycine max
  Peptide Sequence Number=SeqID_140526
atggggacaaccatggcagtgagaacgttgatggccttgacgaattggacaactcgcttagtgcgcactctcactaagcgggaaagctcaagcttagcacgaagaaggcccacgaggaagcccaaagacacgcttagtggaaggcccgtgcttagtgtgaagttagcgtga

SEQ ID NO: 23749 - DNA, 863 bp, Glycine max
  Peptide Sequence Number=SeqID_140527
atggcattggaactcatggggttcccaaaactagacgaacaaaaggccattcaagaggccgcatcagaaggcctcaaaggcatggagcacttgatccgaactctctcccaacaacccctttcacttaaacaccgaactcaccgatgttactgtttccaatactcatctccacccgcacctgttcacaacgctaacacttccacctcatcaattcaactccctcctccgccgcaaaaccctaatattcccgcgccggtgcagtttccttctcctgcgccggtggccgttcaccacgcgccggtgacgctcgatttcacgaagccgcacaacgcgcttctgagctccaacgcgaaatctgttgagctcgagttctcgaaggagaccttcagcgtttcatcgaactcgtccttcatgtcctccgcgatcaccggcgatggcagcgtctccaacgggaagatcttcctggcgccgccggcgacctccgcccgaaaacctccagcgttcaagaagcggtgccacgaacaccgcgaacactccggcgacgtctccggcaacagcaagtgccactgcgttaagcgaaggaaaaatagggtgaagaacacagtgagagtgccggcgattagttcaaaaatcgccgatattccacccgacgagtactcgtggagaaagtacggtcagaaaccgatcaagggttccccatacccaaggggttactacaagtgcagcacggtgagagggtgcccagcgaggaagcacgtggagcgcgcaccagacgatccggcgatgctgatagtgacgtacgagggggagcacaggcacgccgttcaggccgcgatgcaggagaacgcagccggggtggtggg

SEQ ID NO: 23750 - DNA, 933 bp, Glycine max
  Peptide Sequence Number=SeqID_140528
atgaccgtcgaagaggataaggaacaagatcgtggggttctctgtcaacacccttccccctccccccagttccttccgccatccccatgtcgtcaccattgtcgtctcaccattgtgtgttccttcttctgccgccctagtcgaagccgcagacatcacaacaaattatctcttcccaccaccacctccacctccttatttgaaccgaagctcgaagctgtgtttttgtgtttgtctctaacattgtggtatttgatggtattgtcaatgattttgaattcattttgtgatcctcaccctcgagtgcgatgggcagctataaatgcaattgggcagttgtccacggatttggggccagacttgcaggttctggtggcccatgctgcttctgcagtgctaaatttcactgagaattgtaccccagatatcctaacacgttacttagatgggatagtgagcaaacttttggtactcctacagaatgggaagcaaatggttcaagaaggggctttgacagccttagcatctgttgcagattcttcagaggtgcaatttcagaagtattatgacgctgtgatgccatacttaaaagctattttggtgaacgcaaatgataaatctaatcgtatgcttcgagccaaagcaatggagtgcattagtttggtaggaatggccgttggaaaggagaagttcagggatgatgccaaacaggtcatggatgtcttgatgtcactgcaacaatctcaactggatgttgatgatccaactgcaagttacatgttacaagattttctcccatatatgggttttgtgatgcctcctttgctccagtctgcacaacttaagcccaatgtgaccattattacatcagcggattctgatactgaatttgatgaagatgatgacaggtgccctttcagttattgttactga

SEQ ID NO: 23751 - DNA, 675 bp, Glycine max
  Peptide Sequence Number=SeqID_140529
atgcgatcttcgataagggtgtcaaaccgggccaggcccgtcgggcctggcccagcttgttctccgaaaaagttggccctctctctcaagaccctcaccctcgacctcgagccctcacccttctcttttgatttcgaaccccatcagcctcacgtcttcgattggacttcaagagcctcaccctcagtccctcaaagcctccctctatggcgacggctccgtgtcaacctcacactcacgtcctccctctcttttaagaccctcaccctcgacctcaagccttctcccttctcttttgatttcaaaccccaacatcagcctcacgtctttgattggacttcaagcctcaccctcagtcactcattgcctccctctgtggcggtggcttcgcgtcagcctcaccctcacggcctcccttcacggctccgcgtcatcttcatcctccccttcacgccaaacacttatctccgagactgtgcgtctttgtgccaacacttatctcatttcccacactgtgtgtgtgatgatggaaaaactagggtagcatgtaatgcttgtggaaaaaaatatgtaatcggtggtaaaacacatggtacttctcagttaaaacgtcatcttaagaagtgtgagaaaagtaaagggcctgatattggtcaaatgatgttagacatgtaa

SEQ ID NO: 23752 - DNA, 390 bp, Glycine max
  Peptide Sequence Number=SeqID_140530
atggcttcctatggtggtgagcttcttcttgactcatattctccttcaagtggcgtctccaatcatcttacttccttctccattccgctgccattaatcttcaagaagaaaaggactccattgatgaagaagatccaaggcctacaagctccacatggagctacatcagaacttgcatatggtttgagggcaaatcttttcgatgaggaagggaatgatgtaggagtatggtgcatccatgggttaatcaaaatgggatcaaggtatgaaagaggatgtcaaggctctagtatcgaaatccaacagacccatagagagttcaaaatgaagaaatcacttaaaatatcatttgacaagaatgtgaaccttcaagaagatgtcctttcataa

SEQ ID NO: 23753 - DNA, 327 bp, Glycine max
  Peptide Sequence Number=SeqID_140531
atggacagagccaggttggtttatggcttggtaacccacatggatatgaacatcgacaccctgatctcaggtcaaatctcttctgttgctcagagtaactcctctaggctcagatttccagccttgatcactaccctctgtagagctagaggaattacctctgatagtctgacttatgagagcctgagcccggccattaacttggcctacattaagaaaaactgttggaatatggattatctgatagttaacttcagaggggcaaggaaagcaagggctcgaccagttgatgttccttcttcttctactccacgtgggatcctctag

SEQ ID NO: 23754 - DNA, 258 bp, Glycine max
  Peptide Sequence Number=SeqID_140532
atggatgagaaattttttgcctcttttgtcccatcgatttctgacattgtaacggaagagagtgccaagttgtataaagatgtggggagtgacaaattggagaattctcaatgcaatcaaatggaacctattgtttttcccaccaagcagttgcagctcaaaaggaagcttgatgtgcctgctgaagataaaatcaacaaaggatctgagaatcaaaagaaaaaggctcgtgtttcaaaagatgcaaatgctaattag

SEQ ID NO: 23755 - DNA, 234 bp, Glycine max
  Peptide Sequence Number=SeqID_140533
atgtcagaggatgataacacttctaaatctgctctcaactcaaatgggaaaacaagagcaagtaggggatcagcaacagatccccaaagtctgtatgcaaggaaaagaagagagagaataaacgagagactaagaatcctacagaatcttgtcccaaatggaaccaaggttgacataagcacaatgcttgaagaggcagtcaattacgtgaaatttttgcagctccagatcaag

SEQ ID NO: 23756 - DNA, 210 bp, Glycine max
  Peptide Sequence Number=SeqID_140534
atggaacacttacttgttggtgatgaacaaaagcgcaaaacgaaatcaaaaaatgcgaaaaaggatgaccctagggctgcaaactcgtcaatcccgtgggggtggctcgcccaggcgagcccagctcgcccaggcgagctaacctgcacacattttttttttggagctgaggagaacattaaccatgtcccctcccttctcatggattag

SEQ ID NO: 23757 - DNA, 714 bp, Glycine max
  Peptide Sequence Number=SeqID_140535
ggtggacccttgggtactagtaccctcacttttagaggactacacgtcctcgccatcagagggctacacgccctttcctttagaggactacacgtcctctccttcagagggctacacttcctcgccttcagaggactgcatatcctcactttcagaggactacacgttctaaccttcagaggactgcatgccctcgccttcagaggactagacgtcctcgccgtcaaggactacacgtcctcgccttcagagggctacatgccctcaccttcagaggactacacgtcctcacctttagaggactgcactactcatcttcaaagggttgcttgccctcgccttcagaggactacacggctacacgccctcgcctttagaggactacatgtcctcgccttcaaagggttgcacgccctcgccatcagagggttgcacggcctcaccttcagaggactgcacgtcctcacctttagagggctgcacaccctcgccttcagaaggctgcatgccctcgccttcaaagggcgacacgtcctgaacttcagagggctgcacgccctcgccttcagagggttgcacaccctcgccttcaaagggcgacacgtcctaaacttcagagggctgcacgccctcgcctttagagggctacgcatcctcactttcattgggctccatatccacaccttaagagaatttaaggtcctttgcccttaa

SEQ ID NO: 23758 - DNA, 312 bp, Glycine max
  Peptide Sequence Number=SeqID_140536
atgaaagcacttggtggtcttgaagctcacctaggcgagctaatgcttcactttgaagtaaccttgctcgcccaggggagctgcttacttcacccttgggctaagctcgcatccactgctaaggacagcttcaacacacttagcacgaaggagaatctggcaaagcatctgcatcaaggccatgcgctaagtgctagatcagtgtcttcagccagcctacgcgtaagactagcgctaagtccaaacccacttactcgagctaagcgcgagggtggagctaagcgcaacgttgcgatttcagagcctatttaa

SEQ ID NO: 23759 - DNA, 314 bp, Glycine max
  Peptide Sequence Number=SeqID_140537
aagttgtggtctcgctaagccgagaccatgcacttagcgagtatcatctgctaagagaggcatcagctcgcttagtgagtaagaggaatcttgaagggaatctgccacgccagcatgcactaagtgcgtcatcagctcgcccaacgagaagtttgtctcttttggcacttagcgcacctggctcgctgagccaaaatccacttactcgtgctaagcgcgaaaatggtgttaagcgcaccttcgaggtcaaaaagccctttttaagcctgaaatggaaaatcagaagagagctttgggagaattcagagtcttag

SEQ ID NO: 23760 - DNA, 799 bp, Glycine max
  Peptide Sequence Number=SeqID_140538
atggtggttcaagccaaggtaggagggcagactaaatttgagcttgcgaaaacaagtttcgaagtgaaaagggagaatgaagtgggtgatggtggtgtttggcatgggttggtgcactacaagggtggtgggtcacaatgtgactatggggtggctcaatggtgttgtttggtggatggaggttgtaaatataagcagcttgttgatgacggctcggaggacggtggttgtgatttttatattgtggtggttatggagtctgtggaagaagattcgaattcctgcagcccgggggatcctcttagttctagagcggccgccaccgcggtggagctccaatttcgccctatagtgagtcgtattacaattcactgggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgagctaaggaagctaaatggagaaaaaaatcactggatataccaccgttgatatatcccaatggcatcgtaaagaacattttgaggcatttcagtcagttgctcaatgtacctataccagaccgttcagctggatattacggcctttttaaagacc

SEQ ID NO: 23761 - DNA, 198 bp, Glycine max
  Peptide Sequence Number=SeqID_140539
atgttgttacaccaccgtaacaacccctacaaacaaggacctgaagctcctactccactctacaagtaccaggttccatatcatccttttgatatctcattctcacctaactcgtgttccccctcttgtcctcttaataaagggtactttcagtccaacgtgcaagatcgtgaagaccaccttatgatggaaccctaa

SEQ ID NO: 23762 - DNA, 732 bp, Glycine max
  Peptide Sequence Number=SeqID_140540
atggcttcggatcacaccatgagctttcattcttcttccttacacgaagaggacttcgatgatgatgatgatgatcacctacacccccacccccacaacttgtcgaggctctccgtctgcactagcagcacctttggcgacaacgaccatgttgacaatctcgcctccatgtgcgtctcacacttgtccattgaaagctttgacgcagatggtgtgttatcctccgactctgaaaacgaattggggagtttttactctctgccctctactcccccacgaaggaggaaacaggttaaggactatgcaagtgacaatgggaatgaaacaaagaagagtgatccacgaagaaggagaagaccatcaatgatggggtttgagggagtggagaagaagagtaagaggaaagaggaggggtttagtggggagagtgatcaaagtggtctcatgctcataactagacccaaaggtggaattaggtctctttgcatggacttggaggaagttaaggcttgtagagatcttggctttgaattggaacacgaacgtatgcttgagatcccctctcttctctctttctccaattccacacttgacactagcagtggtagcaactcccccatcaccaattggcgtatctcttctccaggtgatgatccaagagacgtgaaggcacggctcaaagtgtgggcgcaggcggtggcactagcatctgcctcaaaatacggcacatga

SEQ ID NO: 23763 - DNA, 192 bp, Glycine max
  Peptide Sequence Number=SeqID_140541
atggcagacgaggttgttctgttggatacatgggctagcatgtttggaatgagggttaggattgcattagctgaaaagggtgtcaaggaagagattcttaggaacaagatgcaatacattgatgaggtctggaatgacgacaaagctccaatcttaccctctgacccttaccagagactcaatgctaattaa

SEQ ID NO: 23764 - DNA, 1467 bp, Glycine max
  Peptide Sequence Number=SeqID_140542
atggggattagtttcaagcagtttctctccactgagttgtttaagattggtggaagagcaccggtttctggtgaggcgcgttcaacgaattcgagttcgttgaatggaccgcagaagccgcggctctctaatacttataatgtgttgattgatttgtatggtaaggcggggaggttgagcgaggcagcggaggttttcgcggagatgttgaaggccggcgtggcggtggatgtgtggacttttaataccatgatttttgtttgtgggagtcaaggtgatttggcagaggcggaggctttgcttgggatgatggaggagaaaggcgtggcaccggataccaagacttttaacatttttctgtctttgtatgctgaagccagggatattggtgctgcggttttgtgttacaagaggattagggaggctgggttgtgtccggatgaggtgacttaccgggctctgcttggcgtgttgtgcaggaagaatatggttcgagaggtggaggatttgattgatgaaatggagagggcttttgtgtctgttgatgagcattgtgttcctggtattgtggagatgtatgttggtgagggggatgttgataaagcatttgacttgctgaagaagtttcaagtgaatggggagatgtcatcgaatattcgttctgcgattatggatgtttttgctgagaaaggactctgggaggaagcagaggatgtgttttacaggggaaggaacttggcagggcggaaaagggatgttctagagtgcaatgtcatgatcaaagcttatggcaaagcaaaactttatgacaaggctatttctctctttaaggggatgaaaaatcacgggacttggccaaacgaaagcacgtataattcccttgttcaaatgttatctggtgctgatttagtggaccaagcaatggacctcgtggatgaaatgcaggaagtggggtttaagccaccttgtcaaactttttctgctgttattggatgttatgctcgccttggtcagctttctgatgcagtcagtgtgttcaaggaaatggtaagaactggagtaaaaccaaatgaggtagtgtatggatctttaataaatggatttgccgaacatggtagtctcgaagaggcacttaaatacttccacatgatggaagaatctggattatcctcaaatttagttgttttaacatccctactaaagtcttattgtaaggttggaaacttggaaggagcaaaagccatctatgagcggatgaagaacatggaaggggatcttggcttggtatctgaagccaagttggcttttgaaaatttgagagaaatgggccgggctgatgcaatttcatatgcaactatcatgtatctttacaagggtgtcggcctgattgacgaggccattgagattgcagaggagatgaaactgtcaggtactggtgtgttatgctgccaacgggcaattctatga

SEQ ID NO: 23765 - DNA, 138 bp, Glycine max
  Peptide Sequence Number=SeqID_140543
atgtattttgcgtggtggcgcggtggtgggtcgaggttgtgccgctgtgggaaagagtcgtatgacttgcgcgcgtgtgtgactgcgtggtggagaaagatcgtgaggagaaaaagtattcttagcctactacaatga

SEQ ID NO: 23766 - DNA, 618 bp, Glycine max
  Peptide Sequence Number=SeqID_140544
atgttccggccagaaccgacaaactggctgagtaagaagaaaaaggtgctattattcacgtccaacggcctgtcgaccgtcgtgaatggaggaagtcagatgagagactatatgaagaatatcttggctgtcggtctttctgcgatcgtggtagcaggagcgattgttccggcagaagcagcgatgccactaccaatggcgccgaagagtgtcgagacggtgggcaacgacgccagcaagaatatcgtgaatgtgcagtactggcgcgaccgtcgcgactgggatggcggacgtcgaggctggtatggcggccatcgcggctatcgtgattaccgcccgggttatcgtcatcatgacggttactggttcccgctcgcagcctttgcgacgggtgcgatcatcggcggcgcgctgtcgcagccgcgtgaagtctaccgtccggttcccgaatatcgtccgcgtccggtttatcgcgaatatcgtccggtccgccgtggcggtatgagccaggcgcatgtgaactggtgctatggccgctatcgttcctacgatgcctatagcaacacgttccagccttaccatggcccgcgtcagccctgctattcgccttacagctga

SEQ ID NO: 23767 - DNA, 1167 bp, Glycine max
  Peptide Sequence Number=SeqID_140545
atgaaggcacaattgcacgcttattacctacctaacctttctcttccaccagcaggtgtttctcttgcaagtaacgttggacttattccttctgatgaatcccttgacctccgcctcttcctagggtccttcaccaacaacttctcaatcaaatccctcgcctcggccatccctgcctcctctcgctccgccacgtggacgaacctcacatccttgcttgatgctatattgcgcagcgtgccctccttgctacaccccttaaacggcgtcgtcccctcgggagctaaatactcgtgcgtcccaacgcacgaccgtgaaaacgccgtcaccggtgtgggaccggaagttgacgtttggtgccacgtccgatttgaagcacaaatcgaaatccgagagcatgacgtggccgtcgtcgcgcaggaggacgttctcgggtttgaggtcgcggtagacgatgccgagcgcgtggaggtactccagggcgacgaggacctcggcggcgaagaaacgcgccgccgcgagggggagacgaaactggggctgtttgcggaggagggagtggaggtcgccgccggggcagaagatctccgcttcggtctgcgcgtgggagagtttcttcggggtgaggaggtctttgtcgacgaccttgagggcgaagtgggcgccgtcgtagtcacggaggcggcagaggaagacgcggccgaggttgccggagccgaggtggcggaggagcttaaggtggcggaggtggaggcggccgtcggaggagaggttgacggcggcctgaatggcggaccagttgggatcgccgctccggtggggacggcggctgataagggaggcggtggtggtttccgaggcggagaatgtggacaaacggtcgttgaagctgagggtgaggctgctagtgcgggcgaggcttgttcttgcactggtggtggtggtggtggtggtgcggtcagtggtggtgctggtgaagctgagatcgaggtcggtgtcggggaacaacaacgttggctcctccatggttgtgtcttgatgggaagacagagaaggtggggcccaaggttcaagaaagttgacccaactggagcatcggggacatggacagatacagagaagtcggttcacattgtaaggataacacagttaaagcttcaggtttaa

SEQ ID NO: 23768 - DNA, 168 bp, Glycine max
  Peptide Sequence Number=SeqID_140546
atgctgcttcttcaaccccaattgcttctcaagcacgttgcttccaatgtttcaattgcttcccaagctagcgatgtgggtgctcttagaagactccaaattacttataaaaatatgacttccgaagctgcttctataagttcagactctaacttatgtaggttctaa

SEQ ID NO: 23769 - DNA, 525 bp, Glycine max
  Peptide Sequence Number=SeqID_140547
atggatgaagtagttcttgtggggttctggaccagcccttatgtgatgagagtgaagattgcattgttagagaagggagttgaatatgtgagtccctcatcattcttgagtacattgatgaggtttggaagaagcaagaaaaacagctcttctctgatgatccttactaccgagccagagccagctgattgtggcaggagactgtgggctagcaagggagaagaccaagaggctgcaaagaaagagtttgtggagtgcttgaaactcttggaaaatgaacttggagacaagccttattttgctggtgattattttggccttttggatatagccttgttaccaattacgtgcaggttttacacatacgagacattttgcaaatttagtgtggagaaagaatgcccaaggttcatggcatgggtcaaaaggtgtaatcagagggagagtgtttccaagacacttcctgacccatataaagtctatgacttcgcgttggagacgaaaaaaaggttcaatattgagtga

SEQ ID NO: 23770 - DNA, 1542 bp, Glycine max
  Peptide Sequence Number=SeqID_140548
atggaggagccaacgttgttgttccccgacaccgacctcgatctcagcttcaccagcaccaccactgaccgcaccaccaccaccaccaccaccagtgcaagaacaagcctcgcccgcactagcagcctcaccctcagcttcaacgaccgtttgtccacattctccgcctcggaaaccaccaccgcctcccttatcagccgccgtccccaccggagcggcgatcccaactggtccgccattcaggccgccgtcaacctctcctccgacggccgcctccacctccgccaccttaagctcctccgccacctcggctccggcaacctcggccgcgtcttcctctgccgcctccgtgactacgacggcgcccacttcgccctcaaggtcgtcgacaaagacctcctcaccccgaagaaactctcccacgcgcagaccgaagcggagatcctacacgcgctggaccaccccttcctccccactctctacgcgcgtatcgacgtttcgcattacacgtgccttctcatggacttctgccccggcggcgacctccactccctcctccgcaaacagccccagtttcgtctccccctcgcggcggcgcgtttcttcgccgccgaggtcctcgtcgccctggagtacctccacgcgctcggcatcgtctaccgcgacctcaaacccgagaacgtcctcctgcgcgacgacggccacgtcatgctctcggatttcgatttgtgcttcaaatcggacgtggcaccaaacgtcaacttccggtcccacacctcaccacctcgcgtgggccccacgagcggttgcttcagttgtaataataataaccgccaccgagaaaagttggttgcagagttcgtggcggaaccggtgacggcgttttcacggtcgtgcgttgggacgcacgagtatttagctcccgagcttgtctcggttaacggtcacggtaacggcgtggactggtgggcttttggggttttcgtttacgagttgttgtacgggacgacgccgtttaaggggtgtagcaaggagggcacgctgcgcaatatagcatcaagcaaggatgtgaggttcgtccacgtggcggagcgagaggaggcagggatggccgaggcgagggatttgattgagaagttgttggtgaaggaccctaggaagaggctagggtgcgctaagggtgctactgagattaaactacacccttttttttatggaattaagtggcctttgattaggacttataggccaccggaggtcaagggattcatcagaaggaataagtccaacgttacttgcaagagaaacacctgctggtggaagagactagggcttcttgtgaggaacaaaggggcatttgccattgaagggcaaatgatggagaaaagtaagtggtttttatcactgagagacttgacgatcgaggaaaatgaagactatgagaatagaaacacatcaagctaccggaggaagcagaggcaagcgaaaaatggtgagctaactgtaatgccaaatggagtaactctccaaagttgcttataa

SEQ ID NO: 23771 - DNA, 3345 bp, Glycine max
  Peptide Sequence Number=SeqID_140549
atggcaatattggagtgtagtaatagtttccacttcctaaatggggtttacatggtgctgttgttttgtcttggtattatggtccttgtgaattcggttaatgaagagggtttgagtctgttgagattcaaagcttcccttcttgacccaaacaacaatctctataactgggattcttcttctgatttgactccttgcaattggactggtgtgtactgcacaggttcagtggtaacttctgtgaaactttaccaactcaatctgtctggtgctttggctccttccatctgtaatcttccaaagcttcttgagttgaatttgtcaaaaaatttcatctctggccccattcctgatggttttgttgactgttgtggtttggaggttttggacctttgcacaaataggcttcatggaccccttctgacccctatttggaaaatcacaacacttagaaagctttacttgtgtgaaaactacatgtttggtgaagtgccagaggagcttgggaatttggtatcacttgaggagttggtcatttatagcaataacttaactggaagaattccatcatcaataggaaagttgaagcagcttagagttataagggcaggtttgaatgcactctcagggccaatacctgctgaaatcagtgagtgtgagagcttggagatattggggttggcacagaatcagctagaaggttcaattccaagggagctacaaaagcttcagaacctcaccaatatagttctgtggcaaaacactttctctggggagattcctccagagattggaaacattagtagcttggaactgcttgctttgcaccaaaattcactgattggtggtgtccctaaggaaattgggaagctgtcccagcttaagaggttgtacgtgtacaccaacatgttgaatggaacaattccaccagagctagggaactgcacaaaagctattgagatagacctttctgagaaccatttgattgggaccattcccaaggagttgggaatgatctctaatcttagcttgcttcatctgtttgagaacaatctgcagggtcatattccaagggagcttggtcagttgagggtgctaagaaatttagacctgtcactgaataacttgacaggtacaattccccttgagtttcaaaaccttacatacatggaggatttacagctgtttgacaatcaacttgagggtgtgattcctcctcatcttggagttattagaaaccttactattcttgatatatctgcaaacaaccttgttggtatgatacccatcaatctttgtggatatcagaagctgcaattccttagccttggttcaaataggttgtttggaaacattccttatagcctcaaaacatgcaaatctcttgtgcagcttatgctaggggacaaccttttgacaggaagcctacctgtggaattgtatgagcttcacaatctcactgcacttgaactctatcagaaccagttttcggggataataaacccgggtataggccaacttaggaatctagagaggcttcggttgtcggctaactactttgaaggctatctccctcctgagattggaaatttgccacaactggtcacattcaatgtttcctctaaccgtttcagtggaagcattcctcatgagttgggaaactgtgttagactgcagaggcttgatcttagcaggaaccacttcactggcatgcttccaaatgaaattggcaacttggtgaacttggagctgttgaaagtttctgataacatgctctcaggagaaataccaggcactttggggaatcttattaggctcacagacctggaactaggtggcaaccagttttcaggaagcatctcttttcacttgggaagactgggagctcttcagattgcacttaacctgagccataacaaactttctggcttaattcctgatagccttgggaacttgcaaatgctagagtccctttatctaaatgacaatgaacttgttggtgaaattccttcatcaattggtaaccttctcagtcttgtaatatgcaatgtatctaacaacaagctggtaggaactgttccagacaccactacatttagaaagatggatttcacaaactttgctgggaacaacggcttgtgccgtgttggtaccaatcattgccatcaatctctatctccctctcatgctgcaaaacatagctggatcagaaatggttcatcaagggaaattatagtgagtattgtttctggggtggttggactagtttctctaattttcatagtgtgtatatgtttcgccatgaggcggcgtagccgtgctgcttttgtttcacttgaagggcaaacaaagactcatgtcttagataactactactttcctaaagaaggctttacataccaggatctcttggaagccacaggaaatttttcagaagctgcagttctaggaagaggagcttgtggcactgtttacaaggctgctatgagtgatggtgaagttattgctgtcaagaaactgaattcccgtggagaaggagcgaataatgttgacaaaagcttccttgctgagatttcaactcttggaaagatcaggcacaggaacattgtgaagctgtatggattttgctaccatgaggattctaatcttctcttgtatgaatacatggaaaatggaagccttggagaacaacttcattcaagtgcaaccacttgtgcattggattggggtagtcgatataaaattgctctcggagcagcagaaggcttatgctatcttcattatgattgtaagcctcagatcatccatcgcgatataaagtcaaacaacatattgcttgatgaggtgtttcaggctcatgttggagactttggcttggctaagttgattgatttttcctactcaaaatccatgtctgctgtggcaggttcatatggctacattgccccagaatatgcttacaccatgaaggtgactgagaagtgtgacatctatagctttggggtagttttgctggaactaattactgggaggtcacctgttcaacctttggaacaaggtggagatttagtgacttgtgtgagaagagcaattcaagcatcagtaccagcatctgaattatttgacaagagattgaatcttagtgcaccaaagacagttgaagaaatgtctctaattcttaaaatagccctgttctgcaccagcacatctccactaaatagacctacaatgagagaggtcattgcaatgttgattgatgctagggaatatgtcagcaactcaccaacctctcccacatcagaatctccattggatgaggatgatggcatttcttccaaaggttag

SEQ ID NO: 23772 - DNA, 297 bp, Glycine max
  Peptide Sequence Number=SeqID_140550
atgatgaatcttaaacatgatgcacattttcttcgtttaccttcagaaggctctccacctgaagaacgccctttagttgcagtgatattattgttgcttgatctcatgatcaccaccaccacaacaacaatcaccaccaccatgattgtcaccatgaccaccgtcgtcactatcaacatgatctctgtcgttatcgccaccaccaacaccagcaacgatcatagttgtagtggaagtaacattgacaataattatggtgattgcggtggccgttctcacaattgtgatagaaaatag

SEQ ID NO: 23773 - DNA, 549 bp, Glycine max
  Peptide Sequence Number=SeqID_140551
atgaagcttcttcagtttcatgttgaggttgttgaaatactgtacaaagatgaatacgaatgcagttttgttcagggggaaatagctgagggaagccaatttgaatgctttgagatgctatggaagataaaagttccaagcaaaatctcagtctttgcttggcgattacttagaaacaggctgccaacaagaacaaatttacacagaagacagctgcagatcatcgatatgtcttgccctttctgcagatgttcagaggaggatgaagcccatttattcattcactgcagtaaaatccaacctctctggtgggaatccatgtcctggctgaatattcaaggtgctaccccacaaactccaagacagcacttcctccgacatggttcaggtctggacaaggtcataagggtaaataggtggcaatgttggtggttggccctgacatggtccaatgcagtgttcaatggcaacaaagtgtttgaagacgcagtttttcttctctggacctggcttagaaggtttagagaggaattttacaatacattttaa

SEQ ID NO: 23774 - DNA, 2808 bp, Glycine max
  Peptide Sequence Number=SeqID_140552
atgaacgaagatggcgtaacctctgcgaatcccaatccctctcttcccaaaccaccctcttctcctccaactcctgcggccagctctgcgggggcgtcgtcgccggcgtttccggcgaacaccggaaacggggatgctcgccggcggcgcgacatattgagcgctgattcgcacgcggttctcggtccgttgctgcgaggggcttcggttccgtcctgccggccctgggaacgcggcgatttgctccgccggctttcaacgttcaagctcgccggaaaattgcacaaggttgctgggtccttggcctgtgcgaagagaggttgggtgaatgtgggtgttgctaagattgagtgtgagatatgtgctgctcagttagattttactctgccttcagctccctcttttgaagctgatgcctccggtgaagaattttctgaacagcttgatagaggacacaaagccacctgtccttggaaaggcaatagctgtccggaaagcttggtgcagttccctcctacttcaccttcagctctaattggaggttttaaggatcggtgtgatggactcttgcagttttattctctccccattgtatcttcatctgcagttgagcagatacgggttacacatagccctcaaattgatcgcttactttctcaattgcaaatacagacagctggagaattgggctgcagagcagaaaatgcttgtggaatgggcttaactggtgaacaggctcctcatccatattcttatgctcaaaagctcataagtctttgtggatgggagccacggtggcttccgaacgtgcttgactgtgaagaacagtcagctgaatctgctaaaaatggttacagctctggtccagccaaaggctctgcacctgatcctgctccaagcaagaaggagtattcaacttcttccaggaaagatactggggataatgatgtactcggttcagagtttaattgcgagtctaggtcacctttgttggattgtagcttatgtggggccacagttagagtatgggatttcttgactgcctctcgtccagttcacatgactccctgtgggattgatacccctcaaacaagcaagaaaatagcatcaacacgaggaataagtgcagctagtggtatcaatgaatgggctgctgctgatggtgttgaaaacgagaggactggagatcgtgatgaggctacaacacctgataaaaggcaacttgtatccaataaaagtttagatttaagtcttaaaattgttagtgggccatcctgttctccaataatcttgacttcaacctcaggtcatgtgcaaggtgctggtgaagggaaagatttaatgattgggcgaccttctggaagcgaggcaacttcttatgaatcacaaggccccaatgtatgtaaacgcaagttggatgatggtggaacaacatctgaaaggccacatctaaacatgcaacaagcagacagtactgaaagaactgtaactgaccgtgataataatgaagtcattggtagtcaacagtattcagctggccctttcaagcgtgccccagatgcaaacaccactaaccagttaaaccaagaaagggatcatgctattggcatcatgtctactagagattctgcccatgcatcttcaattattgcaatgaatacggtttatcatggttcagatgatgaatcaatggaaagtgttgaaaattttcctgttgatgttaatgaattcaatttcccttctgttgatttgaatgaaacatctgagttaaatcaagcacaacagagtgtttgtttccaaccacttttagaaagggcaggaggggagactggtgttagcagttcaaatgcttgtggggaagttttgaacacagagatattgactgcacatgctagagatggacctagttttggtattagtgggggaagtgtgggcatgggtgctagtcatgaggctgaaatccatgggactgatgtctcagttcacagaggtgatagtttaggtgatgttgaaccaattgctgaagtgattgaaaatcagggccaagctggtgaatttgagccttctcatggacttactggggattttgtgcctgaggaaattagtcgggaagatcctcaaggggatagtcaagctgtggtgtctcaatctacagcaagggctgctgatagtggctcaaaagttatagcttcaatgaaggttgaatctgttgaaagtggtgagaagaccagtagtagcatgcaagtgctaggcggccttgaaaatggtgcccatccttccctttcttgtaatgctgttgtctgttctgcttatgaagtatccaaggaagaagttaatcaggctaggaaggcatctcacattgatgatggtgcatctcacgaatcaagccgtttaattactgatgctatggggactccttacagagacaacagtaatggaggtgttgaatttgatccaatcaaattacataatgactactgtccttgggtgaatggggatgttgctgctgctggttgtgataatccctgctccagctctggtgtgggtagtgtagctctttgtggctggcagctgactttagatgcccttgattctttccagtctcttggacatcttcctgtgcaaactcttgaatctgaatcagcagcatccatgtgcaagggcgaagcggagcggccccctgctgcaactgaggtacttgacgcagagtgcctggttgtcatggttgctgtggagatgctggatgatgagagagagactggcattttttattgggcaaaaaggggtgacagcagtggaagaaactag

SEQ ID NO: 23775 - DNA, 3141 bp, Glycine max
  Peptide Sequence Number=SeqID_140553
atggaggataataatcaatggtgtctctatgaccatgacccacttcttctcacagacgtttctttgcagcaagaatcctcttcttatactcacagccccaattctctttcacaagcatcactgagctctcggagtttggctatggcggatgagcctgtgtctcgtggtgacagccccagcatcgggttttctcaggaaaatggaagatttgaagggaacagcgtgaaattcgatgacccaaatgtgaaaaatgtgtttgatggaagatcaattttggggtattctcttacatccccagatttggtcatttgtggctcaccagatattgctggaatcagctatggtgattcccctgagttgtcgaagaacaaacattccaaggatgtggagcaatctatggagctttctctagagaatggaatcaaggggtctcaagtagaagttgacaatggccataagatcccaactgttaaattctccaacttctgtcaaacttttgagcaagaggaaaagccactgtcccctgaagcctcctttgagcttcttccacctcttgtaaccaggaatgagtcaccccaagatcaccctcctagagatactgagatgcttgaagatattggagtgtctcaggaggcagaaatggagtcttcagaagataccgaggatattgggatggaagagaagtttaagagactgaaaagagagtttgactgtcagagaaaggagctgacggaaacaaggagggagttgggggagatcaagagagagaatcaacagaagagtagagaatgccaagaagcttggaactccttgaaagaacttcaaaatgagctaatgcgcaagtccatgcacgttggatctttggcatttgccattgaggggcaagtgaaggagaaaagtaagtggttttcatcactgagagacttgacgaggaaattgaagatcatgaaaatggaacacatcaagctattagaggaagcagaggcaagcaaaaaatatcaagcagatatgagagaaatgggacttattatcaagtccaaaataaatgaacagctggagtcacatgaagatctcaagtccaaatatattgaaggggctaaggaacggaaagatctttacaacaaggttttggagttgacaggaaacataagggtcttttgccgttgtaggcctctcaatgccgaagagatatctgcaggagcaacaatggccttagattttgaatttgcgaaagatggtgatttaactgtaatgtcaaatggagctcctaaaaggaatttcaagttcgatgctgtctttggtccccaagctgagcaagctgatatttttgaagacacagcaccatttgcaacctcagttctagatggatacaatgtatgcatttttgcatatggacagactgggacaggaaaaactttcacaatggagggcacagaagaggctcgaggtgttaatttcaggactcttgagaaaatgtttgacataatcaaggagagacaaaagctctattgttatgatatctctgtaagtgtcttagaagtgtacaatgaacaaataagagatttgctggttgcgggaaatcatcctggaacagctgcaaaaagacttgaaataaggcaagctggtgaaggaatgcatcacattccagggttagttgaagcacatgtgaacaatatgactgaagtctgggaagtcctacaaactggtagcaatgcaagggcagtaagctcaaccaatgccaatgagcatagcagccgatctcactgcattcactgtgttatggttaagggagagaatttgttgaatggggaatgcacaagaagcaagttatggctggtggacctagcaggcagcgagcgagtggcaaagacagaagtgcatggtgatagactgaaggagacacaaaatattaataggtctctctctgcacttggtgatgtcatatcagctcttgcaacaaaaagttcacacattcctttcaggaactccaagcttacacacttgctgcaagactcattaggaggagattcaaaggcactcatgtttgtacagatcagtcctaatgaaaacgatttgagtgagacaatttgctctctgaactttgctagtagagtaagaggaatagaattgggacctgcaagaaagcagttggacactgttgaacttttgagacacaaacaaatggctgagaaagtcaaacaagaggtaaggctgaaggatttgcaaatcaagaagatggaggaaacaatccatggattggagtccaagatgaaggaaagcgacaataagaacaaaaatctccaagagaaggtcaaggaactggaatcacaacttctggttgagagaaagctggcgcgtcaacatgtagactcaaagatagctgagcagcaccaaatgaaacatcaagaagagcaaaacaatacacttatgagaccagcacttgcaagtagaccactaggaagtctcaagaatttcaatgatccagtgagtggtggtggatggtgcaaagaccaacaaataaattcagctaaaccactcgctgagaacaacatcttgaaaccttgtatacccttttctacaatggagagctccatcaagtgcattgatcatgctgagaaagaaaacaatcctgacatggctgacaaggctctattgccaaaaaggcctggaagagcttctactatatgcatgatgacaccgcgtgttccttcagccattgcctcaaggagaaactctctgattccactcccaagtatacctagcttaacacagttccagtcaccattattaccaaagttaacaaaccaagctgatcagaaggatgtcaatggggaattagaaaccaactgtgtgcctgcacagactcattgtgagagtcccaaagaagttagaattggtgttaagaggattggtagcatactaagaagaagccttcataagaaaatacagatgaagtctcctcttcagcagcacatgaggaaggttggtgtgaatgtagggatggagaaagttagagtttccattggaagtagggggagattggcaccaaggggccaagtaggaagtggtagaagaggaggaggagctaaagatattcaacaaaagaatagtcaaaaggagaaggaaaggggatggatttga

SEQ ID NO: 23776 - DNA, 303 bp, Glycine max
  Peptide Sequence Number=SeqID_140554
atgggttcaaatcctagaaatagcctttctgcatgtgtggaggagtctgtaaagaaaaagtatggaggaatgctgcccaaaaagccaccactcatatctaaggaccatgaacgtgcttacttcgattctgcggattgggcacttggaaagcaaggcggagagaagcctaagggaccacttgaggctcttcggcctaaattacagccaacgcagcagcaaacacgttaccggaaatctccttatgctccttcaggagaagaagggggaagtgttccagccgaggatgcaccttccaaccagtaa

SEQ ID NO: 23777 - DNA, 2973 bp, Glycine max
  Peptide Sequence Number=SeqID_140555
atgacttcttttgcttctccagtgagtttggggaacctcatgggtgtgagttcctctggaaggtctcattctgtggtgaggagagtctctctttcaagagggaactgcagggggagaaagagatggcattgtgtgtcattgtctgtgtgtagatattcagttaccacaactgattttgttgctgaccaagggaattcagtgtcccttgattctaacagtagtaggagtaagggtggtgatgatggtgctggttttgtgcttaagcctcctcctaagcctgtgttgaagtccccagagaataagagtgaccccattttggggccctcaaggactactggggatgtggaagagaggaataaggtgattgaatcactcggggaggtgttggagaaggcagaaaagcttgggagttcgaaggtgaatggggacaggaataatggttcagtgaataaaccggtaaggagtaatgcaaatgctagtcctaaggctgataaaccggtgaattcagcagcacctcagaagtctaaaacgttgaagagtgtatggcgtaaaggggacacggttgcatcggttcagaaggttgtgaaggaagtaccaaagcctattaatgacaagaatgaaggagagaggactcaaacaaggggaggggagaaggtggtatctcaaactcatgctcctcaaccgtctttgaaacctcaaccaccttcgcaacctcaaccgatgttgctatcaaaaccttcaatagctcccccacctgccaaaaaacctgttgtcttgaaggacaggggagcagccgagacaacatctgttaaatctaaagaaaagaagtcgcccatcttgattgataagtttgcttccaagaaaccggtagtagatcctctaattgcacaagcagttctagcccctccaaaaccagggaaggcacctcccccgggaaagtttaaagatgatttccggaagaaaggtgctatggctgggggaccaagaagacggattttagaggatgatgcaattcatgacgaggacgcatctgaactcaatgtctctattcctggtgctgcaacagctagaaaaggaaggaaatggagtaaagcaagccgaagggcagcacgactccaggctgccagggatgcagctcccatcaaagtagaaattctagaggttggagacaaaggtatgctggtggaggaattagcctactgtttggcaaccagtgaaggtgaaatcctgggttatctatactccaagggaattaaaccagatggggtacaaacaatagacaaagatatggtaaagatgatttgtaaagagtacgatgtggaagtcatagatgctgatccattcaaagttgaaggtttagttaagaaaagagaaattcttgacgaagatgacttcgacaaactcaaggataggccccctgttattactattatgggacatgtggatcatggcaagacaactcttttggattatatacggaagagcaaggtagctgcttctgaagctggtgggatcacacagggaattggggcctataaagtggaagtacctgtggatgggaaaaagttgccgtgtgttttccttgacactcctgggcatgaggcatttggagcaatgagagctcgcggagcaagtgttacagacatggctattattgttgtggctgccgatgatgggattcgtcctcaaacaaatgaagctatagctcatgccaaagcagcgggaatagataaagatggagcaaatccagaacgagtcatgcaagagctttcttcaattggtttaatgccagaagactggggtggtgacatcccaatggttccgataagtgctcttaaagggaagaatatagatgatcttttggaaactgttatgcttgttgctgagttgcaagagctgaaagctaatcctgatagaagtgcgaagggaacagtcgttgaggcagggctagataaatcgaagggaccatttgcttcatttattgtgcagaatggcacccttagacggggagatatagtagtttgtggagaagcttctggaaaggtgcgggctttatttgatgatggtggaaagcgggttgatgaagcttcaccttctatgcctgtacaggttattgggttgaataatgttccaattgctggtgatgaatttgaggttgttgaatccctcgatactgcacgtgaaagggcagaggctcgtgctgagtcattgcgtaatgagcgtatttcagcaaaggcaggggatggaaaggtcaccctttcttccttagcttcagccgtttcatcaggaaagctgtctggactagatttgcatcaactaaatattattttgaaggttgatcttcagggatctattgaagctgtcagaaaagcgctggagattctaccacaagacaatgtcacactgaagtttttgttggaggcgacaggtgatgtaaacacaagtgatgtggacctttcagttgcaagcaaggccatcattttgggatttaatgtgaaagcaccaggctctgtgaaaagctatggagagaacaaagctgttgagattagattatacagagtcatttatgaattaattgatgatgtacgaaaagcaatggaagggctactagaacctgttgaggaacaagtaacaattggttcagcagtagtacgagccgtattcagcagtggtagtggtcgtgttgctggatgcatggttacagaggggaaaatactaaatgactgtggtattcgagtcaagcggaaggggaaagtagttcatgttggtattcttgattctttgagacgggtgaaggagattgttaaagaggtaaatgccggtctcgagtgtggacttgggttagaagactttgatgattgggaagagggtgacattcttgaagccttcaacacatttcagaagaagaggacccttgaagaggcctcagcctcaatggcatctgccgtggagggagtaggagttgcattgtag

SEQ ID NO: 23778 - DNA, 225 bp, Glycine max
  Peptide Sequence Number=SeqID_140556
atgctgagacaaatatggtcatttgtccccttttgtcgaagactcaatgtctttcgaccgagaccgttattgtccccttccaatccagagatagacgagttcgatgggggtgtgcctagccttgggcccatctggaatattctagagggaggttacttcaggtggaagctaccaagcttgcctgggcaagctgggcgacaatcacctccctcatttttgctataa

SEQ ID NO: 23779 - DNA, 456 bp, Glycine max
  Peptide Sequence Number=SeqID_140557
atggaaggggattttgggcttttccttgagcttctatgttttcagagatttctaaagagagaaaggaagcttcctagatatggagagctaaatcctctattggttcttccttgtaggttgtcaagtagctttagtgctaacactgagaagaatccgaaggaagaatgtaaagttttaatgacaaagagcagaatggaaattcaagttgatgaagttagagctgaagagaaggtggagggatataaacaacagtcgatagctgagcctgcactggaactagtttccgatcttattgaacttgaggaagttttggaagaggaagatgaccaacaggagagagagacaccaataaaagatagtcaagaaggaataaagatgaaggaagagcatgaaaaagaaaaacaaaaagaaaaagaagaaatagaaaaagaaaataataaaaaaaatgaaaaataa

SEQ ID NO: 23780 - DNA, 849 bp, Glycine max
  Peptide Sequence Number=SeqID_140558
atggctccaatcttttcaacagatatggacgatactctctacccattgagcacaggtctcaatttggcatgtcgcaagaacatagaagagtatatgttgaaacacctgcatatggaagaaagtgaagtaccaaagatttgcgtggatttgtacagggaatatgggacaactatggcaggactaaaggcctttggtcatgagtttgacaatgatgaatttcatgcctacgtgcatggaagattaccatacaagaaactgaagccagatccagtgttaaggaaccttctgttttccatgcctcagctggagagcattccatccaattataaaacttggaaatcgccatcccaggtattcactaatgcagatcaagcacatgcacatcaagttctcaacagattaggcttgaaagaatgttttgacagcatcatatgctttgaaacacttaatcctcctaattacacaaatgtacctactgataatctcgcgctaacatggagtaactcgtttaacaaagattgtaaccaagtagagaaccgatgtttcaactccaagacacaaatcctatgcaaaccctctgtggaagccattgaagttgccattcagattgctaatttagatccaaggaaaacgttgttttttgatgatagtgctagaaacattgcaagtgggaaagctgctggacttaacacagttattgtgggacgatcagatttggttcctggtgctgactatgcactgagtagcattcataatatcaaagaagcattacccgaaatatgggaggttgagggagagctacagcaaatgatccaatccccagcagttgaaaccatggtccttgcatag

SEQ ID NO: 23781 - DNA, 1149 bp, Glycine max
  Peptide Sequence Number=SeqID_140559
atgggtccagcggcaaagacgacgacgatgcgttcgatctctcaagaagcgttcgaagaactggtgaatgagaacatcgacgacctcggcatggaccccaccgaggccctccaagacgcaatccaaaccctcactctccaaggcgtcgatctctcaggcatcgtcacgtgcgtccccggagaaaccaaccccgtcatcgagtgcttggaccgcttaagacaccttgaaaccgaaccggaccaaaacctaatcgcgcaagcgtttaacaccctccacgagttgtgcgcaaatccaaattctgattcaaattcaaatgtggctattgcaaccaaaaacggcgccgttgagctagcttgttcgctctgttccaaaatttctcttgccgccggatctcacgttgttccccttgtctccgcattaaacgcgttgtcgtcgttgcttcacggttgtgactcgtttgattctgaatttctgaaacattattgccgttttgccgctggtgcagatgttcagagcacgggggcttttcatcgctgcgacgggccgaggattgtgatggcttttctggttgataataagggaaatgtggagcttttgagcagtggatttcgagttgtggcttcggcggccaccggagatgagattgtgaaggaggcatttatggagttgaaggttgacgagctgattttggagatcatgtcgttgcataggcacaaggggatccagagtttgtatgacgctgtttgcgcgcttttgatgcccgacgacgatcgagttgtggcttctcaggtgtatggttatgcacggaaatttgcaaagattggaattgcagaagcccttgtggattctctgagtgcaggggttagctcacatgacctgatttcagcatgcatcactttgagggccgttgctgtaaatgatgaaatatgtaaatccattgctgagaaaggtggtattgatgcattactcagatgtatagatgacagtggtgaacaaggcgacaaagctgtggccaaagtttgttgctcattactttcaaagttagcaggaagtgacgcaaacaagagtgcaattgttgggaaaggaggtatggataagctaatcaaactttcagccagatttgctgatgacccttctgttttgcaagag

SEQ ID NO: 23782 - DNA, 906 bp, Glycine max
  Peptide Sequence Number=SeqID_140560
atgaaaaggatactgaagagtctgaatcattatgatgcccttggattgagccgccacaagaagattgatgctgcagttttgaaaaaggaatacaggaaaaagtattgtattacaatgtatgaggaatcacatttggacttaacttatattgtgtttgctagcctacttaaagagtgtttggctatgcttgtgcatcctgataaaaatatgggaagttctttggcaagtgaatcatttaagaagcttcaatgcgcatatgaggttctttctgactctgtgaagaagcgagattatgatgaacaattaagaaaagaagaatccatggctaagagtgtctgccagagatcccatagtagttcacatcaggataatgctgattatcgttctgaagaatccagacgaatacaatgcaccaagtgtggaaattcacatatttgggtatgcaccaacaggagtaaggccaaagcaagatggtgtcaggactgttgtcagtttcatcaagccaaggatggagatggatgggttgaatataaagggtctttggtttttgacaggcctcagaaggtggagattccacgcgcttttgtttgtgctgagagcaaaatttttgatgtgtcagaatgggcgatatgtcagggaatggcttgcaggccaaatacccatcgaccaagtttccatgtaaacatggttggcttggagaaaagccaacgttgcaactcgagtagattcccgtgggattttgatgcagaaatgatggatgaagacgaagaggcgtttgacctgtggcttgagcaggctctggcatctggtctcttctgtgagacctccaaacgcaggaagagttggagtccattcaagttgcatcaaaagaaagggaagaagcaatggcgaagaacatcgtgctga

SEQ ID NO: 23783 - DNA, 517 bp, Glycine max
  Peptide Sequence Number=SeqID_140561
gttccatttgtagtcataggagtgaggtttcaccaagattcttgggaatttgaggaagccttggtgatggaggacatagggttgctcaagcagtgttggcaatggtttcggtcacagaaagatgccggctggcgtgctcggaacgcggtgacatggtgcagagataggacaggtgtgttcattgatcggcattggccgatggtgtgcaggggttgctccagattggggagcttgctgaggctgtcagtgattttctggaaggactctgctctgaggggttttcagtccttcattaggtttggtccagtgatgcttctgcttataatgtggagctgctttcttagtctgacttcgatgtattgtttggtttacgtgcttgttagcatgggtgttgctggagtagctgtccaatacttgggttatactcctgggctttttattgtgggactttttgccatccttattttgtggatgtatgcaaacttctggataaccggaacattactcatagttggag

SEQ ID NO: 23784 - DNA, 240 bp, Glycine max
  Peptide Sequence Number=SeqID_140562
atgggggcggaaaacaccgaaagggacgaacttgaaggtgacccagaaaccgtggaaaccctaaaacaaaagagtatgagccattttgaggagaagatcgaagttgagactctgaagtaccgacagagaatgaggaataaaagggaaagaagaagaagaagaagaagaagacgggggattgcttgtgaaaaagagagtgagtttctaaaacgtttcgtaaagggcggaaggaaggagtga

SEQ ID NO: 23785 - DNA, 477 bp, Glycine max
  Peptide Sequence Number=SeqID_140563
atgtcttgcaagtcacaagtcacaacattgtttatggtatccattcttgaggcacatagcctgaaacaatggtggtcaagtgatgcagaacttgatcaggatacttatagtagcaaactcataagcaagcaacttgccaacacaagaatctgtgtaattgtttctgttcccaatgaccagctacttggcattggtaagtccaatgccactgcagcaaactgggttactgagaatgtcatagctcatgtccctgctaccaacatcactgccatatgtgttggatctgaggattacaagaatgatgtcatgggtaaaaaaatggttgacaaagagattaaggttcctataaatgagcaaaacttgtttgttgtgtctaaggaaaaacataaattatgtgcagctcgtggcctagaacaatggtggccaactgaatcagaacttgtgcactttttccataataagaaaaacatttgctga

SEQ ID NO: 23786 - DNA, 249 bp, Glycine max
  Peptide Sequence Number=SeqID_140564
atggccccttatgttggtttcaaaataagggtcgttagaactggagatctcattgaccataggcctataaagcattgggggttacggggacatcaatccagaatgagaatgagagccagaggcagatttgctgcgatcgtatcaatacacatagctggagataatgagatgctagaagatattggagtgtcacaagaggtagaattggaatcctccgaagtatccctcattgtaaataatgatagatag

SEQ ID NO: 23787 - DNA, 315 bp, Glycine max
  Peptide Sequence Number=SeqID_140565
atggcggcagcggctaagagcgcaacgaagaagaaacccgctccgtccaacagagccgctgtgaaagccacagtgaagaagacagtcgcgcctaggaccaccaactccgacatacagaaggtggttctggtgtcttccgagctcggagacttcctcagtgcttcacaagtctcccgatccgaagccatcaagaaattttgggcctacatcaagctacagaatcttcagagtaatgaaggcaaagactcatttgcaccttacatagcttcattctcatctacaggaccaaatgcaatcactccagacattcttaag

SEQ ID NO: 23788 - DNA, 144 bp, Glycine max
  Peptide Sequence Number=SeqID_140566
atggaaagcgaggctagggttcatggagggtgcgcctatgatctcgaagttgcagagatggagagtgacgttggggatgcagaggcatgcgcaattgaattttttatgcctgttgaaggactattcagaattcctaacaattag

SEQ ID NO: 23789 - DNA, 705 bp, Glycine max
  Peptide Sequence Number=SeqID_140567
atgaatgtaccaaaaggatttttggaggagtggtggtcgctcaactatgattttgactcctttagagcatggctgcaagtccaagacacacatggattagaagccgcacaaggatgtaatgcttctcaagaagctgggtgttccatgaatgttgaagcaatgactcaattgcctaataatttcactcctgttgaaacattcagcatagggggcaactcaattccatcacatgtaatgggtgaattgccattattttccctattatattcacaacaggaattaagtggtcaattgtcacaatttttttcgccattttcccaccaagcaataagtggtgaattatcacaacttttattgccattttcacaaggagaacttctaacgtctacgagagcagacaatgtgactagtgcatgtatagaagttgaaccttctatacagaatacatcaaaacctcaatataccggtttcagtgaggaaacagatccagtgcttgagaacttgataaatacattttggttgtttgaccaagatcaaccaagtctgtttaacgattcaactgcaggagagatcaatagaaatatggagaatttgttggcacatggagaaggaaacaatgataggaatgaacttgtaggttcacaaccaacattgagggatggcgataaaactagtaaagcaagtgatttttctagcaatttttga

SEQ ID NO: 23790 - DNA, 804 bp, Glycine max
  Peptide Sequence Number=SeqID_140568
atgggttgcacatatgaactgcatcatgaacaggtgaaaacatttcttgttggtagtgcatttgttggagaggttccattataccatatgatattggctgctctgctgactgagagtggttccttatccaatacaaggtgtggagaattctacttctacacaaaggtgaggaagttagcattccccatggatatatattcattgactcacttttttgagcttgtgataggtgctttggcaatcacaattgctaatccaactgatctagtcaaagttaggcttcaagctgaaggtcaattgccaactggggtacctaagcgttattctggtgctatagatgcatatttaactatactgagacaagaagggataggggccttgtggacaggtcttggggccaatatagcaaggaatgcaattataaatgctgcggaattggctagctatgataaagtgaaacggacgattttgaaaattccagggttcatggacaatgtctatactcacctactcgctggcttaggtgcaggtctttttgctgtctttattggttctcctgttgatgtggtgaaatccaggatgatgggggattcaacctacaaaagcacatttgaatgctttctcaagactttgcttaatgagggatttttggccttctataaaggtttccttcctaattttagtcgagtaggagcctggaatgtgattatgtttcttacccttgaacaaagattcctaattacatttctagacccacattgggtgaagacagctgtgaatttccccgaaaaattggccttgtaa

SEQ ID NO: 23791 - DNA, 738 bp, Glycine max
  Peptide Sequence Number=SeqID_140569
atgacgagaaaggtctcgaatttctcggatctgatccaaagggtcaccgcctcttgcctcctccaccccctcgccaccgccgccgccgccgtcaaggaagacgacaactcgccttacgagtccgaggacaaccggaacgactcagaggaagaagaaaatgagaatgacgacgagtacgaggatgaagagagattggtggggcccttgaaggctttcaaagtaaaacagatggaggcgctgatggaacaagtgtttgaaacggtgtcgtcgatgaagagagcctacgtgaggcttcaggaggcgcattcgccgtgggacccggagaggatgaggtctgctgacgtggcggtggtgtcggagctccggaagcttgccgtgctcagggagaggttccgacggagcggcggcggcgacgacgacgggaggagaaaggggaggaggagaggtggcggtggtggggttgcgtcggtgagggaggtggtggcgccgtacgaggcggtggtggaggagctgaagaaggaggtgaaggtgaaggatatggaggtgaagaatctgagggagaagcttgatagtgctgttgctctcactactaatggaagtgctcaaaagaagcctgggaggtctctgtctaagaggaaactgggaattcaaggcttttgggaaactcctgcattgcatgatctggggtttcagaagctccttcaagctaaaccagagtcaagtgtatatgagaaatga

SEQ ID NO: 23792 - DNA, 570 bp, Glycine max
  Peptide Sequence Number=SeqID_140570
atggagttctacacaaggccaaataggagtgacatccacctctcagcagaggaagaagccaccatagaggcaaagaccagagactactttgatggggttgcaccacaacgccacacaaagcctcaacgaagtgagtattcagctcaatatgtggatgctttctccaatgcccatcactcttcttcttcttcttctataccagaattcatgcaattccaacgcctcgagaatgatccccaagagaagaaattggagtacaatggaagtcaagtaccggaagaatttgtggaaacagagtattaccaagatctcaacagcgtggacaaacaccaccatacggtatttttgaaacgtgctgatacaaagaaagaggtagaggaaacggggaggataacgggaacaggatttatcaaagtagagaaaaatggaaatgactttcacatagaaccagataatgacactggttgccatcactcttgcaagtgcaatccagcaaccaatgattgggttccttctccttccaacgaggtgggtttcaattcagacaaacctaacaggagtgacaactaa

SEQ ID NO: 23793 - DNA, 300 bp, Glycine max
  Peptide Sequence Number=SeqID_140571
atggaggatgagtcatccgagactagcactccagagcccttggtcaaaaggaagaaggcagatcaaacacaagaagctgcaaccacttctgagaaatctcttgaggccactttcgagccttcagaaccagtgacaaatatagcttcacttcagcaggcagcagacccttccactcctgaggatcagactacacctgtcttgtctccgaaaacctctcctacaactaccgttgtgcttcacttaacagatgaggaggatgttcagacacaggatactcaggaccgatcacaggatttttga

SEQ ID NO: 23794 - DNA, 210 bp, Glycine max
  Peptide Sequence Number=SeqID_140572
atggaccaattaaagcgcctaagcatcccctcagaaatgcttaaattctttaaccatgcttgtcccccacgaatgggccatccgacaaggtcagtgcacttcggcccccacgaacatacacaacatccaacgtatcgaacatgggcaccgtcaagtgcaacgaccatggacaaattaaagcgcctaagcatccccgcagcgaatgcttag

SEQ ID NO: 23795 - DNA, 279 bp, Glycine max
  Peptide Sequence Number=SeqID_140573
atgtgctcatttagtcatttgtatcctacacctcccaaaaagtctcaatggtcaaaaataccctgggccctaacacctcctctctctctctcttccctatgccgcccaagcaccctctcctctggaaatgaacatgtcgttgcccaaggttcaggcatccaattcttgcattgtcatcctcttttaccatctaatatgaacatgttgccgatggtggtgattgggcttgttgagaatagacttaagagagggacaataatgaaggaaaggggttcttaa

SEQ ID NO: 23796 - DNA, 354 bp, Glycine max
  Peptide Sequence Number=SeqID_140574
atgaatcttatggttcaattcgaggtcagattctttctatggaccctttccctcactattaatcgcattttttctctggtggttcaagaagaaaaacaaagagaatttggtgcttctgtttctgctttcaactccacaaatgatgcttcacaatctcatgcctttgctgtcaaggactccaaatatcagtttgatcacaagtttaatgctaattccaagaatagaatcgacccctttgtgcacattgtggtcgacttggccatactcaagataagtgcttcaagttacatggtttttccccaaattacaagaagagtaagccttcttcttctaatactgaaagcaaaacagtga

SEQ ID NO: 23797 - DNA, 279 bp, Glycine max
  Peptide Sequence Number=SeqID_140575
atgcgatatgaaatgtttgaagagcttgaagaagcaaatactgctattggtgtgaaacgtggctttcgttcacgacattactgcgacaacgtctgtttctacgaagaagaaaagtggatcaagggtttggggagaacgggagagtggcctagttgcagatgtggagttggatttatggaattgctgagtggcaattgcttcctgcatcacccagaggacaataatgcccttcctcaacatgtaactctaatgcgcaccttgttactaagcaaaggttga

SEQ ID NO: 23798 - DNA, 999 bp, Glycine max
  Peptide Sequence Number=SeqID_140576
atggcgggaactgaattatttccccccaaatccccccaactgtttccagaaccttccccttatataaacctcaccttccctctcatttcccactcctcatttccattttcaattttaatttcctctcaaaccctaaccctaaccctaaccctccccgtcacaaaagaaaaccctctttgtccgatcatcgtcgtcaagatgttggaactccgtctcgtgcaaggctccctcctgaagaaggttttggaatccgtcaaggagctcgtgaacgacgcgaacttcgactgctcctccaccgggttctccctccaggccatggactccagccacgtcgccctcgtcgctctcctcctccgatccgagggcttcgagcactaccgctgcgaccgcaacatctccatgggcatgaacctcaacaacatggccaagatgcttaagtgtgctggtaatgacgacatcatcaccatcaaggccgacgacggcagcgacactgtcactttcatgttcgaaagccctacacaagacaagatttctgattttgaaatgaagctgatggacattgatagtgaacaccttgggattccggaggcagagtatcatgctattgttaagatgccatcctctgagtttgctaggatctgcaaggatctcagtagtattggtgacactgttgtcatttcggttactaaggagggtgtgaagttttccaccaaaggagatattggaactgccaatatagtttgtaggcagaatacttctgtggacaagcctgaagaagcaactgtcattgagatgaatgagcccgtgtccttgacatttgctttgcgatatatgaactcttttacaaaggcaacgccattgtctaacacagttaccattagtctttcaaatgagttgccagttgttgttgagtacaagattgctgagatgggttatgtgcggttctatttggctcccaagatagaagaggatgaagaagatacgaaacctcaagtttaa

SEQ ID NO: 23799 - DNA, 5972 bp, Glycine max
  Peptide Sequence Number=SeqID_140577
atggcgcacctaggaggaggcgctgaagcgcacgctcgtttcaagcagtacgagtaccgcgcgaattcgagtctggtcctcaccaccgactcgcgaccccgcgacacgcatgagcccaccggcgagcccgagtccctgtgggggaaaatcgatcccaagagcttcggtgaccgcgcttaccgtggacggccgccggagctcgacgaaaagctcgagaaggcgaagaacaagaagaagaagaaagaccgtgatgctgccgctgatgatgccaccgctgtcccctctaagcggcgtcgagtccagcacgatagcgtgctctccacctccgatgacggcgtgtaccagccgaagacaaaagagacccgcgccgcctatgaggcgatgctcagcgtcatccagaaccagctcggcggccagcccctcagcattgtcagcgctgccgccgatgagatcctcgccgtgctaaaaaatgacacggttaagaaccctgataagaagaaagacattgagaagcttttgaatcctatacctggccatgtttttgaccagcttgtgtccattgggaaattaattactgattttcaggaggttgtggatgttcccaatgggagttccgcgatggatggtgaggaggggcttgatgatgatgttggtgttgctgttgagtttgaggagaatgaggatgatgatgaggagagtgatttggatattgtgcaggatgaggaggaagatgatgaggatgtcgcggagccaaatggttccggggctatgcagatgggtggaattgatgatgaggatatggaggagggtaatgaagggatgggtttgaatgtgcaggatattgatgcttactggcttcagaggaaaatctctcaggcttttgagcagcagattgatccgcagcactgccagaagcttgcggaggaggtgctcaagattctggctgagggggatgatagggaggtggagaacaagcttttgtttcaccttgagtttgataaattcagcctcattaagtttttgttgcggaataggttgaagattgtgtggtgcacgcggttggcgagggcgcaggaccaggaggagagggagaagattgaggaggagatgaaggggacggagttgcagccaattttggagcagttgcacgcaacaagggcttctgcaaaggagaggcagaagaatttggagaagagtattagggaagaggctaggaggttgaaggatgatactggtggagatggagataaggaaagtagggataggagcaggaggggggttgctgatagagatggggagagtggatggttgaagggtcagcgccagatgcttgatcttgatagcattgctttcactcaaggtggttttttcatggctaaaaagaagtgtgacctgcctgatgggtcttataggcatctcagcaagggttatgaagagattcatgtgcctgccttgaaggctaaaccgcttgatcctaatgagaagctcgtgaagatatcttctatgcctgattgggcacagccagctttcaaaggaatgactcagttaaatagggtgcagagcaaggtttatgagactgcccttttcaagcctgataatcttctgctctgtgctccaactggggctggaaaaactaatgttgcagtgctgacgatacttcaacaaattgcacggcacaggaatcctgaagatggttcgattgaccatagtgcttataaaattgtttatgttgcacctatgaaagctcttgtggctgaggttgttgggaacttgtccaatagattgcaggaatatgatgttaaagttagggagctcagtggagatcagtcactaacccggcaacagatagaagaaactcagattattgtgacaactcctgagaagtgggatattatcactcgaaagtcgggtgatcgcacttatacacagcttgtaaagcttcttatcattgatgagattcatctacttcatgataacagaggacctgttctggaaagtattgttgctagaacggtaaggcagattgaaaccacaaaggactatattcggttggttggattgtctgctactctccctaattatgaagatgttgcattgtttttgcgtgttgatctgaagaaggggttgttttattttgataatagttatagacctgttcctctttctcaacagtatgttggaatcacagtgaagaagccacttcagaggttccagttgatgaatgatatctgttatgagaaagttatggccgtggctggaaaacatcaggttcttatctttgtacattcaaggaaagaaactgccaaaactgctagagccatcagagatgctgcacttgcaaatgacactcttggtagatttcttaaagaagacagtgcaagtcgtgagattcttcatactcatactgatcttgtcaagagcaatgatcttaaagatcttctgccatatggttttgctattcatcatgctggtatgaccaggacagatcgccagcttgttgaggatctctttgctgatggacatgtgcaagtgttggtttctactgcgacccttgcttggggtgtgaatctacctgctcatacagttataattaaagggacacagatttataatcccgaaaagggggcctggactgaattaagtcctcttgatgtgatgcagatgcttggtcgtgctggaaggccccaatatgactcatatggtgagggaataattgttactggccatagtgagttgcagtattacctctctcttatgaaccaacaacttcctattgaaagtcagtttgtgtccaagctggctgatcagctgaatgcagaaattgttcttggtactgtacaaaacgctagggaggcctgtaattggattggatacacctacttgtatgtccgtatgttgaggaatccttcattatatggtatagcacctgatgtcctaacaagagatataacattggaagagagaagggctgatttaattcatacggctgcaaccatcttggatagaaataatttggtgaagtatgataggaagagtggatattttcaggtcactgacttgggtcgtattgccagctactactacataacacacggatccatatccacatataacgagcatttgaagcctacaatgggggacatagagctttgtcgattgttctctttgagtgaagaattcaagtatgtaacagtaaggcaagatgagaagatggagctagcaaagcttttggatcgtgttcccatccccatcaaggaaagtctggaagagcctagtgctaagatcaatgttttgttgcaagcctacatttcacaattaaagcttgaaggactctcgctgacctctgatatggtctttataactcagagtgctggacgtcttttgcgagctctttttgagattgtcttgaaacgtggctgggcgcagttggctgagaaggctttgaacttatgcaaaatggggaccaagaggatgtggagtgtccagacacctcttcgtcagttcaatggaattccaagtgatttattaacgaagttggagaagaaagatttggcttgggaaaggtattatgacctatcatcacaagagataggtgaactcattcgtgcaccgaagatgggaaggactcttcataagtttatccaccagtttcctaaattgaaccttgctgcacatgtgcagccaattactcgcacagttttgagggtggagctgacgataactccagactttgcatgggatgacagaattcatggatatgttgaacctttttgggtgattgttgaggataatgatggagaatatattcttcaccatgaatattttatgctgaaaaagcaatatattgatgaggaccacacactgaacttcacagtgccaatatacgagcctcttccccctcagtactttatccgtgttgtttcagatagatggcttggatcacaaactgttttacccgtttctttcaggcatttaatcttacctgaaaagtaccctccaccaactgaactactggatctgcaaccacttcctgtgactgccttgcgaaattcgtcatatgaatctctttataaggattttaagcattttaatcctgttcagacacaagtcttcacagttctgtataattctgatgacaatgtcttagttgctgctccaacagggagcggtaagactatatgtgcagagtttgctattttgaggaatcatcaaaaagggcctgatagtgtcatgcgtgtcgtttatgttgcacccgttgaagctcttgccaaggagcggtatcgtgattgggagaggaaatttggaggtggtcttaaattgagggtggttgaattgactggagaaactgcgaccgacttgaaactgcttgagaaaggtcagattattattagtacccctgagaaatgggatgctttatctcgccgctggaaacagaggaaacatgttcaacaagttagtcttttcatcattgatgagctccacttgattggaggtcaaggaggtcctattttagaggttgtagtctccaggatgagatatattgccagtcaggttgagaacaagagtcgtattgtggctttgtctacctcacttgcgaatgcaaaagatctgggagaatggatcggagctacctcccatggccttttcaatttcccccctggtgttcgtcctgtgcctttggaaattcacattcagggcatagatattactaattttgaggcaaggatgcaggcaatgaccaagccaacttacactgcaattgttcaacatgccaagaatggaaaacctgctctcatatttgtacctacaaggaagcatgtccgacttacagctgtggatatgattacatactcaggtgcagacagtggggagaagccatttttattgcggtcagccgaagagcttgaaccttttcttgacaagattactgacgaaatgttgaaagttactttacgggaaggagttggatacttgcatgagggattgaacagtcttgatcatgacattgtgactcagctatttgaagctggctggatacaagtctgtgttttaaacagttccatgtgttggggagtgactttattggctcatttggtagttgtgatgggcacacaatactatgatgggcgggagaatgcacagacagattaccccgttactgatcttctgcagatgatgggtcatgccagccgtcctttggtagacaattctggaaaatgcgtcatcttgtgccatgctcctcgaaaggagtactacaagaagtttttatatgaagctttcccggttgaaagccatcttcaccacttcttgcatgataacttgaatgctgaaattgttgctggaattattgagaacaagcaagatgctgtagattatcttacgtggacattcatgtacaggcggctcacacagaatcccaattattacaacttgcaaggagttagtcacagacatctttctgatcacctctcagagatggtggaaaatactttgagtgatttagaagcgggcaagtgcattacaattgaggatgatatggagcttgctcctctcaatcttggaatgattgcatcctattattacatcagttacacaacaattgaaaggttttcatcatctgtgacttcaaaaactaaaatgaagggtcttttggagattctgtcttcagcttcagagtatgctcagcttccaatacgacctggagaggaagaggttgttcgtaagttaattaatcaccagaggttttcctttgaaaaccccaaggttacagatccgcatgttaaagctaatgctttgcttcaggcccatttctctaggcaatttgttggtgggaaccttgcattggaccagaaggaggtgcttctttctgcaaatagactgcttcaggcaatggtagatgtgatatcgagcaacggttggctgagcctggccttacttgctatggaagtcagtcaaatggtgacacagggaat

SEQ ID NO: 23800 - DNA, 1593 bp, Glycine max
  Peptide Sequence Number=SeqID_140578
tccaaggtgcctattactttttggggagagtgtgttgttactgctgctttccttatcaacagattgccttcaccattgctgaaacaaaatactccatatcaagttcttcatggttttgcacctgattattccattttgagatcttttggttgccttgcctttggagctactttagcttttgagaggaacaaattctctccaagagcagttccctttgtgtttgttggttatccacaaggagtcaaggggtacagtgaattagctatttccttacccattcctgaacctataacctcaaacattcaacctagagccattgaacccaatacttctgaaactgatcaccctattccccctaacacaagtgatctgcctattcagttatctgattctacagttgatactaccattggtgcatcatctacattgtcttctcctcccttaagaagatcatttagaacatcaaaccatccaccttatctttctgactatattagaccgcaacctagacaaagatctcatcctatccaggaccattgctctctagtccatctcaaccctgtttataaggacttcattgctcaagtttccactacttatgagccacaattttatcatcaagctgtcctttttccagaatggcaccaagccataacaaccgagatcaaagctttagaatctgataacacatggaccttggttccctttccagctggaaaacaatgcattggctgcagatgggtgtataaggctggcatcgacttttctgatactttctccccaattgctaaacttacatcagttagagttcttttggatgttgcagttgttaaaaattggtccatcttacaacttgatgtggataatgttttccttaatggcgatctatttgaggaagtatatatggaacttccaaaaggtcaaagaatgactattctctctttaccattggcaaaggccaaacttcaagctttattcaaactaaagatccttggtcccttaaagtactttctgggactagaaattgcaaaagtccaacaagggcattgtactgactcagggaaaatatgctttttccattcagtacatgcagaatctaaggacacctcatctagatgttgtgcattatctcctccaatacatcaaaggtacttcagggtcttcattttccaacaagcaattccttcaatttgtctacctatgcagatgctgattggggaggatgcttggacacacgcagatcaacaattggttccagcagaatatcagacattctccttaatatccagtgaagtgatttggctaaaaagacttttactgcactttgagtttactattccttctatcatgcttttctgtgatagcaaatctgccatagatctaacatccaatccagctcaccatgaacgatcgaaacacattgatattgattatcatttcattcgtgagttagtgcagtccaacatcctcaagcttgttcatgtgaaatctcagcgccaagttgcagatgtcttcacaaagcctttactacttctagcttgctcttcctttatccgcaagttggaactcattaacatttactctccaacttga

SEQ ID NO: 23801 - DNA, 597 bp, Glycine max
  Peptide Sequence Number=SeqID_140579
atggacaaagcccaaaccgagccctggcgacccgacccgcttcactccggcatgttccggccgccggagacgccgcgggagcccatggagttcctctcccgctcctggagcgtttccgccctcgaagtctccaaggctctctctccggcgctctctaaggtcaccctctccaatggcgccgccgtcgtcgccataccggaagacatcgccggcgaggccgaggaagcctccgccaccgtctccgggaaccccttttccttcgcctcctcagaaacctcccaaatggtcatggaacgaatcatgtcacaatcccaggaggtatctccacgaacctcagggagactctctcatagcagtggccctcttaacggaacccaaagttgtggttccttaaccgatagccctcctgtttctccttctgaaatcgacgatatcaagaattgcttagaacagccacgtcgagtagcacctatgaatgtccttgaatatccaaatttagcaacgcacagcgtcgaacttcgtccctcttaccttgccgcattaacgttacatacgccggtggtggtgagtttaactttaacccaggcgtggcaatga

SEQ ID NO: 23802 - DNA, 1941 bp, Glycine max
  Peptide Sequence Number=SeqID_140580
atgccaacaccgtccgcatcctccgatccaatcctggaccgcctcgcctcctccgattgcgcggtgaaattcaaagccatccgcgaggtgaagaaccacatcatcggaaaccgaacgaagaagcattcctacatcaagctcggcgccgtccccgccgtcgccgccgcactcgccgactccgaccccaacctcattgtccagtcggccgccgcgctcggcagcttcgcctgcggcgtcgacgacggcgtccgagccgtcctcgacgccggagcttttcctcgtttgatcggactcctctccgctcatgacgagaaggttgtggatgctgctgctcgttctttacgaatgatttatcaatcaacactagctccaaagtatgatttttttcaagaggaaaccatgcaatttcttctttcattattggaaagtgagaatgaaaatcttactgggctaggtgcaggcattgttattcattcttgcaagacaattggggaacaaactatattatgccatgccggtgttttagagaaacttactagccttcttgacagttctctaagtcagcgagatgctagtctagagtccttagctgcaattattagagacaacccagcggccgtctctgaatttgtggaacttcatggtggaagagctttacattctgtagctgaattaactaaagacagatatcctcgaacaaggttactagcctgcttgtgcttgatttctgtgaagaattcttcgacatgctatctccaagatataggaatcaaaaccaaattggtatacattttgcttgagctccttgatgattctggtcaagttggagatgaagcttcttttgctttctcaagtttaattgcagagaaggaagatttgcagaagttagcttttgaggcaaatgctattaataagttcaactgtctcttgcaaaagcatcctgtacaacctaaacggcttgaaggggtatttctggccttggctgatctttgctcaaaattggagtgctgcaggtctagttttctttcattgcaggtcttaaacctagtagttgatgccttaactcatgaggatgccagtgttcgcactgcagcttgcatttgcttaagaagtgtctctcgctcaatcaagaatttgagtgcaggtcgttttatgaatgaaagggttgtttgtcctctggttcagcttctctctgatctttctacttctgtccaggttgcagcccttggtgccatcagcaatatagtggttgactttatgccacataaatcaacattcatagagtgtgggggcattaaagagcttgtgcaattgacgaagtcaatggattcgtctttaaggttaaatgctgtatgggccttgaggaacatggtattccttgcagataagatatgcaaggaaggaattttcgtggagttaacagcgtcttcaatggctagccttatctgtgatcctgaaccttctgttcaagaacaagctctggccctagttcgcaattttgttgatggatgtgtgtactcagttgaacatgcttttgctgaagatggtatcatactagatgctgttggaagacaattaaaaaaatctacaaagattgaaattgggatacaggggatgtatgttctcagcaatattgcaagtggcaatgaatttcataaggaagcagtaatgcagctactcttccctcaagatgagaatgtctctcactctttcttcgagcaatttttgcagagtcatgacagtcgcttacgcacagctgcagtttgggttgtagtaaacctcacttttccagctaatcctggtgcatttggtcggattgtaaatctgcgtagttttggcattgtttctcgaataaagaagatggtcaatgattcttgcatggatgtgaagcttcgtgcgagacttgcacttgggcagattcttacttttggtgatagttaa

SEQ ID NO: 23803 - DNA, 165 bp, Glycine max
  Peptide Sequence Number=SeqID_140581
atggcaatgatggtgatcagggaggcagtggctatatttggtgagggtgcagggacaagtcatgaatgctgcaagcacatgacatgtgcagatgtagataacaaattgaccattgactttgagaatgaagcctcatttcagccacttccaaaaaaggcagaataa

SEQ ID NO: 23804 - DNA, 144 bp, Glycine max
  Peptide Sequence Number=SeqID_140582
atggaaatgcagaaaacaacagtcccgggaagtgctttaagtaaaatgaattgggctaacaaaccagatccttacgaacttcttgggttaggatacaaaagggtgaaagcaaaatttgaacacaaaacttcacagaaattgtaa

SEQ ID NO: 23805 - DNA, 312 bp, Glycine max
  Peptide Sequence Number=SeqID_140583
atgttaaaggtcgaaaatcacgaagatcagggaaactacattggctcagtgatgcaaacaaaaagccttcaattgttcttgctgggcttcatgcctgtggtgacctttcggactttcgtagagtgtaaagatgttaaagctgttgttagtctaggttgctgttacaatttattatctgaagaaatgattaaggatggtgaatctcaatttggatttccgatgagtcacgctgtaagatccattggtttatcacttggaaaaagtgcacgtgatcttgcttgccagtttttctcggtctcccgctacatctag

SEQ ID NO: 23806 - DNA, 312 bp, Glycine max
  Peptide Sequence Number=SeqID_140584
atggggacaaatcaaaatggcaaaaggttttatcaagtcaaggttaaaaatctagatgtcactagcctcaaggaattgggacgattgatgggacctctccaaaggcaagccttccgcaaagtgtacgggaagattctagatttggccgcagcggaggtatttacggaagctgtcgtatccctcgcccaatactatgaccagccgttgagcaagattgcagctgtggttggtgattcagcaaaagagttggatcgcacgaagcaaactcggaacggcgtagtgggcctgcctcggaaatacttggagggttag

SEQ ID NO: 23807 - DNA, 675 bp, Glycine max
  Peptide Sequence Number=SeqID_140585
atgatgaacgagtttaggtattcatgcaagagcgctcaccaaactcttcaatggatcaacgaaattatacacttcctcacgccttactcttccttaatcaatgctcacgtcgttaatttcttcaaggataggctatgggagaatgttgacgccgaatggatcgaatgcctgcgccgagaatctgttcaaaatcttcttctcataccttctggtgcagtacaggatcaatggccaacttctttgaaggagttcatcctaaaaataaggtctatggtattttgtcaagaacaagcagatataaacatggcattacctggcctgcagacaatttcacttaacactgttcttgcccagggcatgaatgtaaagaaaaaacatgaagttgaaattctttctgctgttacaaatacagttgcaaacagtatcagagctgatgccattcttgatgttggtgctggtcagggttatcttgcacaagtacttgcctttcaatatcagcatcctgtaatcgctattgatgcatgttcgcatcatgggagggttactgatgcacgggcagaacgaattaaaaaatactatacatcacagatgataaaatctgagtatgttcttcaactgtcatcttatttactgcaatgtgaccttatattagagacttgtctaactgtattataa

SEQ ID NO: 23808 - DNA, 261 bp, Glycine max
  Peptide Sequence Number=SeqID_140586
atggggttacacaaggttccattctctatcttcttctgtgtcttggacctagccattctggccatgcccacgactcccaagcaaacttcttcaacgtccacaacgcagctaggtcacagtgtttgtggccactatacgcaagtcgtttggagaaactcactccgtgtagggtgtgccaaagtaaggtgtgataatggaagcacgttcattatttgctgttatgatccccgtggtaacattcgtgggcaaagaccttattag

SEQ ID NO: 23809 - DNA, 747 bp, Glycine max
  Peptide Sequence Number=SeqID_140587
atgggatcacacaaagtttcattttttgtcttctttttcttggtcttagcctttcagcctcacgttggccatgcccaatgctcccaagaagacttcctcaatggtcaaaacgatgctaggtcagatgtggatgttcaagttccacttccacctttggtttggaacaacactttagctgaatacgcgcaagactatgctaaacaacgtaagagtaattgccaacttgtgcactctaatggaccttatggggagaacctcgcaggaagcacgggtgacataagttgtgccaatgccgtgaaactgtgggttgatgagaaaccctactatgatcgcaattctaattcttgtgttggtggggcacattcatctgttgcaactattatccccctggcaactacgttggacaaagaccttattaagggtctagctcgtgcagaggttggtgttgagccactcgcatgggacgacaccgtcgcagcctacgctcagcaatatgcggactcgaggatcaaagagtgccaagtagtgcactctcaggggccttatggggagaacctggtggccagtcccggcgatgttagcggcacggacgcagtgaaaatgtgggtggcggagaaggcaaactatgaccacaaggccaacaatgtgacaatggctggacgtttgtcatctgcagctatgacccacctggcaattttcaaggtgaacaaccttactagttttaatgtcgtgttgaggagcacccag

SEQ ID NO: 23810 - DNA, 1065 bp, Glycine max
  Peptide Sequence Number=SeqID_140588
atggcttccctggcctgtgtcaaccacctccctccctggctctcccctcgccccggatccgaccccgaacccgacttcgagttccccttagaccctcccaccaccatgctccccgccgaccagctcttctccgacggcaaactcctccctctccacctcaaacctctttccaccaccactcctcaaacccccaaatcaccttcctccgcttccgttaacaccgtcaccccccccaccaccacctcctcctcctccgccgacccctacctcttctcccccaaagccccccgctgctcctcccgctggaaagacctcctcggcctcaaaaaactctaccaaaccacaaacaacaccaaaaccacaccttcctcaacctcagccaaatccctaaaaatcctcctccaccgcaaaacgacgtcgtcgtctacctcctccttctcctcggaaaacgcgcctttgttaacctcaatttcttccgacgccgaatccctctccatctcctcctcgcgcctctctctttcctcctcctcctcaagccacgaccacgatgacctccctcgcctatccctcgattccgataaacctaaccctaaccttagccttaacactaatcagatctcactccaccgcaaccctaaccgtagaattcgcctagtcaaaaaccgcacgaactcattcgacgcgaacaagcactcgtcggaccagccttcccagctttcccgcccggggaggagtccgatccggcgggaatcggaaacggtcacgtgcaggggagtttccgtggacagccctagaatgaactcttcggggaaaatagtgtttcagagcttagaacgaagctcgagtagtccaagcactttcaacggtgggccccgcttcaagcaccgcggaatggaacgctcttattccgccaacgttagggttacgccggtgctcaacgtccccgtctgctccctccgtggggcatcgaaatcgggttttatcggcttcggacaactcttctcctcgccgcagaagaaagaaggaacaacaacggggaaagggcacaggagcattcggaattga

SEQ ID NO: 23811 - DNA, 377 bp, Glycine max
  Peptide Sequence Number=SeqID_140589
atggagagggattcggcgtcggaagaaattgaggttaacaaaggcgcgttttccgaggagaaggaggaggtagacgacgacgtcgttttgcggtggaggaggatttttagggatttggctgaggttgaggaaggtgtggccgaggaggtctttccagcgggaggagcagcggggggctttgggggagaagaggtaggggtcggcggaggaggaggaggtggtggtggggggggtgacggtgttaacggaagcggaggaaggagtttgccgtcggagaagagctggtcggcggggagcatggtggtgggagggtctaaggggaactcgaagtcgggttcggggtcggatccggggcgaggggagagccagggagggag

SEQ ID NO: 23812 - DNA, 354 bp, Glycine max
  Peptide Sequence Number=SeqID_140590
atggacaaaggcatggaagtaccatatcctgtggtaccttccaagaaagaaaaagatcgcaatttggtaagatttttggatattttcaagaaactggaaataaccatgccctttggcgaagctctgcagcaaatgccactctactccaaatttttgaaagatatgttgacaaggaggcacaaaagattgggagagttggagattatgcccactcaaatgactctacaattagctgaccgctccattaccaagccctatggagtaattgaagatgtattggtcagggtcaagcatttatcttcccagcagactttgtggtcatggatatctctaaagatactgacatccctataa

SEQ ID NO: 23813 - DNA, 180 bp, Glycine max
  Peptide Sequence Number=SeqID_140591
atggcagcttgcctaggcgagctaaggcttagtcctgaagtcatgagcttgcccaggcgagctggtttcttaaccttgaagtcatttggtggtccaaaccaggcagaggctagcctaggcgagctgagcattcaacaccataagccgactagcgaggatcaaaagatcaacgaacgatag

SEQ ID NO: 23814 - DNA, 255 bp, Glycine max
  Peptide Sequence Number=SeqID_140592
tatcaggcattgaatgaatctcctgttggacataaccagtcccctaaagttacctcagaagctgtggccatcgctgatgatattaatgacatcagttgtgaatgttgggagaaggctgaaaatgaagggacaagtttaaagaagcaagtccatgcactgactctcagaaattcaacacttgaagatagagtcacccatctagacagtgcacttaaggagtgtgttaggcaactaagacaaacaaggtgtttataa

SEQ ID NO: 23815 - DNA, 330 bp, Glycine max
  Peptide Sequence Number=SeqID_140593
atggcgaatgtttgtttgtgggagcagaatgctagtagtagagtacaagaaagtggtgatatcatagcgacgaggcgggtctttacacatggggatcctctagtagagtattggaatgacttgaaaagtgcccttaggaagaggcacattgatgtagctccgtgtggagcttgtaggccttggatattcttcatcaataaactcctttgcttcttgaagatcgtgacagcagaatggagaaggaagaaagatgattggagatgccacttcaaggagaagatgagtcaagaagaagctcaccaccataggaagccatggataagagcttga

SEQ ID NO: 23816 - DNA, 231 bp, Glycine max
  Peptide Sequence Number=SeqID_140594
atggatgcacctaccaacaacacttcttttcatagccatgctgctgccaatgtctgtttactgtgtcccaatacagcagggcaagaaggagaacgtgcttatgtacagtcgggtctctgcacagattcctcctcatctaatcccttttaccctatcatatatggcatcactgccaatgccaaccccatctctctcttgcatagggagtgggtcagtgcacaaaagggatga

SEQ ID NO: 23817 - DNA, 306 bp, Glycine max
  Peptide Sequence Number=SeqID_140595
atgtcagctgggcctggacttgaatctctagtagatcagacaatttcagtcattacaaatgatggacgaaatatagtgggagtcctgaaaggttttgaccaggcaacaaatattattcttgatgagtcccatgaacgggtttattctacaaagatgttagatatatctgaaaccaagaggcatttgtctatgattaagaaagaccatttgttgcgaagctggtttgtaatcccaacaacaacaacagccttatcttcttacgagagtcagttacatggattatattatgccattgagtttgcttaa

SEQ ID NO: 23818 - DNA, 414 bp, Glycine max
  Peptide Sequence Number=SeqID_140596
atggaagcagaggaaaacgacagcgtcgtagtcgaatcgacggagccttcgagttcccacggttccgacggcgacgatcaactccggcagagctccgacgtgttggcgaaaggcttgtcttcgatgctctcttcggttattaacgatttcgatttcagagctcagcaaactctccaaagccagaaccatctctcttccgccatcgatcgtctcaccggagaaaggcactaccaacaattcgttggtccgacgagtaatactggattcggttcctttaaacaaggtctcgggtttgagccttgtggatggaaaaacttggttgagaggaaaaatccaattaaagtggttagtcaagttctccggtggagattagtcatcagcaaagccggtggtttcgtaccaataacatggtaa

SEQ ID NO: 23819 - DNA, 312 bp, Glycine max
  Peptide Sequence Number=SeqID_140597
atgtatgcaggtgcttattcagcaacattcacagtcacaaacaattgtgcattcacaatatggccagcaactctcacaggaggtggcacctcacagttaccttcaacaggctttgaactaacctctaaagcctcatccacaattgatgtcacagctccatggtctggcagattctgggcaaggtctcaatgctcaacagacacacatgggaaattcacttgtgccactggtgactgtggatcaggtgaagtgccatgcaagctggtggaaccctccagtttctctagtggaattcactttggcctcaaataa

SEQ ID NO: 23820 - DNA, 927 bp, Glycine max
  Peptide Sequence Number=SeqID_140598
atggcttcacttctgaatacggtgtcaccagccgcaaatttgtcccccaaaacaaaacgacccacttgtggcggttttttgcactcccagtttccaaatctccgcactttttccctcaacaagggtttttctagggtttcggcatcgacccagattgccatatccccaaaagataccatttttaatctccccaattggagggttgggaggaatgaccaaaagggtaaagagctgaggatctatgatgcctttctccatttggagtatttggtgggtaagggccaaaagcctgaggtaaatcaagcaactcagcttttgtatgatctttgcaaattcaacaaggctagaaaagctgttagggtgatggagatgatggtgggttcaggtattatacctgatgcagcctcttacactcacttggtcaattttctgtgcaagaggggcaatgttgggtatgcaattcagctggttgagaagatggaggggcatggctttccaactaacactgttacctataacactcttgttaaagggctttgcatgcatgggaatttaaaccagagcttgcagcttttggataggttgacgaagaaggggctcatcccaaacgcattcacgtattcattccttcttgaagcggcatataaggagaggggagtggatgaggccatgaagcttctggatgatataattgccaagggtggggagcctaatttggttagttacaatgtgttgttaactgggttgtgcaaggaagggagaaccgaagaggctattaagcttttccaggaattgcctgtgaaagggttcagtcctagtgttgtgagttttaacattttgctgaggagtttgtgctatgaagggcggtgggaggaagcgaatgagcttctggcggagatggataaagaggaccagcctccctcagtg

SEQ ID NO: 23821 - DNA, 333 bp, Glycine max
  Peptide Sequence Number=SeqID_140599
atggagagtgataaaatctataaatttttggatgaattgggtgagaaaatgaaaatggctggatacaagcctgacactgattatgttcagcaagatgttgaccaagaggaaaaagctgagagtctttgcagccacagtgaaatattagaatctgctaatgactacaaaatattacacaaagtgaacgaatgtacagtatcaatctccagcaaactgaactctgataaaaagataccaatattcttctacaaagatgcatctaggaagagacctaattgtcctatcctatcactatcagagcaagtctcattggggcaaagaggtcaagactag

SEQ ID NO: 23822 - DNA, 1437 bp, Glycine max
  Peptide Sequence Number=SeqID_140600
atgagattcaagggaagcatcactcacatcacactcttaagcaaatcctcttccatctggaagcagctaccttcaacaaaggtggctccttctgtgcccactaacatcccatcttacttaggtctcaggctcctcaaggcagctctaaatgtgggtgatttcaggcgtgcccaaaaactgtatgataatattacccaaccagaccccgccacttgttccacattaatttcagctttcaccacccgtggacttccaaatgagtccataagactctatgctttgctccgggcacgagggatcgaaacccacagctcggtgtttttggccattgccaaggcctgtggtgcctctggtgatgccttgagagtcaaggaggttcatgcctatgggaagtgtaaatacatcgaaggggcaaggcaggcttttgatgatttagttgtgaaagatgtgccgaatttggtgtctgtgtctagcattttgcccgcgtgctcggttttgaaagatttgaagtctggaagggctattcatggaattgcagtgagacatgagatgatggaaaatgtgtttgtttgcagtgcacttgtgaacctgtatgcaagatgtttaagtgtgaaacaagctaggctagtatttgatttgatgtctcatcgagatgttgtgtcttggaatggagttttaacagcatacttcacaaacatctcatatgagaaggagaaggcagtggagatgcttagcaagatgcaaaatatgggatttaaacctaatcagatcacaattagtagtttcttaccagcttgctctattttagaaagcttgaggatgggcaaggagatacactgctatgtctttaggcattggttaattggggacttaacaaccatgacagcgctagtatacatgtatgctaaatgtggtgacttgaatctttcaaggaatgtctttgatatgatactcagaaaggatgttgttgcttggaacacgatgatcattgcaaatgcaatgcacgggaatggaaaagaagtgcttttggtctttgagagcatgcttcagtcagggatcaagcccaattcagtcacttttactggtgttttgtctggttgtagccactcaaggctagtagaagaaggactccacatatttaattcaatgagtagggatcatcaagtagaacctgatgctaatcactatgcatgcatggttgatgtcttcagtcgtgctggtcggcttgacgaggcatacgagtttatacagaaaatgcctatggagccaactgccagtgcttggggagcacttcttggtgcctgtagagtttataagaatctggagttggcaaaaatttcagccaataaactctttgaaattgagcccaacaaccctggaaactatgttttattattcaacatccttgtcactgccaaattgtggagtgaagcttaa

SEQ ID NO: 23823 - DNA, 1434 bp, Glycine max
  Peptide Sequence Number=SeqID_140601
atggccacaagggaaggtaccctgcaaatcgcaaagaagaaagtccctctcattcctcttctgtctattctctgcttcatttccattttcttccttctctcccagttcaaatctacctccacctcccaccactcccttcccacgttccaaatcgagaaacacgaataccaccgcggttcctgcgactactccgacggaacatggatccacgacccctcgaggactccgaggtacgacaatacctgcaaggagatcttcaagggctggaactgcctctccgcccacaaatccaacgccccacatctctccacgtggcgctggcagccccgcctctgcgatctcccccagttcgaccccgctgagttcctccgcactcacacccacaccaacattggtactctcactctctctttctgggtttttgattccgcaaagaaagttgcgttatttttgggattgttaatgatgggtgttcagcagtgcaggagtgtctccgatggacagatcaagaagtggcgacctgctggcgctgaccgtggattcacctttctcgcttacaatctcaccatcgcttatcaccgtaccaatcttctcgctcgttttggtagctggtcagctactgataaacgtggtgccttggaaactcttggattcagagaaggatatagagttgatgttgatgttccagacaccacatgggcacaagctctaagtttccacaatattctaatttttaacacagggcactggtggtgggccccttcaaaatttgaccctgtgaaatcccctatgcttttcttcaacaagggtcagccagtaatccctccattacgtccagatcaaggcctggatatggttttgaagcacatgtatttgggaactatcccaaccattaacattaagatgaagaagtactgcaacacaattgaacatccaagtcaagcaatatttttcattagaaagatgcatttgggaattatgcctagcaactatatagaatgtgctttcccttttcacaaggacattgaacgtctaaatatcccatatatggaggaaaaagcacgactaggtgctctcaaatttttccgtactcagtcacccaggcattttgaagggggagactgggatcagggtggttcctgtcaaagggatcggcctttgtcgatagagcaggtagaggaacttttctctgagaagaataatgggacaaatgtggagactcgactggtgaataaacacctctataaggctcttaaggggtctagtttcattattttggacatcactcacttgagcgagttcagggctgatgcgcacccagcttcagctggagggaaaaaacacgatgattgcatgcactggtgtttacctggaattacagatacctggaatgacttgttcatagagctactgaaaagtaagtatcaagggtag

SEQ ID NO: 23824 - DNA, 1971 bp, Glycine max
  Peptide Sequence Number=SeqID_140602
atggaaggagaaagtgtttcaagttcaagtaagtcacaaaatgatgtcatagagaaaatgtctctcaatgagggcatggaggatgggaatggggaagcgccagagcacggtctccaaaagttggtacaatttaatgaggaagttgaagaacctaaagttgggatgactttcccttctgagcaggagattttcaattattacactaattttgctcagcataagggttttgaagtgtatagaagaacttcgaaaatggaagaagatgggaagaaatattttacacttgcttgcgtttgttctaggaggtcagaaaacaagcgaagccatcttctgaatccatatcttgttacaaaaacccagtgtaaggcaagaattaatgcgtgtttatgtctggatggaaagatcagagttttaagtgttgcgcttgatcataatcatgagctgtgtccaggcaaagcacggcttattaaatatactaaaaaatctaagcctcaaagaaaaaggaaacatgatcttagcaatctggctgggatcaatggggatggaagtattcaatctccaggtgtggaagctggagaacatggaagcctaggattttttgataaaaatcgtaggatcttcattcagaaagctagtagcctaagatttgagagtggagatgctgaagcaattcaaagctattttaaggctgcaaatgagtattttggagatgttgtaacttttgacaccacatatttaacaaacaagtataacattcctcttgctctttttctaggagtgaatcaccatggacaatcagtattacttggtattgctttgttgtcaaatgaagatgctgaaacttttacatggttatttcagacatggctggcatgcatgtctactggacatgcgccaattgccatcatcacaagggaagatagagcaataaaaactgcaattgagattgtattcccaaaagctcgtcagcggtggtgtttgtcgcacataatgaaaagggtatctgaaaagttgagaggatatcctcggtatgagtcaatcaaaacagattttgatggtgctgtatatgattcttttagtaaagatgatttcaatgagagttggaaaaaattaatttatagtcataaccttcatgacaatgaatggttgaatagcctgtataatgagcgccaccgatgggttcctgtgtatgtcaaagacacattttgggctggaatgtctacaatagatagaaatgaaagtgtgcatgcattttttgacggatatgtttgctcaaaaacaagtttaaagcagttttttaagcagtttgacaatgctatgaaagataaagttgaaaaagagtgcttagcagattttaattcctttaataatttaattccttgtagaagccattttggtattgagtaccaatttcaaaaagtttataccaatgggaaattcaaagagtttcaagaagaggtagcctgtatcatgtattgcaatgctgcctttgagaagaaagaaggcttggtttcagcatattctgttgtggagagtaaaaagattcaagaagcaatcaaatatgtaactttcaatgtacaatttaatgaagaagattttgaagtgcaatgtgaatgtcatttgtttgagtttaaaggtattttatgcagacatatcctctctttgctcaagctcataaggaaaacagagtcagtgccatctaagtatgttttctcgcattggaggaaagatttgaagcggaaacacacattagtcagaagtagttatggtgatttaattgctaatcctgaagcagaacgacttgataagatgtgcaatgcttttcaggaagttgcttgtatgggggtaaatactgatgttgatttcaagaaagtgatgaaatggattgatgacttaaaagttgaattaagttgtaaaaagacttctactggaataactgaaacactccctattgcatcaaacatgtcatga

SEQ ID NO: 23825 - DNA, 231 bp, Glycine max
  Peptide Sequence Number=SeqID_140603
atgaaggccaatgagagagcatgttcacgttcacctcagggtcattgtcattactctcatcgtggatcaccactgacaatggtacgtgatattgctacagcgacaatgggaggtgatgatgcacatgggttgctaatggatgcctttcatgtgacattgttggtgaatgtggaatcaacaatagaagaattgagtggagagagattgagactaaaagagaaaggagggtaa

SEQ ID NO: 23826 - DNA, 504 bp, Glycine max
  Peptide Sequence Number=SeqID_140604
gaatattatgacacataccctgaccttgtagttgttctctattgcccaccattgttgaaaacttcggggtcgatgaagtgggtagttggaggtggccaaccatccttggttcttgacaggaaagttgaaaatgaagggactcatcctttgtatgtggctcatcttgtgggtaaaggtggctttaggggtgttggaaaagttgggaacatgtttgatgttagaagtggaagaaagattaatggaagtaacagttgtggtcaactagatgtaaaggatgattcaatggaatctggaaagggtgtgttaggttgggggttgaatgttggggtcatgccaaacattaggttaagggtaggggtgggtaaagggaaagtaagaccagacggggtgtatgatggacaaatgctattagggataaagggtaataggggatgtgaagatggggtaactggagatgtaagaatagtgattgcaaatgggataaaaccaagtggaatagaataa

SEQ ID NO: 23827 - DNA, 183 bp, Glycine max
  Peptide Sequence Number=SeqID_140605
atgatccagtgtgaacttcacaattggagagctagaggaaaggagtctgcacatgagagaaaccaaaagtataaagaggggaagtttgttcttgaaagagggaggattgttgatgaaatggatttctccactgaattccgtattgagagttgtgtcagcatgagtgatgctgaaaatgcttaa

SEQ ID NO: 23828 - DNA, 273 bp, Glycine max
  Peptide Sequence Number=SeqID_140606
atgacaaccatccaagttgttgaggtagtggaggtaggcaacatggatgtctgtcagccacgtcaacccaaccctggaacctgtagtggttgccgctataacctcctcctctgtcgaaatgccaaggcaagtcatgagcaaaaccttaacaacctatctagtgaaggcggaagggacatgatcaatggcctgtctgtcacaagcaagtgcaagagacatgacacatcatccaaaagtgatggtcatctctctgacaaacagatggaaagatga

SEQ ID NO: 23829 - DNA, 648 bp, Glycine max
  Peptide Sequence Number=SeqID_140607
atgacatttggaggttacatgtcattagtcatgttttgggtgtttgcacatctgcccactattggctatttcgagcctgagatcagtgctttggatgacctgataaccaacagatggaagccaacacgaggcattgggcaagcttatctgatcagggagaagctagtgacctctagatggatgttgttgttggtgtcaggccttttccttaacaagcccttttctctggcttcatcagtgggtagagtggtagcaacatgtcatttaatgggcgatgctgtgccacccaagggtccttgggattgcacccctgactatttgccttggttttattgggtttcccactcctatgccattccaccagaggagggagagccaccacgtcttcttgtacatttaccgcctatcctaatacagctaccgcctaggcaaccactggcagagtatgtaccagatcagttttggatggtgtcaagcaccatgcagagcttattgggcctcgaagttatgttagaggaaacaagtcatcatcagaccatacaacaatctttgcaattgttgcaggagggtttcgaagttaggtgcaacttagagaggcaaaggaagagggcagccaagggtggtaggaagggtggcagaggtggatga

SEQ ID NO: 23830 - DNA, 570 bp, Glycine max
  Peptide Sequence Number=SeqID_140608
atggctctcattccagacaaaataagagagataaatggatttaaagaaaccctgaaacttgtcatcagaataactgacctttgcgctaactttgagcgaggtttgctggttgatattattgatgtagttgatgagttgatctaccaacaaatttcatcagagaataagagggttgtttttaaactaaaggacttgagtgaccaattggtgtcctgcactctttgggaagattattacctacaattcttagagtacttaaatgagtctaatggtgaagggccaatagttattctgctaacccatgctagaattaaagaatcacaagtttgcatcaagtgtaacaataaaactgataaagacaatattcccttcacatgtgcatgctgcaaatataatcaacaaactgtgttgagatatagacttgaggtcatcgtttaccacaaggaacaaagcacaaaatttatgctctggaaccgtgaatgcataacccttattggtcagctagctgacgaagttaataggttaaagataacacttataaaaggagcaaaggatacagttatcttgtaa

SEQ ID NO: 23831 - DNA, 1218 bp, Glycine max
  Peptide Sequence Number=SeqID_140609
atgtctcatcctcctcaccttgctcttagcaggtggtactggcacattccttttgacacagtgaatatggaaggattataccccaatcagtttgttctcggtatggtttggctattggtgcatcagtggctccctttgtccgtgtgcttgtatgcatatgtttcccagttgcctttccaattattgttggattttttgctgggccatcgacatgaagccctattccgtagagctgagttgaaaacactcgtaaatttgcatggtaatgaggctggaaaagggggggaactgacacatgatgaaacaacgatcattgctggggcacttgaactcagtgagaagacagcgagtgatgccatgactcctatatctgaaacatttaccgttgatattaattcaaagcttgatagggaactgatgaatgaaatattggagaaagggcacagcagagtcccagtctattatgagcagcctacaaacattattggccttgtactggtttctagccagtataggagtacaaattaccaaaaaattatgttcagcttgggggtatttgagctttccttaaaggtcaagaatttattgacagttcacccagaagatgaagcacccgtgaagagtgtaaccatacgcaggattccaagggttccagaaagtatgccactttatgacattttgaatgagtttcagaagggccatagtcacatggctgttgttgtcagacggtgtgacaagactaaccaacaatcttcccaaaataatgcaaatggtaaaaacatgctatcaacagttttaaactttgaaactgaaattttctttattaataaaatgctccgtgtgtctctcgcctctgaaatagactcggtgagagatgttaaggtggatattgatggtgaaaagcctcccaaagagaaagctttgaaacccaagatgccactccacaagtggaaaagctttccaaatacaaacaagtcatcaaataggggttctcggagcagaaaatggtcaaaaaatatgtactcggatattttagagatagatggaagtccacttccaaagctccctgaagaagaagaagctgttggaattattaccatggaagatgtcattgaagagcttttgcagtgcatatgtattacgcaagagtattggcatttagtatgcacaggatttcatgaatttgacaagagaaaatgcgtcacaatgcgcaagtga

SEQ ID NO: 23832 - DNA, 186 bp, Glycine max
  Peptide Sequence Number=SeqID_140610
atggaggagatcaaatcacagaggcaatggaggagattcagtcatgagatcgaatcacgacaactgtggaggagatctaatcacattgacaacagaggagatccaatcactacagtgatgggtgagattcagtcacatcgacaacgaaggagatccaaccacaacgatgatggtcgagatccatag

SEQ ID NO: 23833 - DNA, 2053 bp, Glycine max
  Peptide Sequence Number=SeqID_140611
atggctgaggttgcccgacagcacattgatcaggaagccgccgctgatgttggacgaaccgcgcagctgacgcaggtaccagtggccgcgcgattcattgcgcaggcattccttcgggaaggtttccgattcggcggtgaagtggccgcagaagatgatcacgtaggtccagatgttgcgcaggccgttggccaccatgttgcccagcatcacggtgaggaagaacgggccagccagcagcgggaagaacacgtagtccttcagcacctggcgggccatctttcgcgccaccgggcgggtctgcatccacatcgcacggccactgatgcggcccttcagccaacggcccaggcgcaggtcctgcgcggccacgccccactggaacagcagcgcgaagatcggcgcgatgatcggctgcagcaggtagaacggcttccagcgctgttccgggaagatgcgcagcaggccgtagccgatgtcatcgtccatgccacgcacgttggtgtaggtgtggtggcggaaattgtgggtcttgcgccagttgtcggcggtggcaacgatatcccactcgtaggtgttgccattgagcttggggtcgccggtccagtcgaactggccgtgcatgacgttgtggcccagctccatgttctccaggatcttcgacagcgccagcaacagcgtgccggtgatcgcggccggccacagcagcggcatccagaacagcggcgagaatgccgccaggaacagcaggccacggccacccacgccgaaccagcgcacggcggcagccacgcggcggatgtagcgggtatcggaggcgccgaggctgccgatcacacggtcgcggatcgcatcgagttcctcaccgaaagcatgcatctcggcggtgctcagggcacggtcggtagcgcgggtcatggcaggcgtcctcagagatccagggtggcgggtggcgccactgacgcgttcacagctgcagctgttgcagatacccatgcggcagccgtgcttgggcttgatgccatgggcttcgaggctttccagcagcgagcggcctcgcggcacgctcagctggcggccactgcgcgcaagcgtcagcgacacctcgccttcgctgctggcatcgcgcagtggcgccggcggggtgaaggcttcggcctggaagccagccacctggtgcgccaggcgttcacgcgcagcggcaacgaagccgtccggaccgcaggccaacacatggcgctgcgccagcggcgtgtcatcgccggccacctgcagatcatgggtaccgatgcgcgcggccggcgcctcaccctcgcgggtggtcagcagatgcacgcgcaggttcggatgtgccgcggccagcgcctgcagttcatcacggaactgcagatgggcggcggtgcgctcccaatagaacaggtccaccggtgctgccagcgggcgctggcaggcgtcgcgcaacaggctgcgcatcggcgtgatgccactgccggcagccagcagcagcaccggcgccgcggccggcatatggaactcgccgaaggcggcatcgaggcggaacagttcgcccggctgtgcatggttgaccagatgctggctgacccggccgccatcgatcgccttgacggtgatcgccagctcgcgccgacccagtgcggtagggctgtagctgcgctgccacaggcgcccctcaatctcgacgcccagggtgacgtgctgaccggcgcgcatgccggcccagtgccggttggtgcgcaggaccagggtcgccgcgccctcgccggccggctcgcgccggaccagtcgggccatcggctcgcgcagggtccacaggggattgagctggcccgcccagaaatcgaacagcgacggcgagacccagcgcctcgccccaccggaacccccatggccgccgccaccgccttgtcgacgcctgaagatgccaacagcccggcccgccgtacggtgagccgcgaggatctgctggccgccgccctgaagctgatcgggccgcaccgcagcctgtccacgctcagcctgcgcgaagtggcac

SEQ ID NO: 23834 - DNA, 1461 bp, Glycine max
  Peptide Sequence Number=SeqID_140612
atggcgaaacccgggcgaggtcgtcgctctcactccggctccgtttccggctcctcctctcgctcctcttccccctccgactcccgctcctcctctcgctcgcgctccgtttctcgttcccgctctccctcgcgctccagatcctcctctccctcctcctcgtctccctcccgaagttctcgcagccgcagccctcccccacagcgccgccgaagtcctgctgatgcagctaggcgaggtcggtctcctccacctcaatctaagagagcttcacctcccccaagtttaacatggtatattgtgcaagcaatgttgttaaatggtggtaccatggtagatttttttgccaactgccataggcaatttgtgaagggaggcctgctatggcggtgccattggctgcaatggaaaccttctcctgtacgtgaatcacttgttcttcatgtagaaaagctcagcagaaatgtcaatgaagggcatttgaaagaaattttcagctctccattatcctcgtatttgccaaatagttgtaagagttattatttggcaatgcacatcagcacatgtaactttggtgaggttataagtgtggagttggcaatggatcgaactgtcaatcttccaaaagggtatggatatgtgcagttcaagacaagaggggaggctgaaaaagcattattgtacatggatggtgcccaaatagatggcaatgtcatcaaggcaagatttactctacctccaaggcagaaagtttcaccacccccaaagacttctgctgttgctccaaagagagagatccccaggactgataatgctagcgcagatgttgacaaggatggaccaaaacggcaaagagaatcttctcctcgtagaaaacctcctccctcaccacggaggagatctcctgtacctagaagagctggatctccaagacgaccagattctccacgccgtcgtgcagattctcctgtccgtcgccgagtagactctccttatcgtcgtggaggagacacacctcctaggaggcggcctgtgtctcctggaagaggtcgttctccatctccacctagacgccttagatcccctgcaaggctgtcacctagaaggatgcgtggaagcccaggtcgaagacgttcacctccacctcctcccaggcgccgatcaccacctagacgaccacgtagtcctcctagaaggtctccaattggtcgtagacgtactcgctctccaatacgtaggtctgcgcgctcacgctcaaggtcattctcacctcgcagaggtagaccaccggttagacggggaaggtcatcatcctactctgattccccaagtccacgcaaggtatcccgtagatcaaagagtcggagcccaagaaggcctttgagaggaagaggcagtagcaacagcagcagcagcagttcaccaccaccaccaccaccacctccacctcgcaagccatag

SEQ ID NO: 23835 - DNA, 1527 bp, Glycine max
  Peptide Sequence Number=SeqID_140613
atggcaggcagtggcctgccatctttgggtcgtgtgaagcttactgatttagtcccttcagacgggttgccatctgattcctataaaatatcagtttcaattttgtcacaatctctggctcagttttcggcggtcatcatccagtttccagcaagtgatggggctcttctgagatctagtttagaatctgctcgcctctatttccaccaaagggaaacatatccacctgcagatataatccatactagcgagtctcgtgagtggtgcaaaacatctggttattatgcagatcctcatttgtggcaagaaacttatgactatagaccaggattgactccttcagaacctaataattcaattgagttccccccggcaggtttgccagacatatttgccttattcggaaaagcagccagagatattctggatgcaattagctaccatttgaatttgcgaagctctccttttgtagaaatactggataatgttcccctgagaaatagggaaatttcatcttcagtcttgtctgtttgctgtcatgcaaggccgtcgttccaggggccacagcatcataatataactactcaagaggatggcccattgattatgtatcctgaccatgaccaccaagttgataaaagcttgctatcacttgttaagtctgacagggcaggtttacatgtaagagactttcaaggccggtggattcttgtggacggagatctgggacctcaggaagctattgtttatcctgggcttgctctttatcaagcaactgcaggatatgtaaaccctgcattgcacaaaactgagattaatatggaggctaatatgtatggacgatgttctttagccttcaaacttttgcctaaatcgatgaccaatttggattgttcagaaatgcgagtggcaggttacgggattgaagctcagtttcagcttcctgtcccagtggatgattttatgcaaagatctcatccaacagatcatctatttaacaggcctagtcttcagtgcttcaatttccaaccaacacatgatggatctatgaagactttgatgcggagaaggaagcaaaatcccaaaagcaaacctttgccaccatccaagaggttaaggcttgaggcgcagagagttttgaaagaaagggtccaggatattgcagataagaaaggcatcaagctgcggttctgtaatcttaaggaatgtgaaagtcacattcacagcgtagatagcccatgtgcaaatatacgaatggagatagggtggccacttggcgttccatttgtccatcctcatgacttacctaacaaggcaaagctgggttttctagaagcatatgaacctggttggacagaagcccatcaaaactcagacaggctagtcaacactcggctaactttaactggtgatgaaaaggaatcagtccccctgatttccaacgtatgggcgacaatggatcaagttgtgaagatagccctatatagttctcagggggctctgaatctatctgtagctaggctttag

SEQ ID NO: 23836 - DNA, 297 bp, Glycine max
  Peptide Sequence Number=SeqID_140614
atgtttcttgatgtgttcctcgatgaaaacgatggcattgaggattgcaccctccaacttctacgtgacagtgtcataggggttttcaacgttgaggatcgcaccctcgagcttcatcatgttgattatctatctccatgcccaaacattccaaaatgctcaattccattttctagatttgagtttggcttcacgaaattgaggttgagtgggggattgatggtggtcgttgggtttggttgcatggtggtcggtggtggtttccagttaggggtggacaaagacagtggttcatag

SEQ ID NO: 23837 - DNA, 273 bp, Glycine max
  Peptide Sequence Number=SeqID_140615
atgttgaacctgcggtgtctcgcgattgtgttcgatttggacgagaagctcatcatggcgaacacgatgaagtcgttcgaggataggattgaggccttgaaggggtggcttttgcgtgggtcccactcttccccaacctcttcttccccagcttctactacgttggcctttcaggtctcgggatttaggcaacagaggggccgtgatggacatcggaactgtcgtcacgaggcttccgacggtggcttacagacacctttctgttttgcataa

SEQ ID NO: 23838 - DNA, 1490 bp, Glycine max
  Peptide Sequence Number=SeqID_140616
atcccgcgcaaagcggacaaatcgtcagcgtttgccgcgcgatcggttcctgcccgtggcaaaaccaggtaacgtatggcgcattttccgcgccacagcaggcaggagcagttttgacacttcgtattggattaccgcaatggcagcacgccaactggagagtattgggtatcgaaaccctggcggattacgcccggctgttcggctgcgtcgaaggcaacaccacgctttacgcgctgcccaaacccgaagtggtgcagcgctggtatgacatgactgacgacgcctttcgcttctgctttaaatttcctgacaccatcagtcacaaagcggcgctgaagaactgcgatgagctggtgaatgaatttctgcgcctgctggatccgctcagccagcgcatcggccagtactggctgcagctgcccgccgccttttcaccggcgcagctgacagatttatgggcgtttctcgatcgcctgccgcgcagctttcactatggcgtggaagtgcgccatgcggccttttttgccaaaggcgaggccgagcgcgcgctgaatcgcggcctgcaacagcgcggggttaatcgggtgattctcgacagccgtccggtgcacgcctctgcctcgctcagcccggccgccgtgcatgcgcgcgcgcaaaagccgcgcgtgccgacgcatgcggtgcgcactgccggacagccgatgcgacccgctgctgttcatccacacgccggatatgggcgcggtgtttccgctgctgcaggcgctgtggccgcagctgcaacagctggagccgacgctgcgcccgctccccgcctggccacagcaatccagcctgttctaaacgcagggaaacggcgctcggtgccgggttactccaacatcatttcgatgattggcatgctggcagaacgctttgtgcagcccaacagccaggtttacgatctcggctgctcgctgggcgcggccacgctggcggtgcgccgcaatattcaggcaccgggttgccagattattgccgtcgataattcgccggcgatggtggaacgctgccgccgtcacatcgacgccttccgcgccgctacgccggtgcaggtgctggaagcggatatccgcgatgtccacatcgaaaacgcctcactggtggtgctcaactttaccctgcagttccttgagccggacgcgcgcctgacgctgctgcagaaaatcgccgccggcctcaatccgggcggtgcgctggtgctgtcggaaaagttcagctttgaagatgccgacgtcggcgaactgctgttcaacatgcaccacgactttaagcgcgccaacggctacagcgagctggagatcagccagaagcgcagcatgctggagaacgtgatgctgacggacagcgtggaaacgcataaagcccgtctgaaaagcgctggctttgcccacgccgagctgtggttccagtgctttaactttggctcactggtggcgttgaactga

SEQ ID NO: 23839 - DNA, 1140 bp, Glycine max
  Peptide Sequence Number=SeqID_140617
atggcattcgattttgatcaagggatagaccgtcgtcacagcgatagtttgaaatggcacaaatatggtgatcgcgatgtgctgcctttgtgggttgccgacaccgattttcgctcgccgccgtgtatcattgaggccattaaacagcgtgccgaccacggtgttttcggctatggcgcgacgccgcacggtttgattgatatcactatttcccgcttagcccagcgctatggctggcagattgagccggaatggattgtgttgctgccgggcgtggtgagcggcctgaatttatcggtccgggcatttaccgagtcgtcgcaaagcaccgtggctccgacgccaatttatccgccgtttcgcgcggcggcgcggctggcgcagcgcgctcagatcaatctgccattgcagttacagcaggatcgctgggtgatgcagctggatgacagccagatgcagggtaacgagcgcctgctcatgctgtgcaatccgcagaatccaggcggcaccgtttaccgccgtgatgagctggaggcgcagctggcctttgcccaacgccacgatttgctggtgtgctccgatgaaatccattgtgacctgctgttaacgcccagcgtacagcacattccgtttgcctcgctgagcgaagacgccgcccagcgcagcattaccctgatttcgccgtctaaaaccttcaacatcgccgggctgggtgcgtccatggccattatccctcatcccgaactgcggaaacgctttaagcaggtgcgtgaaggcatcgtaccgggcgtggatattctggcactggtggcggcggaagccgcatggcgcggcggtgatgcatggctggcggaccagctggcttacctgcgcgccaatcgcgactggctggtgcagcaggtgaatgcgctgccggaactcagcatggtcgcgccagaggccagctacctcggctggattgacgccagccagctggatgtcgccagcccggcgctgtatttcgaaaaacacggtctcggtttctcgccgggccgtgatttcggcgacgatcgcttcgtgcgcttcaactttggctgcacgcacgccaccctgcagcaggcggtatcgcgcctgcagcaggcagtggcagcgcggcgctaa

SEQ ID NO: 23840 - DNA, 163 bp, Glycine max
  Peptide Sequence Number=SeqID_140618
atgcactcctcccgagccagcagtcatgaaaaggagcaaggtatgacgaaactggaaatttgttgctatggcatcgactgcgcaatgactgcgcaggcgtccggtgccgatcgcgtggagctgtgtagtgctccgcgtgaaggcggactgacaccttcggcgg

SEQ ID NO: 23841 - DNA, 252 bp, Glycine max
  Peptide Sequence Number=SeqID_140619
atggatcaaaattggttgaaagcatcatgcattagcaacaagagacaccaatcagtaaacgacataagatcacatcttatatgtgacgggatcattccaaattacactaaatggatatggcaaggggaattgccagacatgccaacagtctctcacactgagccgattgatgtagactgtggaagcaatgacttccaagattattttgatgatgccaaagaatcaagagttaagcaagttccaaataattag

SEQ ID NO: 23842 - DNA, 237 bp, Glycine max
  Peptide Sequence Number=SeqID_140620
atggagcttgcatcaggagttaaagagaagttcaagacaacggccatcaaggtcaggaaaaagtgcgacaaactaagggacgcattatggccaccaccgaagcctgggaacgagaaaccaagagggcccgaaaggaagcaaaaggccgaaacaagttccaaggagctttatggggcagcaacaatgagcttaagctacaaagagctaaaagagatcagtcgcgggtcaaaggcatga

SEQ ID NO: 23843 - DNA, 345 bp, Glycine max
  Peptide Sequence Number=SeqID_140621
atgtgtagcatgatgacacaacacttggatgtagccaagtggggaatggtgcgaagatccttgtatagcgaaaagagaaatcaaagattatttccaaataaaagattaactgaagaggggagaatgagtgtctcctttgatggtgttcacttgaaaatgctaagcgtcaaaccccttgtggaagcaacattggaaccatccctccctcttgggaggcagatctcaatgccacttttgaggcaaaacccctcaatcttagggaagaataacttttcactgtctgaagaggcgttgactcatcatattttgcataggaagctgacgactcgttcactcttatcatag

SEQ ID NO: 23844 - DNA, 2017 bp, Glycine max
  Peptide Sequence Number=SeqID_140622
atgggtaagaagcctgaatcaaacacaggaggcagagcatcacacaaagagttgaacaaggtcgtgagtggaccaagaagtgctggtgttattggtgaacggggatcaagagaaaattctacttctgaatggtcacaaagggaagatagtattaactggtatgatcagaatgcttatgatagtgaaggttctacagatggcaaaagatggtcatcacagcctcattcttccctagcccatttacatgattcaaagcccttgtacagaacatcttcttatcccgagcagcaaaggcaggagcaacactaccacctccaacattgctctagtgaaccagttcctaactggtttgatcagcatatttacgacacagaaactgctcatgatcatgatggcaaacgatggtcatcacagccacattcctctgttgcgcatttacaagaatcaaagcccttgtacagaacatcttcatatcctgaaaaacaacaggagcttcctcgtttttctagtgaaccaattttggtaccaaagtcttcattcacttcttatcctccccctggtggtctatctcagctgggttctccaagccatagtacaggacacttgaacattccttatcatactggagcagctcagatggtgctatcatctcaaaatcgttctcatttctctaattctgcactacagccgagtgcattaaatcttgggtcacattttggtgtaagcacacgccaatttcctactggttcccatcataatcagcgaatacagaatcaattggtcaaccaggcagggttgtatcctggagatcattcaaatctccttaataatatgttacagcaacaattacaccttcataatggatcagtagctcctcacttgatgactcaattacaacaacagcagcatagactgcatcatcctggtcagcgatctgcaggctacttatcaggcttccagtctcatttattcaatccccgcccttcctctggctcatctgtaatcagcaaatatgaacatatgcatggaattaccgatggtagagatcataaaccaaaatcaactcataaaggtaaacacagtcttcgtttttccctacatggttctgatgccagtagccaaaagagtgacagtggttcatttcagtttcggtccaagtatatgacaagtgatgaaatagagagcattcttagaatgcaacatgctgtgactcatagtaatgacccatatgtagatgactattaccaccaagcttgtctggcaaaaaaacctaatgtggctaagttaaaacatccattttgcccaagccaaataagggaatatcctccacgatcccgtgctaatactgagccacattcatttgttcagattgatgccctagggagggtttcattttcttctattcgctgtcctcgccctcttcttgaggttgaccctccaaacacttctagctctgatcaaaagatttcagagaagcctcttgagcaggaacctaggtttgctgctagagtcacaattgaggatggtctttgtcttcttcttgatgtggatgatattgatcgttacctacagtttaatcagccacaagatggtggaacacatttaagacgaagaaggcaagtcctgttggaaggactagcaacttcacttcaacttgttgacccactgggaaagaatggacacaaagttgggcttgctgctaaggatgatcttgttttcattcggttggtatctcttcccaagggacgtaagctccttgcaaagtatcttcagttgcttcctcctggaagtgagcttatgaggatagtctgcatgaccgtatttcgtcatttaagattcttatttggtggtctcccctcagatccggcagctttagagactacaaataaccttgccaaggttgtttgccaatgtgtccgaggaatggatcttggtgctcttagtgcctgccttgctgcagttgtttgttctgcagagcagcctcctctacgccccattggaagcacctctggagatg

SEQ ID NO: 23845 - DNA, 210 bp, Glycine max
  Peptide Sequence Number=SeqID_140623
atggtggagggcatatctaatcagctccagcaactaatatgtgaaagagaccatgcctccaaaaatcttcgacgtggtagcaaagcgcaccatcggcagctggtctgcagaacaatatgctggcctagccaaaaaatcatgagagaagctttgagcttggtgcatatacaagaaatcatactgcaacgaaggctgagaggaaaatgttga

SEQ ID NO: 23846 - DNA, 2550 bp, Glycine max
  Peptide Sequence Number=SeqID_140624
atggtggatacggatgggtttggaactgggggcgatgttgggggaactcccaagacaggggatcttaggcaactgggaaatgttcccacagccacatgggaattctctgctatgtccaacagtgcatcatccttttttgatgcatcacagtatgcatttttcggttcagacactgctgttcaagaagttgagttgggagggttagatgacgatgatggtttgcttgagtctaatgaggaggagttcattctcaatagagaagaggctgacaatttaaaatctctttcagatattgatgatctgagtactaccttttggaaggttggaagcaggaaagggataaagttgaacaaggttgtaagtgaaccaaaaggcgcaggatttattggtgaacagggatcgagagaaaattctgcggctgaatgggcacacaaggatgatgttcttaattggtatgaccagaatgcttatgataatgaaggttctttggatggcagaagaatgccatcacagcctcattcttctctttctcagttacatgaagcaaaggccttgtacagaacatcctcttatcctgagcagcaaaggcagcagcaacatcaccagctccaacctagtgaatcggctcccaactggtttgatcagcatttgtatggtacggaaactaatcaggatggcaaacgatggtcatcacaaccgcattccaccattgcacacttacaagagtcaaggcccttgcatagaacatctttatatcctgacaagcagcaggaatttcctcatttttctagtgaaccaattttggtaccgaactcctcatttacttcttatcctccacctggtggtagatctcatcaggcttctccaagtcagaattcaggccacttaaaccttccttatcatgctacgggagctcagatggcactatcaccaccaaatcgatctcatttccccaattctgcattacagttgagtggaataaaccatgggccaccttttggtggaaacatgcgtcaatttcctactggttcccctcttaatcagatagtacagaatcaattggtaaaccaggcaggattatatcctggagatcatcccaatatttcatcaggtttacccatgattaacaaatatgaccagatgcttgggctgatggaaatgagggatccaatgccaaaatcagctcaattaggtagacagaatctccggtttcccccacagggttttgatatgggtagcctgagaagcaatagtggatggccccgatttaggtccaagtatatgtctattgaggaaattgagaatattcttagaatgcagcttgttgcaacacacagtaatgatccatatgttgatgactattaccaccaaggctgtctcgcaaaaaagtcttctggtgctaaattgaggcatcacttttctccagctcaaataaaggaactccctctacgaccctcttctaatgctgaaccacatgcttttcttcaggttgatgcactagggagggttccattctcatcaattcgcaggccccgtcctctactggaagttgatcctcccaattcctctcatgcaggtagccccgagcaaagcatttcagagaaaccccttgaacaggaaccaatgcttgcagctagggttacaattgaagatggtatttatcttcttcttgatgtagatgatattgaccgtttcctacagtttaatcagcttcaagatggtggtcttgtgttaaaacggaaacggcaaggtcttctggaaggacttgctacctcgcttcagttagttgatccactgggaaagaatggacgtacggttacacttgctgcaaaagatgactttgtttttctcaggatagtttctctacccaagggtcgaaagctacttgctaggtatcttcaactgctctttcctggtggtgagctaatgcgaatagtctgcatggccatctttcggcatttaaggttcttatttggtggccttccctccgacccagctgcagcagaaactataagtaaccttgcgagggttgtttcgaggtgcattcgtgaaatggatctaggtgcagtaagtgcttgtctagcagcagttgtttatacttccgagccgcctcccctacgtccccttggaagttctgctggagatggggcttcccttattctagtgtctgtgcttgagagggcaactgaacttctaactgatcctcatgctgctagcaactacaatattgcaaatcgttcactttggcaggctacatttgatgaattctttggccttctaaccaagtattgtgtgaataaatatgatagtgtcatgcaatcattccttatacaggggacaccaaatatggcttccattggttcagatgttgccagagctattagtagggaaatgccagttgagctcttacgtgcaagtctacctcacactgatgaccgccagaaaaaacaattacttgattttgctcagcgctctattcctgtagttggatttaatagtaattcgggggatcaaggtcaccatgtgaactcagagtcagtcctgagttaa

SEQ ID NO: 23847 - DNA, 267 bp, Glycine max
  Peptide Sequence Number=SeqID_140625
atggtttggaacccccgcgcgagcagtgctggacgaagcggaagcgagaatgtcggcttgagtaacgcaaacgttggtgagaatccaatgcctcgaaaacccaagggttcctccgcaagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtgggtag

SEQ ID NO: 23848 - DNA, 942 bp, Glycine max
  Peptide Sequence Number=SeqID_140626
atggaatcggaggatttggtgaagcaggaattggaggaattgcagaaacaattggggaagaagctaaaatttgaagcctctatttcgtctctaaaatctcttctccaacgcacttacccatcagcttccccagcgcttcgcaaatccctacgtcaaggttttgaaaaacagtctgcgactgcaaggcttgtggcagttttatttggttatatgccgagttgctactgtgttgaagaccaggctcatttgcttgtttctgaaccttctgagaaggagaagttgaaggcttgcattgctcaggccagggaacatttgcatctagaagataacccatcacaagctttacaaccttcagataatcaggcaaacagaggatatctttttgaggggcaccttacggttgatcctgagccaccacagcctcaatggttggtgcagtcaaacctcttgacaacagctgctacactctttgctgctgaatcctctcaagctccagcagcaaatgaaaccactcaagaggatgccgcaaatatgcttcaagatcttctaaatagattggaagaagttgtgcccttgatggtggatggaggtcctgtagccccaaaagcacctcctgccagtaaagaggttgtggcaaatcttccggtcattactctcacagaggaaatcctggctaatttggggaaagatgcagagtgtgctatttgcagggagaacttggttttaaatgacaaaatgcaagagttgccatgcaagcacacattccacccaccatgtctaaagccatggctggatgagcacaattcttgtcccatctgtcggcatgagctgcaaactgatgatcatgcctatgagagctggaaggagcgtgaaaaggaagctgaagaagagaggaaaggtgctgaaaatgcaattcgaggtggtgaatacatgtatgtttaa

SEQ ID NO: 23849 - DNA, 1548 bp, Glycine max
  Peptide Sequence Number=SeqID_140627
atggaacaacaccaccaccaacaacctcaacccaacaacaatggttccaacaccaccaccaccaccaccgaccctttcctcctcaactacaccacctcggatctccgaaccgcttcggagtttctcgccacgtggctccctttcctctcacgagatctctgcactcgatgcactatattcctctccgatcgcgtccgctccatcgacccaggtgaagcgcctcaagatgacacccccaatgaccaaaacgacatggacgtcgaagataactgcgacaaccattctctcgggagttggaaggacggggcggaggtgaattcttccaatgtggagactccgagccagagaatgtcttgggccgacatggcccaagaagacgacgagtttggcgtagaagaagacaacaacaacaatggtgggaatgttgttatgggtgattcgaatgcttcctctgatgttgccaaggttgagaagcctactctgccgagggaacagagggagtacattaggttcatgaatgtgaggcgaaagaaggactttatctgctttgagagggttcatgggaagcttgtgaacattctcgaagggcttgaactgcacactgggattttcagtgctgctgaacagaagaggattgttaattatgtcgcctcgttgcaggagatggggaaaaagggagaattgaaagatggtaacccacctggtattcttacgaatggaatggttgatcctatacctgatcttttcaaggtcatcattcgacgtctggtcaagtggcatgtactccctcctacttgtgtgccagatagttgcattgttaatatctatgaagaaggggactgtatacctccacatatagataatcatgactttgttcgaccgttttgcactgtctcatttcttagtgagtgcaatatagtttttggatcaaacttaaagattgtaggccctggtgaatttgatggctcaattgctattccgttacctatgggatctgtacttgtcttgaatggaaatggggctgatgtagctaaacattgtgtgcctgcagttcctacaaaaaggatatcgatcacatttagaagaatggatgtggccaggcggccatttgggtatgttccagaacccgatcttcaggggatccaaccattggcctatgaagttgagcaggaaaagaaatcaagtgggcacagacctagtcgtcacacaaacagacataaagtcaggagaggaggtggcaggaatgatgcattgggatctgcaactagaaatgataggttctcagagccccgtgactcaaatctaagttcatcaagatctgcatctagaaatgataggttctcggagccccgtgactcgaatgtaagttcaccaagatctgcatctagaaatgataggttctcggagccccatgactcgaatctaagttcctcaagatctgcaaataggtggagtaggaagcctggtcaagcattcagcattgctagatttgctgggtttagacttgcagcagctggatcaaattacttcgaatttgcttgcttatga

SEQ ID NO: 23850 - DNA, 464 bp, Glycine max
  Peptide Sequence Number=SeqID_140628
atggccaaagtaccccttcctctgctcctgcattccgtcttgtcgatgaacaatgcctccatgaacagtgctttgcaccaagcaccaagcttttttaaatggcacaatgctttatttgcgcattctttcattgttttctctcctctgtgcacagtgcttcttcctcgttccataaaggtgaaggtgaaggcgttgcggtggtcggcggtagcatacgaggtacgcagtgttgggtgtgttcagttctggtgtacggcaaatcgggcgaatcaagttgatccatggacgaggatcagtgaatgtatgaaggtgtttgacagccgagaggatgttctgcgatgggctcgatctgttgcttatgaaaatggatttgtggcagtgattgtaaggtctgacataaacacaggtagtagaggaagaaattcgtttgtgttaattgggtgtgaaaggagtggcgagtatag

SEQ ID NO: 23851 - DNA, 1404 bp, Glycine max
  Peptide Sequence Number=SeqID_140629
atggcttcctcatccttcatcttaggctcagatttcaaatgcatgttctcttcgaggaacactaaaaccatgtctggatttggtgcactgagacatccacacccaaatggtttgttcagtaaatgcttccactttcatactctatctactagaacggtgtcagggactacaaagatggtttctgatgtttatgttggtggagtcacaagtttcagagtcaatagcaagatgtacaccaagttggattcttgtttggtgataccacctaccccaaatcgtgccaagcctcgagctatagtcaaattcctgggtggtgccttcattggtgctgttcctgaagttacttatgggtgggggcaacccttactccatgagctactttttgggttcagtttgtcacgggcaaattttaagatgccacatgttatggaaccactgcaaatgtccagtcttgcaaatttcatgtctgagatgtctagtcttcgacttgaagggagttataaggagggttttcttgttgtggttgtgccttataatgtgacatttgaccattctcaagctgctaaacaagtatatgagaggttccaagcttgtttgggcacaatcctgacatctgggttgcctcaagccaatttgtcacctgctcagcttgaagaccttcctcttttctctattggtcatagcaatggggcacttcttcaagtactcacaggaagcttattttctgagaaaatacctaaggctaatgccataatcgcatacaacaacaggccagcaacggaggcagtcccttactttgaacaggatgcaaaaattgtggaggattgctacacttcgttgagtgctgccctgcagttgggtcctgcagtcagccaaatgatgccagttgtggaggcaactcctttttactcgatagctagaaatgcatcaggagatgtgtggaagatgatgttggatgctgttagatcaactctacaggaaaccgagcaggaaatactgaattcattaactaaatttgttgatcagttaccgtcagtaatgaatgaggttacacaaggagtatcagagttcaagccaacaccatctgaaaaccgtgattgctttaaatgtttatacaatgttgaacacacactattggtgaagttcaattctgatgcaattgatgagacagatattcttgaagaaacactaaagcttcgcgtggagtcattgggtgggacattagaaaaagtaacattaagtggtaaccacatcacaccatgcattcaggaaccgagatggcaggtgggtaaattgtatactccagcagatgctgttgctcaagggcttaaatctctttctttgaatgataccaagatccttgccagaaccattagtgactggttcagacgttttgagggttga

SEQ ID NO: 23852 - DNA, 360 bp, Glycine max
  Peptide Sequence Number=SeqID_140630
atgactcacaaattttgttttgaagcacttgatgaaagtctaagagatattattaaaggtaaatcaagttcaaatcagatctttggaggtaaagttatggtgttaggtggagatttctggaaaattctaccagtcattcctaggggcagttgctctgacattgttcatgcaacaataaattcctcttatctatggaatcattgtcaggtattaacactaacaaaaaatatgcgtttacaaagcaacacacaagcaacagataaagaagaaattgccacatttgcacagtggattttagacattggagatgaaattattggaaatccaaatgatggttatgctatagtggaaatcccataa

SEQ ID NO: 23853 - DNA, 303 bp, Glycine max
  Peptide Sequence Number=SeqID_140631
atggaagaagcaaaacctatttcttctcctatggttggaggctgcaaactgactaagacaggttctgaagatgtctctgactttaccctatatgggtctgttgtaggggcacttcactggcttccaccaaacatcctttctccattcatgcctactgtaatgcaacttaggcctctgatcttgatgataggaggtccacatctagagcagctatcttccttagttcaaactgaatttcctggtggtccaagatgtagactgttgtcccaagatccagcactaaggctgaatatagaagcatga

SEQ ID NO: 23854 - DNA, 294 bp, Glycine max
  Peptide Sequence Number=SeqID_140632
atggattactgtgaatacgatgctttactcagaaatggcacttggactctagttgacttgccacctttaaggaaagctattggctgcaaatgggtcctcaagattaaggaaaatcctgatgggacagtcaataaatatatagacaggcttgttaccaaggtggctccacaacagctggatgtgaagtatgatttcctcaatggaacccttcaagaggaagtctatatgactcagcctttgaatcctccaacaggcggcttgtgggttgactgcacaaagctatttatggcttaa

SEQ ID NO: 23855 - DNA, 321 bp, Glycine max
  Peptide Sequence Number=SeqID_140633
atgaataagcaagtaccaaagaattgttctaggcatgggagtgataaatatgtaaagtttgatgttcatattgatgatgatgaagataatttgagtgaaccagatcataaagagtttgtgggaacttttgttaatttgttccatggacaaggccataatatcaaagtaactagttttaaggtagggatatcgaaagtgcttgattgtttagaagctgaagaagacgatgttgtgctagttactttggtgcctaaggttggaaaaagagatgtcatcataggaggcatcaaagttgagtttattccaaagtacaaggattag

SEQ ID NO: 23856 - DNA, 658 bp, Glycine max
  Peptide Sequence Number=SeqID_140634
tttgaagcatattgtggaagaggttgttagcaagacgaaggcggccgaatttacaatagttatggatgagaatggtccaaatattgacagagaaattgatcccgagagtggtcatgagagcgaagagctgagaagcctgtgggaatgcattaatcttgcaaagagaattgagaagcatctgaaaagtgagaggagagggagaatagccatcctagagcataagtctgagcatacgagcgatgtgagggaggagcgaaatgtggaaggtgaagaaattaggggaatgagtgtggttgaagagagagagagtgagggtgagagcgagatgggagtgaccgaccctaaagagagcatccatgagcaaattacgagcaaaggtatcgggaacaaaagcgtaagaggcttgcaagtggtgataagcctccaagagcatcgcatacatacccgcacgcgagtaaatcctcaacagcaccaactgagatatagggtttgtgagagaggcacagccgatggtctccaagggaatgagtcatggcagcgacgttgggctgaccaaaggaaaagggagagggcaatcaaattagatggacatctcgacaatgtctcgttgttcactgtattcctcctccgccatatcgatgatgaatgccatgagtga

SEQ ID NO: 23857 - DNA, 351 bp, Glycine max
  Peptide Sequence Number=SeqID_140635
atggcggaaacggcttgggagcttcacttgggaggcgaagaagaagaagaagaacgaagaagatgcaaaatcttgaagaagaagcaaaagaatgaaaactcaaagaagaaatctcaccccaccttccaagtcttgacccttcttcctcccacaaatcttttgcaagatcaacccttaagtgacaagaatgtcattattggcgtcttcgtcttccttgtctgtggccctcttcatcttccttgtccgtggccctcttcatcttccttgtcgacggcaaaggagagagaatgggagaatgagagaatggtgcttgctacggtagtggaagaaaagaaaagaggaaaggaatga

SEQ ID NO: 23858 - DNA, 168 bp, Glycine max
  Peptide Sequence Number=SeqID_140636
atgcctgatcttcgattccaagttggggatttggctgagtcaggatgctttcaaggtggttatcgtggtgcatggtttagatgcaagcatagcaacctaaataagaagagaatttttggattggcattggcttcttatgagacacttttatcaaatgtgcattactaa

SEQ ID NO: 23859 - DNA, 268 bp, Glycine max
  Peptide Sequence Number=SeqID_140637
caccatctgcaacaccacccatgggttatccttccaaggatggtcctgcagctgtagggtacacccaacacaaagacttccagaggaaaccaaaaccaggggtgatggattttgagaggaatgcagtgactgcatatccagcaggggctcagagcaacctagcagctccaccaccacctgtaggttatcccactaaggatgatcttccttcccaacaaaatgttcctgtcaaaaccactaccaggggtggtggcttctggagcggatg

SEQ ID NO: 23860 - DNA, 1719 bp, Glycine max
  Peptide Sequence Number=SeqID_140638
atggataaactaaagacttgtcttacctctgccccagtattagcactcccaaattttgacaaggattttgtgatcgaatgtgatgcctcaggacagggaattggagctattcttatgcaagaaaggagacccatagcttatttcagtaaagccttgggagttagaaacctcaccaaatcagcatatgagaaggagttgatggctgtggtgttagccatacagcactggagaccttatctgttgggaaggaaatttattgtctctacggatcaaaaaagtctgaaacaattgctgcaacaaagggtggtgactgctgaacaacaaaattgggctgcaaaattattgggctatgattttgaaattgtgtataaaccggggagccttaatagaggagcagatgccttgtcaagggtgaacgaggatggagggctgtgtcagatacatacaagggttcaatgggaggaagaggagttagtgaagcaggaggtagcagcagatcagcatctccaacagataatcaaagacttacaggaggatgaaacgtctaggcctggctatgaatggaaacaaggagtgttgttgtatgaagggaggttgtctaagtacgctcattttgtcccattaaagcatccttatacagcaagagtaatagcagagacattcatcaaggaggtagttagactgcatgggattcctttaaccattgtaagtgacagagatcctatatttatgagtaatttctggcaagaattgttcaagctccaaggaaccaagctgaaggtcagtactgcttaccatccagagacagatggacaaactgaggtgatcaatcgttgcttagaaacatatttgaggtgtttcattgctgatcagccaaaaacatggagtgtgtggatggcttgggcagagtattggtttaatactagctttaatgccagtacgggcagaactccttacgaagtggtatatggaaggacccccccttctattacacgttgggtacaaggagaggtaagggtagcagcagtacaaagggagttaattgatcgtgatgaggcgttaaagcagcttagggaacagctattaaaggcacaggatagaatgaaacagctggcggacaagaaaaggtgtgataggagctttgaaataggagagtgggtctttgtcaaattgagagcccaccgtcagcaatctgtggtgagcaggatacatgccaaactggcagcaaggcattttggtccttatcctatcatagctcgtataggagcagtggcctacaggctcaaactacctgatgggtctcgagtgcacccggtttttcatgtgtctttattgaagaaggctgtgggtaactaccatgaggaggaagctttacccgagttagagggggaaagtggggtattgattgaaccagaggaggtacttgctagcaggactgttcaagtacaaggagaaaaggtgaatcaagtactcataaggtggagagggcagatggtagatgaggctacttgggaggacaagattgctatgaagagtcaattcccaacattttgtcttgaggacaagacaatattttctggagggagtattgatagatcccgtactcaagaggagggccctaatgaagccttagcccatcaccattccactgtgggcccaaaggtgtggtacgtttattctagaaggaagaagaatgttgccaatccaaatgacagttag

SEQ ID NO: 23861 - DNA, 261 bp, Glycine max
  Peptide Sequence Number=SeqID_140639
atggttctagagagacatgtcgtgtctgtgtttgagaatactagtcctctaattctggaaccaggacctagtttagttggatgggtgagaatgttcccttccctgggatttcaagctaagccctttaaggttacatgctttcctgcgtacatctcttatgatttcccggttgcaatcattaaagtgcaacttcctaaacagaacatacaatcaagcaagttacaagaactaccaaatgtgatccttgactcttactactaa

SEQ ID NO: 23862 - DNA, 1334 bp, Glycine max
  Peptide Sequence Number=SeqID_140640
atggacgaaagaatcgcagctctagaaggggagatggccggagtaaaggcttccttgtcgtcgttagaacagggccaagctacgctcatagccatgttcgaaaagagtttaggcaaggggaaggagggaggagtcattgttaatggagaaacgccggagacggaatctgggcaaggatcgaaacctcatcctgaagcctcaaaaacgggaccaagcaacgacgaagccttgttggagtttcgtcaagcggtgaagaaggtcgagttacccatgttcgacggggatgaccctgcaggatggattgctcgcgcagaggtgtactttcgcgtacaagggacaagaccggaggtgaaggtttgtctagctcatctctgtatggaaggagcaaccattcattttttcaactcattaatcaatgacgaggaagaattgacatgggagcagttgaaggaggcgttgttggagaggtatggagggcacggtgatggtgacatttatgaacaattgacagagttaaggcagaagggtagtgttgatgattatatcactgaatttgagtatctcacagctcaaattcctagattaccagaaaggcagttccaagggtattttttgcatgggttgaaagaagagataaaagggaaagtacggagtatgtcagtcatgggaaatttgtcccgtgcgaggcttttacaggtagcaagggcggtagaacgagagacgacgcgtgatgggtcaagttcgtccagatctaacaaattgggctatgggtcaaaccgatttgggtcgtctgggcccaataagggagggatttctgattgggtattagtgaaggggagtaaggaagcaacacccagaacaaatggacctgtgcctcgtggtgaaaagccgggtcaaaccgaaagaagaaacgggccaagagatagaggatttacccatctttcttacagcgagatcatggagaggcgaaggaaaaatcagtgtttcaaatgcgccggtccgttcggtccaacacaccaatgtcctgacaaaaacttgcgattgttaatcaccgaagatggaggaggcgaggagagtgagctgctagcggtggaagtggaagaaggagatgaagaggtcgaaggagagataagcttgatgagtttccaccaactcagtcagacgcaacaagccaagccccaatcaattaagctgaagggtactatccatgaggtaccagtggtgattttaattgacagtggagctacccataacttcatctcacaacaattagcccaaaagatgaatttagttaccaccaacacttcacctctcaacatcagattaggtgatgg

SEQ ID NO: 23863 - DNA, 4020 bp, Glycine max
  Peptide Sequence Number=SeqID_140641
atgtattattttagattgaccttgcttttggggcctccaagatcaggaaaaactacactgctgcaagcacttgctgggaaactggacagggatttaagggttggccatcctcttgctccatttttaaggaacgatgcaatgatatcttcctacatattgtacttctcacctaaggatcatagacaaggaagttcggtatccggaagagtcacttactgtggtcacgaattatcagaatttgttcctcaaagaacatgtgcttatattagtcagcataatcttcatcatggagagatgacagtcagagagacgctggatttttctgggcgctgcttgggagttggaacaaggcatgagctactattagaattgataaagcgagaaaagcaagcaggactcaaaccagatccagagatagatgctttcatgaaagccacagcagtggaaggtcaagaaacaagtctcattacagattatgttctcaaggttcttggattggaaatatgtgctgatactttggtgggagatgagatgaggaggggaatatctggtggagaaaaaaagaggttaactactggtgaaatgttagtaggaccttcaaaagttttcttaatggatgagatttcaactggtttggatagttccacaaccttccaaattgtcaagttcttgaggcagctagtgcatgtcatggatgttacaatgataatctctcttttacaacctgcaccagaaacatttgacctctttgatgacattatcttgctttcagaaggccacattatctaccaaggtccacgagagaatgttctcaatttttttgagagcgtaggcttcaaatgccccgaaaggaaaggaattgcagactttttacaggaggttacttccagaaaggaccaagagcagtactggttcgcaagggacaaaccatatcgatatgtcagtgtgcccgagtttgtagctcacttcaacaattttggcattggccaacaactttcccaagagcttaaggttccttacgaccgtgccaaaactcatcctgctgcattggttaaagataaatatgggatctcaaaactagaactcttcaaggcatgctttgcaagagagtggctactgatgaagcgcagtgctttcatatacatatttaagactactcagattatgataatgtctttgattactatgacagtgttttttaggacagaaatgagaagtggtcaccttgaagatgggagaaaatattatggtgcattgttctttagcctcactaatataatgttcaatggaatggctgagctttcattgactatttttagacttcccgttttcttcaagcagagagattcattgttttttccagcatgggcttttgcaattcctatatggatctttcgaattcctctctcttttgtggagtcagggttatgggttgtccttacttattataccgtaggatatgctccagctccaagtagattttttcgtcagttattagcattcttttgctctcatcaaatgggtatgtctctgttccgattcattgctgctcttggaagaacactagttgtggcgaacacatttggtttctttgtactgctacttgtttatgtgcttggggggttcattattgccaaagaaaaccttgaaccctggatgaaatggggctattatatttctcctatgatgtacggtcagaacgccattgccatcaacgaattcctcgacgagagatggagtgctcccaacacggaccatagaattcctgagccaacagttgggaaggctcttctcaggattagaagcatgtttactgaagactattggtactggatttgcattggtgctctccttggcttttctctgcttttcaacatttgttttataattgctcttacatttctgaatccatatggagattctaaatctattattctagaggaggagaatgagaaaaagggaactacagaagagagttttgcttcaactgataaaccatttgaagatgccgacattgacatggcagtaaaaaacacccgagagagttcaactcccaaagcaggcactgcaacaaccaagaggggattagtgttaccctttaagcctctatcacttgcttttgatcacgtgaattactacgtcgatatgccaactgtaaattctacacactctagtcctaatttaatcatcttcaactgttatttcagcattgtttttagccactttcttttcctgtctgtgacaattttttcataccaggaaatggaaaaacatggagttgaaggtagtcggcttcaactactaagagatgtcagtggtgctttcaggcctggagtactaacagcattagtaggtgtaactggtgctggaaaaaccacattgatggatgttctagcaggacggaaaactggtggttatattgaaggaagcatcagcatatctggttacccaaaaaaacaagcaacttttgctcggattagtggatattgtgaacaaaatgatattcattctccacgtatcacagtgtatgaatctattctgttttctgcttggctgcgtcttggtaaggaggtcaagagagacataaggaagatgtttgttgaggaagttatgaaccttgttgagctacatccagtgagagattttcaagtaggccttcctggcatagatggtttatcaactgaacaaagaaagagactcaccattgcagtagaattggttgccaatccttctatcatctttatggatgagccaacctccggccttgatgctagagctgcagcaattgttatgcgtgctgttagaaacacagcggatacagggagaactattgtctgcacaattcatcaaccaagcattgacatatttgaagcttttgatgagctgcttttgatgaagagaggaggacaaatcatatataatggtcccttaggtcaacaatctcagaagcttatagcgcactttgagactattccgggagttcctagaatcaaagatggttataatccagccacatgggttttggagatcactactccagcagttgagagtcagcttagagtagactttgcagaattctacacaaaatcagaattgaggaatcaagaacttattgaagagctaagcacacctttagagggaacgaaggaccttgatttccctactaaatactccctttcctttattactcaatgtatagcttgcttctggaaacaacacttgtcctactggaggaatccacagtataatggcatccggttattcatggcagtaattataggtgttatttttggactcattttctggaaaaaaggaaatcaaacagatacggagcaagatcttatgaatttaatgggagctatttttgctgctgttttcttccttggaggctccaacacttccagtgttcaacccatagttgcaatagaaagaacagtcttctaccgtgaaagagcagctggaatgtactcagctctaccttatgcaattgctcaggtggcaattgaatgtatttatgttgcaatccagacatttagctttagtcttatccttttctcaatgatggggttcctttggcgagttgacaagttcttgtggttctacttcttcatgttcatttcatttgtctacttcacactttatggcatgatgactgcggctctgacaccaaatccccaaattgctgcaattgttatggccttctttctagtgttttggaacatattctcaggtttcattatcccaaaatcgcaaattccaatatggtggaggtggttttactgggtatgtccaactgcctggagtttatatggcctagtgacatcccaggtgggtgacaaagatactccaattctggtacctggaacagaatcaatgacagtaaaagcattccttgaggaagagtttggctatgaatatggcttccttggagttgttgctgtggctcatattgcttttgttgcattgtttctttttgtttttgcatatagtatcaaggtctttaatttccagaagagataa

SEQ ID NO: 23864 - DNA, 2991 bp, Glycine max
  Peptide Sequence Number=SeqID_140642
atgcaatataataggcggcgcgaggaagagcacggtgcaccgcaccgattcgaatcgggacccgacccgtttcggagaaatcgtcgagatgggtcggacccggtgcagcagaggaaggtgagtcctttgaaggtggatggggtgagaagggttggtggtggtggtgggaacaaaggggcttctgatgggtttgaagggagggactatgaatggcagcacgtgggtggtggtagaaggagtgctagggttcggtcaaggtcacctcctgctgaaccagtgaggaaaaggtcacactttgatgatggggttggccataatagaagttgctcaccaccaccaggcttgagagcaagatatgagttgtcaaaaaccacggattactctgttgatgatggaaagttggatggaaagcgcgtataccttgatagagagaaggacttgaatgagggcaggttgggtggtgggcagggtagtatggtggatcagaagtttgtggtacgtgaaaatgaagttggaggatcctatagatatcggtctattccatcagatatgggtgtaagcgtgacaacacggtatgaagaagctagtgagcacttgcctccaccgccaaggggtgtgccagcagggagatttgagcatgagcgactacatcacagagatggtccacctatggacaagatgcccatcacagaatcccacagtggggctgaaaaaactatactacatgctagggatgtttcgtattctgctgtatctccctcttatgctaaggattttgcaggcccttctcacatgagggattatggaggctcctccgtagaaatgtcaaggggtgattttctatgttcacatggtgatggcatctgtatacctgcatcttatgatctatcaaggaacagcaggaaacttgcagaacctgtagggtttactgggcaaagggcaattatagacactgttagaggtcctgaaattgggccaaggaatatgacatgtcaccaacgatgtgagtttagtcctaccaggactgagcgtgaggattatcttaattacaaattacaggtaagagcaacacaggatgagcgtttgtatcagtatgatgatttacctagaaggatagctcctcatggtcgattggactatgagcaatctgtaacagaatatgataatagggaattttccagaccttatattccacatccagatttacatagaacaggtaagagtgaagattcttatggcaatcaaagaagggctattgtacacaatcattctgcattacagaagccaaagtattttgactatcatgatgtgagaagaacatcaattgcatcgattcaaggtgaggcttatatgcgatctggatatagtcattttgaaaatgggaagagaatgccacaagactatgaagtttcacatttgggtgcacctgaggctgatcgattaccaaatttaagaacagaatatgaatctcgaagagatggaggtcctgggctccagcaagaaagatttcaaagtccacctttgtctaaacataattcagaaacctacagacaaggtgtcagggtgcaggaaatgagacaggatcttggcattcatgaccattcagatagacttatgaaaagaaaatacaatgcaaatgatgaaatagatgtgcatgatttgagaacaataaaatcaagtaaatggggtgcaactgaagaatttcaagatgcatatgaatgtgaagagtgggtagatgacgaagatatggatatgttgtattcatctggtaatgttgaatttaaccctaagatatacaggaagtataagaaagaatatgatgagttggagaatggagaagattttccatctgatgagtgggttatacctcaaggttctatggaacatgtacaaaggcattcatttcaatttcggaagtattccaatcaaaatataaagcatcacccaaagtctagttcttcaaattggtataaaccccagcatttttctaagagaaatgcaattcaaaagcagcctaaagtttggaaaaagtatcatggatatgatgagaataaacatgcagctaatgatgaatcatctgaagattggataagtgctgcagaatctgacccaactgagggctccgaggagtttaatcaaatggtacatgaaaatttcttaatgtactccaagaagttaaatctgaacttatatgtgcaaagaaggtaccaggaccagggaaaagcgggtagtttgtactgcatcgtatgtggcagaagatatgtggacggtttgaatagcaccaatcccatgacaataggaccaaacatatgctcgtcgaaagaattcatggacactcaacgcctagtaactcatgcttttatgtcccataagactgggttgagagcaaagcacttgggtcttcacaaagcaatttgtgttttgatgggatgggatactgttgttcctcaagatacagtaacttgggttccccaggtcttgcctcaggcagaagctctggctcaaaaggaggatttgattctttggcctcctattgttatcatccataacatatcgatgtctgatgacaatccgcaaaactggaaggttgtaagcatggaaacaattgaggcttttctaagaggcaaaggttttgtgagaggaagaattaaattatgcttagggaaacctgcagatcaaagtattgtattggtgaaattccttggcacgtttggtgggctgggagatgcagagaggcttcataaatatctttcagataataattgcagtagagctgaatatgagagagtaaaatctgaaggtattaaaagctgcaacacgggagagacagatgagggagacaaagtggagaatattctttatggttacgtggggatcgcagaggacttggacaaactagatttcaatagtaagaaatggagtatggtaaagagtaggaaggagatcgacgacctagataaagctcctgttaaaaccgatgaaaagcgatag

SEQ ID NO: 23865 - DNA, 193 bp, Glycine max
  Peptide Sequence Number=SeqID_140643
cgcacccgtgagcctcgcctcgctcgcccgcaaaagggcatgttgcgacaacggccatgagccatgggcgcctgtatcaacaaaggataaagaacgcattcgacaagagggggctttggtgctcaccaacatggatggcgaggagctaccctcacccatgaactccgatgttgtcaagcgatactacacttaa

SEQ ID NO: 23866 - DNA, 144 bp, Glycine max
  Peptide Sequence Number=SeqID_140644
atggtgaatcaaggaattagtgtctatggaaaaaaaagaaagcatggatcaacatgtgttgggagtgtgataaagaatccagaaatatttgctagtgtccctactctacttaagggacttagtgatcctaatgagcatacataa

SEQ ID NO: 23867 - DNA, 279 bp, Glycine max
  Peptide Sequence Number=SeqID_140645
atgactaaggagtcatggaatattatcgttagggtcctccgcctatggtttgttcctagtttgaatgggaaaggtcttcgactttcaatggagatggttcttctcaggatgaaaggtgataagatccatgtctcgttgagaaaaactctcatttacaagtttataaaggatataaaggaggacttggtctataaagtgggtggtgatcaggtggttttgcagcagtttaaagttcttaacatgccaccaatgcctattcttccactgcatacattgtaa

SEQ ID NO: 23868 - DNA, 555 bp, Glycine max
  Peptide Sequence Number=SeqID_140646
atgcatggggcatgcagccaaaccgctagaaccactggcgagtttggtctccgtgaaagactcgccactgccagtgacgatatgtccatgcaaggaagaaatcgccattcgaactggcaatatgcacaactcatagggaaccgccagtcaaactggcaaattctaatagctgagggtgcaggtctagccttgcttctcgcaggccatggcagtgcagcagtgcagacgcgtcagggggtgcaggcaaaatcgccactaccattggcggtttgccttgcactgggatcgccagcatggctgacgggttgcttcagtttgaaaattttggccctcttccattataaaagcagaagctccgagagtgcacagttgcgcttccttcctttgcttccattgctttgtttcttcttcataagttcctccattagactgactgtgttcttcttattttgttgctgtcttttgtttttgggctgtgctttgttctttaagtggtttcacttcttgtacatggtttctctcctcttcatattacgtgacttctgtgcttggtaa

SEQ ID NO: 23869 - DNA, 174 bp, Glycine max
  Peptide Sequence Number=SeqID_140647
atgagcagtcactccaatattgagcaagaagcccctgtatcatatccagcaccttctgccacaccacctatgggttatccttccaaggatggtcctgcagctgtagggtacacccaacaaagacttccagaggaaaccaaaaccaggggtgatggattttgggagggatggtga

SEQ ID NO: 23870 - DNA, 291 bp, Glycine max
  Peptide Sequence Number=SeqID_140648
atgcccacatgcatgaccctccagttagctgaccgcttcattacatggccatatggagtcattgaagatgctttggtgaaggttaagcaccttatatttccagatgatttcgttgtcatagatatagaagaggatgttgacattcctctcattcttggccgcccattcatgtctattgcaagctgggtggtagacatgggaaagaagatgttgcagatgggcatagaagatcagaagatcagctttgatttgttccatggggacaaagatccatctagccaaaatgtttga

SEQ ID NO: 23871 - DNA, 300 bp, Glycine max
  Peptide Sequence Number=SeqID_140649
atggaaagaggcattaaattgatactggctcccaagtctatgagaactttgcctacagtgacctcacctatagaatacggtatcgtgagcactccaggatctttgtgcttaggtgtagaagcaaagcttcatggtgaatcaaaggtgattcaaaggtgttttgatgataacaaagatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 23872 - DNA, 354 bp, Glycine max
  Peptide Sequence Number=SeqID_140650
atgcatcagagctttatgtctgagataacactggagctttgggagtgccgtccagcaaccaacactctcgagatcctaagtgcgttactagcacacttgtcacctattagggcccaaccatttccaccactccacttgtcacacaaagcaatcaaacaacataacaactataattacaaccatctaacatttataacaaacaatttatcgagggtcggacacccccgaacccaaaccacaacacatactaatgtggcttcatgtagagcttgtaggccttggatcttcttcatcaatggagtcctttgcttcttgaagatcaatggaaacggaatggagaaggaggaaagatga

SEQ ID NO: 23873 - DNA, 723 bp, Glycine max
  Peptide Sequence Number=SeqID_140651
atggtggcaatagatgcgagagcgacaaatttctcaaggcttgactttgctcgagttcagggaagaacgattcatggaccaagatgttgttcttctgtgatgcaaagggagtctagtgtttctgattgtttagtacatggtgtggaatgggaagaaggtcttggctcagaggaagagggggctgaaaaaaggtgtacagaggtgtgtcaagctacattaaatgaggaaaggacaaaaaggcattgtgaaagaacaaaagaaagggaacatcatgttgaaggtggagacataacaataaaagatattttgcacacaaaaggaaatttgggcaacaaagatagcctaaaggataagagactaggaggagataggtcaaatgagccaaaggcattgaagacctcaacttcagaacgactaggtcaaagagggagagaggcacaaaagaagagcgagaaaggtgaaaaggatatcgtggggtcaaattttgggagaaaagatgagggcaaacataggggaactgctacaaaaaataaaataaaagggggtcacaaaaaagagggtggtaatagtaaaggagaatctgaagatcatggggtgcagacagatttgagtcatgggtcgtgcaaaggaaagaaaattgagaatcctcagttgtgtttgagcccaattgaaagaagaaagcagacagaaagaaataagggggtcacgaaggagggtatttag

SEQ ID NO: 23874 - DNA, 306 bp, Glycine max
  Peptide Sequence Number=SeqID_140652
atgccaaagctaagcaagcctaacaaaggtccggtgggccataaaggcacaatcagaagcaatttagagggaacacgaagccctaattcataccaagtcagtcgtctggaggaaattataccccaaagaagaattttgctagtagttctaacaatgtttcaatcaagtgctttagatgcaaaggaatgcatatggaatgtcagaagtgttgtaaagaccaatggcggagggccgaaagtagccagattggtgttagcgatgagtggaactgaggctattgcatctgacggcctaagtgcatcataa

SEQ ID NO: 23875 - DNA, 759 bp, Glycine max
  Peptide Sequence Number=SeqID_140653
atgggtataatctcagggactaaattgcctattcactcatcttgtgtcccaaaaagtaaaaagaaaggaggaaaaaagggatgtaagaaacaaattggggtgggtgctagggatatggatatgttcaacaaattcatctttgatatgggggtggaggatctcccaacggtgggaagaaagtatactaggtataggttgcatggtcattctaatagtagactagatcgcatccttgtctctgatacatggattgatatatggctgggcagcatacaatacatccttaataggagtttttcagatcgttgccttattgtgatgaaaattcttatcatagattgggagcccaagccatttaaaactctaaattgttggttctcggaaaaaggtttcttagaaatggtagagaaatggtggtgttcatacaaagtacaaaggaagaaagaatttgctcttaaagagaaattaaagctacttaagagggatttaagggattggcataaagaacattttggggagatagaaaagcaagctttggaattggtaaagaagattcgagtgttggatttgaaagatgaagaggagggcttggaggagatggagcttatgaggaggaggaagcacttaggggatattttgagattatctagaagactagaatctattattcaccaacaatcaagagctaagtggctgaaggaaggggatggtaatactaagtatttcaactccttggaaagatggataaaaaagatgtga

SEQ ID NO: 23876 - DNA, 1464 bp, Glycine max
  Peptide Sequence Number=SeqID_140654
atggaggtggatacattcaatgcgaaggacatggaaaggggctctacagaggctgagcttctaaggaatgcgttagaggagcaagcatgcgatctccacaccattctctcacacaaaatcaaagaccttgaggctctcgccatggagtgcaaccaagcccttaagaggttgaagattgggaatggaatacaatatttgttgaatgccaaggagactactcgtgctgagataatgggaattgatcacaaactctcaatctgcaatgcagggcattttaatgaggatgagtttgtgcttaatccattcattagaattgggcatatcccaagtctaagtgatagagtgctagaccagaatgtaggcttgaattttgaaacgctcaggatttggaaagtgtatgtttataagaagaggaaaactactgagaagaggattaggagaatgctaagttcattaagttggcagtcttcggtgcttcattcacaacctaagccaaatgtgggaactccgacatatattgctctagaactaataaaagagcttaattatgaaggctcaagagctgatttcgattgtagtgatcttgatttctccataaaagtgataggtgttgaaataacacgtgataatgatgatctagcaatgagttcacgtaatgtgtatctttcacctgaagagagggaaaagctaggaaacaatgatttctttcaatcctttcaggcactatcaataaataaatcattgttaagagctaaatcatcagcagaagctggtcaagtgcattcaaagaagttgagaaatttggtcgtccaatctattgacatacattttggctattttgaagcattagtgcagaaggtaaggtgcagtgctacagggctttggatgggtgttgaatggtttccatgtaagcttgtacccttgaatattaagagagattatctaatagatgtcaaaggagttgtgacaactatatcttccattagagattccattagagagtatttcaagggtggaaaatcattgaagaggatatttattgaagtcaattattcatcgtatgggacaagaaaatctactgtttcagctgaggcagagaacaacaatgtgaagaaggaagaaaacaacaatgataacaacaacaactactacaatgaaagtaatagcaaaatcgagaattcgagtgagtgtctaagcaaggccaaacgtcaaatgaagacgccgtttcaacttgaaacactcgagaaagcttatgctgaattactcgttggagactatgagggtggagttgtcggagaagttggaattgtcggattggcagttgcagatgtggttctgtcaccggtgattgaaggacaagaaggagttgtcggcaaagaagccgcaaaaggcagcggcgttgccggattctccgatggaggagcccaagttggtttttatgggatatgcaattcaaccatttaa

SEQ ID NO: 23877 - DNA, 384 bp, Glycine max
  Peptide Sequence Number=SeqID_140655
atggtggcgaatgcagtgctatcgggaagggccaaagaggcgccaatggtgaagaatagcaaaacttggtgtcactggtggcgtttttgctggtgtcgagaacctaaggttcttcaaatcatagagagattcagggagaggaccgtatatccggtcgggagtgagggtgaacacgacgaatgcggagagctctccaacgtcaaggccgaggcagccggtgacactgggggaacctgccatggtgttgatgaggttgagcatgatggcattgttgaagttaccgacgaagatcttgagtattgctatagtaccgccattgttgtcccctgcgtggttggtgccttgagtagtgctacaatactctcacataagatggtcaaatga

SEQ ID NO: 23878 - DNA, 728 bp, Glycine max
  Peptide Sequence Number=SeqID_140656
aattacccgtcgaagactatgagggtggagttgctgaagaagttggggttgtcagatcggcagttgtagatgtggttttgtcaccagcggttgaaggacaagaaggagttgccggcaaagaagccacgaaatgcagcggcgttgctggattctccgatggaggagcccaagttatcatgggtcaagctgttgtgcaaaggtgcaaagcaaatgtcaatttccatgatgaagagaaacctttatatcctccaacaggatgcagaggtgcaccattactttcaccctaccttgtaatcaatgaagatggacttccctatggggctgcacttcatgcatcattggccactagttatcttacaaattatcagcaagacatagccaggactcagaactttgtgtgcaagttactggaccggagtcatggagtagtttggaccactacagctccaccaagtggacctttgactttaatatctactggacaagacaattacaaggatgaagaatgtttatcactccccaccattcaatgggaaacacttgcttccaatcttgaagatgtttcaaaagtagttgaaaaatttgcaatcagcaagtctgctgtagaagttgctgttagcatgaaacttcaagatgatgctattcctgctcttgaaaagcttcggaagcactctaaacctttctattcaagagactatggtcacaaatattttactagggaagaatga

SEQ ID NO: 23879 - DNA, 326 bp, Glycine max
  Peptide Sequence Number=SeqID_140657
atgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtcatttcgggacaagcggatcatttatgatgaagaggatgagcttcaagagaatgattcagagttcttgcagggtggaaccatgca

SEQ ID NO: 23880 - DNA, 309 bp, Glycine max
  Peptide Sequence Number=SeqID_140658
atgaccccagatttcacctccactcctttatgtttccagggaccccagtccccagtggagtcgccaactgtcgcagccttcccttcggtgggaaggcgacgcggaggttcatgggtgcgtcatccaagggaggaaggcgtgcggagtcgccaccaacgtttattcgaggaaaacgtcagaaaaataggaacgtgtggtctaccaactttaatcgtgaaaggttcgggagttgtttttacgcacagggaagggtgtttccctcgctcctacgtattcctcaattgcgatgaagaaatcaaacctatgtag

SEQ ID NO: 23881 - DNA, 527 bp, Glycine max
  Peptide Sequence Number=SeqID_140659
ttaatgtctatgttccaaaggatagagtcaccaaccaacatcagggttatggatttgttgaattccgcagtgaagaagatgctgactatgccatcaaggtgcttaacatgattaagctttatggcaaacccatccgtgtcaataaggcatcccaagataaaaagagcttggatgttggggcaaatcttttcattggcaatctagatcctgatgtagatgacaacctcaaccaaattcaagacttatacatgagtgtcaccaaattatacacgaagtcgtcgacaacctcaaccgtggaattgccaccaccaatctcagcctcagaagcccttatagtcaacacattatgcgcgcttggcttggccttcgccttctggattgcgaacactgtctactccatcgaactcgttactcatccttctctcacactcttcttcatctggattacagagctccccattgtgacccttctatacagtcgatatcgacaaaatcggaagcaatgcacggtaacgcgtgttccttaa

SEQ ID NO: 23882 - DNA, 252 bp, Glycine max
  Peptide Sequence Number=SeqID_140660
atgaagaacagtatcaaacatccaaaggtacaaacaaaaaatgtagatcaccctttccgcgatgacgagaagctcgcttccttgggagaaagccaagggaaccatgtctcgggtgctcgaacttccgatacccttcatccattagaaacttcccaacggcaacaacttcaaactactagccttgaacaagttcaaatcatccaccccaatatcacaacctcccctcaaacaactccatcgactccactctaa

SEQ ID NO: 23883 - DNA, 1416 bp, Glycine max
  Peptide Sequence Number=SeqID_140661
atggcttctgtgcaaatcctctgtgcatgcacttgtcaggttcaactccagggttccattagatatagatatgattatggttacccccatcaccatgacaagatcagtaagcacaggtattattctatcagagtagttgatagtgggaatgagatggttctttcaaatttagaggaagagaaaaggaagttgagagtgttggtggctggtggaggaattggtggccttgtgttggctctggctgcaaagcatagagggtatgaagtgaaggtgtttgagaaggatttgagtgctgttagaggagaaggtaggcaccgtggcccaattcaactattgagtggtgctcttgctgtgttggaaaccatcgatcagagtgttgcaaggcagataatggaggctggttgtgttactgccaataggactaatggccttgctgatggtctatctggggactggttcagtgtgtttgatcttttcactcctgcttcaaggaaaaggcttcctcttaccctagtcatatgtagaatggcactgcaagatatattagtgaataaagttggttccaacataattagaaacaaatctaaagtcgtggattttattcaggaacctaacaaggttagagtgatccttgaaaatggagagcaacatgatggtgatattttaataggagcagatggaatatggtcagaagtgcgttcaaaactctttgggcagcaagaagcaaattactcgggtttcacatgctacagtggattaacaagctatgtgcccccatatattgataccgttgggtatcgggtgttcttgggcttgaaccagtactttgttgcttcagatgttggccatgggaagatgcagtggtatgctttccatggggaacccccttcaagtgaccctttcccagaaggtaagaagaagaggcttttggatctctttggtaattggtgcgatgaagtgattgcactcatatcagaaacaccagaacatatgattatacagagggatatatatgacagagacatgatcaacacttggggaattgggagagtgactttgttaggtgatgcagcacatccaatgcaaccaaatcttggtcaaggagggtgtatggcaatagaggattgttaccaactgatacttgagctagacaaggttgctaaacatggctctgacgggtctgaagttatctcagctcttagaagatatgagaagaaaagaatcccccgagttagggtgttacacacagctagcaggatggcatcgcaaatgttagtcaactaccggccttatattgaatttaaattttggcctctatcaataaagcaccctggcattcatgtagctcaagcccttttcaagttcacttttccacaatttgttacttggatgattgctggccatgggttgtggtga

SEQ ID NO: 23884 - DNA, 207 bp, Glycine max
  Peptide Sequence Number=SeqID_140662
atggagccgccagtgaagaagcggacggagagtgcccgtacgagaaacctatggatgtggaagagtatgagtttatcacgggaacccacaacgagagcctcgtctcctgcgtgtgaacctgcaacgacaaacgacgatggcaaccaaggttcggattcgtggattcacgacgtgctgagggggaagagcggatggcgatgctgctga

SEQ ID NO: 23885 - DNA, 2616 bp, Glycine max
  Peptide Sequence Number=SeqID_140663
atgtcttacatgcaactgtctcagaagttttacgatgctttcaagctgtgtgggtccccacccattgctcgcaaacttcatgcccaactcatactctctggtttggacgcttcccttttcttactcaacaatctattgcacatgtactccaactgcggcatggtagacgatgctttttgcgttttccgtgaggccaaccatgccaatatcttcacttggaacaccatgctccatgccttttttgattcgggtcgaatgagggaagcagagaacttgtttgatgaaatgccccatatagtgagagactccgtttcatggaccaccatgatatccggctattgtcaaaacggcctccctgctcatagcatcaaaacttttatgtcaatgctccgggactccaatcatgacattcaaaactgtgaccccttttcctatacttgtactatgaaggcttgtggctgccttgcctccactcggtttgctcttcagttgcatgcccatgtcatcaagttacatttgggagcccaaacctgcattcagaactcccttgttgatatgtatattaagtgtggagcaatcactttggctgagactgttttccttaacattgaaagcccaagtttgttctgttggaacagtatgatttatggatattctcaattatatggaccctatgaagctctccacgtgttcacccgaatgcctaaacatgaccatgtttcttggaacacgctgatctcagtgttctctcaatacggccatgggatccgctgtcttagtacgtatgtggagatgtgcaatctggggtttaagcccaatttcatgacttatggcagtgtactcagtgcatgtgccagcatttctgatctgaaatggggtgcccatttgcatgctcggattcttcgcatggaacatagcctggatgcgtttttgggaagtggtctcatagacatgtatgccaaatgtggatgcttagcactggcgaggcgtgtgtttaacagtttaggggaacagaatcaagtttcttggacttgcttgatttcaggggttgcacagtttggacttggtgatgatgctttggcactatttaaccaaatgaggcaggcttctgtggtgttggatgaattcacccttgtgacaattcttggggtttgttcaggtcaaaattatgctgccactggggaactacttcatggatatgcaatcaaaaatgggatggattcctctgttcctgtggggaatgcaatcattacaatgtatgcaaggtgtggtgatactgagaaagctagtcttgcatttagatcaatgccactaagagataccatatcatggacggccatgatcactgcattctctcagaatggagatattgacagggcccgccaatgttttgatatgacgcctgagcgtaatgtcataacttggaactccatgttaagcacatatattcaacatggcttctcggaagaagggatgaagttgtatgttttgatgagaagcaaagcagtcaaaccggattgggtcacttttgcaacatctatccgggcctgcgctgatttggctactataaaacttgggacacaagtcgtatctcatgtgacaaagtttggacttagttcggatgtttcagttgcaaacagtattgtcaccatgtattcaagatgtggacaaatcaaagaagcacggaaagtttttgactcaatacatgtgaaaaacctgatttcctggaatgccatgatggcagcatttgctcaaaatggtttaggcaataaagcaatcgaaacatatgaggatatgttaaggacagaatgcaaacctgaccatataagctatgttgctgttttatctggttgcagccacatggggcttgtagttgaagggaaacattattttgattccatgactcaagtgtttggcatttctccaacaaatgagcactttgcttgtttggtagatctgcttggccgagcagggttactagaccaggccaagaatttaatagacggaatgccttttaagccaaatgccactgtttggggtgctctactaggagcatgccgaatccatcacgattcaatactagcaaaaactgccgcaaagaagttgatggaattaaatgttgaagattctggaggttatgttcttctagcaaatatatatacagagtctggggaactagaaaatgttgctgatatgagaaagttaatgaaagtgaaaggaattcgaaagagtccaggttgtagctggatagaggttgataacaggctacatgtgtttactgtagatgaaaccagtcatccacagataaacgaggtttatgtaaaactggaggagatgatgaagaagatagaagatacaggaagatacgttagtatcgtctcttgtgcccataggagtcagaaataccatagtgaaaagcttgcttttgcttttgggttgcttagtttgccaccttggatgcctatacaagtaacgaagaatctccgcgtctgcaatgattgtcacttggtaataaagttgttgtccatggtcacctcaagggaacttatcatgagagatggatttcgatttcatcatttcaaggatgggttttgctcctgtcgagactactggtag

SEQ ID NO: 23886 - DNA, 343 bp, Glycine max
  Peptide Sequence Number=SeqID_140664
atggatgaagacaaacccgagacccacgatggaaggcccaagagaagtaccaagcgatctgagaagccatcagagctgaagcccaatgtttcgctgtctggtgttaaggtcgtgactgatttggtagtggtctttgatgatgtggagccatgtctgattggctctgttcgatttcttggaacaaaattcgttgatagtgatagtgatgtcctagttattgataagtcatttggttttgacgctgctgttgaagaggcacaaggagccataaactttgcttatgtggaagcagaaagcactgagaatggtaacgatattgtcaagcttatcggtcgttacagtg

SEQ ID NO: 23887 - DNA, 1818 bp, Glycine max
  Peptide Sequence Number=SeqID_140665
atgaaaaccatatattggtcaaaggagtctacctcaactcgcccatgcaatacaacaacgacatcagacaatgaagcttacgacgttgtcggccatgacatctctgtagagcggcaatcggagaaatgggatgctcctgaggaggacggaggagtgtcgtgtggggttgctggcagagaaggacgcagaggaaggttggagttcttttggagcaagaaaaccaagaaacacaacaaccacaccctggagaatgggacgctccagagaagaaccctcactgtgtcgccgtggtgttgccagagaaaagcacacagggggcacgtgatacagagagaacaagacgaggaagatcggaatcaatcaatccctcatctcattgctgagatctgcaagctggctatggactacgaaccctacgacagtagcggaactgatgatgaccttccaccaacccatcaaaatagaatttccaggggaggaggaggacgtctcgctgggaatgggagatctgctgttggttcaattccttacccaaggatgtatggtgaaattgatatggagacccaaattcatcagcttgagcaagaagcatacagttcagttctaagagcctttaaagctcaagccgatgccattacttgggagaaagaaagtttgattacagagctgagaaaagaactgagattgtcaaatgaggagcacagagaacttctaggtcgagttaatgctgatgatgtgatacggaggataaggtctgataaaataatgaagcaagtaataaatgctttgctggatactgacaacagggaatggagacaggcaggtggccatcagcctggtgtacttagcactggtcaaggacttcatgattcaattcccagtcccacagtctctgcttctcgcaaaaagcagaagattacaccatctgtaccaccatcacgatcttttggcggaccttctcctccatttcacccccaaacactgactgcgccccaccaaccatcttctgcagcaaaacgtggatctgctcctgggtcaaagggaaagaagcacaaacctggtcaaatattacctggtgtatcttcaatgaagcagtatccttcgtcaggaccaggtggaaggaatcaggtacctaatagagctgccatgggtgagcatgccgagggagcatcatttgattcgttggttggtaggagagtgcggacaaagtggcctgacgacaataacttctatgaagctgttatcacgaactacaatccagctgatggacgacataatctggtctatgacatggggagtgcaaatgaaacatgggaatgggttaatctatcagagatatctcctgaagatattcagtgggtaggtgaggatcctggaatcaatcatcgtgggggttttgggggccctggtcatgggatgaataggtctgttggacgagatggtgttccaggagctggaagaggtagaggagcagcaaaggggcaatccagaaaagattttttgtcatcacagaatggcataggaaagaaggcgcctgatgatatacaaatacttcacacagacacactaatcaaggaggtggagaaggtattcagtgcaaatcaccctgatccccttgaagttgagaaagcaaagaaagtattgaaggatcatgagcaagctcttattgatgcaattgcaagacttaatgatctttctgatggtgaaagtgctgtgtggagcagtcaactccaaaattgctacagtggtatagcagatcgtagagtggccgctccactgaaggcagcttttagaatgagaatacttagaaaaatgtga

SEQ ID NO: 23888 - DNA, 217 bp, Glycine max
  Peptide Sequence Number=SeqID_140666
atggcaaatgagggatcatcaaatcctcctagcactgatcctagatggaaatattgtactagaggacaaggaaatagttgtgtgtgcactttctgtggcaaggttacaacagaacacttgatggcaaagccagggaatgttgcaacttgtgccaaatgtcccaaagaagttagagaagaactatggggatatttgaaggataagaagaagcaagaaa

SEQ ID NO: 23889 - DNA, 477 bp, Glycine max
  Peptide Sequence Number=SeqID_140667
atgttgttgacttggttgcctgtgaatacaaacattagatcatatgaacctccaatatcattaaacatcgataaaaccttgttcatcataatcaacaccatcttggaggaaaaatcgcacaaacaatggaaggcatacccacagaggcaacaaaagcaacacaaaaagcagcacaaaatcgcaatttcagagtttgagaggaaaacaccttggcaacgccgaatgtctcttctattacgaagaccacctggtcgtgaagcttatgcaggggaagtttttcatcaacattcacgtcttttggaaagagctggtaaattaaggtctcagttaggcgaaggaagtatgactgctttgccaatagttgaaactcaatcaggagatgttttagcttatattcccactaatttaatttccattacagatgacctatataaagctgagatggggatccatttttatcttgcacaacatatataa

SEQ ID NO: 23890 - DNA, 669 bp, Glycine max
  Peptide Sequence Number=SeqID_140668
atggaagcaattccatatgcattagttgatgttgcatttaccattgaagctaaatttgtagcatgttttgaggctacaattcaggctaattggctgcggaactttatttcagggcttggaattgtcaacaatattgctaggccactgaaaattttttacattatctacatcgtggagcttaccaaatactattacaacaactctcaagcatatgtcaatgaggaagttgcatatttgctgaaagggttaaactttgtacctacatttgtgttcgaaaaagatgcgtcatatgaggagtttgtgaacagagtttatcctttggagcaaatgctgaggtcagaaggactttgggaagttccacacccttggctgaacctatgggttccaagatctcgaatgtcggattttgataaaggtgttttcaacgacattgttcttaagcaaaatattactggccggagttttctagtctacccaacgaaccgaagaaacaagtgggacgataggatgacaccagttacaccagacgaagatgttttctacgttatagatattttgtgtgttgctacaacgtttgacgtggtggagaaattacaggctcaaaacaaacaaatactacagttttgcaaggatgctggtattaagatcacggaatatctaaaccggtaa

SEQ ID NO: 23891 - DNA, 216 bp, Glycine max
  Peptide Sequence Number=SeqID_140669
atgatagtcaatgactataatagtagcattggtgtcagtatttgtgttaatgaaaatgatggtggtggcagcggctatggtagtgtaagtggagatgacagcagtagtggtgttagttttgatgatgtcaatagtgatgatgataacgatggtgccggtacagatgatgaccgcaataaggataggctgataggcatattagtttgtaaaagataa

SEQ ID NO: 23892 - DNA, 543 bp, Glycine max
  Peptide Sequence Number=SeqID_140670
atggcagagaaaccccaaccggttcgggttctatactgcggggtgtgcagcttgccccccgaatactgcgaattcggatccgatttcgagaaatgcaaaccctggttgatccaaaacgtccctgacctataccctgatcttctcaaagaggcaaatgagaaggaagctgataaagttgctgacaaactacaaagtaccggtatatcaggagctggcgatggagctgcttcctcagcaccgaagcaagaagaggataagcaagaggttgttattgagaaggttgtacgtaacaagcgaaagtgtatcaccactgtgaagggactggaacttttcggtgtcaagctcagtgatgcttccaagaaactcgggaaaaagtttgctacaggagcctccgttgtcaagctgttactgctcaatagtggaccaaatcatggaaagttgcggctggagcagggaccaagtgagaaagaacaaattgatgttcaaggggatatagcttatgacatcgtggagttcattacagatacatggcctgatcagtga

SEQ ID NO: 23893 - DNA, 177 bp, Glycine max
  Peptide Sequence Number=SeqID_140671
atggccccttggaaccatggcagctcgcccaggcgagctaatgcttcatccttaagtaagctggctcgcccaggcgagctgggaagtaaagataaggacactaatttcgttcaagcaatctcgctattcgaccaagcaactggcgaaaaccaaggaagtgaaactgagaaaacatga

SEQ ID NO: 23894 - DNA, 357 bp, Glycine max
  Peptide Sequence Number=SeqID_140672
atggtgagaaacacaaagctcacaaagctaaatacaaaggtcacaactttagtgatcgaaaggaacacaaagatcacaactacagttatagagaggaacagaggaacagcaagctctgaaccatggagaggaatggacatgaacgaaaatgacaaatggaatggtgagaagccgagaggaacacaaaggttacagccacaatcatggaaaagaacggagagctgtggagaggaacccaaagctgagcaaaatcccccagacgatgacacctcagcaaatatcatcggcaacggcgacatatggaagagtggaagaggtactgttggagactctaggagggatagtacaaagaagtga

SEQ ID NO: 23895 - DNA, 645 bp, Glycine max
  Peptide Sequence Number=SeqID_140673
atggcttgcgtctctcacctttgttatcacaaacaatatgaaccaacaacaacaacattgcttcacagccatgtgaacccggtccagagtcgggatgaatccagacttgatagggttaggtctttcaatctcgatttttataacgtggataatattgaaagacctgacccaattgaaaattctgactcaccccaactagaccgggttccttcctcatctttgggtcaggtcaagtctttcaatcttaatatctataaatcagagattgaaagacttgacctagtccataggcctgactcatcccaaataggccgggtttcctccacgtctttgttggaccgagtcaggtcatttaatctcaactttaataaagttgagattgaaaagtctagccgggtccaacagcaagtgacccgtgctccctcgatactcgagcggcttaagtcgtccttgtcatttgacagatcgatgtcagtgaccgagcctgaatccgaagttacaggtggtggagagttggtggaggaaactgaagaagaaggggtggatgcaaaggctgatgatttcatcaataggtttaggcagcaactgaggttgcaaaggcttgactctattatacgttacagggatatgctcaaacgatactaa

SEQ ID NO: 23896 - DNA, 639 bp, Glycine max
  Peptide Sequence Number=SeqID_140674
gaaagggcaggaggctttggtcagctgaaacagcggtttctgctgccgccgggcgtaatcggcgacgttggccgccagcgcggcggcatggctgtcgccaatcagcgctatcgccggtgtgtcactctgcggctggcactgcgcatcgcgggcgggccgcgtggcgccgtaatccagcaggcagggatcgcgctgggcggcgactttccattcgtcgccgagcttcaccgcttcactgacgcgcgatttcaggccaccgctctgccacagcagcaccatggcaccggctgccagcagcgacgaggcgcagtagccggggatcagccagcgcgtaccgctgcgcgcccgacggaatggctgttcgatgaagcgccaggagagccaggcgatgaccagcgccacggcacagatgctcagcgcctgccagatgctgagcggccgatcgctgcagatgcgcgccagactgagcagcggccagtgccacagataccacgagtaggaaattttaccgatgaagcgcatcggcgcgttctccagcagccgttgattgagcgggctgcgtgcaccgatcatcagacaggccgccagcaccggcagcagcgccagccagccagggaagcgatcgctatggctgagtaa

SEQ ID NO: 23897 - DNA, 183 bp, Glycine max
  Peptide Sequence Number=SeqID_140675
atgtctatcctgacatcagccaactctagatttgttatgataaacatgataacggaacaagatgagattgtatgtcattcctcgtcctcgttcttgactcttgatgacgataaaattttgtattcatcctcgactttacatgatatcatgtacacttgcctagtctccatctccgtctattga

SEQ ID NO: 23898 - DNA, 2549 bp, Glycine max
  Peptide Sequence Number=SeqID_140676
cagtttaaatcacctgcgctgtaccgattcggcccgcataacgcactggtcaagccagttaagccattgttttcgcgcattcaggggacaacacaaacccaacttccaccgcaacatcagctacaggcagtacagaagtttatgacacatcgtttaacctccagggatatcctggcgctgggcttcatgacctttgccctgttcgttggcgcaggaaacatcattttcccgcctatggtcggtattcagtctggtgaacatgtctggattgccgccttcggcttcctgatcaccgcggttggtttaccggtgatgaccgtgatcgcgctggcgcgcgtcggcggcggtattgatgcgctcagctcaccgattggtaaagcggccggtctgctgctcgccaccgtgtgctatctcgccgtcggaccgctgtttgccacgccgcgcaccgcgaccgtttcatttgaagtcgggattgcgccgctgaccggcgacggcccgctgccgctgtttatctatagcctggtgtacttcgcgctggtgattggcatttcgctctatccgggcaagctgctggacaccgtcggtcacttcctcgcaccgctgaaaattgtcgcgctgaccattctgggcgtcgcggcgctgctgtggccggctggcggcatttcgccggccaccgccgactaccagcgtgcggccttctccagcggtttcgtgaacggctatctgaccatggatacgctcggcgcgctggtgttcggtatcgtcatcgttaatgcggcgcgttcacgtggcgtggaagacagtaaactgctgacgcgctataccatgctggccggcgtgatcgccggtgtcggtctgacgctggtgtacctcagcctgttcaagctgggctccggcagcggcgcgattgtcgatcagaacgctaacggcgcggcgattctgcatgcttacgtgcagcagaccttcggcggcatgggcagtgtcttcctcgccgcgctgattttcgtcgcctgtatggttacggcgccacctgattcagatttcaattccggtgctgacggctatctatccgccgtgcatcgtactggtggtgctgagctttaccctgagctggtggaatcgcagcacgcgcatcattgcgccaaccatgctgatcagcctgctggtctctcctggctgccgccgtcgctggcaatgctggtgattgctgcggtggtagaccgggtgaaagggcgtgagcaggtactgtttgttatgcaagaaaccaataagctcaaacgcggactgagcacgcgccacatccgttttatggcgctgggatcggcgattggcaccgggctgttttacggctcggcagatgccatcaaaatggcaggccccagcgtactgctggcctacatcatcggcggcgccgtagcgtatatcattatgcgcgcgctgggcgagatgtcggtgaacaatccgcaagccagttcgttctcacgctacgcgcaggattacctcggaccgctggcgggctatatcaccggctggacgtactgctttgaaatcctgattgtggcgatcgccgacgtcacggcttttggtatctacatgggcgtgtggttcccggaggtgccgcactggatttgggtgctgtcggtggtgctgatcatcggcgccatcaacctgatgagcgttaaggtgtttggcgaagtggagttctggttctccttcttcaaagttgccaccatcatcatcatgatcgtggccggtttcggcatgattttctggggcatcggcaacggcggtcagccgaccggcatccataacctgtggaccaacggcggcttctttgctcacggtatcgtcggcatgctgctgtcgctgcagatggtgatgttcgcctacggcggcattgagatcattggtatcaccgccggcgaagccaaagatccggcgaaatcgatcccgcgcgccattaactccgtaccgctgcgcattctggtgttctatgtcggcacgctgtttgtgatcatgtcgatctatccctggaaccaggtcggtaccgcaggcagcccgttcgtgctgactttccagcaccttggcatcgccgccgccgcctccattctgaactttgtggtgctgactgcctcgctgtcggcgattaacagcgatgtgtttggcgtcggccgcatgctgcacggtatggcgcagcagggtcatgcgccgaagatgtttatgaaggtgtcgaatcgcggcattccgtgggtcacggtgctggtgatgatgcttgccatgctggtggcggtgtacctcaactatctgatgccggaaaaagtgttcctggtgattgcctcgctggcgacgtttgccaccgtgtgggtgtggattatgattctgctgtcacagatcgcgttccgccacaaaatcggcaaagaacaggccggtaagctgcagtttgctctgccgggcggcagtgctacggcgtgggtgggggtgctgttccttgcctttatcatcgcactgattggctacttcccggatacgcgtatctcgctgtacgtcgg

SEQ ID NO: 23899 - DNA, 2076 bp, Glycine max
  Peptide Sequence Number=SeqID_140677
atgcaacgcaacaccgccccgttccgcgccgataccgtcggcagttttctgcgtcccgctgccattaagcaggcacgcgagcagttcgccagtggcaccctcagcgccgaccagctgcgtcaggtagaagacgatgcgattcgccaggtggtggagcagcagcgcgccagcggtctgcaggtggtgaccgacggtgaattccgccgcgcctggtggcactttgatttctttggccatctgcacggcgttgagctgtttgaggccgatcagggcattcagttcaacggcgtgcagaccaaagcgcacggcgtgaaggtcaccggcaaagtcgcttttaacccgcagcatccgatgctggaccatttccgcttcctgcaaagcgtggctggcgatgcggtggcgaaaatgaccattcccagcccgagcgtgctgcacttccgcggcggccgtaaagtgattgatgccacggtgtatccggatctggagcagtacttcgccgatctggcacagacttacaaggatgcgatcaaggcattttacgacgctggctgccgctatctgcagctggatgacaccgtctgggcgtacctgtgttcaggcgatcagcagcagcaaattcgcgagcgcggtgaagatccgcaacagctggcgcacatttatgcgcaggtgctgaatcgcgcgctggaagataaaccggcggatctcaccgtcggcctgcacgtgtgccgcggtaacttccgctcgacctggatctcggaaggcggctacgagccggtggcggaaattctgtttggcagcgtgaacatcgacgcgtttttcctcgagtacgataatgagcgctccggtggctttgagccgctgcgtttcatcaaaccgggtcatcagcaggtggtattagggctgatcaccaccaaaaccggcgagctggaagacgctgcacaggtgaaggcgcgcctgcaggaagcggcgcagtttgtcagcctcgaccagatttgcctcagcccgcagtgtggctttgcgtcaacggaagagggcaacagcctgaccgaagcgcagcagtggcagaagattcgtctggttgtcgacatcgcacaacagtttaaatcacctgcgctgtaccgattcggcccgcataacgcactggtcaagccagttaagccattgttttcgcgcatccaggggacaacacaaacccaacttccaccgcaacatcagctacaggcagtacagaagtttatgacacatcgtttaacctccagggatatcctggcgctgggcttcatgacctttgccctgttcgttggcgcaggaaacatcattttcccgcctatggtcggtattcagtctggtgaacatgtctggattgccgccttcggcttcctgatcaccgcggttggtttgccggtgatgaccgtgatcgcgctggcgcgcgtcggcggcggtattgatgcgctcagctcaccgattggtaaagcggccggtctgctgctcgccaccgtgtgctatctcgccgtcggcccgctgtttgccacgccgcgcaccgcgaccgtttcatttgaagtcgggattgcgccgctgaccggcgacggcccgctgccgctgtttatctatagcctggtgtactttgcgctggtgattggcatttcgctctatccgggcaagctgctggacaccgtcggccacttcctcgcaccgctgaaaattgtcgcgctgaccattctgggcgtcgcggcgctgctgtggccggctggcggcatttcgccggccaccgccgactaccagcgcgcagccttctccagcggtttcgtgaacggctatctgaccatggatacgctcggcgcgctggtgttcggtattgtcatcgttaatgcggcgcgttcacgtggcgtggaagacagcaaactgctgacgcgctataccatgctggccggcgtgatcgccggtgtcggtctgacgctggtgtacctcagcctgttcaagctgggctccggcagcggcgcgattgtcgatcagaacgccaacggcgcggcgattctgcatgcttacgtgcagcagaccttcggcggcatgggcagc

SEQ ID NO: 23900 - DNA, 288 bp, Glycine max
  Peptide Sequence Number=SeqID_140678
tctcggtcggaagacgctgacatctctagagaaggtgcagatgacgacatagcaaatgagactttttcgcagtcttggccggaagatgctgacatctccggggaaggtgcagatgacgactcttggccggaagatgctgacatctccgaggaagacttgtcgtctctggatgacaaaggtgcgaataaccgtaaggtgtctccgcatgctatcggactcactggtcatgatagcaaaaagtgtgcacggataaccatcgggtgtctccgcgtgccaccggactcatag

SEQ ID NO: 23901 - DNA, 132 bp, Glycine max
  Peptide Sequence Number=SeqID_140679
atggatgtctctccctcccttgaagaactcgtgcaaatggtggagaatgaaggaagttacatagagggcgtcaccgtggtcatggctaagagggtgtctgatgcaatccaatcctgcaagggcattgggtag

SEQ ID NO: 23902 - DNA, 303 bp, Glycine max
  Peptide Sequence Number=SeqID_140680
atggaggggaatcttgagaagaagctgttgagcagagagcaaaaatcagaagaagagaatttatcattggtgaagagggtgtgggaagagagcaaggtgatgtggatagtggcagcaccagccatattcacaaggttcacaacctttggcatcagtgttataagccaagcatttattggtcatattggttcaagggaactcgctgcttatgcccttgtgttcactgtcatcatacgcttcgccaatggaattctgcatagcctgaaggctgaaagtgtggctggaatcactttctgtggttag

SEQ ID NO: 23903 - DNA, 2087 bp, Glycine max
  Peptide Sequence Number=SeqID_140681
gtagatccccagaccaggaatcagtagggtctgggacaaagaggtccagtgtatcatcggggggtaggcctcgaaatcagaaggagttcttctataaatttgttgaaagtgacagcctgactgcaaaacttgtagattggtttgaatctgtaacagaaaaaagtgaattgaaacagcaggcatttgatgttccatttgagttgattgaacttcaaaaatttgattatgcattggaaggaatttcatttcagcagctaacacgaatgcccaatgctgttcatgcttctacatctgatgctgtagaagcaacagcttatcttgctattgaagattttctacatgcaagtataaaaggcttgtgggaggcattttggagtcaagatgagcccatgcctttttctgtggattgtctgtataatgccaacatgaagttttatcaggctgaaaaggcaattgcaaatggaaggcttggaggtctttgtggcactggtatattgctgaataatcctagacatcctcatggaaaatgggatcatgtccttgaattggcactgctaaggcctgatattggaggccatgctgttggcagtgaccgccagccttctccatcagttcttggagaagctctattttatgctcttcgaatgctattggcaaggagtttaagtagactgagtttctttccagatccaagcacagtgtttgttcttcttgttgattctcaatacgggggtgttgtaaaggttgaaggagatgtaaataagctcaattttgatatgaaaaatgtttatgaatgtgctgctgaatgggtaaaaaatcattctagaatttctgtttctccaattgataggatctggaacaaacttggaaatgcaaactggggagatatcggtgctcttcaggtgctatttgcaaccttccactgtattgtgcaatatgctggaatgcccaagcactctgtcgaggatttagctgctgaccatagttcacgcctccaaacaagaagagttgagaggcagttaggagatacaggtgtaaatggaaatggcctatttcgataccagcaacgtagtgtttcccctgaaattgttgaagttcaggatgattctgtcaaagttgattccaaagagtcaatgataacagaaggaaccatattatggctggaggattcagattggcaaaagggttatcagataaaagaggtaatcaacactagtgaattgacatacttcattgcatctcatgttgaagacccaggacaaaatctgttcctatacgtgggttctcatccgtcccagctggaaccagcatgggaagatatgaatttatggtatcaagttcagaggcagaccaaagtattgactataatgaagcagaaaggtctatcaagcaaatatctgcctcaattgagtgcctctggtaggatcatacacccaggccattgtcgccggcccagctctggtggaaattgtgatcacccttggtgtgggacccctattcttgtgaccagtccagttggtgaaacagtagctgaaatggtacgcacagggcaatttggttcagatgaagctatcagatgttgccatgattgcttatcagcgctttcaactgttgcttctgctggaattcggcatggagacatcaggccagagaatgtgatctgtgtaaagtctggtgtgaggcacccttattttgttctaattggatggggccatgccattcttgaagatagggatcgccctgccatgaatcttcatttctcatctacttatgcacttcaggaaggaaagctatgctccgcttcagatgcggaaagcctagtttatatgctttattattcatgtggtggagttttccctgatctagattcagtagagggagcgctacagtggagagagacatcttggtcaaggagattaattcagcagaagcttggtgatatctccactgtgctgaaagcttttgctgattatgttgacagtctctgtgggacaccatatcccatggactatgacatatggctgagaaggttgaggcgaaatattcgcgaagatgatcatggaaaggaaatcgatggaacgggctag

SEQ ID NO: 23904 - DNA, 333 bp, Glycine max
  Peptide Sequence Number=SeqID_140682
atgggtgaagttagaagaagagaaggacgaggggttcttgggcattgcaggaattggaagggaagaggaagtgctagggctgagggatatttttgtctgttgacatcttttaagaggtgcaggaacaatttccttttcataaatatgcaatttacagcactgccccgagctcatcgtactattcaattgatatcgtccatctacatgactgcatactacccgaacaaaatacacacgatgccaacgattgagatgtatatcgataatatcaaaaatcctaattaccttgtagtccacctatcacctttcattcctaaatccttacgcctctaa

SEQ ID NO: 23905 - DNA, 396 bp, Glycine max
  Peptide Sequence Number=SeqID_140683
atgggatgggaattattctgggaagtttaccagaaagcgtgtgacttaagacaaagcatgctgaaaagtctcatgtttatttatggggcaatgaatgatcttgagagtagtcaaccggtgtcagagctagttgttgaggtcttgaaaatggctacctatgaaggtgtgagagccgtcgagaagtcgactatcagagacattacaaatggtatcagagcaaacctctctcctagtacggatctagaggttgtgcaagtatgggactgtatagttgaagaagacttaaaagaattaattgctattacctatactaacaagatgcatatacttttcagtagctcatcagttaagaactccacagttaagtgtgtttggctcggagcaattatgggatga

SEQ ID NO: 23906 - DNA, 216 bp, Glycine max
  Peptide Sequence Number=SeqID_140684
atgggggataacttaacccttatatctagtgatggggaggacgatttgcaagaaatcctcaacaaaaagattgactggctaggaaacattttggaagaaatccctaaggagatcgcgaatttttgttgcagtagtatccatgatgaggaagatgaacactcatctgaggacatcgttgagggagatttcttggtggtgtccaaggtggtcgagtag

SEQ ID NO: 23907 - DNA, 243 bp, Glycine max
  Peptide Sequence Number=SeqID_140685
atggggaagcgggttaagcaacaaagcgagtttgattgtgattcaagaatggctatgaactttgtcttgcaaggagtgcatcatggacaccctttcaggtctatagttgaagttattaagtggtggatccaaaaagattggcaagttcaaatctctcatgtttatacagatgagaatgtgttagttgattgtttagcaagcttagctcatgactatgatttgatttgcatattttttagatag

SEQ ID NO: 23908 - DNA, 159 bp, Glycine max
  Peptide Sequence Number=SeqID_140686
atgtcttcacttaagaaactctccaaggaattatcgttggagatgctcttaggtggatgtcttgacccttcacaagtctctccccgagagtttcactactatcccaatccatgttttgcccttactaagggtagggcgagtttaaaaggtgggtattaa

SEQ ID NO: 23909 - DNA, 360 bp, Glycine max
  Peptide Sequence Number=SeqID_140687
atgggaaaaggaagtgtgggtgctttaagtgggccaaaatgtggtcctcctaaaagggatgatgtctatggcatgagttctaaaataaaagttgaaggtggtctatatcaacaaaatgagggtgtttgtgggccttcaatagtcaaggataagcctattttggtgactaatatcccacaaagtcaagaagaggttacgttgcttgactttagtagttgtggaacagatagttcaaaacgtgtaaatggtgtggatgaccccattttattctttagagacgagatgagagatgccttgactttgaaggcaattcttagaagcttcgaaatggcatatgggctaaagatcaatttccactaa

SEQ ID NO: 23910 - DNA, 207 bp, Glycine max
  Peptide Sequence Number=SeqID_140688
atgcattttttcttaaaactagcaaaggcactagccaagggtgccgctacgaaaacagaaggtgctagaatgcgaaaagaaaataacagaaaagtggaaaatgatgacaatgcagtgctgcacgatggtaaacaacatgccaacaacatatttcctatgaaccagtatcctcctgacagctcaccaccttctaacagattctgttaa

SEQ ID NO: 23911 - DNA, 1011 bp, Glycine max
  Peptide Sequence Number=SeqID_140689
atgtcccagcagaaaatcaccatccatgatgtcgcgcaggccgctggcgtatcggtcagcacggtatcgctggtgctgtccggcaaagggcgcatttcacccgccaccgccgcgcgggtgaatcaggcgattgagcaactcggctatgtgcgtaaccgctcggcctccatgctgcgcggcggtgagagtggggtgattggcctgatcgtgcgcgatctcagccagcccttttatgcggcaatgacggcgggactgagcgaggtgctggagcagcagggcaaagtgctggtgctgacgcagagtggccagcacggccagcatctgcagcgctgttttgattcgctggcggcgcagggcgccgatggcattgtgctgggcggtgcggtggcgcaggcggaatcgctgcggctgcaggcgcaggagcaaaatattgcactgatctgcgccgcgcgcgccagcagtctggaaaaagtcgattcgctgcgtccggataacagccaggcggcgcggatggccaccgagtatctgatcaaacagggacatcagcgcattgcctgggtgggcggtctggggtcctcactgacgcgcgccgaacgtatcggcggctattgcgccacgctgctgcagtacggtttgccgtttcgcccggactggattattgaatgtgacgatcgccagcagagcgtctccgcgctgacgcaggcgctgctgcatcagcatccgcgtattactgctatcctggcccacaatgccagcaccacgctcggctgctatttcggcgcgctgcgcagcggccgcaccctcggggaagatgccgtggacagttactacacccagcagctggcgctggtcggcttcaacgacgatccgcagcctgagctgaacgatccggcattgacgtttgtcagcagtgaagcgcgcatcgtcgggcggcgcgcggcagaacgcatattacagcgcctggcgcagccacaggccgatgtgcagacgttaatcgtgccgccgcagctg

SEQ ID NO: 23912 - DNA, 321 bp, Glycine max
  Peptide Sequence Number=SeqID_140690
atgttaggattcacaagcgattctcctcaaatttcagccagcccacatcaattagactttgcacattacgcttcaagctcatacaatgctcaatggaatgccccggggctcctccatgataagcacacgttgcgtttgagtcgtattctaggagaaatggaggttgatgaaccttggttggcgttatggataccattgaattatcgagtggttatgggagcaaggatgatctttgtggataactgggtggtgggtaaggagaagatttgttattggctgagtaatgacattgttgggttggtgggaagtttggccaggtag

SEQ ID NO: 23913 - DNA, 198 bp, Glycine max
  Peptide Sequence Number=SeqID_140691
atggaacatttaagttcccaaactgctggtgagtggacaatttatccttggattcacagcaattgcaattcattatcagacagtgatcaacttcgtcctgtttcaataccagatattcatccagccaggtgggcttgtgcattatctactcttctaggcttcaagcctgaaagtctcatacatgaggggctgtgttag

SEQ ID NO: 23914 - DNA, 261 bp, Glycine max
  Peptide Sequence Number=SeqID_140692
atggagttggagaaactcaatgtcaaaattgcctttccccatggaagacattctaatgcagcaactgaagtttcaaggggggaggaaagtagtttcatgaatgctatgcaccaaattggacctagcacaagcagtcagtgttttttggatgcaaggagatctgtgactgagtacgggttcacgattggcaactctcttggtagttggaaggaaacaattcatcccacaatgacttatccactacagaggaagagcacatga

SEQ ID NO: 23915 - DNA, 288 bp, Glycine max
  Peptide Sequence Number=SeqID_140693
atgtccattttgactactggggggactttgagagttccatcactgagaggggaaagagacaaaggcatatcaagacaccatattgtacactatactccacaacaaaatggagtagttgaaaaaatgaacatgaccttttggaaagggttagatgataaggatgtcactaagctggtagagtttgagagctccacaatcagaaaaattagtgatcagaagcaaattgaaggacctgatgagactaatcaggctgatgagactgatcaggatcttcaaatgcacccttaa

SEQ ID NO: 23916 - DNA, 696 bp, Glycine max
  Peptide Sequence Number=SeqID_140694
aaaccaactcgcctgggtgagctctagctcgcctgggcgagctcattgcttcagctcgcctaggcgagctgcctttgccccatgtgcccattttcctataaataggcgtgctagggaggctaaggaaggattggaaggtccagaaggtcaagaattgagagaagagggaaagaacaagaagaaagaagaggaaacaaggccaaagcgctaccgaatcgcaaccacgatcattctttacttcgtttcttgttcggcgttctttgtgcgagcgccagggcattctcatatagaacctgttgaagatacaatcatggctgaagagccaagaagagtaaccttggaggattattcaagttctaatgtgccacaaattttcaccagcattgctcaaccagaagttcaagcacaaaccattacatatccaccatcattgattcagctaattcagaataatctatttcatggtttaccaaatgtgtggaagcaatgtcttccaagggtacatctacttggggattgttatactgagaacaagagagggtacatctcttgtggatcagttcaagtggagggtacatccgcttggtttttcaaagagaacaagggatggtacatcccttgtggatctttggcttttaaaggattttacaaggttgaaagaaatctcggaaactgcaggttgcttggggactggat

SEQ ID NO: 23917 - DNA, 327 bp, Glycine max
  Peptide Sequence Number=SeqID_140695
atggatcaacttggaatagcatcttgctacagcactaaagtctattgcaggcagactttaattggagggaactatggccttctcaataccaccacctttgctcttaatcctgactactacagtgcagttttgtggcatcggttaatgggaaagaaggttcttgcagtctcaagtgatgttcatattaaagacttttacctacagttaggaaatcctagcacatgggaagcttccttgagaagcaaggaaggtagcttccttgggaagctagaggaagaaaacttccttgagaagctagagcgagggctactcacacccctcccatag

SEQ ID NO: 23918 - DNA, 1909 bp, Glycine max
  Peptide Sequence Number=SeqID_140696
atgagcatgcttactgctctggaaagtttgcagctagcttacaataattttataggccatttacctcaaaacatttgcattggtggaacgttgaaaaattttaccgctgctaataacaacttcataggcccaattccagtgagtttgaagaattgctccagtcttataagagtcaggcttcagcgaaaccagctaactggggatataacagatgcttttggtgtacttccaaatttggactacatcgaattgagtgacaataacttttatggtcaactatcacctaactggggaaagtttcgtagcctcacaagcctcatgatctccaacaataatttatcaggtgtgataccaccagaactagctggggcaaccaaattacaacgacttcacctgttctcaaaccatcttacaggaaacattccacatgatttatgtaacttgcccttgtttgatctctcactcgacaacaataatcttacaggaaatgttcccaaagaaatagcatcaatgcagaaacttcaaattttgaagcttggatcaaataagttgtctggcttaatcccaaaacaactaggaaatttgctcaatttattgaacatgagtctgagccaaaataattttcagggaaatattccttcagagcttggcaaactgaaatctcttacgagtcttgatcttggtggaaattcattgagaggaacaataccttcaatgtttggagaattaaaaagcttagaaacactgaatctctctcacaataatctttcaggtaatctctctagcttcgatgatatgacgagcttgacatctattgatatatcatacaaccagtttgagggtccacttccaaacattctagccttccacaatgctaaaattgaagcattgagaaataataaaggcttgtgtggcaatgtcactggcttggagccttgctcaacatcaagtgggaaatctcataatcatatgaggaagaaagtaatgatagtaattttaccccttactttgggcattctaatactggcattatttgctttcggagtctggtatcatttatgccaaacctcaacgaacaaagaagaccaggctacaagtatacaaactcctaacatatttgcaatatggagttttgatggcaaaatggtattcgagaatattattgaagccacagaagattttgacgacaaacatctcattggtgttggagggcaaggatgtgtttacaaagcagtgctgcctacaggtcaagttgttgctgtgaagaaactccattcagttccaaatggagagatgctcaatctgaaagctttcacatgtgagatccaagctttgacagaaattcgacatcgtaacattgtaaagttatatgggttttgttcacattcacaattctcatttttggtgtgtgaattcctggagaatggcagtgttgagaagactctgaaggatgatggacaagcaatggcatttgattggtataagagggtgaatgttgttaaagatgtagcaaatgctttgtgctatatgcaccatgaatgctcacctcgaattgttcatcgtgatatatcaagcaagaatgttcttttggattccgaatatgtagctcatgtctcagactttggaacagccaagtttcttaatccagattcatccaattggacctcattcgtaggaacctttggatatgctgctccagaacttgcatacacaatggaggtgaatgagaaatgtgacgtgtatagttttggggtcctagcatgggaaatactttttgggaagcaccctggtgatgttatatcttctttattgggatcatctccatctactcttgtggcctcaacactcgatcacatggcattgatggataagttggaccaacgtctccctcatccaacaaagccaattg

SEQ ID NO: 23919 - DNA, 420 bp, Glycine max
  Peptide Sequence Number=SeqID_140697
atggtgaaaggaatggacccagagagtttattttcatcaaggaccaagaagtccaaatggaccaagttgcctatggaagctgggattggtccagtgaattcattcaaggataaagataatacactaagctttgacaaatttccaatgttgcctatggaagctgggattggtccagtgagttcattcaagggtatagataatacactaagttttgacaaatttccaatggtgaaaggaatggacccagagagtttattttcatcaaggaacaagaagtccaaatggaccaagttgcctatggaagctgggattggtccagtgaattcattcaaggataaagataatacactaagctttgacaaatttccaatggtgaaaggaatggacccagagaatttatttccatcaaggagcatgtag

SEQ ID NO: 23920 - DNA, 339 bp, Glycine max
  Peptide Sequence Number=SeqID_140698
atgggggcgatgacgtcgtcgatggcggccaagttcgccttcttcccccccaatccgccgtcgtacggtgtcggcttggatgacgtcacggggaagctgaagatgacgggggtggccaccagggaaaacgtcgacgtattgaagctttgcacgaggcgaggaaacagcgtcgtggccatgtacattagaaacccttcggcatcgttgaccatgctctattcgcacggcaacgccgccgatctgggtcagatgtacgagttgttctccgaactcagtctccacctccgagtcaacctcctatgttatgactattctgggtatggccagtcttctgggaag

SEQ ID NO: 23921 - DNA, 207 bp, Glycine max
  Peptide Sequence Number=SeqID_140699
atggctatactcgtggatgatgactttctctcgaggggggaggctaccatgtggaagagactcacacttgagggggagatgtgttggagtacaagtgtgaggaatctccccagtatttcctcccatcgagtttttcccaacagtggtattaaaagtcaggttcatccggagccgtcactagctcgtgcagttcaagatagaggataa

SEQ ID NO: 23922 - DNA, 450 bp, Glycine max
  Peptide Sequence Number=SeqID_140700
atgaaggtttttaatctaacagctgctcactcttcttccatggtacgtgtatgttacctacaagctaacacatttctcagcccacaaatcagcaaattagagtacaaaaaaaccaataacaatgacaaaggtttatatgtaggtccgtgtagcacaggttttggttcgcataccttgagtgaaaaaccgcacacagtttttgatgagaatggagtgagagaaaggttcaccaacaatggcacaaccagaccgcaagaggaaaactcaaaaaggaaaaagagcgaggcagagacaaacaattacgagagcgagagagacaactccaacgatggcaatgtgatgggtagggtttatgaaaggcagggcaataatggcgagggtcaaggaatagagcttcgtgagggcaacagtggtgaagtcacggatacaaaccctacattgtccccataa

SEQ ID NO: 23923 - DNA, 1317 bp, Glycine max
  Peptide Sequence Number=SeqID_140701
atggattgtttagggcattcttctaaatcagggcctggagtttgtgttgctcaatcagtagaaaatggaggttttggtggagatgggaggtgctgcaagcaagcttcccctccaaggagtggtgggtctaggaatactagtccaatgagccgggccggatccaggaacacgagccctttgcggcagaaggttgttaagaccaagcctaggggtttggatgaggaaacacttgccacgtttggtaaggtagtgcatgctgatgttcaaatggaggataatatatgggcaatgttgccagaggacctgttgcatgagatcctagctagggtacccccttttctgattttccggcttcgtttggtttgtaaacggtggaattcgctgcttcaagacagtagttttctcaaattccattccagtgtgccatcacatgggccatgcctctttacgttttggaagaacacgcagaccccacagtgttcagtcttcagcttgccgctgaaaacttggaatagaatacctttcacttttttgccaccgtgggcattctggttggttggctcttctggtggtcttgtttgcttttctgggcatgatgggctaacgtttaagaccctggtgtgtaatcccctaactcaaacttggagggcattgcctagtatgcattacaatcaacaaaggcaactagtattggttgttgatcgggtggatcagtcgtttaaagtgatagccactagtgatatttatggtgacaagtcattgccaactgaagtttatgactcaaatacagacagctggacagttcatcagattatgccggcagttaatctctgctcttcaaaaatggcatattgtgactctagattgtacttggaaaccctttcaccccttggtctgatgatgtacagactagacacaggtcattgggaacatattccggctaagttccctcgatctttgttggatggttatttggttgctggtacccagaagcgtctttttcttgttggaaggattggcctttatagtactctacagagtatgagaatttgggaattggatcataccaaaattacatgggtggagatcagtaggatgcccccaaagtatttccgtgctttattgagattatcagcggagagatttgaatgcttcgggcaggataatttaatctgcttcacctcttggaaccaagggaagggccttctatatgatgtggataaaaagatctggtcatggattggtgggtgtgctctgcagtcatacaacaatcaagtttgtttctatgagccaaggtttgatgcttctatctactaa

SEQ ID NO: 23924 - DNA, 1989 bp, Glycine max
  Peptide Sequence Number=SeqID_140702
atgagcatgcttactgctctgaatagtttgcagctagctgacaataattttataggccatttacctcaaaacatttgcattggtggaaagttgaaaaaaatttctgctgaaaataacaacttcacaggcccaattccagtgagtttcaagaattgctccagccttataagagtccggcttcagcgaaaccagctaactggggatataacagatgcttttggtgtacttccaaatttggactacatcgaattgagtgacaataacttttatggtcaactttcacctaaatggggaaagtttcgtagcctcacaagcctcatgatctccaacaataatttatcaggtgtgataccaccagaactagctggggcaaccaaattacaacgacttcacctgttctcaaaccatcttacaggaaacattccacatgatttatgtaacttgcccttgtttgatctctcactcgacaacaataatcttacaggaaatgttcccaaagaaatagcatcaatgcaaaaacttcaaattttgaagcttggatcaaataagttgtctggcttaatcccaaaacaactaggaaatttgctcaatttattgaacatgagtctgagccaaaataattttcagggaaatattccttcagagcttggcaaactgaaatttcttacaagtcttgatcttggtggaaattctttgagaggaacaataccttcaatgtttggagaattaaaaaacttagaaacactgaatctctctcacaataatctttcaggtgatgtctctagcttcgatgatatgacgagcttgacatctattgatatatcatacaaccagtttgagggtccacttccaaacattctagccttccacaatgctaaaattgaagcattgagaaataataaaggcttgtgtggcaatgtcactggcttggagccttgctcaacatcaagtgggaaatctcataatcatatgatagtaattttaccccttactttgggcattctaatactggcattatttgctttcggagtctcgtatcatttatgccaaacctcaacgaacaaagaagaccaggctacaagtatacaaactcctaacatatttgcaatatggagttttgatggcaaaatggtattccagaatattattgaagccacagaaaattttgacgacaaacatctcattggtgttggagggcaaggatgtgtttacaaagcagtgctgcctacaggtcaagttgttgctgtgaagaaactccattctgttccaaatggagagatgctcaatctgaaagctttcacatgtgagatccaagctttgacagaaattcgacatcgtaacattgtaaagttatttgggttttgttcacattcacaattctcatttttggtgtgtgaattcctggagaatggcagtgttgagaagactctgaaggatgatgggcaagcaatggcatttgattggtataagagggtgaatgttgttaaagatgtagcaaatgctttgtgctatatgcaccatgaatgctcacctcgaattgttcatcgtgatatatcaagcaagaatgttcttttggattccgaatatgtagctcatgtctcagactttggaacggccaagtttcttaatccagattcatccaattggacctcattcgtaggaacctttggatatgctgctccagaacttgcatacacaatggaggttaatgagaaatgtgacgtgtatagttttggggtcctagcatgggaaatactttttgggaagcaccctggtgatgttatatcttctttattgggatcatctccatctactcttgtggcctcaacactcgatctcatggcattgatggataagttggaccaacgtctccctcatccaacaaagccaattggtaaggaagtggcatcaattgcaaagatagcaatggcctgcttgactgaaagtccacgatctcgccctaccatggagcaggttgccaatgagctg

SEQ ID NO: 23925 - DNA, 437 bp, Glycine max
  Peptide Sequence Number=SeqID_140703
atgaagtccaaattgaccaagttgcctatggaagctgggattggtccagtgagttcattcaagaatatatataattcactaagctttgacaaatttccaatggtgaaaggaatggacccagagagtttatttttaaaaaggtgcatggagtccaaattgaccaagttgcctatggaagctgggattggtctagtgagttcattcaaggatatatataatccactaagctttgacaaatttccaatggtgaaaggaatggacccagagagtttattttcttcaaggaacaaggagtccaaatggaccaagttgcctatggaagctgggattggtccaatgagttcattaaaggatatagataatacactaagctttgataaatttccaatggtgaaaggaatggacccagagagtttatttagatcaaggagcataaa

SEQ ID NO: 23926 - DNA, 465 bp, Glycine max
  Peptide Sequence Number=SeqID_140704
atggatcagatgaagatcacggcgctctcgatctttttactaggatgtctcttggtcatggctgtccaaggagattcatcagcaagagttcttccagctgtaactgcagttgaggtagggaatataaacaagcttggagtgtcatctcaaaaggaaccatttatgagaactggagctggtcatcacatgaggaagcaagggcttgggggaaagaaatttagcacaaatgaggtgacaagtgtggactctaagaatggaaaaggagcagatggaggagagacttcaaagacttcaggtgcaacctattccgatggaatatgtgactttgatgaaaagggagatcataaaatagtaaaatgtaaagggaagaaaagtattaaaccaagaaagctcaaaatggatggttttgttgctttaactgatgattatcatggacccaggcaccaccttccgaaacataattaa

SEQ ID NO: 23927 - DNA, 735 bp, Glycine max
  Peptide Sequence Number=SeqID_140705
atggttgatcaagctgatttagttatcatttgtgtctctgttggggtggcccttggagttttgatagcttatctcatatatgttggcataaggtgctacaaaaagcgagctcatcttagccgatctgcgaacgagcctagtttaacaactatccctatacgaacaaatggattagaaactagcattgactttagtgcttctctcaccagttccatagccacttcaaggtcaccaaatcctcacaaaagctcgcattcaacttggtggagtcatcagaataaagatggttttgcttcagtatcaggcattctgaaagaaattcaaaaggctacacaaaacttcacaaatacattgggagaaggatcctttggcacagtttataaagccatgatgcctacaggagaggtggtagctgtgaagatgcttggacccaattccaaacaaggggagaaagaatttcaaacagagaaaagatcttcacaaaggattactttaatacaaggatactgcatagataaaggacagtttatgctggtttacgagttcatgagtaatggaagtttagaaaaccttttatatggtgaagaaaaggaactgagttgggatgaaaggctgcaaattgctgttgatatttcacacggaatagaataccttcatgaaggggcagtcccacccgttgttcatcgtgatttgaaatctgctaatatattgcttgatcactcaatgagagctaag

SEQ ID NO: 23928 - DNA, 318 bp, Glycine max
  Peptide Sequence Number=SeqID_140706
aagcttgtgataatgggaccaaaggaatatttgaaatccaccaagtttgtagttccaagaagaattcccaccagcacgtacccgaagtcaagttcacaatattgcaatattgctgcgccagtagttaaatccagcttagggagttcctcaagtcatgaacagaaaatttctgaagaaacacctcaaaatagtactcagaaagatgagacacaaagatttgctgacgctgcaaaagagattgcatacatgatgaataaggattatcatggaagaccgagtcacaggccacccataaataacaatgagcctagaaattaa

SEQ ID NO: 23929 - DNA, 678 bp, Glycine max
  Peptide Sequence Number=SeqID_140707
atgcaacattccaagtgcagcatccaaactagaagagggtcacagcaaactgagcacaaccgcagtcacgaaacacaacaaagaggggcacaacaaaccaaacacaatcgtctaagagaaagaagggtttctgattttgggctctcaaaggaagaggtctttgatggccgtaattctggccttaaaggtacatatgggtacatggaccctgcatacatttcctcaagcaagttcacagtgaagagtgacatttacagttttggtataataatttttgagctgatcactgccatccacccacatcaaaatttgatggaatatatccatcttactgatgatttcttcttcacatctttatttttcatttactgcaaggctgcaatggattatgatggtgtagatggaattcttgacaagcaacttgtgggaaaatgcaatcttgaagaagtgagacagcttgctaaaattgcacacaaatgtttgcacaaatcacctaggaaacgcccctccattggtgaggtttcgcagggtatattgaggattaagcaaagacgcctcatgaaagaagacaccatgtcatttgcaagcagcaacttctcccgaagtgtgagtcaaatagaggagcaacaggttgaattaagtaaaataaccaccatgaaccacagggaaatggggtga

SEQ ID NO: 23930 - DNA, 1167 bp, Glycine max
  Peptide Sequence Number=SeqID_140708
atgcgatcagcaatatgtgacatggttgctattgccagacacttaaatgtcactctcatagttccagagctggacaaagcctctttctgggctgatttaagtgacttcaaagatatatttgatgtagatcacttcattacctccttgagagatgaggttcgaataataaagcaactaccacctaaggtcaagagaagagttgaactaggattattctactcaatgccacccattagctggtctaatatctcatactatgaaaaccaggtccttcctctgttgctgaaacacaaggtcatacacctaaatagaacagatgcaagacttgcaaataatggactacctgctgagattcaaaagctacgatgccgagtaaacttcaatgctctaaggtttactactcagatagaagaacttggcagaaggatagtcaaggttttgagggaaaagggtcctttccttgcacttcatcttagatatgagatggacatgttggccttctctggttgtgcccatggttgtgacatcaaagaggaggaggaactaacaagaatgagatatgcataccctgggtggaaggaaaaagttattaattctgagcttaagaggaaagaaggtttgtgccctataacacctgaggaaactgcactagtattgtcagcacttggaatagatcgcaatgttcaaatttatattgcttctggagaaatttatggtggagagaaaagaatggcaagtttactaggagagtttcctaatctgataaggaaagaaattctgttgggaccttcagagttgatgtatttccaaaatcactcctcacaaatggctgcagtggattatcttgtctccctagagagtgatatatttattccaacatatgacgggaacatggctaaagtagtggaaggccatcgcagatttctaggattcaagaaaactatactactggatagaaggcttctggtacacctgatagaccaatactataacgggttgttgagttgggatgagttttccactgctatgaaggaagctcatgcctatcgtatgggaagccccaagagaagagttatcattccagacaaacccaaagaagaagactatttttatgccaaccctcaggaatgtttgcaattgttagatgaaccattagaaagcacataa

SEQ ID NO: 23931 - DNA, 2025 bp, Glycine max
  Peptide Sequence Number=SeqID_140709
atgaagtcaaagatgaaatgggttggtctgttcggccttgtgctctcagctttttccatcttcattcacttcctccttgctagattcactcaaatgggtgttgcagactatgagtcctctgtcacaatcttctcttggagacccatctttgagaaaccaattccccccacaaatactccctcttatagaaaattatggggtccggtgaagcgtctcgaatcattgtatccggattcaaatccacgaggatattatgctgatcctgtttcagaaacaaatgggtttatttttgtccggatacaagggggttttcatgagatcaggaattcgatatgtgatgttgttgtggttgctcgacttctcaatgctacattagctatgcctgagatccaatcaacaaccagcagcaagggaataagctctcagttcaagagttttgcatacctatataatgaagagcaatttgtcctctcattagcaaaagatgtcactgttgtgagaactcttccgaaagatctgaaaggtgcaaggagaaagaaggagattcctgtttttaaagttccatattcagcatcacctttttattattttcatcatgttctccctgtattaaagaagcattcggtggttgaactagttgtttctgaaggtggatgcttgaagtttcgacaggaagtccaggaactttctgctaagattttgcagaggcaagaggaatttcatcatcacctctcttttaagttacgagctcctggtcgtccattcattgcctttgaccctggcatgactagagaatctttagcgtatcatggttgtgcagaactgttccaggatgtacataccgaacttattcaacacaaacgatcatggatgataaaacgtgggattgtcaaggggaagctttcagtcaactcagccgaagaaagactaaaaggctcctgtcctttaatgcctcaggagattggtattcttcttcgtgcttatggatactcaaaggatgcaattatttatgtatctggaggagaagtctttggaggtcaaagaacattgattcctcttcatgctatgtttgaaaatgttattgatagaacttctctaagcactccttgggaaatgattaggctctatgggaaagaggtgaaccttgttgatactcctggaccgccacctttcgttgaagaagtaacaaagcgtgcagcttggaaaaatgcaggtccacgtcctcgcccacttcctccacctccagctaggccaaaatcatacaacatagaaggttggtggggttgggtagctgagagtgataatgagcctgatagtacagttatagaactgaggaccaatgcccataaattactatgggaggctattgactatgtgatctgtgttgaggctgatgtattcatccctggatttgaccgtgacgggaaggggcatccaaattttgctagcttggtgatggggcacaggctatatcagtcagctgcatcaaagacatttagacctgacaggtctgttttggcaaaggatctctatgaccttgggtgccaacctaattgggatgcaagaaaggaagtggctaaacttctagacgagatttgtgaccataggcatcatgcaaatcatacatggctagaaacagttcgaaggcatttgacaaaaacattacttgatggaattatagaagcatcaaataaatcaaaaccactatcctttctctctcatccagtccctgaatgctcttgttcacggcgtgactcctttgaagtatcaaagaattcttctagccctttaacttcccaattatggacagctcttagtgtagctcaccagtgtcctgcatggatggacactggtccaatttctcaatcaaaagataaggaaaatgaagaggatgtcgacgaggatgattctgtatccgagttattctttaaacaaaatgctgaaaatcacgaaggtgatgcagaagtgaacattaaagaagaaaatcagtttgaggatcaagaagatgacggtggggaaagatga

SEQ ID NO: 23932 - DNA, 873 bp, Glycine max
  Peptide Sequence Number=SeqID_140710
atggctaggtctgcgaaagggcatcaagatgaattcgacgacgatgatgaagaagaactcttaactgctaataacacctcttccaaagtgaaggtggatgaacccagcacggggaagagggtgaacccacagcgttcaaagcattcagaaaccgagcaacgatggcattgtggcaacttcagtgatctatttgtcacaatgagaaataatcacgggcctgcagaaaatactacagatccttctcaagctactcaaaatgggtctgttgatgagaaaaataacaatgtctctccattgttgcccaaaaatgtacagaacccgatagagtctgacttctcaatgacaactattcagaagggcaacatccctggttcaactacagaagcagttcccctgcccatgcaaatgcgattggacatgtttgatccagttgttagcagtagtatggcaacccaacatctgctggaacctgtatctaatgttaacatgctttcccatacccagcctcaattgtggcttgataaacgaaacaagggcaactatattcttccacataatgatacaatgaaggaacaggaggagctggtgaatgaaagtgggtcagatagcatctcaagtgcctattctcagggaattttagattctctcacacaagcactgcactcttcaggcgtagatatgtcccagactaatgtctcagtgcaaattgatgttggtagacaagaaaatgctgggctgatcccctctgcatctacttcaaagggtcatgaaaaccaatctgtgagcaatccagcaatagcacgttccggagttgattactgcaatattgattctgaacaaagttcaaagaggctcagacaagaagcaagctag

SEQ ID NO: 23933 - DNA, 8673 bp, Glycine max
  Peptide Sequence Number=SeqID_140711
atatctgtcttcaattcaaatcctgatatagtcatggttggttttcgagttcatgtgggaaatacatcagcaagtcacataccgtctagcatttctattttccaaagggttgttaaatttgatgaaggaatgaggtcctggtacgatattccatttactgttgcagaatctcttcttgcagatgaagaatttacaatctcagttgggccaacctttaatggctcaacactccccagaatagactcgcttgaagtttatggccgagctaaagatgaatttggttggaaagagaaaatggatgcagttttagatatggaagcaagagtacttggttcaaattcgtcacttagtgggtctgcaaagaagcgccgatcgatgcagtctgctcctattcaggagcaagtaatagcagatggactcaggctaattactaagttctactcatcatgtaagcaacaggatatctcaaggtttgaggaagcaaggacagaacttggaaaactcaagtgcaagccaatactagaaacgatattcgagtgtgatagggaaccaattctgcaggcttctgctagtcgtgtcttacaagcagtttttcccaagaaagagatatatcatcaagttaaggatactatgcaacttcttggagttgtaaaatcctcatcactactatcatcaaggcttgggataggtggtgctgcaggaagttggatcattgaagagttcaccatccagatgcatgcagtctgtaagattgcattgcaacgtcgctcaaatttagcaacatttctggagacaaagggctcagaagtggtggatgtacttatgcaagttttatggggaattttggattttgagcagcctgacacacaaaccatgaacaacattgttatgtctgcagttgaactcatttattgctatgctgaatgcttagccctacacggaaaagatgcaggagtgcattctgtggcgcctgctgttgtgttacttaagaagcttctcttttcgtccaatgaggctgtacaaactgctagcagtttggccatatcttcaagattgcttcaggtcccttttccaaagcaaaccatgttggctacagatgatgctgttgagagtgtggtgtcagttcctggccctgctgacccaagtactggaaataaccaaatcatgattgaggacgatactattacttcatctgtccaatattgttgtgatggttgctctacagtacctatacaaaggcggagatggcattgtactgtttgtcctgattttgacttgtgtgaggcttgctatgaagtaccagatgcagatcgtcttcctccaccacactctagagatcatcctatgacagcaattccgatagaagtggactcagtgggagatggaaatgaatttcagttcacagctgatgatgttagtgaccagaacttgttgcctttacctgctgatagcaacatgcaaaattcttctccatcaattcatgtcttggaaccaaatgattctggggattttgctgcttctttaactgatcctgtctcaatctgtgcttcaaaaagggccataaattctttacttctttctgagcttcttgaacaattgaaaggatggatggatacgacctctggagttcaagcaatccctgttatgcagcttttctacaggttgtcatctgctgtaggtggaccttttatagacagctccaagccagatagcttagatttggagaagctaatcaagtggtttttggatgagattaatctcgacagaccatttgtaggcaaaacccgttcatcatttggtgaagttgcaatcctggtcttcatgtttttcacattgatgcttagaaactggcatcagcctggtagtgatggttccattcctagacagagtggaactactgacatgcatgataaaaatgtagtccaatttccaccatccacctctgcttgtgctaagacttcagtagatgaccaacagaagattgactttgcatcacaactgcttcgagcttgtgattctcttaggcagcaatcttttgtaaactatttaatggatatattacagcagctagtgtatgttttcaaatctcctgttaacaacgaaggtgtgcacagcaatgctgggcctggatgtggagctctactagcagtacgtagagatttaccagctggtaattttttacctttcttttccgattcgtatgccaaagtgcatcgaaaagatatcttcatggactaccacaggcttctattagagaatgctttccggctggtgtacacccttgttcggccagaaaagcatgacaaaactggggaaaaggaaaaggtctacaagttatcacatggtaaggatttgaagcttgatggttatcaagatgttctctgcacttacatcaacaatcctcacaccaattttgtaagaagatatgccaggaggctttttctgcatctctgtggcagcaagtctcattattacagtgttcgagactcttggcagttctctactgaagccaaaagactttataaacacacaaacaaatctggtggttttcaaaataatcctatcccatatgaaagaagtgtaaagattgtgaaatgcctttccactatggccgaagttgcagctgcacgtcctcgtaactggcaaaagtactgtttaaggcatggagatattttgtctttcctgatgaatggaatattttatttcggtgaagagtctgttattcagactcttaaacttctcaattttgccttctatacaggaaaagatgttggtcacactccacaaaaaatggagtcaggagacataagttcaagcaaatcaggtaccatatctcaagaatcaaagaagaaaaagaaaggtgaagatggaggtgaatctggttcagagaagtcctatttggatatggaggcagcagtagatgtcttcactgacaagagtagcaatattttgaaacagctcattgatggtttccttctggagtggaattcaattactgtgcgtgcagaggctaagttagttttatttggtgtctggcatcatgccaagccaacatttaaggaaaccattctagtggcactcttgcagaaagttaagttcctcccaatgtatggtcagaatattgtggagtatacagaacttgttacttggttgcttggaagatcctctgatactagttcaaaacacaagatttctgaacttgtgggccgatgcttgacacctgatgtaattaaatgcatctttgagacactccattcacagaatgagctgttagctaaccatccaaattctcgcatatataatactttgagtggcttagtggaatttgatggatactatcttgagagtgagccttgtgttgcctgcagcactcctgaagtaccttacagcaggatgaagctagactctctgaaatctgaaacaaaattcactgacaaccggatcatagtgaagtgcactgggagttacacgatccagactgtgacaatgaatgttcatgatgccagaaagtcaaaatcagtgaaggttttgaacctatactataataacaggccagtcactgacatatcagagttgaaaaataactggtctttatggaagcgtgcaaagagttgtcatcttgcattcaatcagacagaacttaaagttgaatttccgattcctattactgcttgtaacttcatgattgaactggattcattctatgaaaatcttcaggcattgtctcttgaaccattgcaatgtccacgttgtagtcgtccagtcacagataaacatggtttatgtagcaattgtcatgaaaatgcttatcaatgtaggcaatgtcgcaacatcaattatgagaatttggattcttttctatgcaatgagtgcggatacagtaaatatgggcggtttgagtttaacttcatggcgaagccaagttttacgtttgataatatggagaatgatgaagatatgaagaagggattggcagccatagaatctgagtcagagaatgctcataggagataccagcaacttttgggcttcaagaaacacttgctaaaaattgtatcaagcattggtgacagtgaaatagactcacagcagaaggactctgtacagcaaatgatggtttctttacctggtccatcatgtaagatcaacaagaagattgctcttcttggagttctatatggtgaaaaatgcaaagcagcttttgattctgtcagcaaaagtgtccagacactgcaagggctacgtaaggtgttgatgagttatctgcaccagaagctttctgatactagtgtgggttcaagatttgtggtttccagatcaccaaatgattgctatggctgtgcaactacatttgtaacacaatgtctggaactattacaggtgctagcaaggcatccaaattctaagaaacaacttgtttcagctggcattttgtccgagttatttgagaataacattcatcaaggtgctaaagctgcccgcgtccaagcaaggattgtactttgttctttatctgaaggtgatgtaaatgcagttactgagttgaacggtctgatacaaaagaaagttttgtactgccttgagcatcatcgctccatggacattgcagtgactactcgtgaggaattgctattactttctgaggtgtgttctttggctgatgaattctgggaatcaagacttcgtgttgtgtttcaattattattctcttccatcaagttaggtgccaagcatcctgccatatctgagcatgtcattcttccttgtctgagaattatatctcaagcatgcacacctccaaaacctgagacaccagacaaagagcaaagccttgggaaatcttctacaaatacaaaggatgagagtaatcaaaatgtatctgggtccttgactggtgcagtcactgtcagtggaacaaaaacattcccagactcatcagaaagaaattgggatgccacacccaagactcgagatattcaattattgagctattcagaatgggagaggggagcttcctatcttgattttgttagaaggcaatataaagtgtctcaggcagtcaaaggtactggccagaggtcacgaccccaaaggcatgattacctggcagttaaatatgctctgaggtggaagcgtcatgctggtaaagcagctaaaagtgacttatcggtgtttgagttgggatcatgggttaaagaacttgttttgagtgcttgttctcagtccattagatcagagatgtgcacactcataaccatgctttgtactcaaagttcatccagacgatttcggttgctgaacctagtgctttctttgttaccagcaacactttcttcgggtgaaagtgctgcagagtattttgagttgctattcaagatggtagattcagaggaggctcttttatttttgactgttcgggggtgtctacggaccatttgtactctaattacccaagaagtgagtaatgttgagtcgttggagcggagtctacacattgatataacccaggggtttatccttcacaagctcatagagcttcttggtaaatttttggaggttccaaatatcagatcaagattcatgcgagatgacttactttctgaaattcttgaggcccttattgtaattcgtggcttgatagttcaaaagacaaagttgattagtgattgcaatcggctccttaaagatcttttagatagtctgctgctagaaagcggtgaaaacaagcgacaattcataagggcatgcatcaatggtctggaaatacacagagaggagagaaaggggcgtgcttgtttgtttatcttagagcaactctgcaatgtgatctgcccctcaaaaccggagcctgtatatttggtggtcctgaacaaagcacatacccaggaagagtttatcaggggatcaatgactaagaatccatattcgagtgttgaaattggcccattaatgcgcgatgttaagaacaagatctgccagcagttggatttgttagattttcttgaggatgactatggaatggaattgttagttgctggcaatattatctctcttgatttgagcattgcacaagtttatgagcaagtctggaagaaatcaaatcactcatcaaatgtgactaattccaacttgttatctccaaatgctgtcaactcatccagagattgcccaccaatgacagtgacttatcggctccagggattggatggtgaagcaactgaacctatgattaaagagttggaggaagatagggaggagtctcaagatccagaggttgagttttccatagcaggtgctgttcgtgagtgtggtggactggagatactattgaggatgattcagcatctgcgagatgatttcaagtccaatcaggaacaactggttgcagttcttaatcttcttatgtactgttgcaaaatcagagagaacagacgtgctttgttgaagctaggagctttaagtttgcttcttgagactgcaaggagagctttctcagttgatgccatggagccagctgaaggcatacttttgattgttgaaagtctgactttagaaggaaatgaaagtgacaatataagcatcacacaaagtgcccttactgtcactagtgaagaagctgggacaggggaacaagccaagaagatagttcttatgttcttggagagattgtctcatccattgggccttaggaaatcaaacaaacagcagagaaacacagagatgattgctcgaatattgccttacctaacctatggtgaacctgctgcaatggatgcgcttgtccatcattttagtccttacttgcaagattggggtacatttgaccatttgcagaaacaacatttggataatccaaaggatgataatattgctcagcaagctgcaaagcagagattcacactggaaaattttgttaggctttcagagtcgcttaagacaagttcttgtggagagagaataaaggacattatcctggagaagggtataactaaaactgcaatgacacatttgaaagatagttttgccaatactgggcaggctggctttaagaacagtgctgaatgggcacagggtttaacactgccatctgttcctcttatattgtctatgctgagaggtttgtcaatggggcatctgctcactcaaaagtgtattgatgaggaaggtatcttacctttgttgcatgccttggaaggagtttctggagaaaatgaaatttgggaaagggctgaaaatttgttggacacattatctaacaaggagggaaaaggagatggattcttggaggagaaggtgtgtaagctgcgagatgcaactagggatgaaatgaagcgtcgtgctttgcggaagagagaggaattgcttcaggggcttagaatgcgtctagaaccgtcttcagatggaggagaacgtattgttgtttcccagcctgtccttgcaggtttagaagatgtccaggaggaggatgggctggcatgcatggtatgccaggaaggatacagtttaagacctgctgatttattgggtgcttactcttatagtaagcgtgtgaatctaggggttggttcttcgggaagtgctcgtggaggagagtgtgtttataccacttgccatcaagaggccaagagaactgatgctgctttgaagaatccgaagaaagagtgggatggagcaacacgtagaaacaatgaatgtctctgtaattctttattccctgtcagaggtccatctgttcctctggcacagtatgttcgctatgttgaccagtattgggacaaccttaatgctcttggacgtgctgatggaagtagactccgcctgctgacttatgacattgttctgatgttagctcggtttgcaacaggagcatcattcagtgcagattgccgaggtggtggacgagaaagtaattcccggttcctcccatttatgatccaaatggcatgccatctccttgatcaaggaaacccctcccagtgtcgaaccatggccagggccgtatcagcatacatatcctcttcctcatcagatctcagaccctcttctccatctggcacccaacctatgccggggactgaagagactgtccaatttatgatggtaaactcatttctctcagagtcgtacgggtcctggctgcagcatcgttgtgcttttctgcagcgtggattttaccatgcatacatgcagcacacacattctcggtctgctacccgtgcgccatccgttacagctcctgcacaaggtgtggaatctggaagcatggaccaaactgctactaccgaaacagggcagagtgatcttttgtctattatacgtccaatgcttgtttatacaggcttgattgaacagttacaacgtttcttcaaggtcaagaaatcaactagtgcaacaccacctgcaaggactgaaggggcatcatctactatagaaggggaagatgaaagtggaattctggaaggctgggaagtggtaatgaaagagcgactcttgaatgtaaaagaactgctcgagttccccaaggagatgctgtcatggcttgatgagattaattctgccactgacttgcaggaagcctttgacatagttggtgttctagctgaggtcctgtccggtgggttcacccggtgtgaagattttgtgcaggctgcaattaacgcagggaaaagctga

SEQ ID NO: 23934 - DNA, 1653 bp, Glycine max
  Peptide Sequence Number=SeqID_140712
atggagtccttcatgatgttagggagagggatgatagagaactcactctccgatggccttgatgttcatcgccgccttgtcagtagtggttttgaccaagacccttttttagctactaaactaatcaatatgtactatgagcttgggtctatcgaccgtgctcgcaaggtatttgatgaaactcgggaaagaaccatatatgtctggaatgcactcttccgagcgctggcaatggtgggttgtggtaaggaactgctagatttgtatgttcagatgaattggattgggatcccatcggataggttcacatatacatttgtccttaaggcttgtgttgtttcagagctgtcagtctcccctctccagaagggtaaggagattcatgcccatattctgcgacatggctatgaagcaaatattcatgttatgacaactctgttagatgtatacgctaagtttggcagtgtgtcatatgcaaattctgtgttttgtgcaatgcctaccaagaactttgtctcatggagtgctatgattgcatgctttgcaaagaatgaaatgcctatgaaagcactggaactgtttcagttaatgatgcttgaggcacatgattcagttccaaattcagttacaatggttaacgtgcttcaagcctgtgcaggtcttgctgcattggaacaagggaagttgattcatggctatatccttagaaggggacttgattctatactgccagttcttaatgcccttataacaatgtatggaagatgtggtgagattttgatgggacaaagagtttttgataacatgaagaatcgtgatgttgtttcatggaattctttgatttctatttatggtatgcatggttttggaaagaaagcaatccaaatttttgaaaacatgattcaccaaggaagttcaccgagttatatatcattcattactgttctgggtgcttgcagtcatgcaggccttgttgaggagggaaagattttgtttgaatccatgcttagtaagtacaggatccatccaggtatggagcattatgcttgtatggtggatcttcttggccgagctaacaggttagatgaagcaataaaactaatagaagatatgcattttgaacctggccctacggtttggggttcccttcttggatcttgtaggattcactgtaatgttgaacttgcggagagagcaagcactttgctttttgagttggagccaaggaatgctggtaattatgtgcttttagcagatatttatgcagaagctaagatgtggagtgaagcaaagagtgtgatgaagctattggaagctcgtggcctgcaaaagctaccaggttgcagctggattgaagtgaaaaggaaggtatactcatttgtctctgttgatgagcataacccacaaattgaagaaattcatgctttgctagttaaattgtcaaatgagatgaaggcacagggttatgtcccacaaacgaacgttgttctctatgatcttgacgaagaagagaaagaaagaattgtattgggacatagcgaaaagcttgcagttgcttttggactcattaatactgaattcactgatccatgtctttctggaactggagctctcacgcgttccatcttgggttattctaactcttggatctga

SEQ ID NO: 23935 - DNA, 249 bp, Glycine max
  Peptide Sequence Number=SeqID_140713
atgtcggtggccccacatttcccagccaatgtaatactaatagcttcatcaatgtcaatgctttgtgaagaaacagaatatggttctttcggaacctgtattgcatttgctgctgttcttccagctaaggcaaaagagtatcagtactaccctacccgctattgctatataccaacttgggtggcacatgttcccccagcataccatgttaatccatgtaaaccagatatatatctctcatcttcctga

SEQ ID NO: 23936 - DNA, 525 bp, Glycine max
  Peptide Sequence Number=SeqID_140714
gcttcgcttctacgactgcctccccagccgttgcaaagactgagcgagaacgggctgctcgccctaccgaagtactaaaggctttcgaggcttacacctccctattacacgacaaaaaggcccggcccgcccgtctgctgctagatccgggaatggcgccaggcgagggcgccgctatgccccgcagctctgcagcggccggcccccggactatgcaaaagaatcgaggccgggggctcgccctcgagccctgggcaggtcggccgggtctttccctgttgttctgttcccgccacgagaaagacgcacagaagaggtatgcccagcgcgcggaggatccgttgagagtgtctgttgtctcgcggagcggggccaatttctcgtacttgctcagcgatctagagagatactacgagtcctccgtcccagattccatcgccgcggccatctggttcaccggtactaccaaaaagtctcatgcttacgttactactgttacggatggtttgattatcttggaccccg

SEQ ID NO: 23937 - DNA, 1056 bp, Glycine max
  Peptide Sequence Number=SeqID_140715
atggcccaagacaaaaaggagcgtaaaaggagcatgaagaagaagcagaaccaatctctgacaactctgcctcaggaattgatcagagaaattcttctgagataccgatcacatgatttttatgctcaatccatcgccacggaatcagtgttcaaaacctgtagccgagacgtggtttatttccctctccctcttccatcaattccatgccttcgccttgacgattttggcattcgacccaagattttgggttcatgcagaggccttgtacttctatactatgacgacagcgcaaatctcattctgtggaatccgtcccttggccgtcacaaacgattgccaaactacagggatgacataacttcattcccatatggttttggctatgacgaatcaaaagatgagtacttgctgattctaattggattgcccaagtttggacctgaaactggagctgacatctactccttcaaaaccgagtcttggaaaacagacactattgtttatgatccattagttaggtataaggctgaggatagaatagccagagcagggtcgctcctcaatggggctcttcattggtttgttttctcggagagcaaagaggatcatgtgattatcgcctttgatctcgtggaaaggactctatcggagattcctcttcctctcgctgatcgttctactgtgcaaaaagatgcagtttatggtctgagaataatgggagggtgtctcagtgtgtgttgctccagctgtggaatgactgagatatgggtgatgaaggaatataaagtgcggtcatcttggactatgacctttcttatccatacttctaatcggatttccccaatatgcacaatcaaagatggtgagattttaggatcaaattgcgcgggaactggaagattagagaaacgcaatgacaaaggagagctgcttgagcatttcatggacaccaaaggtcaacggttcagctgtgccaatctacaggctgctatgtatacagagagtctactgccactcccaacgtcattttgggaaacaagtgaagaggactaa

SEQ ID NO: 23938 - DNA, 507 bp, Glycine max
  Peptide Sequence Number=SeqID_140716
atgtttaagtaccaagatatacgaaagacgaagagtggggtagagcatgggcactctccctcaagagttgataatagaaattctcctcagattgtcgtgcatttgattctcccctctacatcaaccccgtaccgtgaccaatacgatgatgattatcgtgataaacttgagattttgggttcatgcagagggctcatacttttatactacgatagaagtagtgatctcatgtcgactatgatggatcatatttctgctatgtataagcgtctcgatgataaatttggagctgactcgctcttcaatgaggttcttcaggttattgccattcttgtctttgatctgataaaaaggagttttcgagagattcctctctttgatcatttcactatggagaaatatgaagtttgtagtttgagggtaatgggagaatgtctcagtgtatgttgctcggtccaagacggtgcaactgatgaaatatgggtgatgaaagaatataaaatgtag

SEQ ID NO: 23939 - DNA, 6186 bp, Glycine max
  Peptide Sequence Number=SeqID_140717
atggctttggttgatggaataaatatggtagcagacatgttgcaacccacaattgctagtgccttggtagatatgttgccaatggtagatgattgttgtggtagttttgtggatgactacaaaaaatgccatctagaaggtttcaaatgctcaaaggaagaaaaatcaatggattggcttttaaagactttggcttctgaacgtgtgcctcatgataggcaagaatctggattcattgaacagacttattatcaatatttcaataattttgtctttctatcccagcactgggcagttgtccatggaaaatgcactcctcgcctgatcttgctatgcaataagctagctaaagtaaaaaatgtatttgatgagaaggccatgagtcaaaattttcgaaggagactgtcattcattttgaggatgttaaagatacttggaagtctcttgaaggatgttccatatgttgaatatgatgcctcattgatgggggcagttgccacattttctaatactctgtttagtttgtttagaattaactttgagtatgtgaataccttttctgttactgagggaagttttgagagcattattttaatggttatagaagaatttcttcacagtgttcaggttatttttggcaatagcaatgtttccaagaatatccaaacatgtattatagcagctatattggagagtttggattcttctgtttggacatatgacaaatttgctcccaatttgaagccccccttagcttacttcccccgatttattgtttatacactgaaactcattactgatctgaaaagacaaaggcatctggttccttttgagtggaaagactttgatgtggaacttgttggcagttctactgactcacagatcggttctccttcgtgccttgttcatctggagcctgttcctttgctgaagggatttactttggaagagcttctaaaattaatgtttcctgtgtcgagccaatggattgccaatttgatgcaacttgctttgttccttcattgtgaaggtctgaaattaaggccaaaaatggaaaggtcccattctagtttggcaaaagttgctgggacatctgaagttgaaaatgcagtatgccatgaggatgaggctctttttggagatcttttttctgaaactgggcgttctgttggatctacagatggatgtgaacaagcacctgttgctgctttaatttctagttccagctatcaaaatatgccaacacaagctgctatagaacttttgaactttcttaaaacgtgcatcttctctgctgaatggcatccttctctttatgttgatgcctgcaacaaactcagcagtagagacattgatattttgctttccttactcaattgtcagggctgttgttctgaagataatatttctgatagttgtaccccattacttgtagatggaaagattgggcatatccatgatctgtgctttgatattttacacaaccttctcactagccatgctttgaatgattcacttgaagactaccttgtagataaaatcctaactgttgagaatggttcttttagttataatgacagaaccctgaccctgcttgctcacacactgttttgtagggttggttcttctggtagtcagttgagaaccaagatttgcagggtatatgttgcctttgttgttgagaaggcaaaaactgtgtgcataaattgcccaagtatcaatgatcttgtaggtactcttccctcgctgtttcacattgaggtggttcttatggcattccacttgtcttctgaaggagaaaaggcagtgatggcaaaattaatcttttcaaccctcaaagaagttgcaagtttgatattagatttgaacagcacacatttaacatgttgggctttagtagtttcaaggttgatcttaattcttcgtcatatgatatttcaccaacagacttgtccaacatcattgctcatagatgtgcgatctaagttgagggaagcaccactttctggctcatctatgccaaacaaagttaatgatcacatgccatcttggtcttcaactgcatttaaaaacattgcaggtggattgattggagaggaagcttttgttagtagcttgattggacacctagttgatatttctgggtcttctgcttctcttgttagggaagatctggcaattgacagcttaactttgaattggggagagatatactgtactttttctctgattttggggttttggagtggtaaaatggccactgcagttgaggatctaattgttgaacgatatgttttctccctttgttgggatattccttatgtaggctctgaagcagaccatacaattaaatcttgggatcaagatcaccctatggatccatctaatatgttgcattttttccacttcagccatttactccatggccatccagagggcattgggaagttcactatttctccagatgctatattgagcctgcttcagcatttaaatgatgctttgcccataccaaaaggcattgagcaattaggttggtatttcctcagaagtggaatgtggctatctctggtgatctccttcattaacgttggcatatggagatattgtatggataatgctatttctggacatggtctaacctggactgggaatgctttgggggatgataaatatgttaaagttgctggaagcatgatttcctccatgattgagtctggccaatttgcattgcttgtaaagctgttctcatcattgctgaacaagcatttacaagtttgtcagaacgctttccttgatatccttaatgacaagcaaaagctggctcctggattttcaccattcttgcttctgaaacatactgaaatggaccaaagcctacaggatgagctcctagagaggagtggttcgaatgcaggtgagctgcagtctgttcttagcctcattttgaggttggatgttgttgttgataaaaaagcttctggaattctttctagagcttcttgggagtgcctgttgcatggctttccttttaatctctgtactcctagttctactatgttttcttgtgtccttagcataagaggaattatctttgttttagatgggttacttagagtaaaagaaggaggcagtattagtaatttggaggatgaaatccttgggcaagttcttgatgcagtaatgatcatcaagtatgataggacctttgaaagtgttcatgggaaatgtaacactatctatcacagcttgagtgctgaactggatttttcgtgttatgaagatttaattctaatgaagcaaatggaagggtttctgaaggatgtcaatgctggaggagcaagtgattgcagtgttcgtgaatggataatctgtaaaattattgaaatattaaacagcctaagaaaagacccttcgaagtctgttatatttcatttttatcttggtgctgaaaatgtgcctgagaagatgaataggcttttgcatttgcatcttggagactgtttggttctaattgatgctttagattcatgcttctctgaatcagtgaatgtgaaggttcttggattctttgtggatcttttgtctggagagcaatttcctgaccttagaatgaggatacaaaggaaatttctggatagagacatacattgtgtatctaagtggttggagaagaggcttttaggaagcataatgaaatcagattgtggggtggactgtgcaaaggggagctccatttctcttagggaatcaacaatgaattttattctgtgtcttgtatcaccaccctctgaacaacaatcaaaagaattgcaacaacatatttttaattctgcactggggtcacttgattctgcttttttgttgtttgatatacatgtagcaaagtcttttttcaatttcattgttcaaatttctagaggagagttcttgatgaaacaggttttgacaaggactgcaatgttgatggagaaactggtggccaatgaaaatctgcttccaggactgaagtttctttttgcctttattgaaactgtcttgagtgattgtggatccagtaaaatttccttgcaaaagacaactaagaagtcttctggcaatagtcttggggtaggacattcttctgctcaactggttggatccagaaaaaattctgagacatttatcctttctgccaatcaagaaggggggtcaacctctctcgaatgtgatgcaacttctatggatgaggatgaggatgaggatgatgcaacttctgatggagaggttcttagcatagataaggacgatgaagatgatgctaacagtgaaagagtccttgcctctaaagtttgcacatttacttccagtggcagcaatttcatggagcaacattggtatttctgctatacgtgtgacttgactgtatcaaaaggctgctgctcagtctgtgccaaggtttgtcatcggggtcatcgtgttgtctattcacgttcaagccggttcttttgtgactgtggagctgggggtgtgaggggtagtaattgtcaatgcctgaaacctcgaaagtttactggagatagcagtgcacctgttcgtggctcaaatacttttcagtcatttttatccttccctgaggatggagatcagctgccggacagtgattcagattttgaagaagaaatcagttcagatgcagataactctctcaggctatgtattccaaaagaacttcaagaacggattccgttgttattggaagaacttgatattgagagtcgggtgctcaatctttgctcttctttgttgccatttatacttagcagacgagactctcaccattctaaggataagaaaataagtttgggtgaagacaaggtgatttctcatggcattgatctcttgcaattaaagaaaacatataaaagtggatcatttgatctcaagataaaggttgattattcaaatgccaaagagcttaaatcacatttagctaatggttctcttgtgaagtccttactcagtgtgagtggacgaggtcgacttgctgttggtgaaggtgataaagttgctatatatgatgttgagcagttgattggtcaagccaccattgcacctgtgacagccgacaagaccaatgtgaaacctctttctaaaaatattgtccgctttgaaattgtacaacttgcattcaacccttttgttgagaactatcttcttgtagcaggatatgaggattgccaggtcctgacattgaatcctcggggtgaagtgattgaccgccttgccattgaactagctttgcaaggtgcatatattagacgggtggattgggttccaagctcacaagttcagttaatggttgtgactaacagatttgttaggatatatgacctgtccttggacaacatcagtccaatgcagtacttcactttgcaagatgacatgattgtggatgcagttctttgtccagcttcccaaggaagaatgtttctccttgttctttcagaaaatggaaacatattcaggtttgagttgtcagttaagggtaatgttggggctgtgccattgaaagaacttgtacaccttcagggaaaagagattcatgcaaagggatcatcattatacttctcttcaacttgtaagctactctttgtatcttttcaagatggcaccacagtggtgggtcgcccaagccctgatgcagcctctctagttgagatgtcttttgtatacgaggaacaagaaagtaagctgcagcctgctggagtacatcattggaaagaattgctggctggcagtggattatttgtttgcttatcaacaatgaaatcaaattctgcgctcactgtgtcaatgggggaatatgagataattgcacagtgtatgcgacattcagtgggttcaacctcacctatagttggtatgattgcatgcaaaccactatcaaaggataaaatccactgtcttgtcttacatgatgatggtagccttcaaatatattctcatgctcctgctggtgtggattctggtgtgattgcagcatccgagaaagttaagaaattgggttctggaatcctcaataaagcctatgctggtacaaatcctgaatttcctcttgatttctttgagaagactgtgtgcattacgcaggatttgaaactgggtggtgatgctgtcaggaatggagattcagaaaggagctaa

SEQ ID NO: 23940 - DNA, 936 bp, Glycine max
  Peptide Sequence Number=SeqID_140718
atggaggttgttttggcgtcgtcgtccgtcgacggcggaatagggtgctgggaccttcacaccggcgcggagcagctccgctacaaatcttgcacctccccttctcatggcctcgtctctgtcgctgctcgcttcatcgcttcgtcgcagcttcgagaagatcaatcagcccctggctctgttctcttctggtcctggtccaagcctcaagttgaagtgaagagttttcctgctgaacaaattaaacctcttgctactaatcacccgggaacctttatagctgctggagctccgtctggtgacatttacttgtgggaggttgaaacgggtaggttgcttaagaagtggcatgctcattttagggcggtttcttgcttggtgttttccgaagatgactcgctgctggtatctggttctgaagatggatccgtaagagtttggtctctcttcatgatatttgatgatttgcgaaatcagcaagcaagtagtctttatgagtatagtttttcagagcacaccctgactgtgactgatgttgttattggtaatggagggtgcaatgcgattatcgtgtcagcttcaaaggatcggacttgtaaggtatggagcttatctaggggaatgctactaagaaatatagtattcccttcaataattaattgcattgcattggatccagccgaacatgtcttttatgctggcagtgaagatggaaagatatttatcgcagcacttaacactgaaagcatcgccactaataattatgggatgcatatcatcagttctttttctaaccacagtagtagttctaggcttctagctagggttgtcaatatcaatcatgcacaataccgccgtcaggacatattatggctattggtcattccattgaagcctgttgtgtcacagcttgctgccgcacctgaagtggcataa

SEQ ID NO: 23941 - DNA, 1197 bp, Glycine max
  Peptide Sequence Number=SeqID_140719
atgaagaacgacactcagactctccctctggagttgatcatagaaattctgatgagattgccagtgagatctgttttgggtttcaagtgtgtctgtaaatcatggttttctcttatttccgatccccaattcggtatttcacattttgatctggctgcctcacccacccaccgacttcttcagagatgtaatcatttttacgctgaatccattgacacagaggcaccacttaagaaatattctagtgcagtgcatttccttctcccccctccatcacccccacaccatggtgaatacgacaattacgctgattatcaggataaacatgagatcttgggatcatgcagaggcctcgtacttttatactataagagatactgtgatctcattctatggaatccatcaataggtgcccacaaacgatcaccaaactttgcatatgatataacctttcaatttctatatggctttgggtatgacccatcaacagatgagtacctgctaatgatgattggattgtatgagtctggaaattacaagtatgataatggtaacgagtctgaagatcatgaatgcaaaggtaactatcagattttctctttcaaaactgattcctggtatatcgatgatgtctttgttccatacaaggatcttggtgataaattcagagccgggtcactcttcgatgagactcttcactggttggttttctccgaggataaaaagattcctgtcattctagcctttgatctgatactaaggagtttctcagagattcctctatttgatcattttactatggagaaatatgaaatttacagtttgagggtgatgggaggatgtctctgcgtgtgttgcttggtccaaggctatgaaaatgctgaaatatgggtgatgaaagaatataaagtgcagtcatcttggactaaatccattgttatccctactagcggattttccccgctacgcatcaccaaagatggtggaattcttggatcaaatacctgtggaagattagagaaacttaattacaaaggagagctgcatgagcatctcaattatggtggaggtcaatggttgtactctgccaatctacagtctgctgtgtatagagagagtctactctcactccccagtgttgttcgggtaccaagtaaagatgatcatgggaaaacaagtgaagatgaccaacaataa

SEQ ID NO: 23942 - DNA, 303 bp, Glycine max
  Peptide Sequence Number=SeqID_140720
atggggtatggtcatggtggattcagtttacttagtaaaataattcatgtcttccttactcagaagccacagtcatcaaagggagggcacgggcagcagcatggtattatggctgttagacttgtgaatggttattggtatatgcagacaactcttaattctggtaaatcgaggttgagggatgggatcataggcagcatagagcatatcacatgcaacttccttaaaatatgctatggtcagtatggtgtatcctctatatacggttactggtgttgtttgcggttgacaggctctttatag

SEQ ID NO: 23943 - DNA, 612 bp, Glycine max
  Peptide Sequence Number=SeqID_140721
atgacttctacagcttcacttgataattctctatctgacatgtaccgttctcctccaaggcccctgccttatgatgcagacaggtttttccgttcacagcgtgatggactagtgtcaagacgtgagaagggttcaagtcatttgaatgaagagtcagaacctctaagaggtgatgtagatgctgactcagaatctttaaattctgctggtaaatggaatgataccagtgaagatggatcaaaggaataccgttctaagtccactgtaaggctctcatcagcaaaacttacaactggagctggggttgtctattcatcatcagaagaggaggatgtctgtccaacttgtcttgaagaatttgaacttgtgacctccacgactctgtgtcacaaggaagcaatctatgttatcaatagcggctgtcctggttgctatcgcagcagtgtggagtggcccttccctgcaacaagtacaactgtagctgagcagattaaaggagcgacgcttttctccgcaatctcggtggagagggacgacaatatcacggtctctgtcgtggatcctttgaaattgaatgcaaattcaaaaaatgccctcaaatttcatcattaa

SEQ ID NO: 23944 - DNA, 2313 bp, Glycine max
  Peptide Sequence Number=SeqID_140722
atgcagagcgcagcgtcatcgtcgccgtcgccggaggccattctggaatggctgcacaaagaaatgggctaccgtccgctcggcacctacgcctccggcaagtcgcacctgccgtccgtcgactccatccgccggatttgccgcggcaacatgattccggtcttgaacttcctcgtcacgcgcgccaagtccgagaagaccgtgcggaacatccgccggaacatcaccgtgcacggcggcgcagacggcggcggagaggcgaaggaggagggaagggggaagggcgcgaggaagaaggagagggcgctcgccggcggcggcgagggttccgagactgcgacgacgagggaggcggcgttgcaagagcgggatttggccgcgaaggaggtggacaggctgaggaaagtcgtgaggaggcagaagaaggatttgagagcgaggatgctcgaggtttccagagaggaggctgagaggaagagaatgctcgatgaacgagccaattacaggcataagcaagtgatgttggaggcctatgatcgacaatgtgatgaggctgcaaaaatatttgctgaatatcataaacgtctctgttactatgtaaatcaagcgatggattctcaaagatcgggtgtggattcttctgttgaaatggccaaaagtgagaaggaagctgtttattctactgttaagggaagtaaatctgcagatgatgtcatcctcattgaaaccacgagggaaaataatattagaaaggcctgtgaatctcttgtagaccacatgatggaaaaaatacggagttcttttcctgcttatgaaggaagtggcattcatttaaatcctcaagcagaaacagcaaaattggggtttgactttgatgggcaaattcctgatgaggcaattactgcatacactttgcggctgaaaagtctaatctccagagaaatagagaaaattgatgttagagccgatgcagagaccttgaggtacaaatatgaaaataacattgttatggatgtttcatcatccgatgggagctctcctctacagtatcaactttatggcaatggaaagattggggttgatgtgcctccaggagggagtcaaaatcagcttcttgatagacagaaagctcatgttcaacaatttttggctactgaagatgcactaaacaaagctgcagaagcaagggacatgtgtgaaaaacttatgaaacgtttgcatggaggcactgatgtttcgtcacgctcacttggtattggaagtaattcccaaaatgttggaagtctcaggcaacttgagctagatgtttgggccaaggaaagagaagttgctggtttaaaggcaagcttaaacaccttaatgtctgaaatacaacgcttgaataagttgtgtgctgagaggaaagaagctgaagattctctaaagaaaaaatggaaaaagattgaagagtttgatgctcgtagatcagaacttgagactatatatatggcactccttaaagcaaatatggatgctgcttcattttggagtcagcaaccattaactgcaagggagtatgctttgagcactataattccagcatgtgctgctgttgccaaggcttcaaataatgcaaaggatctcattgagaaagaagtgtctacattttatcgaagtccagataatagtctctacatgcttccttcttccccacaggcactgcttgaggccatgggtgctagtggaccacctggccaggaagcagttgcaaatgcagaaataagtgcagctatgttgacagcaagagctggtgctcgggatccatcagcaattccatcaatatgtcgcgtttcagctgcacttcactatcctgcgggcttggagggttcagatgctggtctagcatctgtgctggagtccctggagttctgtttgaaacttcgtggttctgaagctagtgtgttggaagatttattaagggctattaatcttgtctatattagacgggatcttgttcaaagtggtgaagccttgttgaatcatgccaaccttgttcaacaagaatatgaaaagacaacaaaattttgtttgagtaaggctgaagaacaggagaaaactatcatggaagaatggttgcctgaacttaagaatgctgttttgagtgctcagcagagcttggaagattgcaaatatgtcaggggattgcttgatgagtggtgggagcagccagcatcgacagttgttgactgggtaacagtggatgggcaaaatgtaactgcctggcataatcatgtgaaacagcttctggcattttgtgacaaggagctattgtga

SEQ ID NO: 23945 - DNA, 1209 bp, Glycine max
  Peptide Sequence Number=SeqID_140723
atggatctgctaaacaacttcaacatggctttagacttgttgcagcagccactagaagagctacttgaaaagcaaagaccctacccaagttgcataattgccgacaaatatatcatgtgtgtgactgatgttgccaacaagttgaatgtcccgagaataatattcgacgggactaattgtttctttctactatgcaaccacaatttacaaaaggataaggtctatgaagctgtgtctggtgaagagaaatttcttgtccccggaatgccccacagaattgaattgcgaagatctcaactccccggattattcaatcctggcgcagacctcaagctgaatgcttaccgtgagaaggtaatggaagctgcagaaaaagcacatgggatagttgttaatagttttgaagagttggaagcagaatatgttgaagagtgtcaaagatttacggaccatagggtatggtgtgttgggcctgtgtcgctgtcaaataaggatgacaaggacaaggctatgagaagtaagagaaactcaagtgatcttgagagtgagtatgtgaagtggcttgattcatggcctccgaggtcagtgatttatgtttgccttggtagcctaaaccgtgcaacgccagagcagttgatagagctcgggttaggattggaagcgacaaaaaggccattcatttgggtgcttagaggtgcatatggaagagaggagatggagaagtggctgttggaagatgggtttgaagagagggtgaaagggagagggcttttgatcaagggttgggtgccacaagtgttgatcttatcacatagagcaataggagcgttcatgacacattgcggatggaattccacactcgaagggatttgtgctggcgtgccgttggtaacttttcctctgtttgctgagcagttcatcaatgagaaacttgtacaagtggtgaagattggcgtgagtgtgggagctgaatctgttgttcacttgggtgaagaagataagtctcgggttcaggtgaccagagaaaatgttctggattctattgagaaggtaatgggagatggccaagaaaaagaagagataagggaaagggctagaaagtatgcggacatggcaaggaaagcaatagaacaaggtggctcttcttacctcaacatgtccctactaattgatcacatcatacatctgaaagggttagaccaaagctaa

SEQ ID NO: 23946 - DNA, 1014 bp, Glycine max
  Peptide Sequence Number=SeqID_140724
atgtcttggttccttgtaattctatttctcagtctcacatttggtataactcattctgaggctagccatgacaagaagcttccctctgctgttgtagttggcactgtttactgtgacacatgcttccaacaggatttatccacgggcaaccacttcatttcaggtgcatcagttgctgtagaatgcaaagatgggtatgggaggtcaaagccaaggtttaggaaagaagtgaagacagatgagcatggggagttcaaggtgcagttgcctttctcagtgagcaaacatgtgaaaagaataaaaggatgcactgtgaaactaataaatagcagtgagccttattgtgctgttgcctcagcagcaacttcttcatcactgtgcctcaagtccagaaaggaaggactacacatattctcagccggctttttctcattcaagcctcttagacagccagttctttgcaaccaaaaaccaagcattcaaaacatcaagggccctgattatgtgaaacacatatttcctccaaaaatagatccatcatttcctcctccacttcaaaatccaaaaacacctggtggtcttcttcctcccattcctggattacccgacctcccaccattgttgccacccctttcaggaatattgtcaccactagtccctgcaggaatccctaatgagtccccaaatgttcagccttcagatcagaaactacttgaccctaataacctcatatttcctcctaacccatttcagccaccaccctcagtccccaaccctcttcagcagcctcctctaattcctaacccattagaaccatcaggcccatcatcacttgttcctaacccactccagcctccctcaacaggaacatcaccaccactgtttccgtttccaacagtaccaggtttaactccaccaccaccagctcttccctttcctttccctccattattccctccacctagcggccctggcacaccctctgtttcctcttcaaagaatgcttctccttaa

SEQ ID NO: 23947 - DNA, 1533 bp, Glycine max
  Peptide Sequence Number=SeqID_140725
atggatattgatgcaatttttgggaccattcgacccgtgagtgttccaaggaagagtgccatttatgtgtgggggtacaatcaatcagggcagacaggtagaaaggggaaagaggatcagttgaggattcccaaacagcttcctcctgagctgtttgggtgtccggctggcaccaatgcgcgctggttggatgttgcctgtggtcgggagcacacggcggcgatagcctctgatggctcactcttcacttggggggctaatgactttggtcaattgggtgatggaactgaggagcgaaggaaacttccagaaaaagtaaagcaattagagtcagagtttgtaaaatctgtatcctgtggagcacattgttctgcttgcattgctgaacctcatgaaaatgacggtaccatctccacaagaaggctctgggtgtgggggcaaaatcaggggtcgaatcttccaaggttgttctggggggcattcaaacctaatactattattcgtgaagtgtcctgtggagctgtccatgtggttgctttgtctgaggaaggcctactacaagcttggggctacaatgaatatggtcaacttggccgaggtgttacttgtgaaggactacagggggcttgtattataagttcttatgctaaattccttgatgaagcccctgagcttgtgaagattgccaaagtgtcatgcggggagtaccacacagcagtcatttctgataagggcgaggtctacacatgggggctaggaaatatgggccagcttgggcattcttcactccagtatggggataaagagttactgccaaggagggtggttacccttgatggtattttcataaaggacgtggcatgtggcggtgtacacacatgttctgtaactcagggaggagcactttatgcctggggtggtggtcggtctgggcagctagggcttggcccccaaactggattattctcgtgtgttgctaatgactctcagacatttttccgaaacattccagttttagtagttcctaaaggtgtgcaacttgttgcatgtgggtattctcacacccttatctctatgagtgatggtcgaattcatggatggggttacaataattatggtcaggcagcaaatgagaaatgtacatatgcttggtatccatcaccaattgactggtgtgttggggaggttcggaaactagctgctggtggtggtcattcagctgtgttgactgatgcttattcattaaaggagttatgcgagtttgtacttgcagatagtatgactttatctaatgctgctaaggttgaggatattgcatatagaactggatcagatgctttggcgcgcctttgtggaagacttagagagaagcaggaaaagtacctgagagttagagaaggaaccagtctttgtggtgatggtggtggtggtagctgtggagaagataagttgagtgtggatgaatcaaagcctagagtttctgggccgttgtgtggaccttcagtcactgtcttcgctttctccttcatctag

SEQ ID NO: 23948 - DNA, 618 bp, Glycine max
  Peptide Sequence Number=SeqID_140726
atgtgtgtttgttcaccgttgggacagcttgttccggtgggagagcaaggttatgggtggggtttgagaaatttgagctatgccagggtgaaccttgtgataacgggaggaggaagagcctccaaagaaggacaagtggacgacaaagaagaggttgaagatgcagaggaagagggagaaggagaagaggagagcggccaacaggaaggacccccgccgactcggtgtcaaggggaagaagaagaagcagagatttgccagtgcagaagagagaatcaaggtcctgttgtaaagcctgatgagttgacaggggaggaacggttttatttgaagaaaatgggtcagaagagatctaattatctacaaattggcagaagaggattatttggaggggttgttctcaatatgcatatgcattggaagaaacatgagactgttaaggttttttgcaagccttgtaaacctggtcaagtacacgagtatgcacaagaacttgccagattgagtggtggtataccacttcaaataattggggatgacactataatattttatcgcagaaagaactatgaacagcctgaggttatgtcaccaatcgataccctgtccaagaaaaag

SEQ ID NO: 23949 - DNA, 1068 bp, Glycine max
  Peptide Sequence Number=SeqID_140727
atgagagacaacctgggagagaccgaaaacgaggtagagtacgagaatctgagagcaaaggaagctctccttatgctgcggaataacgaagttgcccttgttgaagaacaagtgtttcttttttgtgttgttgtgttttttgtgttgtattgtgttggtggtgttgttgttcaggatttcaaagggtatggagcaaataactcaaaattgaagcttgacgttgttgttggtgttattgttctccacagtcctgtttttgctctttttacgtttcaaatggaggttgagattgatggctctgttactgtcgaaacagtaggaaatactgctataggtgaggttagtagcatagcggatgacaacagagaaggtggaagttctgttgaaccaaatgacaaccaagatcaacatgataatgggactcaagattcctctggagggatcactatcccatctgcaattcccacagtatcggttgtttcagttgaagagccctatgttggtcaggagtttgggtcagaagcagcagcacatgcattttataatgcttatgccacagaagttggatttatcgtacgtgtgagtaaactctcgcggtcaaggcgtgatggaactgctattggacgtactcttgtttgcaacaaagagggattcagaatggctgacaaacgtgaaaagattgtgaggcaaagggccgagaccagggttggttgcagggcaatgattatggtgaggaaacttagttctggcaaatgggttgttgcaaagtttgtgaaggaacacacacatcctttgacccctggcaaaggtagaagggatttctactatgaacaatatccgactgaacaggataaaattcgggaactatctcaacagttggcaactgagaaaaagcgatctgcggcctataaaagacatcttgaattgatatttgagcaaattgaagagcagaatgataacctttcaaagaaaatacagcacatagtagactgcgtgaaggagatggaagccaaagaagaacatagtagacagtgtgaaggagatggaagccaaagaacaacagagtag

SEQ ID NO: 23950 - DNA, 588 bp, Glycine max
  Peptide Sequence Number=SeqID_140728
atgaccaagttcgatccagacatagtccttgaattttatgccaatgcttggcctacagaggagggcgtgagagatatgaggtcctgggtgaggggtcagtggatcccgtttgatgtagatgctatcagccagttcctgggataccctttagtgctggaagagggccaggagtgcgagtatggccagaggaggaaccggtccgatgggttcgatgaggaggccatcgcccatttgctatgtataccggggcaggatttttcctggactgctgccgggagacgggtgcggatcatgggcaccaacatgaccaccctgactcagatctggatgactttgctactcaacaacatccagcccagcgatcataattctgacctccccctgccgaagtgtcagttggtgtacgccatcctgacacggatgagcattcacgtggctcagttaatcgctgatgccatctatctatttgcaggtatggcgcctaccaggcaccctcttgacccggataagtccaacagggccctgggatttcccgccttgatcacaggactctgccagtcgttcggagtccccgtcacacccagcaag

SEQ ID NO: 23951 - DNA, 207 bp, Glycine max
  Peptide Sequence Number=SeqID_140729
atgttctctactggtttctttgccgttggcgaaaacgcatattcatttgggtcctcgtgtttctacactctgttcttcgacaatgacaacattcttcatcttctttacgatggtcctgaagtttctgcctttactggccacatccatggctggcatcttggaaagctcattaggaggcagtgcatgctcgacggagtagtgaagtga

SEQ ID NO: 23952 - DNA, 261 bp, Glycine max
  Peptide Sequence Number=SeqID_140730
atgaaagtcaaacacaagcgttatgcgacaaatacactagactcaagcctacatgcaatgtggtaccattttttagtgaaaaacctcgtcaaacgcttaggagtacatgacaggacatgcctcacaatggggagaccagtcacggtcacactgttttgcgagaatgctccaaccatgtgggatcgacacaggcttaaagaagcactcaaaccggatgacccccaaggcctacactccgaagagttcgtcagggtgatgtaa

SEQ ID NO: 23953 - DNA, 255 bp, Glycine max
  Peptide Sequence Number=SeqID_140731
atggatcaactggttgatattcagaccaaggctctctctccttcatttctctcattctggaccaagtggttgaaaggcattcttccaagccctcatgagcttctggaggagaaacaagcaagcctaaggtggctatatttttggcagattgcatgtactcaaacacgacgtgttgcagctatgagtgttgctgctcgagtttctgaagaaatgggtgttaaattaggacatgaggtaggcttcctccgttattaa

SEQ ID NO: 23954 - DNA, 444 bp, Glycine max
  Peptide Sequence Number=SeqID_140732
atggcaaagttcccacttgatccaatgttgtcaaaaatgattgtggcttcagaaaattacaagtgttcagatgatattatttctattgctgctatgatttctgttggaaactcaatattttactgtccaaaagataaacaagtacatgcagacaatgcaaggttgaattttcacactggaaatgttggagaccatatggcatgtctaaaggtctacaattcatggaaggagaccaattattcaacgcaatggtgttatgagaattatatacaggtaaggagtgtgaaacgagctagggatatccgtgatcaactggcaggtcttttagagagggttgagattaaactaacttcaaatgataatgatttagatgccatcaagaaatccattacatctgggtttttcccacactttgcacgactgcaaaagaatggatcatattga

SEQ ID NO: 23955 - DNA, 989 bp, Glycine max
  misc_feature (327)..(327): n is a, c, g, or t
  Peptide Sequence Number=SeqID_140733
gaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgaggtcttcatggtcttaacgaaaatcatagttttncaatttctacgcaaatcaagataaagaaaaggcagtttccaatcattgactcaaacccattgttgaaccgaatcccactgagtggaatatggagattaatagatcactttggaatggcatatacatcacatatcctggatcaagtaaagactctgggattccgtcaagctacggatacatccatttcattaggaattgatgaccttttaacaataccttctaaaggatggctagtccaagatgctgaacaacaaagttttattttggaacaacatcatcattatgggaatgtacatgcagtagaaaaattacgccaatccattgagatatggtatgctacaagtgaatattttcgacaagaaatgaatcctaattttaggatgaccgacccctttaatccagtccatataatgtccttttcgggagctagaggaaatgcgtctcaagtacaccaattagtgggtatgagaggattaatgtcggatccacaaggacaaatgattgatttacctattcaaagcaatttgcgcgaagggctttctttaacagaatatatcatttcttgctacggagctcgtacaggggttgtagatactgctgtacgaacatcagatgctggatatcttacacgcagacttgttgaagtggttcaacacattgtt

SEQ ID NO: 23956 - DNA, 405 bp, Glycine max
  misc_feature (395)..(395): n is a, c, g, or t
  Peptide Sequence Number=SeqID_140734
atgcatacgacattacgggccaatgcacctctctcatatccccaccttgctactctttttcttcatcatttcaatgttcttttggatgatgaaccatatgtcaaggtcaaaaggtctttctccattggtgccggtgttgttacctcctttggttaccggaaggatgttgatggtcagtgggttagcaaacaagacttgccaccgcctattcctgatgaacgtaccccatctcctccaccacaacgggatgcttcttcttctctactgactgaagtcctcacagagctccacgatcttcgagcatttgtggatgagcgttttgatgccatggatacaaggatcactcgactcgaagatgatataagattcatcaggcgttgcttcgatcccccggntgactcttag

SEQ ID NO: 23957 - DNA, 273 bp, Glycine max
  Peptide Sequence Number=SeqID_140735
atggctctccttgaaggtggcaagtcaactaagatccaagtgccatttctgagtaatgtattatactcagcctttataacaataagccaagttggatttgaaagagcaaaattggtggttttgggttcaagagaaggttctgaagttgcattgagttgtgtgggtgcactgagtggtgtggatgattcaggttcagtaggtcaaaatgatggtttaggttcattacttggtgtgaggacaataagggttaaggtgatgttaggtggttatggg

SEQ ID NO: 23958 - DNA, 468 bp, Glycine max
  Peptide Sequence Number=SeqID_140736
atgaattctcctccttcctcccagtcaccgcactcttcactggtggcttcttcatcgtcttcatctctggagacgttcttacattcaatctctctgaagttattgagcaagaactatatcctttgttgtgttgccaattttatgatttatgaggttgagaccttgctcttggagcatgaatcttgcattgacaggtccaaaaaacgttccctagtttcgattaatctcactgaaggaaactttagggctaatgattcctctcaacctttgaattccaaattgctaggtcaagtttatctgacttctcaaaatgctattgattacaaggctggacgtggtggtcatggttttggcagacacaagtgcggtggtcggagttttggatgcggcagtggtggtcgaggctggtttgctgatgtacaatgccaattgtgtcacaaatgggggcatgaagtgtttttctgttaa

SEQ ID NO: 23959 - DNA, 639 bp, Glycine max
  Peptide Sequence Number=SeqID_140737
atgagtactgagaaagaaaaatctttttgggaccttaaggcaactacaagctttattatagcatgtttggaacaagtggtcaaaggagaacaacttggcactagttttaccaagaaaggattattgggtaaagaaactggtctgcgatgggacaatgtgaagaatattgttgatgcaattgatgaatggtggaagagaaagcaattggagagtttgagatttgtgtttagtttcgaatgggctcccttgtttgggatgctgccacctcattttggggttgatatgaatgatgggtattgtccaagtcaaaagggtgttggcatagatatagaggaagggtcgggtgatagtgaagatgcaagtattggtaagaaaaagttaattgccttgtcacaagtagctgaggttgttagtgtgattgcaaaaacatgtaagtcacacacaaaagatgtggcaagtgcatttatcaatgaagtggtgaaagaacttaaggtcatgcctgaagttgcaaatgatgttgactttcataccaactatttcaaatttatgttaattaagacaacaagggagatgttcatagctttgcaaggtgaagatgtgaaaaggctgcattggcttaagtatgcaggcaaaacatga

SEQ ID NO: 23960 - DNA, 183 bp, Glycine max
  Peptide Sequence Number=SeqID_140738
atgacaacaatcatgttggtggtggtgacgattgacgatcatggtggtggttgtggttgcggccatgataatcgtggcggaaacggatgtcataaattaatcttaagatatttgattttctatttgataagtggtggaggcggtaacaatgacaataaccatgttgatggtggcggcggttag

SEQ ID NO: 23961 - DNA, 129 bp, Glycine max
  Peptide Sequence Number=SeqID_140739
atgacaacaacaatcatgttaatggtggcagcagttgatgatcatggtggtggttgcggtgacgaccatgacaattgtggcggaaatggtcatgtcagtgatggtggttatgattttatagtaaaatga

SEQ ID NO: 23962 - DNA, 201 bp, Glycine max
  Peptide Sequence Number=SeqID_140740
atggaaaaactacaaccaatcagtgttgcaaaccgttcagagaattgcaacaatgtcgcagtcacagaaaggggcaaatcttcgactcccactgctattactaacctcgaatgctggtttgagctgactcataaaggaatgccaccaatggacaagccaacccaacaagagaaatttgaggaaacaaatttgcataaatga

SEQ ID NO: 23963 - DNA, 429 bp, Glycine max
  Peptide Sequence Number=SeqID_140741
atgaaggaatcccctgagactagaaaatctcttgctaatgcattgagtagcaaatatatccaaaggctaaaaaatattatgcacggtgcaggacctatatggcttttccatggtaatttggagcaaggtgtttcttcaacagcgggttctgaaggggaagattcacactcttatgcctcgctggagctaggggaacaaggaggttggccggaggaatcatttggagacttaaggaatattctggtgaagggggttggggaggaagtcaacgtggtcaaatgtagtacaaatcttggaagtaaccgagaacaaaagcatgttaatggacaaaaggcatttaatgtggtgagcattggtgacatcgagcagtgcaacaaggtggaggaaggtgtttatgttcaggaagtaggagaaaaggcgtgtttgtga

SEQ ID NO: 23964 - DNA, 300 bp, Glycine max
  Peptide Sequence Number=SeqID_140742
atgcaaaacagtggggtcatcctaagggctgaatctcaacacttcgccagtgtacatgatgacaatccctgtgtagcttctatcccttactttggcaacaccggtgtacggactgatgatgtaggatttatgttggtagacctacagaaactagcttaccacaatgaccctttcatcatggcagaacaagctaaacatgtattttatgttcaagacccttgtgatgaaaggtggtctgtggttctacacgggaaaactggtgttaatgtagaagaggatgattcatacattgatacttat

SEQ ID NO: 23965 - DNA, 276 bp, Glycine max
  Peptide Sequence Number=SeqID_140743
atggcgtgggctcattggaaaaagagcagtagagagctcaccaaaactagcgccaacgaagagctcattggggttgccgtcagaggaagttttattgtcggagcaggcaccataggggtggatgaagatgttgttgccagcaatgcggggtggaacaaacttgctagagaagatttgagacgacgctcacctgaaaaaaacatgacacttcatgcttggaattatcatgcatgccatcatctaggcatgagtgtagtttatgtcaatcttgcttag

SEQ ID NO: 23966 - DNA, 645 bp, Glycine max
  Peptide Sequence Number=SeqID_140744
atggcgcctggtcatctgcccttcttctttatgtacagatgtttgtttgaggtcctgggtgttattttacccttgaccacttttcagtgtgctctgttggagcacttgaatgtggcccattcccagcttcacctgaaacagttaggcaattgggcaaggagccttggttcctattctattggcagcttgatcctaccaggtcgacaaagaaattttggagcagctgctggcctcactggacagatgaaccattttgtctcttcattcgacgagcgttcctctcgctaccttggatggagccatcttactggtgaggttggtcttgttgttgttgttgctgaggtcacccccaacattccttcctctgttttagcaaagagaaagagggatgatgttgttgggctgtctagccgcaagaagttgaaggcccctatgagtctttgtgtcctaagtcaagatgcaaggttaatgcccactgcgggttgccttccgactgtgccagatatgcccccggctccaccgaccgtcgaggcttctactgctgctactagtacatcggctactcctgctctttcacctcctcccattgttgctattcagaaggttactcctactgctattgaagttgttgtgccaaccacttag

SEQ ID NO: 23967 - DNA, 332 bp, Glycine max
  misc_feature (21)..(21): n is a, c, g, or t
  Peptide Sequence Number=SeqID_140745
ggatcgcgcccgtacgacacncagtggacccggagaaatccaacagggtcctgaggtttccagctttgattacgggcatctgtcagttctacggagtgcatgtcgcacctaacaaggtcatcaggccccctactaaccgagctttcatcaagaagtacttcgcccccaggcaggtgcatggcgagaccccacaacagcctagggatggccgacagcaggcaacagacgcaccgtcgccacctccagagcccttaagctcatctacaaaggctggagcgttgcctatgactcatggccgaccagcgggcgaccaagtccaaagccaaaggtaa

SEQ ID NO: 23968 - DNA, 174 bp, Glycine max
  Peptide Sequence Number=SeqID_140746
atggattcagtagaaggttgctcgaaggagtttgaggggattggttttgaggctcgagttcacgctgaagaagtgctagatgtttcatcaaacacaacatcatcgactttttcagcaaaaacaagtcattctggccatagctccaaaggtccaaaaatcggcaaaaagttctga

SEQ ID NO: 23969 - DNA, 234 bp, Glycine max
  Peptide Sequence Number=SeqID_140747
atggagacatcagggggccctataagctttgctcgtataagggaacgattggtatttccttttctaatgttcatccaagtaagaaggatagagaaccctcgactcaagctgaaatgtttattgaaacttgacaaagggaaacttcaagagttgattgaaaattctggccaatcttcttcttttgaagctttccaaactatgtatggcaaagaaaaaccagggagaatacgttga

SEQ ID NO: 23970 - DNA, 477 bp, Glycine max
  Peptide Sequence Number=SeqID_140748
atggttttcttgcggcgcgctggcgcagccggccggcgatctgccgctgatgccctggccgcagcaggtggaagtgacgcaaccggcgggcaagctggtgctggatcaccgtttgtctctgacgttgcagggcgacgatctgggcgacgcgctgccgcgctggcgccagcgcatcgaactgcagaccggctggacgctggtgccgatggaagaagcgaacggcgcggcgatcaaggtggtgatcaaggaccggggcgccacgctgaccgccaacacccgcttcggcgcgctgcgcggcatggagaccctactgcagctgctgcagaccgacgggcaaaataccttcctgccgctggtggatatccgcgacgtgccgcgcttcccgtggcgcggcgtcttgttggattcggcgcgtcatttcctgccgctgccggacattctgcgccagctcgacggcatggcggcggccaagcttaa

SEQ ID NO: 23971 - DNA, 159 bp, Glycine max
  Peptide Sequence Number=SeqID_140749
atggccttcatcaaaacattgtgcagtggcataaagctccaaccggatagatcaaatgcaatgtggaagcagcaattttttcacttgataccagattcagtgttggcttgtgcttgcaagatgaaactggcaggttgtaatttttcagtcagatatttg

SEQ ID NO: 23972 - DNA, 462 bp, Glycine max
  Peptide Sequence Number=SeqID_140750
atggcgttggcaagtcaagtagtacgacctgggcagttcagttgctgtcaactactaggcagctccaactaccctggcaagtggtgcatcgactctcaatggcattacttacgcactgttccggaacacgatgatagtagcaatagtggtcatcgatacgctagtggtgttgtagtgattcgagtacttactgacttcatgaaacaactagtagtggtgatagtagctgaaagggtagttgaggcaatgcagctggtggtgttcaatgccccgggtgaacagatgagtgattcgacctcgacccggcatctcgctactagcgatggcaccggaactcctaccggctctagcgcactgccttccgctactactatgatactctcgatcgtactactcgctaaaaagtggatggcaattggtgctactactaaccagcccgtaacagcatggccaaacatcatg

SEQ ID NO: 23973 - DNA, 258 bp, Glycine max
  Peptide Sequence Number=SeqID_140751
atgttgaggccgaagaagagcatgatgcgacacaaatcgcagccaagaccggttttgtcggggcaattgaccgtgaggagagttgggtcgccgtctttttctggcggccttatgatcactacgtcgtcgtacagtatacccatcaataatctacttctcgttgttgttgggggatggttagtggcggttggtggtgttgaatcgttgtcgagagaagttggagccaaattgacgatatatcgagaaaacgagatatag

SEQ ID NO: 23974 - DNA, 243 bp, Glycine max
  Peptide Sequence Number=SeqID_140752
atggataccttagagccctacactggggcaatgaaagggaaagaatgtcatgaacattgtacaactttccattacattgcattgtttcatatgaagtccgcatttacccaaattcatgacaaaggttgcagcatctgcatccctaaaaatcatgttaactgcatagatttcctacatctaatgtccaatcttttgaatttggaatggccggcccttgatcgaggtcgtacccaaatcaaataa

SEQ ID NO: 23975 - DNA, 192 bp, Glycine max
  Peptide Sequence Number=SeqID_140753
cggctgtcacgctggtgtggagtggagtggcccttggccacgacaagtccacctgttgtggagcagtttaaaggagctgtggtcgttgctgcaatcgcagcggtgcggggcggtgctgttgcggtctgtgttgcagtttcgaatgaaaacctgaaaatactcgtgctgtggacctccctctcttccacttga

SEQ ID NO: 23976 - DNA, 149 bp, Glycine max
  Peptide Sequence Number=SeqID_140754
atggatgattttagtgaggatgaggaccaacagttctttgatcacatcaatgaggatagcaatgaccaaagtgatgaccaaagcgatgacgagggtgttggcagaccaatgacacctccgtcacctccattgccgtatcaccaacctag

SEQ ID NO: 23977 - DNA, 213 bp, Glycine max
  Peptide Sequence Number=SeqID_140755
atggaggcttcaatcccttctccgtgggaactctatcggagtagtcggaggaaaaactggaggaatctcacgaaaccgctagagatgccactatcactgccggaaaacacctatgaattatgcaatcacacaactgtaagaccctttaagggcgacgagttttgcgcgaggggtattgtgatgggatccattgtggaaacccgacgagtttaa

SEQ ID NO: 23978 - DNA, 264 bp, Glycine max
  Peptide Sequence Number=SeqID_140756
atgactacatcaacaactacctcctgcctggcttatatggctccagacataattataccgcccaagactttagcaatctacctgttaatagctatgtgcgacaaattttgttttctggagtggggtttaatggaagcttgcttgtggagcttctatggaggctggatctttgagcttcaatggggtcctttaatggtgattttccaccatggagatgcagcggaagacaaaggaaaagaggtgagaggaggcgccatccattaa

SEQ ID NO: 23979 - DNA, 384 bp, Glycine max
  Peptide Sequence Number=SeqID_140757
atggcgaggacgtgtagtcctctgaaggttagggcgtgcagtcctctgaaggtgaggacatgcagtcctctaaaggtgagggcgtgcagccctctgatggcgaggacatgtaatcctctgaaggtgagggcgtacagccctctgatggcgaggacgtatagtcctcaaaaggtgagggcgtgcagccctctgatggcgaggaagtgtagtcctctaaaggcaagggcgagtagccctctgaagacatggacgtgtagtcctctgaaggcaagggcatgtagccctctgaaggtgaggacgtgcagtcctctaaaggcgaggacgtgtagtcctctaaaggtgagggcgtgcaaaaagaatttttcaaggacgagaaatagttga

SEQ ID NO: 23980 - DNA, 255 bp, Glycine max
  Peptide Sequence Number=SeqID_140758
atgcctaaatcatctcccaacatgcatgtgaagcaagaactatcaacaagagtcaagccaaggctattgtgcaagcaatcaatggggcaaaacacaccgaataaaatagatgatggctcaaattctcaccaaggagaaaaacaaggatttcaattcacaaaatgccaagaaactcctatttcaaaaacaattacccattacctgtacataacccaaaattcaaagaggaacatgcaatgttgtacaaaaacataa

SEQ ID NO: 23981 - DNA, 210 bp, Glycine max
  Peptide Sequence Number=SeqID_140759
gctcggattgtcactgttggtggaccttccccaactactgctgccaacccgacaccaggaccttgtgaggggaaccttcgagcaccgagaaggttcctctcaagagaagaggatgaggcagctagtgcttgggccaacatgaagttggctggtgacaacaagagcctcgaggattgggttcttttgctaacaaatgacgctaaggggtag

SEQ ID NO: 23982 - DNA, 468 bp, Glycine max
  Peptide Sequence Number=SeqID_140760
atgttggagtctgacgcaaagtattggtggaacaacacgggagagagtttggcaactcaggaagctcttatcacttgggatgagtttaaggaagttttccttgagaagtactttcctcacagtgttcgtatccaaaaggagatcggattcctccaacttcagcaaggagagatgatcattgtcgagaacgtggctaagtttgagagcttaagtagaaaatgcaagcagtgggggctcatagatctaaggagaaggcttgctttgatgggaagaaattccataacaagtgatgtagctccatgtggagcttgtaggccttggatctttttcatcaatgaagtcctttgcttcttgaagattaatggcagcggaatggagaaggagaaagatgattggagacgccacttcaaggagaagatgagtcaagaagaagctcaccaccataggaagccatggataagagcttga

SEQ ID NO: 23983 - DNA, 378 bp, Glycine max
  Peptide Sequence Number=SeqID_140761
atggacccggagaagcccaacagggccctggggtttctagctctagttatgggcctctgtcagttctaccgggtgcccgtccccccagcaaggtcatcaggccccctactaactgagctttcatcaagaagtactgcgcccccaggcaggcgcagggcgagacaccacaacaacctggggatggccgacagcgggcaacagacgcaccgtcgccacctccaaagccctttagctcatctacaaaagctggagtgttgcctacgacctgtggtcgaccagcaggcgaccaagttcaaagccaaaggtaagcaaagtactaggtccatgaccaacaagtcatcacgcgtccagctcaagacgttaaagaagcgctactag

SEQ ID NO: 23984 - DNA, 309 bp, Glycine max
  Peptide Sequence Number=SeqID_140762
atggttgccttcgttaggcaatttttcgctgacgaaaggatcaaagtgggtctgaaaagaggtaaatttaatcatcctgcttggacgaatgagaaaattggggcaaatgaagagggtgagaatgaaggagaaacccatgctgtgactgccgttcctatatggaaactcccccaccagctcaacaaacatcattactcagccaatatcaggcccttctcattacccaccacccagtcatccacaaaggccatccctaaatcaaccacaaaacctgtctaccgcatttccaatgacgaacaccacctttag

SEQ ID NO: 23985 - DNA, 1014 bp, Glycine max
  Peptide Sequence Number=SeqID_140763
atggccggtcagttcgcgcaggatctgcgaattgcggtagcagcagaagcccaggtcgggattggtgacgccgtggctgagcaggccgctgttctgcacgaagatctcgttgccgccgtggtcgatgctgtagttgcgcgcgatgcggtagccgccatcgtcggcccaggcgatgcggtcgtggatgggattgacgcagctggggatgctgcgcgcatagccggtggccagcaccaggccatcggtcgaatgcgagaacggctggccggtatcgacgtggcggaattccagctggtagcggccggtgccgcggtcatggcggctggcgcgcaattcggcattggtcagcagcgtgtagcggttgtcgccgttgtggatcctttcatcgagcaggtcgtagatctggttgatcagcgacgcgttgatgcccttgtacaggctgctctgctcggccaggatctggcggcggcgagcctcgggcaggtcgtagaaataattggtgtagtcgggggaaatcagttccagcgtgagcttggtgttctccatctggaaaaagcgcggcgaacgggtgatccaggccaggctgtagtcgtgttcgtcgctgtcgcgcagcaggtcgtggaacacctcggccgcgctctggccgctacccacgatggtgatcgacgtccgtcgttgcagctgttccttgtgccgcagatagtcggcgctgtggatgtagggcgcttcgcgccggtcgcagcaggccggcagcaccggctgcgagcccaggcccagcaccagcttgcggcagcggaccatgaagcgttcgccattgacgctgtgctggccggtgaccaggtaggtgtcggtctcggggtcatgcagcacgctctgcacgtcgctgttgaagcgcaggtttggcaggcgcgcggccacccatttgcaatagcggttgtactcggcgcgcgtcaggtagtggttctcgcgcatgtagtacgagtagatgcggccggtctgcttgcagtagttcag

SEQ ID NO: 23986 - DNA, 213 bp, Glycine max
  Peptide Sequence Number=SeqID_140764
cttgggaggattgatggggacccggcgttgagaggaacgaggataagggctacgtgggagtacgtgagctcagttggaggtgggcaacaggggatggaagtgtggaaggtgagacttccttcttttattgttgaccacagagtgtacctgagatatgtcgcggggtcaggagaccttgggacgtcagtggtgctatgcccaaaccaagcttga

SEQ ID NO: 23987 - DNA, 396 bp, Glycine max
  Peptide Sequence Number=SeqID_140765
atgcaagatattgatgaggttgctgcaagagaatctagtctaacaagcaaaggagtaagaggagggggaaaacaaaacaaagataaagggtttgtggtggaagaagtgcaagtcattggtggaaaggtgatcattcccaacagtgcaacaaggatgttgaacaatgatgaagaacacaaagaagtcactgaatctactcaacaagcatttaaaagtctagaaattcaagttggtaagctagcagaagaagtgactaaatttgtggccaaaagagaagaaaactttgtagaggttgaagctcatgaggaaagcatcgtagaagagcatgattcaaaagaaaaatatgaagagaaagtgaggagaaagcacaacaatgggagaagcactcacaagtag

SEQ ID NO: 23988 - DNA, 159 bp, Glycine max
  Peptide Sequence Number=SeqID_140766
atggtgccacccgtgaacggcggagttgagacagagcactcagaggatgctccacttagcggcagtcacaaaccccaacgacaatcgcgaacggcgatgatggtaacgaggagatggcggtcccaggtcacaaacgacagtcacaggtcttgcgggtga

SEQ ID NO: 23989 - DNA, 207 bp, Glycine max
  Peptide Sequence Number=SeqID_140767
atggccagtctcgctcccattaacggccagcctcgctttaggtggccactctcgaaagataaaggcacaatgctagtgtttttagagattattgaaatgagaaacaagacaggcaccaaatctggctttgcaactgattctgctgcctcaccagaactcattccaaacactaacaacttatttgtaggcttgcttctatttgcataa

SEQ ID NO: 23990 - DNA, 837 bp, Glycine max
  Peptide Sequence Number=SeqID_140768
ttcacgtggcctgcattagtggctaatgagatactcaacaagcgactgggaagcagcaattttatagcagattttccaagcaacacagaacccttattgagtcatgatcagtcatctctgagctctaaaactatgcttaatgatcagaaggatacacaaaaaaacaagatttttgtcagcacatggaacgtaggtgggattgccccagatgaaggactgaatatggaggatttgttggagacacgcaacaattcctatgacatctatgtacttgggtttcaagaaattgtgcctctaaaagcatccaatgtgttggggtatcaaaacagtaagatttccaccaagtggaattccataatcagagaagctctgaacaagaacaacacgcatgtacttcacagtttcaaattagatgaagaaggtgatgataaaaagggtatttattgcaataataaggaattaggaaataataataataataataatccaggtctgcaaggcccacaagatttcgaatgtatcattagcaagcaaatggttggtatattgatatcagtatgggctaagagagaccttcgtccattcattcaacatccaagtgtctgttgcgtcggatgtggcatcatgggatgcttagggaacaagggttctgtatctgtgagatttgtgttacatgaaacaagcttttgctttgtgtgtggtcacctagcttctggtgggagagagggagacgagaagcatagaaactctaatgttgctgaaatattttcacggacaagctttcctagaagaggacctatgcttgatttgccgagaaagattcttgatcacgagtaa

SEQ ID NO: 23991 - DNA, 150 bp, Glycine max
  Peptide Sequence Number=SeqID_140769
atggagaattggcgaacagcgctacgcaataacttcgcggggctccagactcgaagtggagaatggagaattggcgaacagcgctacgcaataacttcgcggggctccagactcgaaggtggaggacgcatgaacagcgctaggcaatga

SEQ ID NO: 23992 - DNA, 813 bp, Glycine max
  misc_feature (39)..(39): n is a, c, g, or t
  Peptide Sequence Number=SeqID_140770
atgaaaaacaaaacgaggagcgcgctaagccgttgcaanacagaggagccaccacgaagcacgcgcatagccagcacggtcgtgctaagcgcgctcatcaacctcagcgaacgcgctaagcgcgtgttagtggcgctaagcgagtgcctccttcaacagacaggggcgccaagcgcggggctgggcctcagggccatcagccttcacgctttgctctttacacccccacttctactctcctcacccccttctgctttactttctgctcccccttccttttactttctgcacccttctttactaccttcacccctaatttatttactttttgcaccccccatatggcctcccgtaaacgccgtgccgtgcccacaccaggggaagcgtccaactgggactcttcccgctttacctcagagatcgcttggcacaggaactcaggaggcgcagatgggactaggtgcttacatgtctaccagagaagaggatcgatgtggctctgaggaccacagtcccagattctgcaggttgagaggacaggtcgttcgttttgacgctgacacaattaacgacttcctcgacaccccagtcatcttggaggacggggaaaagtacccagcatacaccagatacctcagcactcaccccgatcctgacaccatcgccgccacactatgtactccaggggggcgttttgttctaaacgccgatggccttccctggaaactgctgaagaaggacatgacgacactcgctcagacatggagtgtcctttcttattatgatatcgcacccacttctcacacatctaat

SEQ ID NO: 23993 - DNA, 435 bp, Glycine max
  Peptide Sequence Number=SeqID_140771
atgaggaaggcgtcgagcaattcttacaatttgcttcacaaagaggtcaaccggatgaatgttgtcattttgcctaaggaaaatgttgtcatttggttttgttcgttgcataataagccagacaactacctcaaagacataattaataggtcagtgttgttttttaatatatttgcattagcattagtcagtgctttgaaaggacttgacgatactcaacaaagtaaatccaagactcctgctaggtggattgttgttaaatgtaatagacaaaaaggaagcactgagtgtgggtattacgtcatgcattggatgtcaactataatcttaggaaatttccagaataattgggaaatgtatttcactgatcctagaccattggaaccagaaagattgaaggcacttcgcaaccagtgggcaaagtactatttgaaa

SEQ ID NO: 23994 - DNA, 330 bp, Glycine max
  Peptide Sequence Number=SeqID_140772
atggtgctctcgcgaatgatttatttttctttgcaaaaagcatgttttccttttaggtggaaaaacccggtggaccgttcggtcctgccaataaacttttatttggagacccatgaatgtcattgcctagcgctgttcatgtgtcctccaccctcgagtctggagccccgcgaatgtcattgcctagcactgttctccatcattttaggaacttttaggaataactgggaaacgtattttaacgatcctagttcattggagccagagagattaaaggcattgcggatccagtgggcacactattatctccgagttagagatcagacctag

SEQ ID NO: 23995 - DNA, 540 bp, Glycine max
  Peptide Sequence Number=SeqID_140773
atggctgagaagaccaagaaaaagctagaagaaactgctcagttcagaagcactgagggcgtcattaatcctccatctcccatcagacgacatgcatcacagggttcgtttatcccccatggacgtcaggatgtcctgactgctgccattgggcgaccacaacaccttggtcgcgtgcatgctgctagagccggtgtcaccatcaagcaatacttcagatcggctgcacgaagctcctgcagttcctcctccatccctcatgaagaactcgagcagctcactcaacaaatcagggaccaactggaggagtcaatcagagaaaaaggacttgcactgcctccggagcctgaggttggtccctcagctgctcgtgttagcacaaaaggaagttgtgtcgatcccttattgaccgatccagagacgggtgactcagacaaatgcaggttgtacatcaaagcaaatccttcccacctagttgccctattaagagtttatgagggatccacaactgttcacaatgtccctttgttgcatggccaa

SEQ ID NO: 23996 - DNA, 431 bp, Glycine max
  Peptide Sequence Number=SeqID_140774
atggtactagctgagggtgaaaccttacccgcatattccagatactgcaggttgcccactgatattagagaaattgaggctgccttatgtatcccaggtcggaggaaaaactgttggaaccctgatgatttgacagttactatcagagaggccaggagagtgaggacaaggctagttgaggccccttccacatctacagctcctcctccagcatgtaccctagcagctccttctgccccagcttatgcagattttcagcgtcttgaagccgtgcttcaaaacatccatcaggggcagattatcttattacaaagtttacagatggtggcacctccaaactctattccttcagtagagcagtttaatgagtgggtagcctggcccggaactcagtcttctcttcacagggaaggtgaaggtccccaacccag

SEQ ID NO: 23997 - DNA, 420 bp, Glycine max
  Peptide Sequence Number=SeqID_140775
atggcagcgcagttcatccatgatcgagtggagatggagtgcctcgagggagcttgggagaccctcgaaggcaatgcgaggtgccgattccggggcacgattcgattcacgactacttcattggtgcatccagaggaacccgcgtgcacgattcagcgtactatggagtggatattacccacgcctacaccatatcgtctagtggagccagtccaagtgatcgaggtgacgtcatctgaggaagacccagaggagctacctcctgagcccgctgtggatgcccttgactttctagagggtgatgaggacccactccctgaggtggactctctcgaggacgtcatgtcggcatctgaggcagactctacggaagatagcggccctggagagatggcgactagtggaggctcttcatcatag

SEQ ID NO: 23998 - DNA, 285 bp, Glycine max
  Peptide Sequence Number=SeqID_140776
atgtcatgggcattacaaaattttcatgaatcaaaaccctccgcattactaaaaacaaagcccacctttactgcatttcaagaagaagaatccaaggatgagttccagaagttcaaaaatgaatcaagaacacttcaaggttcaagaagaaatttgatttccagaatccagaatccagattccagaatccagattccaggttcaagcttcccagaatccagatcaagattccagatccagattccagaatccagatccagattccagaatccagagaagaattaa

SEQ ID NO: 23999 - DNA, 180 bp, Glycine max
  Peptide Sequence Number=SeqID_140777
atggagaaaaagaacaggtacccgaagccatgttgtatgaaatcgattgagtttgagctgtcgtcagagtatcgagacgttgaaaccactgcacaactatcaagatcctacaaagcatctacacttcctattagtatgaatcttcttagactaaagtggttcaatccaacacaaaaataa

SEQ ID NO: 24000 - DNA, 387 bp, Glycine max
  Peptide Sequence Number=SeqID_140778
atggagggatctagaaactttgaagatcgtcgaaggtctgattatggaagatcatcttcaacccatcaaggatttgcaaactctatctcgtgctcttttccctctctccaaaacaccaatgacgactttgacaatgatcacgttggagctccattgcggccacttcgcgctcccaccagcattcggtggaaaatcaaccaatgcttcatgttccaatctctcactttgaaggtgctcttctttctcttacatgtggtggttgtgtttgattcgaggtatagtggtgatggtggttcgaggtgtttaggggttggaggtggtggttgttttggttcaaggtgtggtgatgatggttgtttaaggtgtcgtggttatggtttattctag

SEQ ID NO: 24001 - DNA, 765 bp, Glycine max
  Peptide Sequence Number=SeqID_140779
atggaaggagaaaatggaaagaagctgaaaatattgtgcctccatggattcagaacaagtgggagttttcttaaaaagcaaatcagcaaatgggatccttctatattcactcaatttgatatggttttcccagatggtaaataccctgcaggagggaagtctgacatagaaggcatcttccctccaccttactttgagtggtttcaattcgaaaaggacttcacagtgtactttaacttggaagaatgcatctcatacttatgcgaatatattacagccaatggtccctttgatggcttccttggcttctcacagggaaagttactaaaggagcatccaccaataaaatttctcatatcaatatcaggatgcaaattcagaaatcccagcatatgcgatgttgcctacaaagacaccatcaaagctaaatctgttcatttcattggggaaaaagattggctgaaacttccttctgaggatctcacatctgcatttgacaaacccctgataataaggcatccccaaggtcacaccgtaccacgattagatgaagtggctaccagtcaattgagaaaatggattaccgaagaagtcctatgtcaaccaaaagttggcatctcagtttgtgagcatgaaacagaccatgaagaaaagaagtcagagaaggggaccaagctagaaccctgtggtaccaatcaagacaaaggtgtaaacggtgttgaaataaacaagggttctgaaacagtagaggtggctcaagcctga

SEQ ID NO: 24002 - DNA, 2076 bp, Glycine max
  Peptide Sequence Number=SeqID_140780
atgataacattgggatttggatctccaaagcaaaacaaatgtggtgcagcacctgttgtctctcctgcattgactccttccagaagctttggttggaaaaaaagtggagaaccagtttctgcacctgtgtatgaaacaccaaagccaccaccaactatagtacattcccatgctcaagcacctgttgtctctcctgcattaacaccttctagaagcttcaattggacaaaaggtggagaaccagtttctgcacctccgtacaaaataccaaagccactaccagctatagtacattcccctgctcaagaaagacaatttcaccatgctcctgagccactgatttcatctcccaaatctcctttcaacaaagatcatcctcctgcatcttcaccttcaaccacattctataagcatcactatacaaggaacacagtcaccagccctgctcctgcatcatcacattttgtttctccttccacttcaaaacaccaagatggatcaaatcctccctcgccgctgccaacaagtgggcaaagacatcatgctccaccaccaatgaacacaggttcctcggtttccccatcttccctccatattcagtcacctgtgaaccaggtttcacctgctccttctccgatattcaacatatccccccactcaaccaaaattccattgcatcctcctaaagtgtctccttctcggccttcttccaagatccctaagaagccagtccggcctcgttttcaagcactgccacccccacctccaaatgaagattgtatatcagtggtttgctcagaaccctatacaagtactccacctggagcaccttgcaaatgtgtgtggcccatgaaagttggtcttcgccttagtgtttctctgtatactttcttccctttggtttcagagtttgcttctgaaattgccactggggttttcatgaagcaaagtcaagttcgcattatgggagctgatgcagcaaaccagcaacctgataaaactattgtattcattgacttggtaccacttggggaagaatttgataacactacagcctttttaacttctgagagattttggcataaacaagtggttataaagacttcttactttggtgattatgtcgtgttgtatgtgacctatccaggtttgcctccatctcctcctttacctccttcaagcatttccataatcgatggtggtccgtattcgggtggtggcaataatggtaggacaataaagccccttggggttgacatatcaaagagacagcatagaggtggacttagcaagggcataattgctgtcattgctctttcagtttttctagtagttgctttatgctttgctgctgctttggcatcgttcaagtacagagatcatgtgagtcaaacaccttcaaccccacggattttacctcctcttaccaaagcaccaggtgctgctggatcagtagttggcggtgggcttgcttcagcttcgacatcatttcgatctagcattgctgcttacacaggatctgctaagactttaagcatgaatgacattgagaaagccacggataatttccatgcttccagagtacttggagaaggtggttttgggcttgtttatagcggtatacttgaagatgggacaaaagttgctgtcaaggttctaaaaagagaggatcatcaaggcaaccgtgaattcctatctgaagttgagatgcttagccgccttcaccatagaaacttggttaagttgattggtatatgcgcagaggtcagcttccgctgtttagtttatgaactcattccaaatggcagtgtggaatcccatttacatggagctgacaaggaaaacagcccacttgattggagtgctcggttaaagatagctcttggttctgctcgtggactggcttatctgcatgaagattcaagtccccatgtcatacatagggacttcaagtctagcaatattttgctggaaaatgattttacaccaaaagtatccgattttggattggcccgaacagcagctgatgaggggaacagacacatatcaacacgagtgatgggaactttcgggtaa

SEQ ID NO: 24003 - DNA, 1932 bp, Glycine max
  Peptide Sequence Number=SeqID_140781
atgtctctttctattaagattttttttcttctttacttgagctgcctcacagtttcctgctttgcagagcaaacttcaaccttgattgtagatgctaaaggatctgtgagaaaaattccagatactttctttggagcattttttgaggagatcaatcatgcaggagctgggggattgtgggctgagctggtgcggaatagaggttttgaagctggaggccccaacgttccctcagatatttatccctggtcaattattggagatgattcaaccatactcgtctcaactgatcgtagctcttgctttgagagaaataaaatcgcattgcgtatgaacgttctttgtaatcaatctaatccttgccccgctggtggtgttggcatctcaaatcctggtttctggggcatgaatattgagaaagggcagaagtacaaagcagtcttctatgtcaaagcacgtggtggacttgatctagacgtttcgtttgttggatctgagagaggtgaaaagttggcttcacaaaactttagagctcccggacataatatttcaatgtggacaaagatggagactatattggaagccaatgatacaaatcgtaatgcaagtcttcaaataacaacaagcaatacaggagttgtatggttagaccaagtgtctgttatgcccttagacacatttaagggtcatggttatcgaaaggacctttttcaaatggtggcagacttgaaaccaaaatttttcagattccctggtggctgttatgttgaaggaaattatctaagaaatgcatttaggtggaaagacacggttggaccatgggaggagagaccaggacactttaatgatgtatggaattattggactgacgatggatttggtttttttgagggactccaattcgctgaggatgttggtgcattgccagcatgggtgtttaacaatggtctcagccttaaggacgaagttaatacatctgccatagcaccttttatccaagaagctctagatggaatcgagtttgctagaggttctcccaaatcacaatggggatctcttagggcttccatgggacatcctgagccatttgacttgagaattgttgccattggaaatgaagagtgtggcatgtctaagtatcaagcaaactatctcaaatttcacacagccataaaacaagcttatccagatattcagataatcacaaattgtgatggttctgagaaaccgttggatcatccagctgacctctatgattttcatatttatacaaatgctaaagacatgttttcaaagtctaccaaattcgacgacgcaccacgatctggtccaaaggcgtttgttagtgagtatgctgtttggaaggatgatgctggaaatggaactcttctggctgctgtggctgaagctgcatttcttattggactagaaaggaatagtgacgtcgttcacatggtcagttacgcgccactctttgtaaacacaaatgacagaaggtggacaccggatgcaattgtatttgactctcaccagcattatggaactcctagttattgggttcaacatctttttagtgcttcaagtggagccactttgcttaatacaacacttcaaaattctactgactccctagttgcatcagcaattgagtacacaaaccctgaggacaagaagaactacttgaaaataaaagttgtaaactttggaagtgatccccagaactttaggttttttataagtggactggcttcaaatgtgcagcgatctggagcagctaagacagtgctcactgggcctaacgtaaaagaagagaattccttctcagaaccaaaaagggttgcgccacaacacacttcacttgaggttgctcatggggatatgaatgttgtactttctccttattcggttacatcatttgatatattaaagtag

SEQ ID NO: 24004 - DNA, 1932 bp, Glycine max
  Peptide Sequence Number=SeqID_140782
atgtctctttcttttaagatttttcttgtttgcataacgtgcttcacagtttgttgctttgcagaacaaacttcaaccttgatcattgatgctatagctacgagaaaaattccagatactttccttggagcattttttgaggagatcaatcatgcaggagctgggggattgtgggctgagcttgtgaggaatagaggttttgaagctggaggctccaatgttccctcaaatatttatccatggtctattattggagatgattcaaccatacttgtctcaactgatcgtacctcttcctttgagcgaaataaagttgcattaagtatgaaagttctttgtaatgaatctaatccttgcccatcgggtggtgttggcatctcaaatcctggttactggggcatgaatatcgagaaagggaagaagtacaaagtagtcttctatgctaaagcagatggtgcaattaacctaaacgtttcatttgttggaacggagaaaggtgaaaagttggcttcaaataacattagatcttataaacataatgttacaaattggacaaggatggaggttataatagaagccaaggctacaaatcataatgcaagtcttcaaataacaacaagcaagagtggatttgtgtggttagaccaagtgtctgcaatgcccttagacacatataagggtcatggtttccgaaaggatcttttccaaatggtagcagatttgaaaccaaaatttttcagattccccggtgggtgttatgttgaaggagattatttaagaaatgcatttaggtggaaagacacagttggaccatgggaagagagaccaggacactatggagatgtatggaattattggagtgatgacggatttggtttctttgagggccttcaattagctgaggatcttggtgcattgccagtgtgggtgtttaacaatggtattagccaccacgatgaagtcaatacatctgccatcgcgccttttgtgcacgaagctctggacggaattgagtttgctagaggttctcccgaatcaagatggggatctcttagggcttccatgggacatcccaagccatttgacttgagaattgttgcaattggaaatgaagattgtgacaagtttaactacaaaggaaattatcttaagttttatgatgccataagacgtgtttatccagatattcaaattatttcaaactgtgatggctctgaaaaccctttagatcatccggctgatctttacgattttcatatttatacaaatgctgaggacatgttttcgaagtctactaagttcgataatgtatcacgatatggtccaaaggcgtttgtgagtgagtatgctgtttggcaggacgatgccggaaatggaacacttttggctgccgtggctgaagctgcattccttattggactagaaaagaatagtgatatcgtctccatggtcagctatgcaccgctctttgtaaacgcaaatgatagaaagtggacgccggatgcaattgcatttgactcttatcggcactatgaaactcccagttattgggtgcaatgtctttttattccttcgagtggagcaactttgcttaattcaacactcctcagttcttctaataaatcccttgctgcttctgcaattgagtacacaaaccctgcaaataagaagaattacctgagaataaaggtggtaaactttggagatcatacagagaaccttagaatttttgtaaatggattggattcaaaagtgcaacaatctggatcaacaaagatagtgctcacagcgcctaatgtaagagaagagaattctttctcagaaccaaagaagattgtgccacaacacacttcacttgaggctgcaagtgaagacatgaatgttatactttctccttactcagttacatcatttgatctattaattaagtag

SEQ ID NO: 24005 - DNA, 405 bp, Glycine max
  Peptide Sequence Number=SeqID_140783
atggagaatgaagttgaaataagtgaatctaatgtaaatcgagttctagaacatgagagtagtgaatctaatcgcaagagtggtgatgatttcgatcattcagatgatgatatacaagacatgggtatttgggcaggccatttgtttgacatactagtgggaaagggaaagaggattttggatttcaaattctcagacttaaaaaatgagaagtctagggtgaaagctaaatgtactgttgaagattgtccatggtgtactcatgcttctctatgcccggatagactaacaaataagatcaaaacttacaatgttgtacacaactacataagacaaaccaaaaacaaggataaggaagctacttctgcttggattgctcaaaaacttgaaagcaaacttagatag

SEQ ID NO: 24006 - DNA, 430 bp, Glycine max
  Peptide Sequence Number=SeqID_140784
gctttacaccggaatccatgcaaaaccaaagcccaaattcaagagcggagctatatctgaatcaacaactgctctgaatgtggatcagacaaacacctctgtgattagtgctgacatcaaaaccacaccggcgagtgctgcattgccagcagccaccgcaacaagaggaaataatcaggaacaggcagcagcggctgttaatggttctaatgctgccgctacagtcatttctgctgctgcttctgcaccccaaaagaaggaaggtggacaagcaaaagctcaggtggacaagaagaagatagatgccagaaagaaaagtggggttctaaaccctgctaaattttacaaagttgacgatgccttctacatccatccacagtggtttagtcaaggtggagagtatttgccttcgcaagttcttggactttag

SEQ ID NO: 24007 - DNA, 195 bp, Glycine max
  Peptide Sequence Number=SeqID_140785
atgtgggattggcacaagcttagaggatcactcaaactgggtgtatttgcctccaaggcctacactccgaagagtccattagggcctctccctcctgattcagtgattcaactcgtcgggttcccacagtggatcccatcacgatactcgtcacgcaaaaactcgttgcccttgaagggtcttacaattgtgtga

SEQ ID NO: 24008 - DNA, 900 bp, Glycine max
  Peptide Sequence Number=SeqID_140786
atggagtctgaatccttagttgctgattttgcatatgaggaaattaaagtggtagtgtggagctgtggcaatgggaaaagttctagaccaaatggatttaactcaaatttttttaaagagtgttggagtatagttgggaaggatgtatgtgatagagtgcatgaatttttttgtaacactgaactaccaaaggcaattatagcctcctttataacattgataccaaagcaggattatcctttgggcctggctgattttcatcatatatcattgataagcaacattcataagattatatcaaagctgatagcggaaatgattaaggtacttccttcaattatatatatgaatgccattttgcctttatctcgggttaagggaaggcttgacggggttctagatgctaatgaactaattgactggactaagagaaatgggcgaaaggtaatcatggttaaggttgatttccaaaaagcttatgactcttatgtagatgattcgataattgttggtgaagaaagtcaagataacctatgggcattaaaagcaatcttaaaaaattatgaattggtctcaggtcttaaagtcaactttcataaaagtggtatatatgggattaatattgatggtctgtttttacaagcagtagagaactttttgtattgcaacattggtactttgcctcttaagttcctagggatcccgataggggctaatgcacgtagatgccatacatgggaaccaattatagctattttccaaaagagacttgtgggttggagaaggaaacacttatatatgggagggggagtgggcctcgaggaaggttatctagtcatcagttataatacaatgcaaatttttgtggcagggtggtctaaaaatcaaaagactaattag

SEQ ID NO: 24009 - DNA, 630 bp, Glycine max
  Peptide Sequence Number=SeqID_140787
atgtcttcaatagtttggtcttctcaacaggattctaacaagcttcttctcaacaggattgttgcaacctaccctttggcgggagggcgaggcaagatcgaagtgagcattttccaaaaaggagaacacgcgggagtcgccaccaacaattattcgagggaaaatgttagaaaaaccaaaagaaggtttgcgaatttcaaaaatgagggttcgagagttgtttacgcatgggaaaggggtcgccctggctcctacgtatcctcagatcaagataaaaatccaagagattcaagatacatcatcaagaagatctctagtgatttagggagggaattccaaattgaaatagcaagaggtttggccaagaaatttaagctaaaatgtctttttcaagagatttactctctgggattaagagaccgagagtctcttgttgtaaagaaatctaaacacaaaggaagggttgtccttgtgtggttcagaacttgtaaagtgattttgcaagatagtaaaactctcaagcgggttgcttgggaactagacataggcacaagggcactagcaggaaaacctgtagggttcttctctagcactagttctcaaggaggtggacaagaagagaccccatga

SEQ ID NO: 24010 - DNA, 180 bp, Glycine max
  Peptide Sequence Number=SeqID_140788
atggccagaagagcgcaacatcggggacaaaggggacaccacggacttagctctgaactcaagatgcgcgtgacaccggggactcaaacaaaggacccggaggacatacgtacgaacaacacgggagaaagctctgaacacgacagggtttttgaactcgcgcacgacagactagattaa

SEQ ID NO: 24011 - DNA, 597 bp, Glycine max
  Peptide Sequence Number=SeqID_140789
atgggttctgtatatcttttggtatcagagcccagtttgctcacctcacagcatagtgtgcatgcactactactatctgactggattgatgcagtagtatgcaacacaaacacagctgtgcgtaaaaacgttatgaattttattgaatctgggtctggacagcagtggaattccttgagagctgttgagaatttcttatcaggagaaaatgcttgtacagcaacacccaagtcagcagtgaaatcaggcactggagagaaaagagcttgtggtgtgagaagtgtccgaaaacctgtccataaacgcttttcagcagcagatgagaaaatgactccaaagtacttgaaacactctattcaatctgcacttcctgagaaaccggattctcagaagaaaaccaagttggagaaggacaacagagcttccatgcataacttaacagcaccaccccctgcaaaagtaagctgggttctgtctggtccgggggggttctggagcccttcccttgacgattccattgtaccagaatctgaaaagctgaaatggtccgaagcatttgtactatccatccataatgatggagttactaatagctga

SEQ ID NO: 24012 - DNA, 735 bp, Glycine max
  Peptide Sequence Number=SeqID_140790
atggtgtctagaccttctcaaccattcttttgttattctaacggaccattgaagcttgaaggacctcatccgaggataccgctcaatggggatagtaaactattggtgctttctattcctcactttatattcatggacaagcttcttcactccttgtctcaaaatgcagcgtatgttgaattgcgcactccaattgctcagaatcctaatgcccactcagacttcactattcacaacaacaccatcctgcagcaaggcaaaatttggcttcccttggttgctaagacacttcaccacttgcaagataattttcgatggtcttatatgcgccacgatgtccgtcagtatgtggcacactatgacatctatcaacaaacaaagtatgagactcatagaccaactggcttactgcaacctctccctattccaaaaacaatttgggaagatctctctttagacttcattactgggttaccaccttctcaaggatacacaacaatattagtcattgttgatcgttattccaaggggacacacttgggagcacttcaacctcactatattgtgtacaaggttcccttactcttcatcgatatgcttgtaggcctaggatcttctttatcaatggattcctttgcttcttggaacatgaatggcagcggaatggagaatgaagagagagaggagacgccacttcaaggagaagataagtctagaagaagctctccaccatag

SEQ ID NO: 24013 - DNA, 255 bp, Glycine max
  Peptide Sequence Number=SeqID_140791
atgaagctcgccgccgataaccatcatcgtgatgtcaccttctcggtcaatgactgggttggcgccaactttctccaaattgcccacctgcttctttggacctttccgtatacaggaacatattggcccagtaacatacaagctatgtttaccagcaacttccaaaatacaccctattttccacttgtctatgctgaaacctcaccatggtcctccaccgggatcctagcccgtgtttcgatgcaccagtactga

SEQ ID NO: 24014 - DNA, 745 bp, Glycine max
  Peptide Sequence Number=SeqID_140792
atggcggctatcttattgggatcaggggaaactcctaatgttgatacaatatggccaatgtactgccaacatccagcatggtggaaacttgtttctccagctccgccttctggtagtaagggtatcaataaggctttacattcactggggaaatgtttggaagaagatgtatgtgatgggggcgtgggtggtggagtttgggaaggctgggctgggtctggtaaggggatcaattggtataaggctgagatactgttgtctatggttatgggccctagtaattttagccattgtaccccgaggataatatcggcgctgcataagggaggtgaggtggaggaaacgagcgacgtgggtttggataaaattatgggtactcccaccgtcaatcaaaatggtgaagggatagaggttgtaaagcctgcacttcgtggtcgccttgcgggtcatcgtaaaaagaaggtgcgaagtgagattcaagcacctagagcatcgccatccatgaggtatagcttggtggtaaaaaaattgggatatcttgaatatccatccaagagggtcttggtcatcgaatctcgggacttccagtttcatgtgagggcgagaatgaggaggtggaatgggggtgggaggggatttgggggaggaatggattgcggtcatggtggtaaggtgagcaactgcctctttgagcctttcgatgatggtttggcacgtggtgtgtttaggcatggtcgttgggcag

SEQ ID NO: 24015 - DNA, 686 bp, Glycine max
  Peptide Sequence Number=SeqID_140793
gatataattattgggattacaaggacgcctggaccaatgtgttctggcatcaaaatagtaaattcaagcattcatggctaatttacttcaaaaataacaccgtgtataattttccaaattggttcctccaatggtggaactacttcggaccaattccacagatatttccagaagaagtccaacagggattccaacaattcagcaagctcttcaacagcaaggaatcaagaattccgacagacttaaaatacttttccagttttgccatgtcatggattttttcatggcaatacagatatggaaaaaccgaaaatagcaagcagtatccaccgttgcagagacacgcctttgtaaaatggtggtcacaattcgatacctcaaatgctgctccagaacaagtcaagaactggtttcagagcaaccctgagtttctcaaacctgctgatccagagacatctttgtttctgaatcagaagtctcaacttgcagcattcttggcaagctcaaaatctaaagaaagtcttgctcagaatcttaaggaagttctccaactacttcaacaggaagaagaagaagaaccccccaagaaggaagccgaatcatccgaaaataatgatgaccaagaagatgatccattctaccagaatgaggatgactgttttggtatatcgttagacgatgattag

SEQ ID NO: 24016 - DNA, 279 bp, Glycine max
  Peptide Sequence Number=SeqID_140794
atgactggaacatcccagaaaacatggatgacccaagaggtcgcccctaaacacaatctcttcgatgaggaagtccgattcgaagatatcaatcaaaacatggatgactggaacatcccaaaaatccctcaggatgaactatacgttcctgaaacaatgaaagataaacacaactttgattacataatcaaaacagtagaaaacaatactcctctagggcaagacataggggaagaattccatttactttcaaaaaattcaatttatgaacatagttga

SEQ ID NO: 24017 - DNA, 834 bp, Glycine max
  Peptide Sequence Number=SeqID_140795
atgggattcctggtggcaatgatttccaccaattttggcatactggattccgacattggtcaactgatatttattacatgtggtttggtgcctgaaacatggaaaggtttctcttttttagcattcaaagatctttggccggttgccaagcttttccatttcatctggtgccatgttatggaaattggatatagattaattcttgagctctggtatagcacaatattgattcttttgactggtaacatgaaagatgctgaggttcaaattgatgctctatctatatgtattaacatcagtggatgggaaatgatgatagcatttggtttcatggctgctgttagtgttcgagtggcaaatgaacttggaagggaaaactccaaagctgcaaagttctctatagttgtgacagtgcttacatcatttgcaattggagaaaaagtagcttatctctttacttcaaacgaagatgtggctactgctgtgggggatttgtcacctttgttagcgctttctttgttactaaatagtattcaacctgtactctcaggggtggctgttggagcagggtggcagagcactgtagcgtatgtgaacatagggtgttattacctcataggtattccggttggaatagtacttggtaacattattcacttgcaagtcaagggtatttggattggaatgttgtttgggacactaattcaaactataatcctaattataatcacctacaaaactaattgggatgagcaggtgattatagcccgtgatcgtattaataagtggtctaaaatggtccttgatcatgaaacaattacatcagataattag

SEQ ID NO: 24018 - DNA, 414 bp, Glycine max
  Peptide Sequence Number=SeqID_140796
atgtatggaaaccatcaaattgccatatcaataggacctttctctggcacgcagatgaggaagcttcaacggatttattcaatattctgtgggcgacttggttcagccagaattcatttcttagcaagggcctccattcagaaattgaaaaggcaacaagcagaacaggtgcaaacgcaaactccacttatctcgtggaaaagaccacctctacagtgcataaagattaactttgatgcatctgcccataacaatcaagggacgggaatggggctagtagtggccagagaccatgaaaaactggttctgggagctgctaccataatggttacggtggtgtatatgaaccaaggactgcagaagctttatgctacaagtgggcgattcaagtggcaggcgagttctattttataa

SEQ ID NO: 24019 - DNA, 1155 bp, Glycine max
  Peptide Sequence Number=SeqID_140797
atggagactcctcctccgcaacaaggcgtggtgaagaagaaggagacaaggggccgaaaacccaagccgaaagacgaacacgccaaggcgttgaaggaagggagaaaaacacagcaacaacaacatgatcagcagcaacaacaacaacagcaacatcaaccttcggtggacgagaaatacacgcagtggaagtcccttgttcctgtcctctacgactggctcgccaaccacaacctcactgatggtagcgtgccgaatactctggtgattgcaaattgcgaggttgtgaagcctagggttgcagctgcagaacacatttcgcagtttaatgaagaggcacggtccccatttgtgaagaagtacaagaccatcatacatcctggcgaggtgaacagaattagggaattgccacaaaattccaagatagtggctacacatacagacagccctgatgtccttgtttgggatgttgaaagtcaacctaatcgccatgctgtccttggagctacaaactctcgtcctgatttgatattgactggacaccaagataatgcagaatttgctcttgcaatgtgcccaactgaaccctatgttctttcaggaggaaaggacaaaacagtggtgttgtggagtattgaagaccatataacatctgctgccacagactccaaatctggtgggtcaattatcaaacaaaactctaaatctggagaaggcaatgataaaactgctgatggccctactgttggaccacgaggcatttattgtgggcatgaggatacagttgaagatgtgactttctgcccatctagtgcacaggagttctgtagtgttggagatgattcttgtctcatcttatgggatgcacgtgttggctctagccctgtggttaaggttgagaaagctcataatgctgatcttcactgtgtggactggaatccacatgatgataatctgattcttaccgggtcagcagacaattctgttcgcatgtttgatcgccgcaatctcaccactaatggagttggatcacccatccacaagtttgagggtcacaaagctgctgttctttgtgttcagtggtctccagacaaatcatcagtattcggaagttcagctgaagatggtctcttgaacatttgggactatgagaag

SEQ ID NO: 24020 - DNA, 225 bp, Glycine max
  Peptide Sequence Number=SeqID_140798
atgtcagtctctaaggataatctagctttggcaaaggaatccgccaagttgtttgcctgtaccatagatcgagctttgctgaaacttgcctttgagtttccaaatctcagcaaactggtcagcaacagcttgattgcagtgcagcaggctccaagtaaactacaaaagatgttcatgttagattataggaaacccataacatatacatccggaagaattatttga

SEQ ID NO: 24021 - DNA, 594 bp, Glycine max
  Peptide Sequence Number=SeqID_140799
atggcgcaaccttaccgttgcgctgtagagggtaactcaggcagcggtgatattgagcgcctggttttaaaaccattcatctggatggacgagaagtgggcgaacagatcttcaccgccgtcgtcgggcgtaatgaagccgaacccctttgcatcgttgaaccatttgacggtacccgtcgatttgggattgtccccttggacggcggttgcggtcgtatcagacatgcggactgcctcattgaatcaatgcgtggataatgcgccgcttttctttgcggagtcaagtatggaaactacgcatttctaccacgatttggccgtcgaaaaggcaccggcccgcgccgcgccgcctccgatgtaccaggtcctgttgctcaatgacgactacaccccgatggagttcgtcgtgaaggtgctgcagaagttcttcaataagaatcatgaagaggccacgcgcatcatgttgcaggtgcatcacgaaggccgcggcgtttgcggcgtctatccgcgcgacctcgccgccacccggatcgcccaggtggcgcagtatgcgcgggcccgccagcatcccttgcagtgcgtgatggaaccg

SEQ ID NO: 24022 - DNA, 777 bp, Glycine max
  Peptide Sequence Number=SeqID_140800
aggactgcgcgtcctcaccttcagagggctacacgccctcgccatcagaggactgcacgtcctcaccttcatagggctacacgccctcaccttcagaggactacatgtcctcaccttaagagggctacacgccctcacctccgaggactacacgtcctcatcttcagagggctgcatgtcctcaccttgagaggactacgcatcctcgccttcgtagggctacacgccctcacctttagaggactacacgtcctcacctttagagggctacgtgcccttgccttcgtagggctacacgccctcaccttccgaggactacatgtcctcaccttcagagggctacgcgccctcgccttcgtagggctacacgccctcaccttcagaggactacatgtcctcaccttgagagggctacgcgccctcgccttcggaggactacacgccttcaccttcagagggctgcatgtcctcaccttcagaggactacatgtcctcaccttcatagggctacatgccctcaccttcagaggactacatgtcctcaccttcagaggaccatgtcctcgccctcaccttgagaggactacacgtcctcgccttgagaggactgcacaccctcaccatcagagggctacacgccctcacctccagaggactacacgtcctcgccttgagaggactacatgtcctcaccaacagagggttgcacgccctcacctccagaggactacacgtcctcgccttgagagggctactcgcccttgccttgggtactag

SEQ ID NO: 24023 - DNA, 288 bp, Glycine max
  Peptide Sequence Number=SeqID_140801
atgaaaaccctaaaactgaatggaaacctagcaaaactacccatcatatctcccaaaacccaatacccacgaaaatcaagtgagaaagaagtctacccaaacctgaaatttcgaggtcccacacgtagagatgcgcttcacgactccgaaaatgccttcctttcgcgatttggagcaaaaatgatgaccaaaggttggagctttgttggagcttcaatggtggaggaagaagaagagaatggtaacgtgagagagagaaaagagctttctgaaattttctttggctga

SEQ ID NO: 24024 - DNA, 322 bp, Glycine max
  Peptide Sequence Number=SeqID_140802
atgtggtgttatgagtggaaaaagagtgaggctttgagagttggaaggctaaatctggattcagtggatgcaatttgggaaaaattggatgaaggaaagagtggttttcgaaaatgtgcagcagaattttgcataagtgcagaaaaatgctatgtatttgctggttgtggaaagagtatttgtgatgatttggatgttgaattacctggatgttggggaagctttgggaggattgatggggacccggtgttgagaaaaacgaggatatgggctacgtgggagtacgtgagctcagttggaggtgggcaacaggggatgatgg

SEQ ID NO: 24025 - DNA, 594 bp, Glycine max
  Peptide Sequence Number=SeqID_140803
atgggatcaagtcaaaagccttcgcttaaaaagaggttctatcaagtcaaaatcaagagcttagaggtcaccagtttacgaaagttggggcaattaatgggtcaacttcaacggcaagccttcgcaaagcctatgggttctacccctcattggccagaatttctaaaaagtccaaatctcggcgcaggaattagaccgccaaaggcaagtcgaaaatggggtggtcggaatatcgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaggattctatcttcatgcgaaggatgtccgaatgttcccttga

SEQ ID NO: 24026 - DNA, 609 bp, Glycine max
  Peptide Sequence Number=SeqID_140804
atgtggcctggagctatgaaatgccctacaacgccgtggtggcgatcaaggatcatctggcattttatcccgacaaagtggcggaaatccgtgccgaagcctgagccccgccgcatccgggcgtgggcaggtgccaaggtgtctacctctacgcgatttgccgttgccatccatattctgaccaatatcacgctgtgccgtggccagacggtgcgttccgaagatatcgcgcgcagcgtcaacaccaacccgacggtggtgcggcgcatcctcggcgcgctggcggaggcggggctgacctattcacagatggggcaaggcggcggggcgctgctggcgcggccggcggaagcgatctcgttgctggatgtgtatcgcgcggtggaagatcaaccgtatttcatgctgcaccgtacccggcctaacgatgcgtgctatatcggccacgccattaccccggtgctggagcaagagtttgctcgcgtcggtctcgcgctggaagccagcctggcgcaaaccagcatcgccgaaatggccgggcaggtcgagcggcgcgcaggctatccttttgtcccttgttcgccgcaatatcaagcggatacgcaataa

SEQ ID NO: 24027 - DNA, 1556 bp, Glycine max
  Peptide Sequence Number=SeqID_140805
gatggcgtcgtagaaggcggcggcggcgtccagatcgctgacgccgacggtaatatggctgaacatggcgcttcctttccgaagagagagggcaaagcgcgcttcacggtgtgcggggcaggccgccgctcaattgctttcgacgcgcggattggcgtgagtcggttggctgggatagtccacctgatgcttatgcagataatcgcggatcagctggcgcaccacctgggaaggggtgacgtcctgttgcaggcacagttcctccagggctttcttcttgtccgggtagccgagttcgcagttgaacagctcgccgctgctggcggccaggctgcgcagcgcgctcagcggcagcgtcacctgggccggcgtggcgtaaatgatcacgttgccgctgggggcgacgcaaaacagtacggtgccgaatattcgctgcaggctgtggtacagcaggctgttttcgtcaggcagatcgtggtaattgagcaccagccagcccccgtcgttcagccgcgcggcgcagttttccaggaaggtctgggtgccttgctgcggatccatggcgaacgccgaatagagatcggagaagatcagatcgtagcgcgtctcgacgggcgggcgcacgaagtccatggcgtcggcggtgcgcaggctgatggtgtcggtggccggcagcgtaaaatagcggcgcgcgacggcgatcaccgcagcgcgcagctcgacgacgtcgaggcgcatggccggatcgagcgcgtgcagcgcgcgcagcagactgccgccgcccaaccccaaaatcaacgccgagctcggcggttgccaggctaccgccatcagcatcgctttgatgtagttgtggatcggctgcgcggggttgctgaggctcatcttgctctgttcgcagatgccgtcaaaccgcagcgtgcggtagtccttgtgatcggaaacgatgatttcgccccaggcagacatggtattcgcagggctcctttggcaagcggcctatttacgggcgcacatgaaatcggcggtgcaaatgcgccggccatcgatgctggcgcggccggtaaagcgagcgatcgccccgcgccgacgaacaaaagcgacctccatcagcacctggtcgccggggcgggcagcgcgataaaaccgcgcgcgctgaatggcggcgaaatagtaatgctccccctcattcagcgccccgagatagtagtgggccagcagaccggtgctttgcgccagcgcttccaccaacagcacgccgggaaatccggcgaagtgcgcgtggccgttccagaacgtcggctcattggcggtgatgttcttgatggcgctcagccgcccttcggcaatgcaggtgccggcgggcagtacgcgatcgaccagcaggcagggataacgatgaggcaaaatcgcctgaatatcgttgaattgcagggggcgaagagaggagcgagagggaggcacccgatcctggcgatcgagtgtggcagcgcgtttagtgcttggagcgggtcactttatccaggtagcccatcacgaaggcggacagcacaaag

SEQ ID NO: 24028 - DNA, 219 bp, Glycine max
  Peptide Sequence Number=SeqID_140806
atggtagtggcgattgaaagcacaaacaagatgcactatggtataggaggctcaaaggaaagtatgataagggaagtgggaattgggagtggaagggaaggagatgttcgaactgataatggcaagaaggaatatgggtatagagtaaggattagaggagacctctatttatttgaatgggagaaggactcgatgttggagttgaaggagattgtgtga

SEQ ID NO: 24029 - DNA, 1779 bp, Glycine max
  Peptide Sequence Number=SeqID_140807
atggtggtgaagaagccacggattgtgataattggagcaggaatggcaggtctcacagctgccaacaagctctacactgccactgcctcaaaggacttgtttgagctgtgtgttgtggagggtggaacaaggattggtggcagaatcaacacctcagagtttggtggtgaccgcattgagatgggagctacatggatccatggaattggtggcagccctattcacaagattgcccaagagatccactcactccactcagaccaaccttgggagtgcatggatggcaacactgatgaggccatcaccattgctgaaggtggctttcacctccacccttccattgttgaccccatcacgaagctcttcaacaccctcatggaatattctcaaggtaagaagaccctcactgaggccacttcaaagggtgctgaacttgaaagctatcacaagctggctgctttggctgctaagcttgcttctgcttctgcttctgcttacaacaacaacaaccttagtgttggttctttcctcagacaaggccttgaggcataccaggtttcaaaggagcaagaggaggtgaaagggtgtgggaactggagcaggaagctgcttgaagaagcaatctttgcaatgcatgagaacaaccagaggacatatacttcagctgatgaccttttgacactggattatggtgctgagagtgagtacagaatgttcccaggtgaagaaatcactattgctaaagggtacttgagcataattgagtccttggcttctgtgttgccacctggttttgtccagttaggtaggaaggtcacaaggattgagtggcagcttgatgatgagaagaggaagggtgctgtggaaaatggatgttgctcttctaggcctgtgaagctgcatttttgtgatggctcagttatgtctgctgatcatgtcattgtcacagtttcacttggagtgttaaaagctgctattagtgatgatgatgatgattcaggtatgttctgtcctcctcttcccccttccaagactgaggctatttcaaggcttggttttggtgttgttaacaagttgtttatgcaattgagtccaacacacggagaagggaaacatggaaatgaacactctaacaaagggtttcctttcttgcaaatggttttccattcacctcaatctgaaatggggcacaagaaaataccctggtggatgaggaggacagccacccttttccccatctacaacaattctagtgtcctcttgtcatggtttgtgggggaggaagcactagcacttgagtcactcaaagatgaagagatcataaatggggtttcatccacagtctcatgctttctacagcattctcagtggcaaaagggttccaccagttcacataaattgtgcaatgggaatgtgaattctgaggagagatctcaccaccaaaatgaagtgaagttcagtaaagtcatgaagagcaaatggggaactgatcccttgtttttaggctcatacagttatgttgcagtaggatcaagtggtgatgatttagatacaatggcagagccattgccaaaagataacagttgtcaacctcctgcagcttcatctccacttcaaattttgtttgcaggggaagcaactcacagaactcattattccacaactcatggagcttacttcagtggtcttagggaagccaataggcttcttcaacattaccattgtgttgggatttataacaactacttggaatctcctctcattagttctatgaagtga

SEQ ID NO: 24030 - DNA, 486 bp, Glycine max
  Peptide Sequence Number=SeqID_140808
atggctcggtttaacttgaagttatgcatcactgatttcaatagtcgtgactactatgtcaacattagaaaggaaatgttcatgcaggtggcccatttggagcggacaggacatttacttgacaatgaaaaacaaccggttggtgcacttgcatccatcaaattgcctggaccacaagccggagtagctaagattgagtttgaaaacctcgaaatggtgaaaacgttaatggatgtagccccacattactatgatttgtcgaattttccacaatgtgaagcgaagtgtgttcttgagaggctttacaagaagcgagaaaaggaaaaggaggaagccaagagtcagaatgatgttggtaaaaatagggcaccagtttttgttagtaagctgcaggagctcaacaatgtattgattgtacaaagcttgactactcaactgattaaagagcacttttccaatttccaagtacctaattcctctgtctaa

SEQ ID NO: 24031 - DNA, 549 bp, Glycine max
  Peptide Sequence Number=SeqID_140809
atggccaatgatggagaggcccaaagtggtgctcgttcatcttccttccttccttcgattctcaacatccaatcagagagaccttgtgaaggattagttggagaagaagagaccagcaacgacaacgacaacaacaatagttctctcaagaagaattggatcatcgccgccactgccagaaccgtcgattcgacgacatcgatgaggatctccacagtcgacagtgtatgggaaagagaccatgtagaggctctttggttccaacattctcgtcttcaagatgcagggtcttgcattgagattgataaaatgaaacctttctgtgccaaagttgggttgaagaaggggccatggaccgtagaggaggacaagaagctcataagcttgatcctcaataatggccaatgttgttggagagttgttcctaagctagcagcatttgtacatctacatagagtcaatattgtgcacatgatgggatgtctggctacttacacatgtgctcagatgcatatgaatgcggttggtagaacatgtcctgttaagtag

SEQ ID NO: 24032 - DNA, 890 bp, Glycine max
  Peptide Sequence Number=SeqID_140810
ttgtagtagggtggttcataatgggatctcaaagtggggcaacccaagaccaagagccaaagactggttctttgaccagacaagggtctttgtacaatctcacccttgatgaggtgcaaaaccagcttggaaatttggggaaacccgtaggaagcatgaatcttgatgagcttctcaagagtgtgtggactgttgaatctggaacggatgcgtacatgcatcatggtggtggtcaggtggtttctgctggctcatctttgaatccagaacaagggagcctaacattgagtggggatcttagcaagaaaactattgatgaggtttggagagatatgcaacaaaacaagagtgttggtaaggaaagacagcctacacttggtgagatgaccctggaggatttcttggtgaaggctggtgtgtctaccgaaccctttcctaatgaggatggtgctatggccatgtcaggggttgattcccaacataacacattacagcatgcccattggatgcaataccagctcacttcagtgcagcagcagcagcagccacaacaacagaatagtgtgatgccgggtttttcgggttttatggctggccatgtggttcaacagcctataccggtagtgttgaatacggttcgggatgcaggatactctgaagcattgccatcttctttgatggctgccttgtcagattcacaaactgcaggtaggaaaagggttgcctcaggtaatgtggttgagaaaactgtagagaggaggcagaagaggatgataaaaaatagggaatccgcagctcggtcccgggctagaaaacaggcttacacacaagagctggagattaaagtttcccaattagaagaagagaatgaaaggcttagaagacagaat

SEQ ID NO: 24033 - DNA, 480 bp, Glycine max
  Peptide Sequence Number=SeqID_140811
atgaaaagctatgacaaatcatggctcatgttggtcagaagatcctgcttgcgtgcaagtcaatccaatgatctcacaaaagaagattgcaaggaaacaagttcagtggttgtttgtttcggggaaatgttaatagactttgttccactggtgggaggagtgtcactagctgaagcacccgctttcaagaaagctcctggtggtgctcctaccaatgtggctattggtatctctagactaggaagttcatctcctttcataggcaaggttggagcagatgaatttgggtacatgttggctaacattttaaagctgaacaatgttgagacttctggcatgcggtttgaccctaatgcaagaattgcattagcttttgttacacttagagtagatggcgaacgcgagttcttgtttttccgcaatccaagcgctgatatgctccttcaagagttagaacttgataaagatttccttaagtag

SEQ ID NO: 24034 - DNA, 285 bp, Glycine max
  Peptide Sequence Number=SeqID_140812
atgtgtccagctcatccttcttctagattcatcctcgcgctcaaccgcaagagtggttgcaatgtttggtggtgggataggcaacacaatacaaagggatctaaccaggattgcagaaattgcacatacatcctctcaggatggtttgacctatctattgacaggtttttggtgcaaatcgtattgtttccattgtacacaaaatcatctctagatataggtatacataaaacaaggtcgaaaccactgtcattagatggtgtaaaacaggatattcatttgtaa

SEQ ID NO: 24035 - DNA, 228 bp, Glycine max
  Peptide Sequence Number=SeqID_140813
atggcaaattatatacatagtgcggtgggtgcaagtgggaattatataggaatctcagtagcagcatgtgatcttgaaggctcagcaaacggacaaactcattcaaactcacatatatataatatgagtttagaagagacttcattccatattaacaaagtaagtgactttctcgaggatgttggaggccactcctctgtcagaattcagaaacagatgtctaggtaa

SEQ ID NO: 24036 - DNA, 2451 bp, Glycine max
  Peptide Sequence Number=SeqID_140814
atggcttcttcgatattcttaatactacatcttctccttcctctaattttcaataattttgagaattcatattcattctccctctctgtggagaacttcaaagaagaagtaatagtgtcatcacccaaagctacattcagcgcagggttttaccccgtaggggataacgcatacggcttcgccatatggtacacaacaacacctcacacccttgtgtggatggccaaccgggaccgaccggtaaacggaaagcgctccatgctatcccttctcaaaaccggtaacctcgtattaaccgatgctggccagtcaatagtgtggtccaccaacaccatcacctcatcgaaacaagtccagttacatttctacgacaccggcaacctcgttctcctagacaactccaatgctgttgttctgtggcaaagcttcgatttcccaacggacacgcttcttcctggtcaaacactcagcaagaacaccaaccttgtttcgtccagaagccagaccaactattcctccggtttctacaagctcttctttgactctgagaatgttctacgcctcatgtaccaaggccctcgagtttcaagcctctactggcccgatccttggcttcagagcaacgatttcggaagtggtaatggtagattatcttacaacgataccagggtggctgtactcgatcatttaggctacatggtttcttccgataatttcactttcagaacaagtgattacgggacggtgctccaacggagattgaccctcgatcacgatggtaatgttcgtgtctatagcaagaaagacctagaagaaaaatggtcaatgtcagggcaattcaagtcacaaccatgttttattcatgggatttgtggacccaatagtatttgcagctatgatcctaaaagtggaagaaagtgttcttgtattaaagggtatagctgggttgatagcgaagactggtctcaaggttgcgtaccaaatttccaactaagatacaacaacaacactgagaaggagtctcgcttcctgcacttacccggagtcgatttttatggatacgactacagcatctttaggaatcgaacttataaagaatgtgagaatctgtgcttgggattgtcccaatgcaaagggtttcagcacaaattttggcagccagatggtgtgtttatctgtttcccgaagacgcagttgctaaatgggcatcatacaccaggtttcacaggatcaatcttcttaagactgccaagaaatagtcctctgtcgctcagtgacagtgagaaccccatcaattataacaacggctttgtttgtgggggaagtaatggaggaccgaaactactggatagaccatatgtggaagaagaggaaaatgactcagtgaagctcttgctttgttttgtgactgccttgggaggaattgaggttgcgtgcatctttctggtgtggtgtttctcgtttaggaacaaaaataggaaattacactcgggtgttgacgaacccggctatgttcttgcagctgcaacagtatttaggaaattcagttactctgaactgaaaaaggcaaccaaaggtttcagtgaagccattggaaggggtggtggaggtactgtgtataagggtgtcttgtctgatagtcgagttgtggcaataaagagactgcatcaagtagcaaaccaaggagaaagtgagttcctggctgaagtaagcatcattggaaggcttaaccacatgaacctaatcgacatgttggggtattgtgcagagggaaagtatagattgttggtttatgagtacatggacaatggttctttagctcaaaacctctcatcaagtttaaatgcacttgattggagtaaaagatataacattgctcttggaacagcaaagggtctggcctacttgcatgaagaatgcttggagtggattctgcattgtgatattaagccacaaaatatacttctcgactctgattataaacccaaggtagcagattttggcttgtgtaagctacttaaccggaacagcaacctcgacaattcaagtttctcaaggataagaggaacaagaggctacatggcaccagaatgggttttcaacttgccaatcacttccaaggtggatgtttacagctatggaattgttgtcttggagatgataactggaaggagcgcaacagcaggtacccaaatcacagaattagaagcagagtcgtatcatcacgagaggttggtaacatgggtgagggagaaaaggaagaaaggatcagaagtgggatcatgctgggtggatcaaatcgttgaccctgctttggggtcaaactatgagagaaatgaaatggagatattggcaacggtggctttggaatgcgtagaggaagacaaaaacgcgagaccaagcatgggtcaagttgccgagaagctgcaaagatatgcacacaattcttga

SEQ ID NO: 24037 - DNA, 462 bp, Glycine max
  Peptide Sequence Number=SeqID_140815
gtagcagattttggcttgtctaagctacttaaccggaacagcaacctcgacaattcaagtttctcgaggataagaggaacaagaggctacatggcaccagaatgggttttcaacttgccaatcacttccaaggtggatgtttacagctatggaattgttgtcttggagatgataactggaaggagcgcaacagcaggtacccaaatcacagaattagaagcagagtcgtatcatcacgagaggttggtaacatgggtgagggagaaaaggaagaaaggatcagaagtgggatcatgctgggtggatcaaatcgttgaccctgctttggggtcaaactatgagagaaatgaaatggagatattggcaacggtggctttggaatgcgtagaggaagacaaaaacgcgagaccaagcatgagtcaagttgccgagaagctgcaaagatatgcacacacttcttga

SEQ ID NO: 24038 - DNA, 358 bp, Glycine max
  Peptide Sequence Number=SeqID_140816
atggtgaagccgccactggcattggcgccacgtatgactcaccttcaggactggcgatacagtcacgtagatgtcgccttctccattggcgagacaggccatcatcacgtgaagcttcagggtcacaggcttgcagttagggcttcagcttttcagtctgagctttgcttttctcctttgttgagtttcattgagtgtctgcgtgctggttccataattcctggctgtatcgccaatgctaacagcgagtcccacgtggcctgtgtcgccaatgcaagaggcgacactctccttcctacgtggcctgtcacgccaatgccagtggcggcttcaccattctcgccagtggctatggcgg

SEQ ID NO: 24039 - DNA, 1337 bp, Glycine max
  Peptide Sequence Number=SeqID_140817
cggaggtatttacggaagccgtcgtatccctcgcccaatactatgaccagccgttgaggtgtttcatgtttggggacttccaaatggtaccaactattgaagagtttgaggaaatattaggatgccctcttggggggagaaaaccgtatcttttctctggctttcttccttccttgagcaagattgcagctgtgattggagattcagcaaaagagttggatcgcatgaaacaaacttgcaatggcgtagtgggcctgccacggaaatgcttggaagacaaggcaaaggatatggcgagccaagagaagtggggcccgtttgcggatattttagctttgctgatttttggggttgtcctcttcccgaacgttgacggtttggtagacttagccgccattgatgctttcctcgcatatcaccatagcaaggaaagtccagtggtggctatcttggcagatttgtttgacacctttgaccggagctgtgagaaaaacagtgcacagattgcctcacaatcaattggtttcctcgttggaaggaaggcaaggaaggagttcttttctcgtgtggggactaccctaatggttgcattgatagggactagggggtgtattaattataatcccgcactcgccataagacagctagggtaccccatgaggggagcaccaacggaagggagtctctcacctttccttgtgaaagatttagacgtgcaaggtctcaacgttatacaaagaatccacaaggtgtggaggagtccgttgaggaaagacaaggagcttaggggcatccgtaatggcgtcatcggaggttatcacggatggctaagaattcacacgcgagggttagattggctctccaagttgaaagttatcgatgaggagaacttcgaagctccgaaggaagatgaagaagtccgagctctaaaattagagctagggaaggcaagactcgccaaggagaagttcaaatcagctgctacacacatccggaaagagtgcaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggaaagagatcggtcacgggtgcatggcatgatcttaaaagaagagttagttgcttgcgcgaggtccaaaaggagtttggctcaacacttggaagccacggagcaaagcatgctagctatcatagggcaatacaaggaagagttgaaccagtctgtggcccatgaacaaaagctagtggaggattttgcacaa

SEQ ID NO: 24040 - DNA, 219 bp, Glycine max
  Peptide Sequence Number=SeqID_140818
atggcttcgtcatcagtcaatgcaattatctattacgatggcgcgatcataacaaccttaaacctttctatgtttgtaagcggttcaccaaagatcgttcaacttgacaataaaatgtcatttgatgccttgaagcaagctactagaaacaacattattctaccaaatgttcaagtagtgaaggatacattttcgattacctgtatcatttgtcggtga

SEQ ID NO: 24041 - DNA, 2481 bp, Glycine max
  Peptide Sequence Number=SeqID_140819
atggcctcgtcaacactccttctggctcttgtaattctccacaattttcagcactcaacacaatattcgttctccctctccgtggagaacctcaaagaagacgttatagtatcatctccaaaagctacattcaccgcagggttttaccctgttggagaaaacgcatactgcttcgcaatatggtacacccaacaacctcacacccttgtttggatggccaaccgggaccaaccggtaaacggaaagctctccaccctttcccttctcaaaaccggcaaccttgcattaaccgacgctggccagtcaatagtgtggtccaccaacaccatcacctcatcgaaacaagtccagttacatttgtacgacaccggcaacctcgtcctcctcgacaaccaacaaaaccgttcctccaacattgttgttctgtggcaaagcttcgatttcccaacgaacacgcttcttcctggtcaaattctcaccaagaacaccaaccttgtttcctcgagaagcgagaccaactattcctccggtttctacaagctcttctttgacttcgagaacgttcttcgtctcatgtaccaaggtcctcgagtttcaagcgtttactggccagatccttggcttcagaacaataatttcggtaatggtggcacgggtaatggtcgatccacttacaacgatagcagggttgctgtacttgatgatttcggctactttgtttcttccgataacttcactttcagaacaagtgattacgggacgctgctccaacggagattgaccctcgatcacgacggtagtgtgagggtgtttagcttcaacgatggacacgacaagtggacaatgtcaggggaatttcacttacatccctgttacgttcatgggatttgtggacctaatagttattgcagttacgagccatcaagtggtagaaagtgttcgtgtcttccaggtcatacttgggttgatagtcaagattggtctcaaggttgcacaccaaatttccaacatttatgcaacagcaacaccaagtacgaatctcgcttcctgcgaatacctgacattgatttctatggatacgactatggctactttggaaattacacttatcagcaatgtgagaatctgtgttcgcaattgtgcgaatgcaaggggtttcagcacagcttttcggaggcaaatgctttctttcaatgctacccaaagacacatttgctaaatgggaatagtcaaccaggtttcatgggatcattcttcctgcgactgcctttgtcgtcccatgatgagtatgagaaccccgtccaaaataatagaagtggcttggtttgtgggggagatgttggaaacgtaaagatgctggagagatcgtacgttcaaggggaagaaaatggatccttgaagttcatgttatggtttgcaggtgccttgggaggaattgaggttatgtgcatctttctggtgtggtgtttactgtttaggaataataggactttaccctcaagtgctgacagacaagggtatgttcttgcagcagcagcagggtttcagaaattcagttactctgaactgaaacaagccaccaaaggcttcagtgaagagattggaaggggtgctggaggtattgtgtacaagggtgtgttatctgatgatcaagttgtggccataaagcgattgcatgaagtagcaaaccaaggagagagtgagttcttggctgaagtaagcatcattggaaggcttaaccacatgaacttaattggcatgttggggtattgtgcagagggaaagcatagattgttggtttatgagtacatggagaatggttctttagctcagaacctttcatcaaattcaaatgtacttgaatggagtaaaaggtataacattgctctgggaacagcaaggggtctggcctacttacatgaagaatgcttggagtggattttgcattgtgatattaagccacaaaatatacttcttgactctgaataccaacccaaggtagcagattttggcttgtctaagcttcttaaccggaacaacgtcaacaattcaagcttctcaaggataagaggaacaagaggctacatggcaccggaatgggtttacaacttgtcaatcacttccaaggtggatgtttatagctatggaattgttgtcttggagatgataactggaaggagcccaacaacaggtgttcgaatcaccgaattagaagcagagtcagatcatcgcgagaggttagtgacatgggtgagggagaaaaagatgaaaggatcagaagcgggatcttcttgggtggatcaaatcattgaccctgctttgggatccaactatgccaagaatgaaatggaaatattggcaagggtggctttggaatgtgtagaggaagagaaaaacgtcagacccaacatgagtcaagttgtcgagaagctgcaaaatcatagtatgcacacaattgttgatggtttgaacaaagaatag

SEQ ID NO: 24042 - DNA, 1716 bp, Glycine max
  Peptide Sequence Number=SeqID_140820
atgcagaaattgcgaatggccacttcaccattatcacaactactactatctctgattctcctccagaattttcaccattcacattccttctccctctccgttgagaaccacaatgaagacgtcatagtttcatcacccaatgccacattcaccgcaggtttttaccccgtcggtgaaaacgctttctgcttcgcaatatggtacacccggccacctcgtaccgtcgtttggatggccaaccgggaccagccggtaaacggaaaacgctccacgctctcccttctcggaaccggtaacctcgaactaaccgatgccggtcagttcatcgtgtggtccacaaacaccgccaccccatcgaaacaaaacccccggttacatttgtacgacaccggcaacctcgtactaatagcaatcctcgacaactccgaagatcatgttttgtggcaaagcttcgattttccgacggacacgcttcttcctaaccaacctctgagcaagagcaccaacctcgtttcatcgagaagtgggaccaactattcctccggtcactacaagctcttcttcgacttcgagaatgttctgcgtctcatgtaccagggtcctcgagtttcgagtgtttactggccttacgcttggcttcagagcaataacttcggtaatgggaatggtagatccactttcaatgatagcagggttgttgtgctggacgatttcggcaaactggtttcttctgataacttcactttcactacaattgatagcggaacggtggtgcttcgacgaagattgaccctcgatcacgacggaaatgcgagggtgtatagcatcagagacggagaagataattggaaggtgacgggaatattccggccacagccttgttttattcacgggatttgtggacccaatagttattgcagtaataaaccaactactggaagaacgtgttcctgccttccagtacataacgagaaaattatggaaacaggatatagatgggttgatagtcaagactggtctcaaggttgtgaatcaagtttccagctttggtgcaacaacactgagaaagagtctcacttcctacgcttacctgaatttgatttttacggatacgactatggctattatccaaaccacacgtacgaacaatgtgtgaatctgtgcttggagttgtgcgaatgcaaagggtttcaacacagcttctcagagaaaagtgactctactagtcagtgctacctgaagacacagttgctaaatggccatcattcacctggttttaagggatcattcagcctgcgacttcctttgtctcatgactatgatgagaaggccatcctaaataatgacaatggcttggtttgtgagggaaatagtggaggagcgaaagaactagagagaccgtatgtggaagaaaaagaaaatggatcggtgaagttcatgctgtggaataatgctgacaaacaagcctatgttcttgcagctgaaacagggtttaggaaattcagttattctgaactgaaacaagccaccaaaggtttctctcaagagattggaaggggtgctggaggtattgtgtataagggtgtcttgtctgacgatcaagttgtggcgataaagcgactacatgaagttgtgaaccaaggagaaagtgagttcctggctgaaagggaaagtatagattgttggtttatgagtacatggagaatggttctttag

SEQ ID NO: 24043 - DNA, 795 bp, Glycine max
  Peptide Sequence Number=SeqID_140821
atgccaccgacaaaaatcaacgacctagatatcatcgattggagcaacgaacgtttaacgaccaaggtctcattgaaaaaatcaacggcctatgtatcattgattagaccaacacacgttcaacaacgaagatcccatcgacaaaatcaatggcctagatatcaccgattgaagcaatgcacattcaacgaccaagatcccaccaacaaaataaacggactagttcttcttgacattagcaccaaagcccaaaaattagcatatactgctagtactcttcttaggaaacaaaaccttcataaatttagagaagtaacaaacgatgtaatccaatcatatgctcagacaatgccctctccagatcccagaattaaacctttgttggttcaagctagggtttcaggtgttgcaaagctcgaacaagttacaatcaacaacagtttggtgattgctttggttgaaagatggagacccgagtcactcacatttcatcttcctgttggtgaattcataatcaccttggaagatgttgctctacaactgggtttacacgttgatggtgttgttcccctagagattgcactagttggattaacacttaaactaaaatggttaaaagaacatatgttgactttcctagtagaacccacaccacaaaaactagcaactcattgtaaggcatacattttaggacttattggtggggtattgatgccagacaagccagggaacagatttcacctgatgtatctacccctgttagcagattttgattgggatgattggtacaactag

SEQ ID NO: 24044 - DNA, 747 bp, Glycine max
  Peptide Sequence Number=SeqID_140822
atgaagatccagtgtgatgtgtgtgacaaagtggaagcctccgtcttctgtcctgcagatgaagctgctctttgccatagctgtgatcgcaccattcaccgcgccaacaagcttgcaaccaaacacgcccgtttctctctccactaccccacctccaaagacttccctctttgtgatatatgccaagagaggcgtgcatatctattttgccaagaagacagggcgttgttatgcagggaatgcgacgttcctatccacagagccaatgagcatacccaaaagcataacaggtttcttctcacgggtgtgaagctctctggtacttgtttagatcctgcttcgtcctccaccaattacaccaataataatagagtcactggctctgaaggaagaaacgacgctcgatctagaatgaacagacccagatcatcagtttccaatgaagaaaatgcaagtaattcttcttgcaaggttgaagacaacgtggctagtgacactggttcgatttcaactagcagcatttctgagtacttgattgaaacaatacccggttactgttttgaagacctccttgatgcttcgtttgcacctaatggtttctgtaaggttttatttaacaactttgaaccgtgtttgttgctgttgctgcagaagcagaactttgatcatccctgggcgtttcaggaccaaaagcgaacaagtggagacactatggccgtgccgttcctgaaactagtcatccattga

SEQ ID NO: 24045 - DNA, 288 bp, Glycine max
  Peptide Sequence Number=SeqID_140823
atggcaaggtcaggggatttaacattggaactggagccaattgcatttacccgttcttggtgtttttcttcatggatggagttttgtaggatcaggaaagaaggtgcaacaaatgaggagataacaacaacaataacacttgctaatgccaaaaagttcattgataagttgcatcaggagggatggattttcattatgagggacttagattgcaacagagaatgtaaatgccttcaccaagccagtgtatttcagcttcatctaagagccattaatctttcatattga

SEQ ID NO: 24046 - DNA, 273 bp, Glycine max
  Peptide Sequence Number=SeqID_140824
atgatgatgcagaagaagaagaagagaaacacgaagaagtggagacttacaacattttttagtgcaacgatcttgaggaaagtggaagtctttaggaattggaggattcgtcatcgtcttcgtcggggaggagtgtcatggcttggcgcatcaaatcagagagttctaacaagtcctcaatcgctgccatggatgaatcaatcaacggatcctaaacggagaatttgtcgtcgaatcgaaggaactcgcacttgctggttagggatcaattga

SEQ ID NO: 24047 - DNA, 399 bp, Glycine max
  Peptide Sequence Number=SeqID_140825
atgtcggaggtggaaagcaagaattttttgcggaaagctgagctacgggatcataattctatttggcacccctcgttgcacccatatgtaaagattaatgtcgacgggagttggaatgaagctaattacgagatgggtggtggtggtgtggacaataattttgttgggagagagggcatgagtctgttgtgtgtgaatcagactgcctgcatgtcgtttccatgtttgagtgcagccaacatcagcatgatgagcttcgataagcaagtcaatctggttgttgtgcctacggagtgcaatggtattgctcatatgcttgttggttggggttctacggggcaagatattgatttacaaagggatcacgtacccacctttttctatttgttggagctatga

SEQ ID NO: 24048 - DNA, 501 bp, Glycine max
  Peptide Sequence Number=SeqID_140826
atgcaaagggtgtctccaacctccacaatttggaggaccatagtctccaaggccagaaaaaacgtgtttttcatcaacgacccttttgctgcgcgctccttctctgcggttcccgtcgtggcagccgccaagaaattgcatcaaccagagattccaagcgatttccagaaatggggttcggttggattctgcagaacgtcgaaatttgcctctgggttcaatccacttcaaccgaagccgttggattctattgtagatgtccacagattgaaagatcggtatcctgaagacattgcttctgtttgggatgatatttccagttctcagcattctttctttatccttgcagccgatattttgtcattcctttatggaggggaagtggatacacgacaatgtttgttcaagactggcgtcaaagatattgctacgtgtccacttatattcatggactctattgtaatccgctatgcaaataaggatatcctaattggcaattag

SEQ ID NO: 24049 - DNA, 2406 bp, Glycine max
  Peptide Sequence Number=SeqID_140827
atggcctcattattacttccttttttggtttctctcatcattttccataattttcagcacacatcttcattctccctctccgtagagaaagacgttatagtgtcatcaccggaaggaacattcaccgcagggtttcaccccgttggagaaaacgcatactgcttcgcaatatggtacacccaaccacctcgtaccgtcgtttggatggccaaccgggaccagccggtgaacggaaagcgctccacgctttccctcctcggagtcggtaacctcgtactaaccgacgcggaccagttccaagtctggtccacaaacaccctcacctcatcgaaacaagtccagttacgtttgtacgacaccggcaacctcgttctcctcaacaactccaacggttttgttttgtggcaaagctttgattttccgacggacacgctgcttcctaatcaacctctgagaaagaccaccaacctcgtttcttcgataagcgggaccaactattcctctggttactacaggctcttcttcgactttgagaatgttctacgcctcatgtaccaaggccctcgagttaccagtgtttactggccatttgcttggcttcagaacaataacttcggtaataatgggaatggtagatccactttcaacgataccagggttgttttgctcgatgatttcggcagggtggtttcctccgataacttcactttcaccacaagcgattacgggacggtgcttcgacggagactgaccctcgatcacgacggcaatgttcgtctgtatagcatcaaagacggagaagacaattggaaggtgtcagggcaatttcggccacaaccttgttttattcacggaatttgtggacccaatagttattgcactaatcagccaactagtggaagaaagtgtatatgccttccaggtcacagatgggttgacagtgaagactggtctcaagggtgcataccgaatttccagccttggtgcagtaacaacagcactgagcaagagtctcacttcctgcagttacccgaaatggatttttacggttacgactatgccctctatcagaatcacacgtaccaacgatgtgtgaatctgtgctcgcgcttgtgtgaatgcaaagggttccaacacagctattctaaggaaggtggtgatattggtcagtgctacctcaagacgcagttgctaaatggccatcgttcggggggcttctccggagcgttcttcctgcgtctgcctttgtcactccaagactatgatgacagggccattctgaataatagcaatgtcttggtttgtgagggagaagtgaaggttcttgagagaccgtatgtggaagaaaaagaaaatgcgttcgtgaagttcatgttgtggtttgccattgccttaggaggaattgagttcgtgatcttctttctggtgtggtgtttgttgtttaagaatgatgctgataaagaagcctatgttcttgccgtggaaactgggtttaggaaattcagttactctgaactaaaacaagccaccaagggtttcagtgatgagataggaaggggtggtgggggtactgtgtataagggtctgttatctgataatcgagttgtggcgataaaaagactacatgaagtagcaaatcaaggagaaagtgagtttctggctgaagtaagcatcattggaaggctgaaccacatgaacttaattggcatgttggggtattgtgcagagggaaagtataggttgttggtttatgagtacatggaaaatggttctttagctcaaaacctttcatcaagttcaaatgtacttgactggagtaaaaggtataacattgctctgggaacggcaaggggtctggcttacttgcatgaagaatgcttggagtggattttgcattgtgatattaagccacaaaatatacttcttgactctgattaccaacccaaggtagccgattttggtttgtctaagctacttaaccggaacaacctcgacaattcaaccttctcaacgataagaggaacaagaggttacatggcaccagaatgggttttcaacttgccaatcacttccaaggtggacgtttacagctatggaattgttgtgttggagatgataacaggaaggagtccaacaacaggtgtccaaatcacagaaatagaagcaaagtcgcctcatcatgagaggttggtgacatgggtgagggagaaaaggaagaaaggatcagaaatgggatcatcttgggtgaatcaaatcgttgaccctgctttgggatcagactatgacatgaataagatggagatgttggcaacgatggctttggaatgtgtagaggaagagaaagacgtgagacctaccatgagtcatgttgctgagaggctccaaagtcatgaacatgattcttga

SEQ ID NO: 24050 - DNA, 234 bp, Glycine max
  Peptide Sequence Number=SeqID_140828
atggtcgcacaaagaacaccgaacaagaaacgatgtagggacgatcatagttgtgattcggcaaaggatcactttggggcaattgcagctcgcccaggcgagctgaaacttagtgatgaagcagtgagctcgcccaggcgagctggaactcgcccagtagcatttcgcattggtctccaagtacacgaaatgaaagtggtcacatcaactgaccacgatcaagtatgcacctag

SEQ ID NO: 24051 - DNA, 842 bp, Glycine max
  Peptide Sequence Number=SeqID_140829
atgtggatagtggcagcaccagccatatttactaggttcaccacctttggcctcagtgttataagccaagcatttattggtcacattggttcaaaggaactcgctgcttatgctcttgtattcactgtcatcatacgctttgccaatggtattctgttaggaatgtcaagtgcgttgtcaacactttgcggacaagcatacggtgcaaaagaatatgacatgatgggagtgtatcttcaaagatcatcgatagttttattcttaactgcactctgccttcttccgttgttcatcttcacaagcccaattttgactctcttaggccaagatgagagcatagcacgagtggcaagaaacgtttctctttggtcaattccaatcttatttgcttatattgtgtcattcaactgtcagacattccttcaatctcaaagcaagaatgtcataattgcattcttggcaacattatcaataatcattcatgtgtccctctcttggctattcacaatacaattcaagtatgggattcctggtgcaatgatttcaacaattttggcatattggattcccaatgttggtcaactaatatttattacatgcggttggtgccctgaaacatggaaaggtttctcttctttagcattcaaagatctttggcctgttgtcaagctttccctttcagctggtgccatgttatgtcttgagctctggtacaacacaatattgattcttttgactggtaatatgaaaaacgctgaggttcaaattgatgctctatccatatgtattaacatcaatggatgggaaatgatgatagcatttggtttcatggctgcagcaag

SEQ ID NO: 24052 - DNA, 300 bp, Glycine max
  Peptide Sequence Number=SeqID_140830
atgaccaaacttggtctctgcttgtcatcgggcccgccgcctctggatgacaaaagggtgcggataaccgtaagaatgaccaaacttggtctctgcttgtcatcaggcccgccgcctctggatgacaaaagggtgcggataaccgtaagaatgaccaaacttggtctctgcttgtcatcgggcccgccgcctctggatgacaaaagggtgcggataaccgtaaggtatctccgcgtatcatgggtgcagaatgaccaaacttggtctctgcttgtcatcgggcccgccgcctctggatga

SEQ ID NO: 24053 - DNA, 282 bp, Glycine max
  Peptide Sequence Number=SeqID_140831
atgggggagctgcttcgagctcggaagaagatggatccgccactggagatggtggatcagctggcactagttcagcctatgcaggtgtgggctcaggaagagcagcctcgttgggtctcaattgctgaggtgcctgggctgctctgcataataataacatctccctggaataagctttgcagcatagcgactgcagtttgggagctctgggcatctggtcccgctgatgcagaaggaggagctggagtagatgatgaagggatttcatctactttggcctag

SEQ ID NO: 24054 - DNA, 138 bp, Glycine max
  Peptide Sequence Number=SeqID_140832
atggcaacagatcagaggcaccctgctggttatgctttcagtgtggaattccaaccacaatgtcgtaccggatgtcatgacatcacgcttcagaacatgcagattagatgcgtccgtatgaacagattaaacaagtaa

SEQ ID NO: 24055 - DNA, 324 bp, Glycine max
  Peptide Sequence Number=SeqID_140833
atgaatatcatgattgacgatgcttctaaccaaatgataagtgtctcagagcttatgttgcatcaaacaagggttcaatctattattgctcagttgtcattaatactctacctaccatatgcaaactatttggcagataggcatttagactctgccatagactggattcctggcttgaagaacatcactctaagggaccttgctggcatctatcgtaccacaaatccaaatgatatacttttggactttatggtagaacaaattaaagcaacttcaaaagcttcggctattattctgcccacatttgatgccttcgagcatgag

SEQ ID NO: 24056 - DNA, 276 bp, Glycine max
  Peptide Sequence Number=SeqID_140834
atgtgttttcgtgaagaaaattcaagccgaggtgctttcgtaacgctttcgagacatttccatgaacaaatccatgaagcttttccgccgttcttcatcgttcttcgtccgttattcgttcgttctccggtcttcaaccgtggaaggcaaaggagaagaggagaggggagacaccatccactagggaataagccatggaagaaggagcttcaccaccaaggatgtgccttggataagaagcttgaagaggatgctttaatggaggaaaagaaatag

SEQ ID NO: 24057 - DNA, 261 bp, Glycine max
  Peptide Sequence Number=SeqID_140835
atgttggaggaagtgctcactctattcatgcaagcttccatgtgtaccaacaaaaatatcgaaccttccatcaagaagttagaaatgcaagtggaacaattagccaataaattagaagcaaaatccaacaatgaagatttgcctttccttatggatgatgcacttgcgataacaatacctaaggaagagtattgtgcgggtcttgaggcgtgtaaaaatagccttcgtgatgcaatcctagcccccaagggtattggatag

SEQ ID NO: 24058 - DNA, 993 bp, Glycine max
  Peptide Sequence Number=SeqID_140836
atgggaacaaatcaaatcggaaaaagattctatcaagtaaagattaagagcctagatgtcatcagccttaaggagttgggacggttgatgggccccctccagatgcaagccttccgcaaggcgtatggaaagattttagatttgagcatagcggaggtattcacggaagccattgtatccctcacccaatactatgaccagccattgagatgcttgacgtttggggacttccaaatggtaccgactgttgaagaatttgaggagattctaggatgtcctcttgggggaaggagaccatatcttttcttcgggtttcttccctccttgagcaagattgtagttgtggtcaggggttcggcaagagagttggatcgtgtaaagcaaactcgaaacggcgtagtgggcctaccatggaagtacttggaaggcaaggcaagggatatggcgaatcaagaggagtgggtcccgtttgcgaacgtattagctttgctaatctttggggttgtcctctttccaaaggtggacggtttggtggacctagccacgattgatgctttccttgcatatcaccatagcaaagagagcccggtggtagctatcttggcggacttatttgatacatttgaccgaaggtgcgagaggagtagcgcacggatagtctgctgcttacccgctctttgtgtatggttggttttgcacctattccaacaagacataaggcacccatgtccgctccaaagtcatcgcttgtgtgtcaaaaagagaagactagattgggaccaatacttggctgggataggaggcagaacaatcaactggtttcgtcgatggaaggaaggaaaggagggagttctcttctcatgtggagactacccaaacattccgttgaaagggacgaggggttgtattaactacaatcccgcacttgctataagacagttagggtaccccatgagggaagcaccgatggaagagagtctctcgcctttcctt

SEQ ID NO: 24059 - DNA, 625 bp, Glycine max
  Peptide Sequence Number=SeqID_140837
atatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 24060 - DNA, 387 bp, Glycine max
  Peptide Sequence Number=SeqID_140838
atgcgggggtccggggaatttgtccccttcttagatacgacgtctaggggtagcaaaatgccccaacgcacgtttttaagaaggcgacacggaccctccgttgtggagtcgccaactgtcgcaacctacccttcggtgggagggcgacgcgtgactcgcgggatgcgtgttccacgaaaggaatacgcgcggagtcgccaccaacgtttatttgaggaaaacgtcggaaaaaccggaaaagacccgatctacgaactttttagtgaaaggttcgggagttgtatttacgcacggggaagggtgtttccctttgctcctacgtattcctcaatttgggatgagaaaatcagacctacgtggttctttcggaacaaagtgttttgttaa

SEQ ID NO: 24061 - DNA, 432 bp, Glycine max
  Peptide Sequence Number=SeqID_140839
atgatgcttactgtttgtaaaggacctacctcatttgaggatttaagaacagttgataatgttcagtatcctacatataaagaagcatgttttgctatgggatttttgcaagatgataaagaattcattgaggcaatcaaagaagcaaaggaccagggttcaacacattatataagaatgctatttgtgttgttacttttaactgcaacaatgagcaaacctgaacaagtttgggaccaaacttggcattggatggctgatgacattgtctataattataaaaaaatcatcaacaggttcagcttgatgatagaactcttcagaatccggtcttgcttgaaattgaagaactgctgcaagcaaatcaaagatcgcttagagactatccttcaatgccatatccagaggatgcaaattgtccatcctatctag

SEQ ID NO: 24062 - DNA, 510 bp, Glycine max
  Peptide Sequence Number=SeqID_140840
gcaatcacttcgccaggctcaagactcattgctggaggatcgcatgaacgacaatcaattcatggggctccgaataaaagtggagaatggagaattgcactaggcaatcacttcgcgttgctccagactcattggtggaggatgcatgaacgacaatcaattcatggggctccgaataaaagtggagaatggagaattgcactaggcaatcacttcgcgtggctccagactcgttggtggaggatgcatgaacgacaatcaattcatggggctccaaataaaagtggagaatggagaattgcactaggcaatcacttcgcgtggctcaagactcattggtggaggatgcacgaacgacaatcaattcatgggactccgaataaaagtggagaatggagaattgcactaggcaatcattcgcctggctccacactcattggtggaggatgcatgaacaataatcaattcatggggctccaaataaaagtggagaatggagaattgcactag

SEQ ID NO: 24063 - DNA, 657 bp, Glycine max
  Peptide Sequence Number=SeqID_140841
atgaaggtccttatttcgatcatttggctttttggcgatgtttttagaagcagtgggatagaacaggtcagggttaggaacagggtagtgccctattcctattcaagttccagtagtagggtagtgagttggtcctccggaagcagagaggccataaacatcgttggcaccaaagttagaattacgaccaacagccatcatggagtagaaatcggtgtggttgaaactggagccacgtggagtagggtttcgagaggactgaagagagtaaatctcagcattggtgagattggaagggtgatggttggtggaagaaaagccctgggaccttctagaaaagatgtcagatctggaagcattggattttctgacagtgacatggagcttgccatcctctttgatttgggcatcagtttccagagggtagtgtcgtccgtcaagagacatgacatcagagtcgacatggatggagacaatggtaccggtagcgtctgggaactgctcaaagatcaacaatctgacacctttgtactcgaacatgaagagcatcaaggtgtaccagatgatgcactggaggaccacaatttggaccatcagactccccgaaaaatgaaccagatgatgcactggggaagtaccaactacaaaaaccaatag

SEQ ID NO: 24064 - DNA, 1191 bp, Glycine max
  Peptide Sequence Number=SeqID_140842
atgtctcttaagacccttggtaagttcaaaagggatttgggtcttgacaaaaagaggagacttattgccgtgttgaagaaattcccagcagtgtttcagattatggaagaaggggttttctccctgaaattcaaaatgacccctgaagccgaaaggctctattttgaggaaacgagggttaggaatgagatggaagagttggtggttgtgaagcttaggaagttgttgatgatgtcactagaaaaacggattttgttggagaaaattgcacatctcaagacagatttaggtctcccgcaagagtttcgtgacaccgtttgtcataggtatcctcagtacttcaaagtggttgcaactcagcgtggtcctgctttggagttgactcattgggaccctgagcttgcggtttcagcggctgagctagcagcggaggagaaccgcattagggaaatggaggagcagaatttgatcatagacaggcctcccaagttcaatagggtgaagcttcccaagggtcttaatctttccaagggtgagatgaggaagattatgcaattcagagacttgccttatttttcgccttactcggatttctcagggctgaggccggggtcacgggagaaggagaagcatgcttgcggagttgttcacgagattttgagtctcacgcttgagaagcgaacactggttgatcactttacgcattttcgagaggagttcagattctctcagcagctgagggggatgctgataaggcatcctgatatgttttatgtctctcttaaaggagatagggattctgtgtttctgagagaaggttatcgggattctcagttggtggagaaggatcgattgttgcttataaaggaaaagcttcgcaccctggttaatgttccacggtttcccaagggacctgcacgcaggatagttgaagatagcatgagagaaagcgatggcagagaagatgaaagtggccaagaggaagaagaatggtcagaagatgttgataatttattgagtgatgatgactggagtgatgaagatgatgatgatttgccgccagattttgatgaggatggtgaactattggaaattggacaaggaaagactattaaacaagactcaagacagaatgatgaaatggtccttcttcctgtatttgcagatggtcgtcctagagaacaatggtga

SEQ ID NO: 24065 - DNA, 426 bp, Glycine max
  Peptide Sequence Number=SeqID_140843
ctgcgaaaccacgacctccggtcaccacgcaccacttatcttccgccgctgccatactcaaaactcaaacacacaccacgctctcacctgattcgattcgaagaatcgcagattcacactaaggatgtagatctcgccgcaaacacgcgaccaacggcggagcgacgcggcggtggagtgacggaggagcgaagagaagcgaagagagaaaatggacaattgggagaagaggatagtgtttctgagctgaaaacgaaagggaattatctttgcaactcgacagagttgaagctggtggtttcgagaactggtgcagttaactgtgtagatgcagactctatttcggaccttgatctgctaatgaatttgtgtgatgagttgcaggaaggagacagtttggttcgatgtcttagtgtgatgttttaa

SEQ ID NO: 24066 - DNA, 876 bp, Glycine max
  Peptide Sequence Number=SeqID_140844
atgccaggatccatcatggtttcagtactggaattcatcgatcttccattatcttcatcaacatccataagggcttccttggggaaaatagagtaccaagtgaatgacaagggaaacttatccttccccttaactagcctccgtgatgatttgatcttcaaaattcaggatgctgaggggaatgaaatatcacgtacaggtgttcaaataaagttgatattggagaaaggtgttttggaagacaactttccccttgggggtggccatctgcgtttgaagttgcaattcatccttagcgatgaagagcgcgacagaattcgttcattgagacaatctgcattaaagaaaaaacatgagcttcttagtagcggtagaagagctgaagaaagtgatagtagaaccatgattggcgatgctgcattacccttccgcagaaatgatgaggtctcagaatcaccaaagaaacaacctcaacaagaagcccaattgcaagatcctgctggttctggcgatggcaaagaatctgatactagaaataacatttcagatcaatatagggagtcctcatccacaatacctgtgtcacaagcagttactctcactcgatcaccacagaagggtaaggagcctttctatcagtcaccaaatctcaatcgatcgtcatctgagaaacatcctcagagggatattggttcagaagaaattgcaattttgtttggctcagaaaaaaaggaagccctgacaagtaatctgatacaacctaatctagagcaaggtggtatacagtattctgagaagaggacctcactggggagaattcccagtaatgtgaagaaaatgataagtgcctttgaaggtggattggctcaggtatag

SEQ ID NO: 24067 - DNA, 948 bp, Glycine max
  Peptide Sequence Number=SeqID_140845
atgataccaacttatcgttactcagtgtcttcacctatgcctatagatcttaatgaagatcacacccaccacctcttcagtacaaatcatcaagcctcttgttcatcttcttcgctatcttattctattctcttcaacccggatcaagatcagggaggatcttgtagcgactggaaatccaagcatttgcaaagtgatgaagaggcccagaagattgttccttctagtggattatccgaaaaggatgaaaacaaaagtgatctcaagctgagggtttggaagaaagaagataagtgtgaaaattttcaaggtgaagataattcaaccaagtggatgcctttaaagatgagaatgatgcggaggctgatggtgtcagatcaaacgggttctgatgatacagaaggcatgatctctaactctcagaagatcaagtatgaagagaaaaactcaccactgtcccctctaggaactgatgatagtaactacaattcttcttcaaaccacagcaatatcactgttagggtttgttctgattgccacaccactaagacccctctctggagaagtggaccaaaaggtccaaagtcactttgcaatgcttgtggaattcgacaaaggaaggtacgacgtgccattgccgccgctgcaacgtcaaacggaacaaatccggtggaggctgagaaatctcaagtgaagaagggaaacacgttgcatagcaaagggatgaagtccaaaactgagggtgcacaacagatgaaaaagaatcgtaaactcggagccaggtatagaaagaggtttggtgcttttgaggatttgacagtgagattgagtaagaacttcgctctccagcaagttttccctcaggatgagaaggaggctgcaatcttgctcatggctttatcttatggccttcttcatggctttcccacggatcgttatatcacttag

SEQ ID NO: 24068 - DNA, 1425 bp, Glycine max
  Peptide Sequence Number=SeqID_140846
atgagcatagtgaatctctcccacaattctctttctggacaaattccagagctgaaaaaatgcaggaaacttgtttcattgtctttagctgataacagtctaataggagaaataccatcttcccttgctgagctacctgtgcttacttaccttgatctttcagataacaatctcactggttcaatcccacaagggcttcaaaacttgaagcttgctcttttcaatgtgtccttcaatcagctatcaggtaaggtaccatactccttgatttctggtctccctgcctcatttttggaaggaaaccctgatctttgtggccctggattgcctaactcttgctctgatgacatgccaaaacaccacattggtagcacaacaaccttagcttgtgccctcatctctttagcctttgttgctggaactgccattgttgttggtggctttattttgtataggagatcttgcaagggtgatcgagttggcgtttggcgctcggtgttcttctatcctctcaggattactgagcatgatctgcttatggggatgaatgagaagagctcaaggggaaatggtggggcttttggtaaagtttatgttgtgaatttgcctagtggtgaactagtagctgtgaagaagttggttaattttggaaaccagtcctcaaaaagtttgaaggctgaggtcaagactttggcaaaaattaggcacaagaatgttgttaaaattctggggttctgccactctgatgagtcagtatttctcatttatgagtacttgcatggagggagcttaggggatttgatttctcgtccgaattttcagttgcagtggggacttcgattgagaattgccattggagttgctcaaggactggcttatcttcacaaggattatgtccctcacttgcttcacagaaatgtcaagtcaagtaacattttgttggaggcaaactttgagccaaaactcacagatttcgctcttgatcgagtagtgggagaagctgcatttcaatcagttttgaactctgaagcagcatcttcatgttacattgcaccagaaaatggttacagtaagaaagcaactgaacaattggacatctacagctttggtgtggtattgctagagctagtgagtggcaggaaagcagagcaaacagagtctagtgactcacttgacattgtgaagtgggttagaaggaaagtgaatatcactaatggggtgcaacaagttcttgaccctaaaatctcacacacttgtcaccaagaaatgattggagccttagacattgcgcttcgttgcacttctgtggtgcctgagaaaaggccatccatggtagaagttgtaagaggccttctgtccttggagtcaagaacttgcattgcaaatttgcatgaaccatatgaggaaccctccattccagtctga

SEQ ID NO: 24069 - DNA, 372 bp, Glycine max
  Peptide Sequence Number=SeqID_140847
atggcagaattagacataacatcccagggatcaggcggtggtagagtgacattattattatgcctcgaagatgaggccggaatcacctcctctaatttcttcactgatattggtgagggaaaagatgataaaaaggggcactcttgtttggttggagtagggaaggtgttgttaaagctaagcaatatggaagtgtccgaaggagaattattattggaatcaggatctctttttggccatactttctccattggtggccatctacttttggagttttcgacacctcctcccattcttgcgtatttcttcttctacaaggaaatccagattaaaactaacgcgatcttaattatcaaacactactacccttag

SEQ ID NO: 24070 - DNA, 1149 bp, Glycine max
  Peptide Sequence Number=SeqID_140848
atggaagaaaatgaatggcagatggtgcaaacgaaaggaaaccaatttgtggtgaacgaccaacctttctatgttaatggattcaacacatactggttgatggtatttgctgcggatgagtccacaagagggaaggtcactgaggtgttcaaacatgcatcctctgtggtttatgatgaagacgtattcaaggccttggactttgtggtaagtgaagcaaggaaatacaaaatcaggctcatattatcactggttaacaactgggaggcttatggtggcaaaccacagtatgtgaagtggggcaatgcagctggccttaacttgacctctgatgatgacttcttttcacatccaactctcagaagctactacaaggctcatacggtgctcaatagagttaatacattcacaaatatcacttacaaggaagatccaacaatttttgcttgggaactgatgaatgagcctcgatgcacctcagactcctcaggtgatgtgttacaggattggataaaagaaatggcattctatgtgaagagcattgatccaaaacacctagtggagattggactagaaggattttatggcccctcaacacctcagaaatatcagttcaacccaaattcatatgctcatgaggttggaactgattttatcaggaaccaccaggttctaggtgttgacttcgcttctgttcacatatatccagactcttggatttcacaatcagttgcagattcccatctcccattcataaagacttggatggaagcccacatagaggatgctgaaaagtatcttggaatgcccgttgtttttgctgagtttggtgtatctgcaaaagctcctggctacaattcaacatatagagacaaccttataaacactgtgtacaagaccatcctgaactctacaaagaaaggaggtagtggggctggaagccttgtgtggcagctctttcctgacggaacggattacatggatgatggctatgcaattgttctctcaaagtcaccttccacgtcaagcattatatcccttcaatccacaaggctagccctcttcaattccctgtgttctaagaaatgccgttggggttgtaagaaaagaaatgtgttggaaaaagtactctatcatgacgaactgtaa

SEQ ID NO: 24071 - DNA, 702 bp, Glycine max
  Peptide Sequence Number=SeqID_140849
atggtgagagtgagagccaacacagtctcgttgccaatggccttggtgccactcctccaatgggctgttgcagattatgttcatgggaagggtcttaagcttggcatttattcagctgcagggtattttacttgtgcaaatgtgatgcctggttcacttggttatggagagcaagatgccaagactttcgcatcatggggtgttgattatcttaagtatgacatttgtaacaatggtggaacaaagcctattgataggggagacatgcatcctgcattatggggttatcaagtgggaaatagctggataattactgatgacattagggataactgggatagtatgctttcaaaagcagatatgaatgaagtttatgctgattatgcaagacctggtggttggaatgagttaccgcaggcccctcttattatcgggtgtgatgttagaaatatgactgaagacactaaagagatactatcaaatacggaggttattgcagttaaccaagatccacttggtaaacaaggtaaaaaggttaggatggaaagcactctcgaggtttgggcaggtcctctttcagaatatagggtggatgttgttttactcaataaatactctgatcttcgtgcgtccattactgctctatgggaagatattggccttcatccttcaactgttgttgaatcaagagatctttgggag

SEQ ID NO: 24072 - DNA, 1494 bp, Glycine max
  Peptide Sequence Number=SeqID_140850
atggcttctctgctcctccctccaactgctacttcttccacacttaaacacaacaaccaaatcctgaaactgaaaccaaacaataatgctcatgctacatgtaacgtcttcttatcaaactcaaaccactaccgtttcaactctgcaaagtgccatgcattgttcgatgacgtggccaaagggttgttggagagcagcagtgtcggggtggaccagttccagagagtgacagaaggcttatccgacatgcagaggtgggtgttccttgtctttggtgggttgacgtggatttacctgactgcaagaccaggtgttcttgtcggtgccattgatgcgtaccttttggcacctcttcaactgggtttggacaacttgtctggaaggaggaacttgaagaggagtgactttgtggttggagacaagctcggtgaagggtcctttggtgttgtctattcgggtgttttgcttccaaagaatgtggatgtggatgtgctgcagaagagggggagagccaagacaactcagcttgatgccaagtctaaggataaagtcattcttaaaaaggttaaggttggaatccaaggggctgaggagtttggtgattatgaggagtggttcaattacaggctatctagggcagcacccgaaacatgtgctgacttccttggaacttttgtagctgatcaaactaattcacagtttacaaaaggtggaaaatggcttgtttggaagtttgagggagatcgtactcttgctgattacatgaaagatcgcaactttccttcaaacttggaatcagtgatgtttggacgtgtcttgcaaggtgtggactcttcgaaacgaaatgcattgatcatcaaacaaataatgcgccagatcattacgtctcttaggaaaattcacgatacaggcattgttcacagggatgtaaagccagccaacttagtggttactaaacgagggcagattaaactcattgattttggtgcagcaacagacctgaggattggaaagaattatgttccaaatcgtacccttttggatcctgactactgtcccccagaattatatgtacttccagaagaaacaccaagtccaccaccagaaccaattgctgctttcctttcaccagttctgtggcagttaaacagccctgatttgtttgatatgtattcagctgggattgtactactgcaaatggcaataccaagcttaaggtctcctgctgctttgaagaatttcaacttggaactaaaaacatgtggatatgatatgaaaaaatggagggactacactcgcctccggcctgacttgcaaattctagatagtgaatccagtagagggtgggatttagcaacaaagcttgtatctgaaagaggttccctaagaagaggacgcttatctgctgctgctgctctgcgacatccttattttcttctgggtggtgatcaagcagctgcagtcctttcaaaattaaacttgaacagaaagtga

SEQ ID NO: 24073 - DNA, 420 bp, Glycine max
  Peptide Sequence Number=SeqID_140851
atgcaggttgaccctgatgaagtgaatgctctagctcagctaatgacatggaagacagtcgtagcagacattccttatggaggagcaaagggtgacattagttgcaacccaagggagctcaacgttagtgagttaggaagtctcactagtgttttcttccaaaagattgatgatctcatttgcattcagagagatgtttttgcccctgacatgagaactaatgcacaggatcttggaggttcattgggaagaaaggttgccacaagattgagagtgatttttgcaacaaaggctttatttgttgaatacgagaagtcaatttcagatatgacattgtcatctaggtatttctttacttactatgatcatcatggctccagacatagatattcatacttgatcccattttcatgcatatga

SEQ ID NO: 24074 - DNA, 714 bp, Glycine max
  Peptide Sequence Number=SeqID_140852
atgtccaaacaattcagcttctgccaggctttccgtgagggcgccgcagttgacggcgagaaacggggcatgccggcgtggactgtggtgatgcagataccgcgcgaccacctctttgccggtgccggtttcgcccacaatcagtaccgtggcgtcggtgggtgcgaatttatccagcagcgactggaaagccagcgatgccgggtcgaccaggcgaggataagcataatggccgattctgcgcacgagagcataaatgtcttctggttcctgccgacgcacggcgatggccgttacctgggtaccacagaaggcggacgcccggttgatttagcctatttacagcaggtcgcgctggccgccgacaatctgggcttctacggcgtcctcattccgacaggcaaaagctgtgaggattcctggctggtggctgccgcgctggcacccatgacgcggcggctgcgctatctggtcgccgtccgtccgggattgcagccacccacactggcagcgcgcatggcccccacgctggatcgtctgtcggaaggccgtctgctgattaacgtggtcaccggcggcgatccggtggagaacaaaggcgacggcatcttcctcaaccacagtgaacgttatgaagtgactcgcgagtttctggatgtgtatagccagctgatgagtggggaaaaagtggattatcagggcgagcatattcag

SEQ ID NO: 24075 - DNA, 138 bp, Glycine max
  Peptide Sequence Number=SeqID_140853
atggcttcaaagagaatcttgaaagtgctcaaggacttgcagaaagatccacccacttcttgcagcgcagatttagaggtggttcttttcattgacgatggaaaaggaaatgatgctattttaactgttaaaatgtga

SEQ ID NO: 24076 - DNA, 879 bp, Glycine max
  Peptide Sequence Number=SeqID_140854
atgctgctgccatctggactgatcttcgcgaaaggttctctcaaggcgatttgttgcgtgctgctgagttacaataagagatttactctctcaagcaaggaattagacaatttccgtcctttgactccttgcacttgctcagccaaagattttcatcatcaggatttcattatctggtttctcaaaggactcgatgagcgctttgccatggtccgatcacagattctgcttcttgatcccctaccttctgccaacaaggttttctccatgattattcagcatgaacgacaacatttcaccaatatctcaccgtcgctcgatgttaacccgtttgccaacgtcgtctctagtagaagccgtgacattccacagtcagggggaggcaaatcgaactcttccaaccacaaatgtgatcattgtggtcgccttggccacaccagcgatgtctgctatcagaaacaaggaaacaccattcctaaatgccaacattgtacgcgatacggtcacaccatggatatatgttacgccagatttggatatccacctggccacccaaaatactcgggccaacctcaccttcccaacaagactggaactttcggaggtggcgccgctggtggtgccgctgtcaacaacactacaagaaaaggaaatcgaaccctacatggagaagaacataaggatgggtcagctacaatacccggtcccaacatcacacaggcccaattccaacaactgatggctctactccaaaagactcaagttggtggtgcgaatacaaatgacatacccattagagcaaaccttagtcactccagcccaaaatctgtttctgatctgtgtggaaatgaacacgttgaagatgattggttcggctaa

SEQ ID NO: 24077 - DNA, 1401 bp, Glycine max
  Peptide Sequence Number=SeqID_140855
atgaacagcaggaatgtgaatgtgaatcagcatcatcaccgcagagctagatatgctcatcatcactactgttatttctggatagggaaactctcgtttgaatcagcaaaactggccacaagtgggattgatgatctattgtcatccacggaaggaggaaagcatgactatgattggctccttactcctccggggacccctcatttgccatcatctgaaggtgaatcccaaccaactttggtgcctccaagaagcaatctgggtagattaatgtcaaacactaatgtctcaaggctttcagtctcacaatccgagaacaacaatcactctagaccatcaagaagtggttcagtgactcgcagtccaaacagatcctcctccatccttaacacaaggccatcctcccccataactcgctctccgtctgcagcaaggccttccactccaacctctcgcacgacatcaacatcaacatcaacaccaacaccccccagagtactactaccacgctcaattccaagtccaaccaactcatcatcaattgacatcaacaaaactagaacatcacaaggctcaaggccatcccagtctgccacttctcggtcaccttcgcggccctctacccccactcgtcgccattcgctgcgtcccctgccagttgtcccacctgatttcccccttgaaacaccaccaaacctcagaacaacattgcctgctgatagacctgtctccgcaggcaggtctcgtcccggtgctgttgttactcttccttcgaagccaaactcagaaatgcaagccccagttagcatgtcaaggagacagccatctcctattgccaatagggggagactgtcagagtacacaggaaaaggccgcggccataccaatgctgctgatgcctctgaggtagttgctaggagatctgttaagtgttcaactactgcctcagaaaacagtggactgggaaggaccatctcaaagaaatcattggatatggctattagacacatggatgtgaggaacagctcaggaactcttcgttcagttccaaacgccaaactctatcctcagagcattcgaacttcaactcccaagacacaccacagtcgaggtttgagtgttccagtgtcaatgaacaatattagcggaagcctccaaagaagaaataataataataataatatgaaaaatggaagagagatagatgaaaggcaaaagcaatacttgggaaaattgagtgaagtattggatgtgtacgagagttatcgttatgattcactgttgcttaaagaagacttaaacaacacaaactggctgcgtagtgttgatgataaatgtgatcaaggacccatctttgacaatggatttgagtccctgcctgaaccttttggactcttttag

SEQ ID NO: 24078 - DNA, 1398 bp, Glycine max
  Peptide Sequence Number=SeqID_140856
atgcctctccgagtactccaagcagaggctacttcaccctctaatgagtcacatgcaccacagcataaatccggatcatcattgttttacatcctcggaggactagttgtgctcgccatagtgttgatttttttgtatgtagtttggaagcgaattaaacggccagcacagacgatgacagttgcaagtaaagagcatcaagagtttgggaaacataatgaatcggcagaggtgatgaagatgatattttcatctaatcaacagtcagggtccaaggagttctttagtgggaaccttcggactattagctgctttgactaccagacattgaagaaagcaaccgagaatttccatcctgataatcttcttggaagtggtggatttggacctgtttaccagagttttagatgccagcaaaaatggccaacctgtagttttacagctactttgttaatatacataatcagcaaattaactaaggaaacaggtacgggaaagttggtagatggaaggctagttgctgtcaaaaaattggctctcaacaaatcccaacagggagaaaaagaatttctggtagaggtgagaacaatcactagtatccaacacaaaaatctggttcgccttctcggatgctgcgtagatgggcctcaaaggttacttgtctatgaatacatgaagaacagaagtttggacctcttcatacatggaaacagtgatcaatttctgaattggagcactaggttccaaattattctgggagtagcgcgaggactacaataccttcatgaggattcacaccaaagaattgttcatcgagacatcaaagccagcaacattcttcttgatgataagtttcacccaaggattggagactttgggctagcaagatttttccctgaagaccaagcttatcttagcacgcagttcgctggaactttaggttatacagctcctgaatatgctattagaggagaattgtcagaaaaggcagatatctatagttttggagttcttgtgcttgaaataatttgttgcaggaaaaacacagagcatactttgccatcagaaatgcagtacctcccagaatatgcatggaaactgtacgagaatgcaaggatattggacattgtagatccaaagctgcgagaacatggattcgtagaaaaggatgttatgcaagcaaaccatgttgctttcttatgtcttcagcctcatgcacatttgagacctcccatgtcagagatcgtggcattgttgacattcaaaattgaaatggttacaacaccaatgaggccagccttcctcgatcgaaggccgagaaagggtgatgaaaaccaccctttggaggcattatcccagggtttcacatctcccatatatctaaaagcatctgattga

SEQ ID NO: 24079 - DNA, 321 bp, Glycine max
  Peptide Sequence Number=SeqID_140857
atggacatgaagaaggtcacttgcgctcttctcatcgccgccgcctccatgagtgctgcagtggctgccgccgaggctcctgccccatcccccggccctggcccaagcagcggagcctcagctccccttgttggctccttgattggtgcctctgtattgtctttctttgccttgttccatttattggtagaatttctcctaaattttttatgtggtcgtgagaatttcactgtccaaatgattgaaggaatagggaatgattgctgcatgatacagataactgaaagtgttaaccagaaattgacgttaatatggtcatga

SEQ ID NO: 24080 - DNA, 1947 bp, Glycine max
  Peptide Sequence Number=SeqID_140858
atggagatagagaacggtgacaccaggtccaaaaagatggaagagtatcaagtcatagagcaaattggaagaggagcttttggctctgccttcctcgttcttcacaagtccgagaaaaagaggtatgtgctgaaaaaaattcggttggccaagcagacagagaagttcaaacgtacagcattccaagagatggacctgattgccaaactgaataacccatatattgtggagtacaaagatgcttgggtggagaaggaggaccacatatgcattataactggctattgtgaaggaggtgacatggcagagaacataaagaaagctcgaggttcattttttcctgaagagaaagtctgcaaatggctgactcagttgttgatagctgtagactacttgcactctaatcgtgtaatccacagagatcttaagtgttccaacatattcctcaccaaagacaacaacattcggcttggtgactttggtcttgctaagcgacttaatgcagaagatcttgcttcctcggttgttggaactccaaattacatgtgtcctgagctccttgcagatataccttatgggtataaatctgatatgtggtctcttggttgctgcatgtttgagattgctgcacatcaaccagcatttcgcgctccagacatggctggacttatcaataaaataaacagatcctccatttctccactgccaattgtttattcttccacactgaaacaacttatcaaaagcatgcttaggaaaaacccagaacataggccaactgcagctgaattgttaaggcatccgcttttacagccttatgttcttcgctgtcataatgcatcatctaatgttcttccagtatatcccttagttaatccaaaggataaaacaagaagatctaataaatctagtggtggcaaggaccataaggacaaagaagctagtttggtaaatcgtttggagcggattcatccaattgagggaaatggagatatacagataagcaatcttcctaatgatgcggtaacaatctcaaccagtgcagaagacaatctagagaccaggatggctgatcttaccagctacatagtggaatcttgtactagtattagtggctcaaaagatgggtcaacaacatctgaatcaactatttgcagtgtgtgcaaggaggactttaaaagtagacctgcaagggaaacggctaacaatgagatctcttctaagagtacacaaaattctatgcatgaaaaacaaagatttgctgctaaacattttcataaattagaagaagacaacataaatgtggcgaccacagaagttgaagatgcttcttgcaatgaaggtttggatagtgctgaagcacagagggaagattcgaactttgaggactcaggtaaatccacaatgtccagtgcaggcagtagcactgataaagataagtccatcaatgaggaaagttcatcactgattatgcatcctattagggttgaacatgacactgaatctggaaaccactcgaagaaaagcaaaacccctgatgtatttacagaagtctctcatatgaactgcttgacatcttttagtaatgatgcacttccagttaaggatgatgacatggcaaacgtacacattctttgctccacgcataaagaagatgataatgcggtggaggttgatcaggcaccaagaggtgtttcattgagtgtaataactgaagtagatggtgatgaaacaatcaagactccggtggatagtccctgccagcaaagagcggatgctctggaatctctgctcgaattatgtgctcagctactcaagcaagataaactcgatgagcttgctggggtgctaagaccatttgggaaagaagctgtctcatcaagagaaacagcaatatggctggcaaaaagcctcatgtctgcccaaaagtttaatgctgaagcctaa

SEQ ID NO: 24081 - DNA, 687 bp, Glycine max
  Peptide Sequence Number=SeqID_140859
atgagtacgacctatcacccacagagtgatggccagatagaggtcttaaatagaatactggaacaatacttgagagcttttatgcacaatcaaccctctcaatggggaaagttcctcagtcttgtcgaatggtgttataataccaccacccattcctcaactaagctgacaccttacaaggtcacttatggtaaacccccaccaagtgttcctgattacatgcctgggtcctcccttgtggatgctatcgattttatgcagaaattagaacaagctcaggctagtatgaagaaaactgttgatgctcaccgtaaggatgtcacattcaccatgggcaattgggtctatgtgaaattaagaccttatcgacaatcatctgtttcaggccacaagtatcataaactgggcaaaagatattttgggccctacaaaattgttgagagagtgggatcagtagcttacaaactggcactgtccgaatcctccaaaatacaccattggcttgggttgcaaccagaggactctacttgggaagactggattgagctgcaagatacttatcaccttgaggacatggtgtttctccaagggccaagggatgatagcaatctgcaccagagtgattgtggccacaggcccaagtgtatgggtaagaagcctcaaggaagggaggactatgtctattag

SEQ ID NO: 24082 - DNA, 1269 bp, Glycine max
  Peptide Sequence Number=SeqID_140860
atgggaagtttcctttttttttttctaagcaccctatcaacttgggtgctttcattgcctctatccattgccaataatacacgctttcagtccctggcacacttagaagaagccatcgccattttaactcaaacttggagctcactccattccaaattagatgatgttatctctcgcctcaccatccttgaatctcgttcccctaacagaccacttccgtttcccccactgagaatgaaactcgatgttccttgttttgatggcgctaacgcgatgtcttggatcttcaagatttcacaatttttcaactatcaaggcacccccaacaatgaccgcctccaggttgcttccttctacctcgacggccctgccttgagctggtttcaatggatgcacagtaacaaccaaatgtcctcatggtctgacttccttcaagccctggaaatgcccttcaccctttcattttacgaggatcctcgcagagcccttttcaaattgactcagcaaggtactgtcaattcttacttgtcggaattcgagagtttggctaatcgaatcgtcggccttcccccgccattcttgctcagttgttttgtctccagtcttagccttgacattcgccgtgaagaggacaagctcaatgatgctcgtcgtccttcgcaatttcgccctctggccacctcgttagcaataagccctatcgcttcagctttgccgacgccgcctcccctactcccggctcttccccagaccattttcaagaagctcactgcggtagaaatggcagctcgccgtgaaaaaggcttgtgctataattgtgacgcgcactacagccccaaccacaaatgtcagactaagttcttcctcttgattgcttctgacgatgtttccccagatgaccccattccgccagacttagtccccatactttccgaggactacaccgccacgccgtcggacgatcactttctggctcagcttagccttcatgccatggccgatcatttagcttctaccatgtttcgtgtcaacggctgcattaatggcacagaggtcatcattttggttgatgggggtagtacccacaacttcatccatgaccgcctggctcgcagtctccacctaaaggcccagcccgttaagcgtctttgtgttatggtgggcaacggtggtgaactctgttgtgatagggtgtgcaaagcaattctcgtcaatatccaaggctatacttttatggtggacctttttgttatggccttggaggtgtag

SEQ ID NO: 24083 - DNA, 615 bp, Glycine max
  Peptide Sequence Number=SeqID_140861
atgggctccttgcctaaccttcgatttttgtatctggaaagcaataagttcgggggagaggtaccttcttcacttaaaaactgcaagaatcttaccatacttggtcttggtcacaataatctttctggagttataccaagctggttgggacaaaatgttaaaggtcttaaattgagattcaatcaattcagcggcaatgttcccacgcagctatgccaacttcattcagtaatggtgatggattttgcaagtaatagattatcaggaccaataccgaattgcttgcataacatcacagccatgctttctagtaatgcttcaactcgtgaagtcggctatactactcactttgcaggttctacggaccttagttatatcggcaatcttgacctctgtggacctccacttacaaagatatacccaaaagatgaaaaatccgacaatacaaaatcaatggtagaagaagatgatgatgataaatatgaagtatactcctggttctacatgggcctgggaattgggtttgctgttggatttttaggagttttgggcatcattttcttcaacagcagatgcaggcatgcttatttctgcaccgaatgcatcactttgtga

SEQ ID NO: 24084 - DNA, 402 bp, Glycine max
  Peptide Sequence Number=SeqID_140862
atggtgggaattgggaatctatctttaatagtgatggtgttgagtgcacgatacatccttcttcttgaccaggagcacaaaggaagaatacgggctgtgactcgaccttatatggttacgaaggagcatctcttcaacttgggtttcaatttcgtgcttctgaaaataaggatacctatagggtttaacgtgaactggtcaagaattgggctgaataggactaaaggaggatctggagggcttgcgtcgaaggaggaacgtgaagttgaaggtggaagaatgctacgacccggtccgtttggatcaggcgacgaacctgacccggagtggcttccactggatgcggcccagttcgaccctggagagtcacaggcccatcgcgccccgaaaatgacatcctaa

SEQ ID NO: 24085 - DNA, 288 bp, Glycine max
  Peptide Sequence Number=SeqID_140863
atgaccaaaggtgcagataaccatacggtacccccacgtgctactgaactctcaggtcgatggatagcaaagggtgtgtgcaggttaccgtcgagtgtctccacatgccaccggactctcgggtcgctagatagcaaagggtgtttgcgggttaccgttgggtgtctccgcattccaccagactcttgggtcacggtaacaaaagttggggtggtcaacaaaagcagggcttttgctcctacatatcctcaatttgtgaagaggaactcagacctacgtagttcttga

SEQ ID NO: 24086 - DNA, 147 bp, Glycine max
  Peptide Sequence Number=SeqID_140864
atggaagataccagcaggaaatataaggctttgggaccgaccatattgattcgctctccgggatactacttgttcgtgtggatgcgaaatctaccggcaagtgcaccgggtcgtcaagctcaagtactaaacaccgatgtctcgtga

SEQ ID NO: 24087 - DNA, 174 bp, Glycine max
  Peptide Sequence Number=SeqID_140865
atggctggtttggtgaatgttatgtccttccagcaattgcagcgtcacattatttgcaacaggagggagctacttcgggcaagcaagccaccacgtggtgaaggaattgtgaatgtcacttacgcatatcctgtgcgtaaaatcatgtgggcatccagagaacaacttccatag

SEQ ID NO: 24088 - DNA, 144 bp, Glycine max
  Peptide Sequence Number=SeqID_140866
atggtggctgatgttcaccgcacattgctttatggaggtatttttctgtacccagctgataaaaagagtccaaatggaaaacttcgtatgttgtcacaccaattcaatcttatggaaatggtgattctaggaaaagagctatga

SEQ ID NO: 24089 - DNA, 210 bp, Glycine max
  Peptide Sequence Number=SeqID_140867
atggttaagactgctaatcatcatgctttcaaatcagagaagaaacatatctctaatgatagcaagaatttgtcttttaatggggtatcaaagctggttaataatgatcctaagaagaaaaatgactcacgggatttagagaaaaagaaatgcctccagaaagctaatcaccatgtcttcaaaatgaagaaagatcatacatttgattaa

SEQ ID NO: 24090 - DNA, 447 bp, Glycine max
  Peptide Sequence Number=SeqID_140868
atggcacacgatttggagctgatagcgcaacacaaagcttcgtcactgaagctcgaatcgaacaagatccaaaacttgggaaagtttccatcttttcttttcccaatcgaaattaagaatatacaactcggcaaacatggcagtgacactggagtctatgatactgaaggaaggtttgttccttcaaaatttgaagaaattttcacaaaacatgcacatactcatccaaatgctttaacatatgatgagctgaaggagatgttaaaggcaaacagagagacaaaagatttgaaaggaaggattggtggtgaggttgaatggaaattcctttacaaacttgccaaagataagaatggcttactacagaaggaaacaatccgtggtgtttatgatggaagcgtgtttgaactgttgaaaaaggaacattcttcaagcaaaaagaagtaa

SEQ ID NO: 24091 - DNA, 462 bp, Glycine max
  Peptide Sequence Number=SeqID_140869
atgacgaaggaagcgatccacggtcataactttacagcgcctcggctctgcttttcctctactccttgttcttccatgggaaactcacccaggcgagtggcttgcttagggctgaagttttctcttagcccaggcgaggtagatgctagcctggacaaatttaggactcgcgagttagtcaatgcaactaaccatgaatggatgaacaatttatttggtgtcgatttggatacaccaaattttgcagcatcatatttagcttctttacaacagtttgatgcactatattcgtttggagagcaaggaaaaagttcttcagatgttgcaacccatagtgaaaaccctaagaccgaacaacaacatcgtcatcatgagggagaaccaatgatacatgagagaagaaattcgcgacgtaatcgacgtccaccaccttatgggattggtcatcgtcttggtcgttaa

SEQ ID NO: 24092 - DNA, 450 bp, Glycine max
  Peptide Sequence Number=SeqID_140870
atggatgagatcatcgtaggagaaatgtgggccggtggcggcattgatgaagatggttactacgaaggctacaaaatctcacactacaagggaatcccgcgagggtggtgtggtgggccggtggcggcattgatgaagatggttactagtttgggcaagttacgacggaggcaggaggaggagtggcttgaggctacaaaatctcacactacaagggaatcccgcgagggtggtgtggtgagggttagggcaaggctttggggtttgcgaaggggcatcgaaccccacgagggacggtggctccggggagtggatgtaggagaggtagatgctgacgaggagggggatgaaggagaggactaccaggtggatgtgggggtcagaggagaggaaggtgtcatagagccattggctgagatggtacatagccgtaatcgaatgggagtgtga

SEQ ID NO: 24093 - DNA, 271 bp, Glycine max
  Peptide Sequence Number=SeqID_140871
atggcgatttggttggtagagatgggtggccccagcttgcccaggccagcatttggctcgtctgggccaccaaataacttcaacgctaagggactagctcacctgggcaagctgcaactgcctcaagggttccaaggtttagtacttgagggaattgagagaattgagaaagaagaagaagaaagaagaggaaacaaagccgaggagctaccgaatcatgactgtgatcgtccctacgtcatttcttgttcggtgttcttcgcaccagtcg

SEQ ID NO: 24094 - DNA, 489 bp, Glycine max
  Peptide Sequence Number=SeqID_140872
atgcttcttgacccagctaggaacttgaggaatcacttaggagttggtggactgattgcagaagatagaatgttggcttacctcattacctacattctcactctgagattcattgactacttcactattgatgtctctaataagattgtggactttaccaaagcatctagtgagattatcgaaagacatctcaagaagcttggaataaggtttattgattatgaatggataatggttggagagctggcagttagaaactttgaccaaatggaagaaaatgctaaagctaaagctccacaagaacctggacatcaatggagtccttttgagtcaattatgattcagaacagggacactatgcttcacctccatcaagagcacttagctgaagttcatagttcattagagaatacaactacccggctggaaaacattgagactaggctgacccttagcaacctccttaaccttgatgaggatgaagcttag

SEQ ID NO: 24095 - DNA, 249 bp, Glycine max
  Peptide Sequence Number=SeqID_140873
atggatcacaagaacaatatgtttaacgattgcttcttagatcaccaggagatgagattcgggccaaagaagacacaagcgccaaagttcaatcgtctatcatctggatcaaaggcccaattagcatcacagaaagttgtgataaaaataggtgcaaaaggaggcttgagatgcaagccccacgagatggttcccttgagataccacaatatccttttaactgccacccagtgggtcttaagaggatga

SEQ ID NO: 24096 - DNA, 369 bp, Glycine max
  Peptide Sequence Number=SeqID_140874
atgataaaaaaaatcacattggagaataaaataaacgatagcactaccacaaaaacaagcttctacatcggtggaaaaccagcatctacgacgggcccaacaccgtctttgttccaggtgtcgttgtatgtcgacaacaacgacatcggtcaactagcacccgtctttgtaatggaaaaaacaacgtcagtggctagaaaagaacccgtcgttgttgtgatccatttcaacgacggagaaacctcaatgcagggcagcatagacatagcagcaaacatagaaggtgaacacacaagcacaggggtgcagaaagaaacaatactcaaaaggaaggtcaaaaagcccacttatctgaaggacttcgtctga

SEQ ID NO: 24097 - DNA, 291 bp, Glycine max
  Peptide Sequence Number=SeqID_140875
atgaaggcctacaatgaagtgttgtcaaatcgacaaattgttgacaaggtgatgagaatcttgactccttattttgatcacattgttgtgacaatcaaggaatccaaggatcttgattcaatgaagttgatctacgaagaaacgactatgcctacttccgccaatgaaggaaatgaaggaggtggcgatcctccattgaatggagttctcgtgccgccttatcagaattcgatgcacacaaaattcaatcactccatcacagaaagcttgactctgaattatcttttctga

SEQ ID NO: 24098 - DNA, 924 bp, Glycine max
  Peptide Sequence Number=SeqID_140876
atggagcaacttgaaaatgcggaggctgcaagggattcattgctttctcagcttaagcatgcacttcaggaacaagaatcaaggcaagagctcgttcacacccagttgctagttgcacgaagccagatcaagaaagtggttggtatcaggaagcagcttaaccaagcagcagaagccacaaatccatctcagcctacttctgtatcatatgctcctttccaaactactgaagatgatagcaagaaggcagcagcagctgccgttgctgctaagcttgctgcctctgcatcctctgcccagatgcttacatctgttctttcttctcttgttgcggaagaagctgcctccttgaatggtagcttaaattctacaggattttcatcaggattacctattttcaacccagagaaaagacccaaacttgaaaaaccaacacctgctcatgatgctagcaattatgatatggccaactctcccttttatgccactatgcaacagccatcactggcaaatgtaccacttgcaccgtcagttggcatgcaagctgtgtctcaagccagtcaattacaacctgcatttgcttcaccaccccctcccccacttcattctttggcaaatcaaccatcaaatcaatatgtccaatcaactggtttgatggctgggggaattccttatggatacagatcaaatagcctaccacctccacctccacctcctttgccgccacacatggcaataggtttatcaatgcctggcactcaaccagcacagcagcaacagcagtctccaccgggattttacaggccacctggcatagggttttatgggaaaagccacccatcaacaccaccaccagtacctaggcacatgttcctctgggaaattgctgtgaaagttgaggattttccagcaggggctgtgtaa

SEQ ID NO: 24099 - DNA, 576 bp, Glycine max
  Peptide Sequence Number=SeqID_140877
atggaggaagcaaatgttgtactaggatctggatctattcttgggcgtcttctatcttttccttctgctgctttaaacatgcaaaacaataggatgcttcctccatctctaagccctctgcaggaagacaggctaagaaacctacggcaacggcttgaagtcccctttgatggttctaaagcagagcaccaagatgcacttaaattattgtggaaattggcttaccctgacagggagcttccttcgcttaaatcagacctttggaaggaaatgggatggcaaggttcagacccttcaacagattttagtttcttgtgtacttttggaactaatgggttacaatcccttggcatgttcttatggcatgcagaagttgcttcaaaaaataatggaacagggggtggaggatttatttcattagagaatctcatcttctttgcgatgaagtatcctccttacccttgcatatgcaaagatgctgtttccggattcgaacccatgaccaacaagtcaccaaggcacaactttaccgctgcaccagggctcgccctcaaaatagtgagcctattaagttaa

SEQ ID NO: 24100 - DNA, 1830 bp, Glycine max
  Peptide Sequence Number=SeqID_140878
ttgcccccaaattttgttgatcagaatggatctacaatggctgagccgcaggttgtccctgtttctgtggattcaaatttgtcttctgatattggatcaataaaggatgtgactaatttaggcttagttcatgggcaggatctagctgactacatacgtgctgattctgaagttcttcaccaagacagtgtagattctccagattcagattatcaaatggcttctgaaaagtcacatctatcagataatgaatctgtggaggaaggagcactgcccaatttagaatcaagatttgataatgcaaatatgtctacgtcagtccaagatgcagatgaaatgtttgattctgcggcttctgatgcccaccatatttcttctaatggttcacctatggctgccccacgggatttagagctctcacctgcagcagggccatcaccagtggttcatcctgattcaccttctgaagaaactgaacatatagaaaaattttcatcaaataatgatgacatatttcagattcagcaaggtaaaaccaacatccaccaagatttggataagaatacggttgctttcacttcgggcagtcaacatgaaattgatgtgaagtctccctctaacttggagaatgatctgtcaagctctgataaatcagttgttgcacaatcttctagtgatcatgatgaaattcagagttctaatgctatccaggttgaatctgcacactgttttggcacttccaatgatgaagttggagaattgcatgatgcagttgacaaatttcctccaagcatttcttctgtgacctctgaaaaatttgagacccctaaattcaggtcacccactggtgaagcagatttggaagttgataggcacggggaagttgaaaatgaagaccaaaatgaagtgctagaaactgcgcttcattcagaagagagcatgtctcaggttactgaagaaaatagcaatgaagaatttgatgatatgaaggaaattgatgaagaattcttgtcagaattggacactgttggagactttagtgtcaatgatgctggtgtatcacttcatactggcattgaacatgagaaaattagagatgctcaacttagttcactccctaaggatgtaaagacagaagagtttgagcaggacatcccagttcttgaagcaagatcacttgaagatattaacttggcttttaagcaacttcaagaaggcgtggatgtcgaagaggtcatcaatcgaagtactattaaggatcagaatgtcggtggagaatctaaagatcatctggaaattaattcagaccttcaagttgttgaagccagatctctagaagatattaacattgctttaaaccaagtctctgaaggtaataaaggggagctgccaaattctttggattcgaaagacacttcagtcaaagtagaagaaaatgaggatggctcagccaaggtgaatgaattctttaacgtagcaaccagttctgaggaaatgagcagaactacagtggataaatcagaagatgtacctaatagcagctccggtatcgaggagaaatctcacagtaggaaatctagttccagctcgagctcaatgatgggagtttgggtatctagccttggcaccaatcatgtcttggctaatggtagtcacaagtcagtggcggcgacggcgggcgtgcacggcggtggttcaccttctacactcctctcatctcgtaagtctttgggatctatcgaacgcatagagaaactcttctcctcactcttcatcgtgcttcgcttcgctttatcgcatattaggtttcgagctcttaaacctaattga

SEQ ID NO: 24101 - DNA, 243 bp, Glycine max
  Peptide Sequence Number=SeqID_140879
atgtcagaggttgatagggctcgaggtgtgggcttagagttagaggggaggctcaaagtttggagggtgtacactaggaagaataggggtgtgaagagtgctgctgaggtggctttgggtgtaacagaatgctcaagtggaggtgagaggagagagagggtatcaggagaaatcatcattctgttagcggcagagaggatttccctctttgtaggagctgagctctgggcaggggaattgtga

SEQ ID NO: 24102 - DNA, 936 bp, Glycine max
  Peptide Sequence Number=SeqID_140880
atgatctgtcttgttcctttgcaaattcctaagagaccccccctcccacccaccaagagacacaatcattcagcactttcccattggtgtatttctcaccggaagagagcaaaagaaatagttgaaacttgggataaattgttcaatgcttcccagaaagagcagcgtgtctcttttctatacttggctaatgacatattgcaaaatagtaggcgaaagggcagtgagtttgtcaatgaattctggaaagttcttccagcagctctcaggcatgtctatgaaagtggtgatgaagatggaaggaaagcagtgaccagactagttgacatatgggaagagaggaaggtttttggttcacgaggtcaaggtcttaaggatgatgtaatgggcaagaatccccttccatctgctagcaatggaaagagttcaaattctatcaagatagtgaagagggatgcccactcagtgagaataaaactggctgttgggggtttgccagagaaaatactaacagcatttcagcccattcttgatcaacatcttaatgaggaagcttccttaaacaactgcagtgctgctgtgcgtgaagtgggtaaagttgtggaagatgttgaaaatacattggctcaagtttttccctcacaaaatcaaagcttcaagttggcattagagcgggtcgtatctgtcgccgccgccgccgccgccgatgttttctccggcgattactgggttttgtgcgccttgaggagtgcaaccctgtcgcacaactcgcgtgaccagaaaggcctccacgcaccgtcgtcccttggtcggagtcgtgccggattgacaccggtcgactcgccgtcccctcctaagcctgtttcagcccttggtttcctgtttcggcgcgtcgggagtagtgttcttgtgttttcccttttctcccttcattag

SEQ ID NO: 24103 - DNA, 372 bp, Glycine max
  Peptide Sequence Number=SeqID_140881
atggaggcaccaaataaatctgatgcattttgctcatcttttatgcatttttggtatgcctttggtggagctatttgccaggttattaatgctgagtgttcggtggtgccttgcttgcttcgtttctttgctttgtttttcatgcaggttgttcctgaggctatcttttgcccttttgagctatctgtgtcagtgacaacagacgatggcgcacttctaagggtttcgttgatgtcctcacttctaagggttccgttgccacccataaagcgtctatcatctgatgaattgggtcatgaagcaatgacttgtgacatttcacccgtgcaagtttcctttggcaaactagcaagcccttctgcaactgaatga

SEQ ID NO: 24104 - DNA, 213 bp, Glycine max
  Peptide Sequence Number=SeqID_140882
atggatttgtgcacaaatttgattcccttactagcgctccagcaatgtgcggttgcacctgcacgtgccattggactttctaatagcagtgttttatttccaaatcatgtggaatgcgatgtggtcaaaaccatggggtttgcgactgctcgagttggagaaggtgttgcaagcggtgtagaacgtgttgtagagagtgttgttgcgatctag

SEQ ID NO: 24105 - DNA, 561 bp, Glycine max
  Peptide Sequence Number=SeqID_140883
atggaagcttgcttgtggagcttctatggaggctggatctttgagcttcaatggggtcctttaatggtgattttccactatggagatgcagcggaagacaaaggaaaagaggaccgatcaaactggttggcgacaatacggttttcggccgcattccatgtttccaagttttttggtggtgacaaaaatattaccttcgaggtggatgtcattggacctatccttgggcagcgctgtccaagccgatgtcaccgaacacatgatgcaacagagcctccctttggtaatggtccttccactagcagctttcaatttttgatttggatcacaaaaaattattcctgttcggagaggttatggcaaatgtctcaacaatggcaaatcaccatgcaggatggtgtcccatttgttgcccagacatggttccaatatctctctgaaaataatttaatggctggagataaggtaatattcttcttcagatttgacgaacacgtatgtgaagttgtatttagaaaggaagttatatgggatgacgaggacctttccaaccgaagataa

SEQ ID NO: 24106 - DNA, 858 bp, Glycine max
  Peptide Sequence Number=SeqID_140884
atgtcgtttaagagatcgaaatcagaagctgaaaaaactttatctcctgaagagcagcagaccatgattggagaagttagaaagataattggtccaattgctgacaagttctctactctgtgttcggatgcatcagttctaagataccttagagcacgaaactacaatactaagaaggctgcaaagatgttgaaaggatccataaaatggaggctggagttcaagccagagaagatccaatgggatgatgttgctcaagaagctgagagaggaaggctatataaagctgattacatggacaagcaaggaaggattgtttttgttattagacctggtattcagagtgcaagcagctcatgtgcccaaatcaagtaccttatttactgtttggagaatgccatatggaatataagttccaatcaagaagagcagatggtttggcttattgattttcaagggtggagcacagcatgcttatcgttgaagatcgtccgagatactgctcaaatcctgcaggctcattaccctgagaggttgggccttgcaatcttttacaatccaccaaaagtgtttgagtcattttggacgatggtgaaaccatttctagaacccaagacttacaaaaaggtgatatttgtttaccctgacaacccaaggagccgccgcatggtgatggaggaacaccttgacatggacaagctggaatcctattttggtgggaaaaatacggttggattcaactatgaagcctatgctcagaaaatgaaagaagatgacaaaagcatgtctgatgtttttgattcatgttgttcatcgtcgccaggttttttaagctccgaatttcatgaatcggtgtag

SEQ ID NO: 24107 - DNA, 417 bp, Glycine max
  Peptide Sequence Number=SeqID_140885
atgtgtttagaagccaatacagatgcaacagacagagaagaaactgcagcttttgcagagtggatccttaatattggtgatggaattgttggccagcaaaatgatggttattgttcaattgaaattccaacagatctgttaatcacagaatatgatgacccactctatgcaatagttaattctacatttccaaatttatctcaccatcatacaaatcctgaatactttcaaaccagagccatattagcttccacaaatgaaaccatacaacaaattaatgattatatactatcattgataccagctgatataatttttggcaaaaatattggtcagaatgtttatattccaagaatgtctatgtctccatcacaatcaccatggccttttaaactcttgagaagacagtcccaataa

SEQ ID NO: 24108 - DNA, 249 bp, Glycine max
  Peptide Sequence Number=SeqID_140886
atggcgccaaaatttacttgttcgaccagaatacttgtttactccctcttccaaattggtattacttgttttatatgggagtggtcttatcggcaagcgcaccgggtcaccaacctttcatggcaaggaaactccttttacactgaagaagaggaatcaagagaaattgcttgtttacaaaggagtggggatgtctcctccacctctaggaatctcacaatcactcaaaaactcactaatctcccctaa

SEQ ID NO: 24109 - DNA, 480 bp, Glycine max
  Peptide Sequence Number=SeqID_140887
atggcgattcaggctctgtcccttcttcccagaacgtccatatcgagggatgtcaagggatcaataatattggcacttcttcaatccacatggcaaagctctgggcttttgactttagggtggatggacattgcctggtcttgggggtttactgagctcatggttgaatcatattcgatggtggccattaatcttatccttaagtggtgttccccaactcatcagtgtgcttctatggttcaatttattatcctcaaagatggaaatttgggagtatcttcttgggtgcatgtccttagagaggaaacaagcttcatacctccatcattgtcaattgtgtttagaccacctccaattaggccttcagcaccaattcgaattatattctcaaatgtatcatcccataggatgaacaaactgaattacgtgagcttcatactcacacgagggctaccctgctgccaagattcgaagaagtga

SEQ ID NO: 24110 - DNA, 585 bp, Glycine max
  Peptide Sequence Number=SeqID_140888
atgggtattgatttatcggttatttggtttgttatcatcgtgtttgccaccctgatgtatatcgtcatggacggtttcgacttagggatcggcattctgtttgccgccgtacgcggcggcgatgagcgcgacgtgatggtcaacagcgtcgccccggtatgggatggcaatgaaacctggctggtgcttggcggcgctggtctcttcggcgcctttccgctggcctatgcggtgattatcgacgcgctgtcggtaccgttaaccctgatgctgattggccttatttttcgcggtgtggccttcgagtttcgcttcaaagcgaccccttcgcaccgtcctttctgggataaagcttttctgggcggatcgctactggcgacattcacccagggcatggtcgtcggcgcggtcattcatggttttccggtcagcggtcgcagctttagcggtggaatgtgggattggctgacgccatttaccctattctgcggtttcagcctcaccgttgcctacgcgttactgggcgccagttggctgcctgtggacgccgctctcccagccggcgatcgccgagcgctggtttag

SEQ ID NO: 24111 - DNA, 753 bp, Glycine max
  Peptide Sequence Number=SeqID_140889
atggcttgggaacttatgaatgagattaggtgcccttctgatcaatcaggaaggacagttcagtttaaagcaccattccgttacatcttaattcttaatcttcagatcgttttgtctgctgcatttatgcttgctcaagcttggatcactgagatggcatcttacctgaaatccatagatggaaaccacttgctggaagctggtctggagggtttctacggccagtcaaagcctcagtctaacccaaacttcaatgtaggaaccgatttcattgccaacaaccaaatcccaggcattgatttcgcaacagtgcactcctacccggaccaatggctatcaagttctagttatgaggaccaaatctcatttttaggccgttggctggatgagcacatccaagatgcacagaacacccttcacaagccacttctatttgcggagtttggtatttccacaaagagttatggtggcaactcaacaccaagggatcggttattcaacacagtatattctgcaatatactcatcagcaagcagtggcggggctgctgttggtggcttgttttggcaacttatggttcaaggaatggattcttatcgagacggttacgaagttgtcttagatgagagcccttcaacggctaatttgatcgctcaagagtctcaaaaactaaaccgaattcgcaagatgtacgccagacttagaaacattgagaagtggaatgaagctaagcaaattagaggtggaaactga

SEQ ID NO: 24112 - DNA, 1599 bp, Glycine max
  Peptide Sequence Number=SeqID_140890
atggattcaacttgtgcaatcctgagtggccgcaatctagctaaagtttgtgagggaattggaagaaacagaagaagtggcttctggggtgagagtacgaggcgaagtgtgaacacaaggaatcttagaaactccaagcctggaagtggaattgcacacgctgttctcacatcagacattaacgaagattcgatggcatttcaaggggtacccacttttgaaaaacccgaagtggacccaaaaagtgtggcttccatcatattgggtggaggtgcaggaactcgactctttcctcttactggcagaagagccaagcctgcggttccaattggcgggtgttatagactcatagatatccccatgagcaattgcatcaatagtggcatcagaaaaatattcattttgacgcagttcaattctttctctctcaaccgccacctgtcccgtgcatacagcttcggaaatggaattacttttggagatgggtttgtggaggtcttggcagctactcaaacacctggagaggccgggaagaagtggttccaagggaccgccgatgctgtaagacaatttatatgggtttttgaggatgccaagaacaagaatgttgagcatatattgatactttctggtgatcatctttaccgaatggactacatgaactttgtacagagacatgttgacacaaatgctgatatcacagtttcatgtgtacccatggatgacagtcgggcatcagactatggactgatgaaaattgacaaaacaggacggattatacagtttgcagaaaaacctaagggatcagatctaaaggcaatgcgtgttgacaccactcttctagggttatcgccacaagaagcagaaaaatatccttatattgcatccatgggtgtctatgtgtttagaactgaaaccctgctgcaactattaagatggaatggttcttcatgcaatgactttggatctgaaattatcccatctgctgtgaatgagcacaatgtccaggcatatttattcaatgactactgggaagatattggaactataaagtccttctttgatgcaaatcttgccctaacagaacaacctcctaaatttgaattctatgatccaaagactcctttcttcacttccccaagattcctaccacctaccaaagtagaaaaatgcaagattgtggatgcaattatatctcatggttgcttcttgagggagtgtagcattcaacattccattgtaggagtacgctcacgtttggagtctggtgtagagcttcaggggtattgcatgatgtcccatgaaaagtttgtgttctacatgactgcagatacgatgatgatgggtgccgactactatcaaactgagtatgaaattgcatctctgctggcagaagggaaggttccaattggtgttggggaaaatactaaaattaggaattgcataatcgacaagaatgccaagataggaagaaatgtggtcatagaaaacatcgatggtgttcaagaagctgacagggcaaaggaaggattctacattagatcgggcatcacaattacattaaaaaatgcaacaattaaagatggaacagttatatga

SEQ ID NO: 24113 - DNA, 268 bp, Glycine max
  Peptide Sequence Number=SeqID_140891
atgataaatgggatgactgtcagccagtgggcatccataactttttcacgaaacatacaagatagtgttgctcacactttttgtaccgaactagctcaaatgtgccaagaacttaatcgagagcctgttatccccatctacaatgccaaacctaagcatgtggagaaagctttgaagcatgtttaccatgtgtcaacaaacaaaaccaaaggaaaggaattggagtttttgttagcaatattgcctgacaaaaatggttctctctatg

SEQ ID NO: 24114 - DNA, 258 bp, Glycine max
  Peptide Sequence Number=SeqID_140892
atgacgttgtctatgatgatatcaggggcaaggaaaccaagaaatgacattgatgtttatccaagtcccttgattgaagacttgagaaagttgtgggatgagcgggttaacgtgattgatgggaatcaaaatgagacattcaagttgcatacaatgctcttgagcgggttgaagactagtgacgactacaaagaggccgcagagagcacactcatcgagttctacactatcataggagggaatctcacacatgggtaa

SEQ ID NO: 24115 - DNA, 216 bp, Glycine max
  Peptide Sequence Number=SeqID_140893
atgggggggtgcattgaccttgttgaacgtcccttgtgtgggaaactaaagtggttaaagaatctaagcatttctgaggggatgcttaggagctttaattcatccatgggggtgtatcacctggtagggaactccttatggccccaggttgatcacctaggagggagttacagtgcacgattgggtggcctcaacaaatactgcatggtttcctaa

SEQ ID NO: 24116 - DNA, 225 bp, Glycine max
  Peptide Sequence Number=SeqID_140894
atgggtcaggatgacaaaaggtgcaggagacgatgtaacctcgcgtgtcacctgacttcatgggtcagcacgacaaaaggtgcaggagacaatgttagtctctgcgcgtcaacgggctcgttcgcccctggtcgacgaaaggtgtgggtaaccataaggacaacaaaaagtgcaggagacgatgttagtctctgcgcgtcaacgggctcgtttgcccctggttga

SEQ ID NO: 24117 - DNA, 216 bp, Glycine max
  Peptide Sequence Number=SeqID_140895
atgcggggttaccttatggttgcccgcacctttcgtcaaccaggggcaagcgagcccgttgacgcgaagagactgacatcatcttctgcatctttttccatccagggacaacgagttaggtggcaggcggagataccttatggtcatctatgcctttcgtcaaccgaggggaacgaattcggcagtatcaggatgatgttggtcgttcggtgctga

SEQ ID NO: 24118 - DNA, 180 bp, Glycine max
  Peptide Sequence Number=SeqID_140896
atggggtgtaataagtggacccaacattggcccatgggctcaaaaatctaccctgaggttcatgagaatcctcgggcattcttcaacagctctagcctaatcctcttggagcctcttgctcatggctctggtaactggtcccttcctagggaggattgcatcagtaaggatcatatttga

SEQ ID NO: 24119 - DNA, 1120 bp, Glycine max
  Peptide Sequence Number=SeqID_140897
ggctacacgccctcaacttcagagggcttcacgccctcgccatcagaagactacacgtccttgccttcagaggactgcacgtcctcccctttagagggctacacgcccccgtcttcagaggtatgcatgtcctcaccttcatagggctgcaagtccttgcctttagaggactacacgtcctcgccatcagagggttgctcgccctagccattagagggctgcacgctctcacctttagagaactacacgtcctagccttgaggcctacacggctacacgtcctcaccttcagagggctactcgccctcaccatcaaaggactacacgtccttggcttcaaaggactacacgtcctcgtcttcagaggactacacgtcgtcgtcttcagaggactacacgtcctcgcctttagagggctgcacaccatcgccttcagagggctgcacaccctcgcctttaaagggcgacacgtcctcgacttcggagggatgcacaccccctcgcctttagagggctacgcggcctgtagtttccttttatcaactcctgggccaccccctgatcctggaggagggccaactatgcgagcacaacgagaggaggagggtatcacacagctactgtgcataccggggcaagatttcacccgtgccgctgcaaagagacgagtgcagatcatgcgcaccaacatgaccagtcttacacagatatggatgacgttgctacttagcaacattctgtccagcgaccacaatgtcgatctctccctgcggaagtatcagttgggatcgcccccacaagacacccagtggacccggaggagcccaacagggccctggggtttccagctctggttacgggcctctgttagtcctataggggatcgcgcccgcaagtcacccagtggacccgaagaagtccaacagggtcttggggtttccagctctgattacaagcctctgcaggcgcagggcgagacaccacagcagcctggggatggccgacagcgggcaataaacgcaccgccgccacctccagagcccttcagctcatctacaaaggctgaagcgttacctacgacccgtggccgcccaacaagcgaccaagtccaaagccaaag

SEQ ID NO: 24120 - DNA, 231 bp, Glycine max
  Peptide Sequence Number=SeqID_140898
atgatggcacatcaaaaccccccatacttagccttttgcactcctgggcaaaatgaaacaaagaacaaaatccaaggatatcaaagagagacaaacaaaaacattcacatatttctcaatgaacatcaaggaatgaaaggaatggcctttgagaaacaacatcatattcagcatgtccaacatttaaccaatatgcaatgtacatcaagtatggctcaaaatatatcatga

SEQ ID NO: 24121 - DNA, 225 bp, Glycine max
  Peptide Sequence Number=SeqID_140899
atgccagcaacaaaggaagaggtgagctaccaactcgtcacctcccctctcgttccacttctgtctgtaactgagtctaatgtctcggtagctgtcaccagcagtggagcttttcttccttgttttgtgcgagttaagagggcctttcccttgctcgatgggaagaatagcgtaataaaggaagagcctactttcgtactcaagccttctgatactgaatcctag

SEQ ID NO: 24122 - DNA, 165 bp, Glycine max
  Peptide Sequence Number=SeqID_140900
atgggtgccaagcacctcaaaatgaccaaacacaagttgcatgccaccaagcaaaggtccccggacgaaattagggcaccacatacaccagttagcccttcttccattaagcatgaacgcaagttaggctcagaggcaattaatcgtacacgaagcgtgcactga

SEQ ID NO: 24123 - DNA, 246 bp, Glycine max
  Peptide Sequence Number=SeqID_140901
atgtcatcgggcccgccgcctctggatgacaaaggtgcagatgaccataatttgtctctacgtgtcaacgggctcgcttgcctctggttgacaaaaggtgcgggacccctaacttcacgggtgtctccgcatgccaccggactcttggatcacggtaacaaaggtggggtggtcgacaaaagcagggtttttgctcctacgtatcctcaatttgtgatgaggaactcagacctacgcagttcttga

SEQ ID NO: 24124 - DNA, 294 bp, Glycine max
  Peptide Sequence Number=SeqID_140902
atggatgatccattcagattgcaaattgcatctaagatagatggagaaaaagccatatttagagctctttcagatagggatatcatcaggtccttctctaggagcagggataggagcaatgatggcgcaaagagagggaggcaaaagaagattaagaacatcctaacaccaacccttaagggaagtataagcaaatgcatggaagttagcttcacgggaatggatggcatatgcaatcatgctttgaaaagaattaatcctagggatccaactatccaaccagaaatgggttaa

SEQ ID NO: 24125 - DNA, 890 bp, Glycine max
  Peptide Sequence Number=SeqID_140903
atgggaggtatcgcactacttggatgtttgtctatctttctcctaaaacaagctaccctaactcagttcattagggcttgggttatttcgaggaaactgagtaactacgcaacggtgggtccgaccccgagtgcggcacgtgtgggaaacgacggtgacaatggttcgttgatgattcctcgtttcaacgcttaccgcattttctgttcgatctcaaccaaggttgttccttccacctccgccatgagtttcatctttggaaagcgaaaaacccccgcagagcttctgcgggaaaataagaggatgctggacaaatcaatcagagaaattgagcgtgagcggcaaggattgcaaacacaagaaaagaaattgattgcggagataaagaaaagtgccaaacagggccagatgggagctgttagagttatggcaaaagatcttgttagaacaaggcatcaggttgagaagttttataagctaaaatctcagctccaaggtgtatcactcagaattcagactttgaaatctacacaagcaatgggtgaggctatgaaaggcgtgacaaaggccatggggcaaatgaataggcaaatgaacttgccatctttgcagaaaatcatgcaagaatttgagagacagaatgagaagatggaattgacatctgagatgatgggagatgcaatagatgatgctttggaaggagaagaagatgaagaggaaactgaagatctagttaaccaagtccttgatgagattggaattgacatcaaccaagagcttgtaaatgcaccatcatcagctgttgctgccccggcttcaaagacaaaggtacctcaagttgaaacgactgggaatgatgatggcgggatagatagtgatttacaggcaag

SEQ ID NO: 24126 - DNA, 385 bp, Glycine max
  Peptide Sequence Number=SeqID_140904
atgcggcactttggcgcagatgccgatgctgatggtaacgatgccgtgcgggttgccctgatgcggaattttcagatcgcgcaccgcgttgataacgcgctcggcgaaaatcagtgcgccttgcacgtcggtatccggcaggataatccccatctcttcgccgccgtaacgcgccaggacgtcgttgctgcggcaggccaaccctttgagcgtttggccgatctgctgcaggcactggtcaccggcgacgtggccgtagctgtcgttgtactgtttgaaatagtcgatatccagcatcagcagcgccacgctgcggtagttgcgcgaagcccgcgccagctcgttcttcagcgcgatatcaaactggcggcggttggccagcccg

SEQ ID NO: 24127 - DNA, 687 bp, Glycine max
  Peptide Sequence Number=SeqID_140905
atgacaatagagctgacaaaacaaagacaaaaaaatgaaaaagtagaacgtcgcgagatatttaacaaatggcaagctcaaagatggtgggcagagaactatgacaaggtgatggaactttacaatgttcaaaggcttgatcgccaagctttccctcttccaactccaccaaggtctgaagacgagatgcagacatcatgcggtggcagtggagaaaatagcaatgatgactttggtcaagccctattaataagttcaaagcgtgaatcaatagaagatttcccagtgacacctccactgagcagggaaaggccaccttgtaatctataccgtgccgggggaagaggaggaggaggcatgggaatggggtactcatcctcagattcctttgatcacacctcaatgcaatcatcccggcattactatgaccccaatggtgtgaactcaaccccaaaggcttccaccattagtgctgctgcaaagacagatatctcatcaataatggatgctgatgcttccataagaagtagttcatccagggaagctgatcgctctggggatctttcaatcagcaatgccagtgactttgacaatgaatgggttgagcaggatgagcctggggtttacatcaccatcagagctctcctgggtggcaaaaaggagctcagacgagtcaggttcaggtag

SEQ ID NO: 24128 - DNA, 1032 bp, Glycine max
  Peptide Sequence Number=SeqID_140906
atggctgtgatcccgtgtcactgttaccgtaccgtcggatcagacaaaccctacctctccggtcagagtctccgccgtcgcgctcctttccccgccgtctctgtttcatttcgacgccgaatatcatgcgtcgcctcttctgccatcgctcacaaagttgggctgaaagattttcttcacttagatgattttgataaggacactattctgaagatgctggaccgggcacttgaggtcaaggccttgctgaagtcaggggacaggtcgtttcgaccttttgaggggaagacaatggcaatgatatttacaaagccgtccatgagaacgcgtgtttcgttcgagactggctttacattgttaggtggccatgctatttatttaggacctgatgatatccaaatgggcaagcgagaggagactcgtgacattgctcgtgttttgtctcgctataatgacatcattatggctcgtgtttttgctcataagttactcatgtttgtggtcagtgaagaattatatctgcatctaatatttgtgacacgtgccactggtaatgacatacttgatcttgcaaaatatgcaactgtgccagtcatcaatgggttgacagactacaaccatccctgccagataatggctgatgcccttaccatggttgagcacattggtcggtttgaaggtacaaaggttgtctatgttggagatggaaataatattgttcactcatggttgttgatggcatctgtaattccgtttcactttgtctgtgcgtgtcctaaaggatttgaacctgatgcaaaaacagttgagaaggcaaggaaagctggaatcagcaagattgagataactaatgatcccaaagaggctgttaaaggagctgatgttgtgtattcagatgtctgggccagcatgggccaaaaggaagaagctgaataccggcgccaagcttttaaaggatttcagaatatgcttgtagctcaattggcaccggctgaagtcataaagacttggtggttttttgcaaattgttga

SEQ ID NO: 24129 - DNA, 633 bp, Glycine max
  Peptide Sequence Number=SeqID_140907
atggataaactgagcgcaatgaaaacctttatgcgggtggcggaactgggcagcctgtcggccgccgctcgcgatctgcgtttgacgcagccggcggtcagtcagcaaatcgctgccctggagcagcgactgggagcccagctgctgtttcgcagcacccgggcggtcaccctgaccgatgccggcagcggttattatcagcgcctcaaaccgattctggcggcggtcgacgaagcggaagaggcgttgcacggccagcgccaccagttgcagggcaatctgcgcattcacgccccgaccgggttcgggcagttgcacgtcacaccgctggccatcgctttccagcagcgccatccgaacctcgccatcgagctgctgctggacgatcgcctcgccgacgtgatcggcgaaggcatcgacgtggcgttgcgtttcggtgaactgcatgcgcccggcatggtggcgaaacgtttgggcgagctgcagcgcctgctggtggcgtcaccggcctatctggccaggcatggcacgccgcgttccccggcggagttggcgaaacatgcacacattcgttacagcggcctgaacgacggcgatacgctcaccctgttcggcccgcacggccccgagacg

SEQ ID NO: 24130 - DNA, 1041 bp, Glycine max
  Peptide Sequence Number=SeqID_140908
atgccacggaaaaagcagcaatgtggttttaggatcccttggatctcaggtccttccactgaatctcattctcctcctccaaaacaaaaatcaaaatctgtttccactcatcatcgaccaccatttcgtcctcctggaatagcctctacccctccacaacctcctccgaatggaaccccaaaatctaaacctcaacaagtgtcaaattttcttccatcacactcaccagcaccttcagtgatcattaattccccagtgtcttttcagccagaatccctttctacaccttcagagccaaatgtggaggaattggagttggatagtactcctactcagaattccaattccaatgcccctttggaaacacaaagcaaaccccaccaatctaaatcaaatggcaacaccatagagagaaagatgatggttgccacgtccactcctagcgggaaagacatccaagtggtgccaccagcttcaacatcagcgaccataccattatcccacgaggaaaaccccactatccaaaaagatattaatgatatttcagctctgaatccaacattgaacgtggatgacaaaacaattagtgtggtaactctggctggtgacaacagaggagtgacaatgcacgtggcgggttctcactcaactaggcccaaacctgaaggtaagaagagcgcgtccacggagaaagatgaagcggggaagacatacgtaaacagcaacattcagagcatcaacaattcgatcatgtcgaacggttccatcaatggaagagaccctggtgttcgtgttattctcccccaacagcctcagcctgatgtgaaacaaccgtgtttggaaaaacctaaggctgaagttagcattaaccgtgtggagagggtgccttaccggcccgttgttcgaagacgatgcctcaggggacttttccatgaacccagtgactctgaacctcataaccctgacaagcctcgtcgtcatggttgcaagtttagatgcggagacattgatataaaggataaggatgctgcaacaaaataa

SEQ ID NO: 24131 - DNA, 480 bp, Glycine max
  Peptide Sequence Number=SeqID_140909
atgcagcagaaaggattggagaatgtcacagtgtcagaggtactaatgacaaaaggggaagcaaatgttggttcctggctctggtgccgagttgatgatgctgttatcaacgcaatgaagaacatggctgataataacattggatcattggtggtactaaagccagaggggcagcatatagcaggcattatcacagaaagagactgcttgaaaaaaatagttgcacaaggaagatctcccttgcacacacatgttggtcaaataatgactgatgagaataacctgataacggtgacctccaacaccaacattcttcaagcaatgaaaattatgacagagaatcatatccggcatgttcctgttatagatggaaaaatagttggcatgatttccattgtagatgtggtgcgagcagtgatggagcagcagagtggagaactgaagcgactcaatgactacgtcagaggagaatactattag

SEQ ID NO: 24132 - DNA, 198 bp, Glycine max
  Peptide Sequence Number=SeqID_140910
atggtctttctttctataccccggacattgaaggcaactcttacaatcaaagagggattagctatcagccattcggtgttcgtgaagggtgaccacactaactttgagattgatccttcttttggggttgaggcttcccagttgtacccttatgtcaactacaccgctgtggaagaataccttgacacgttcgtttga

SEQ ID NO: 24133 - DNA, 1383 bp, Glycine max
  Peptide Sequence Number=SeqID_140911
atgaccttccccggaaacctaccatacctggacggaaagaattgggatcgttggcgaattcagatgaaggcgatcttagggagtcaagatgtaagtgatatcgttgaacaagggttgtcagcgcttcccgatggagctatggaggagcagaaggcggcacacaaggaaaacaagatgaaagattgcaaggcgatggcgtggaagattcttgaaagatgtaacgtaggagtggaacagctgaagaaggtgaaattacaaacccttcgtcgtcaatatgagttgatgcatatggaggaaaataagagaatcgttgtctacctcaatagcatcacaagtcacacaaatgcgatgaagtccaagaaggtagaaatcttgaaggttaaagagttgcaaggctcactcgaggctcatgagcaaagactcatggagagatcaatggcaaggtctggtgaccaggttcaacaagctacagtctccaagaaaggtggttatggaggaagatccagtttcaggaatcgagaaagctcaaataagaggggaacttccagtaaatggcgtggaggaaggaaaatggttgatagaaagaatctcaaatgtttcgattgcaacaagattggacatttctccattgaatgcacagcacccccagctcagaatgacaatcgtgggaatcatcatgaggaagcacacctaactaaggaaggtactgagacaaatttagaggaaaaacctcttatgctcatgatggtcacaaaccataatcccagagatgatgaaagatggtacattgacttaggaagctcgagtcacatgacagaacacaagaattggtttgtgaatcttgatgaaaccaagaagagcactgtgaggtttgctgacaacagggtaatcgaagcagagcgaattggtgaagtcctgattaaaagagatgatgggagtagtgctatactatcagaatgtctctatatgcccaacatgaagagcaacctcatcaacttaggtcaactggtggagaagaaattccacattgacatacacaatggatacgttgcaatttttgagccagtaattgagaaactggtgataagaacaaaaatggcatctaacagaacattccaggtaagcctcagaaatctagaatctcagtgtatgactgttgaaatcctagctgaagatacttggctatggcatttgaggctagggcatttaaatttcagggatttgagcatgcttagaaataaggagatggttctagggttacctacaatccagattcctagtaaagtctatgatagtttcttaatcagtaagcaacctagaaactctttcagtaatttcacaccatctagagccaatgacttactccacattgtatactctgat

SEQ ID NO: 24134 - DNA, 428 bp, Glycine max
  Peptide Sequence Number=SeqID_140912
atgcttacgtgcatagcacgtccgaagaaacccggtggcgactcggcaagcgacgatccgagttcgcggagccagcagggagtgaagtcgctgacgtgtcagctgaaggagatggcgctgaaggcgtcgggagcgtacaagcagtgcggcccgtgcgcgacggcgccgagtaggccgagtcgcagcggaaccgagtcggactcggagtcgtcgtcgtcccggcggcggtgggggaaggagctggaggcgcggctgaaggggatatcgagcggggaagggacgccgagctcgagcgggaggagggtggtgatgctgctcgaggacgaggaggagccgaaggagtgggtggcgcaggtggagcctggcgttttgatctcctttgtgtcgcttccacgtggcgggaaccatctcaaacggatacgattcag

SEQ ID NO: 24135 - DNA, 1551 bp, Glycine max
  Peptide Sequence Number=SeqID_140913
atgggaacccttgggagagcgatctacagcgttggtaactggattcgagaaactggacaggccattgatcgtctcggttcccgtcttcagggcggttactacttccaagagcagctctctaggcatcgaactctgatgaacatatttgataaggctcctgttgttgataaggatgtatttgttgcgccaagcgcctccgtcattggagacgttcaacttggaagaggatcatccatttggtatggagttgtcttgagaggtgatgttaacagcatcagagttggaaatggaactaacattcaggacaactctctggtgcatgttgcaaagtcaaatttaagtgggaaggtgttgcctacaattattggggataatgttactgtcggccacagtgctgttatccatggttgtactgttgaggacgaggcttttgttggtatgggtgcaatactacttgacggtgtagtagttgagaaaaatgccatggttgctgctggtgcccttgtgagacagaatacaagaattccttctggcgaggtatgggcaggcaatcctgcaaagttcctgagaaagctcactgacgaagagatagctttcatctcccagtcagctaccaattatactaaccttgcacaggtccatgcggccgaaaattcaaagtcctttgatgaaattgagtttgagaaggtgctacgaaagaagtttgcacgcaaagatgaggagtatgactctatgctgggtgttgtgcgtgagatcccaccagagcttattcttcctgataatgtcttacctgataaagcagaaaaagctcttaaaaaatctgggcggggacccaatttgtttgtgctggatccaagaaacggagataactctaccttgaagtgtaagcaagtgaggaaatgggaagccttgggagttgggagagccatttacagcgttgtttctaggcatctaactttgatgaacatatttgataaggctcctgtcgttgataaggatgcatttgttgcaccaagtgcctccgtcgtttggtatgggtgtgtcttgagaggacaactccctggtgcatgttgcaaagtcaaatttaagtgggaaggtgttgcctacaatgattggggatataatgttactgtcggtcatagtgctgttttacatggttgtaccgttgaggacgaggcttttgttggtatgggtgcaatactactacttgatggtgtaattgttgagaaaaatgccatggttgctgttggagcccttgtgagacagaatacaagaattccttctggtgaggtatgggcaggcaatcccgcaaagttcctaagaaagctcactgatgaagagatagctttcatctcccagtcagccgccaattatactaaccttgcacaggtccatgcagccgaaaattcaaagtcctttgatgaaattgagtttgagaaggtgctgctgcgaaagaagtttgcacgtaaagatgaggagtacgactctatgctggatgttgttcctgataatgtcttacctgataaagcagaaaaagctcttaaaaaatga

SEQ ID NO: 24136 - DNA, 462 bp, Glycine max
  Peptide Sequence Number=SeqID_140914
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgcacttaatgatttggatagaagtatggtgaaccaaaatcttatggatttggctggttcaaaggcatttttcatgcattgcttaccggcggaaagaggggtggaggtgactgacgaagttattgaagctccaaattcaatagtcttcccgcaagctgagaaccgaatgcatgcacagaatgccgtaatgcttcatgtacttgccaagtag

SEQ ID NO: 24137 - DNA, 195 bp, Glycine max
  Peptide Sequence Number=SeqID_140915
atgatatgcgaaattatagcgttgaaggagtttactgcattaatcggcgatgatgacatagcaaagacaaaaaccagaagcgcaaaaactgattatggaatcgcagatcacgcgcaaccagagatcgagaccaaaggagtgcgacgaacggagaaatcgcacaaaacagaaatcgcgatcaaagaggtaacataa

SEQ ID NO: 24138 - DNA, 1941 bp, Glycine max
  Peptide Sequence Number=SeqID_140916
atggcatacaagtacgagaattatgacccctccttccccgaccaacccgtggttgacttatacctcccagtttgggccaggttagcagccttgaagtccaagccagccttcatttgggctcaagacttgtccacctccactcttctcacctaccaacaacttaattccaccgttgatgtcatctcctctcggctactctctcctccattacaaaaaagaggtgacactgtccttcttctctgctctccaggacttgacctagttgagctcatcttcgcgtgccaaagagctggtcttttgagcgtccccatcatccctcctcaccctgccttcgctaaagaaaactatcaccatctcatacgagccatttcacagaccaagcccaaagccgccatcgctcaccctcactacatatcaagcattcgacactacgtgtcttctccacataacaacaacaaacttactcacatgttgcaaagcatccactggatctccattgacgaactcaaacatggacgtcaaggtaataataacatggttactttaaataatcttgattaccgtggttgcaaagcagatgaggtttacttggttcagtacacgtctggtgccactggggttccaaaacccgtgcttgtcacagcgggttcagccgctcacaacgttagaacagcgagaagagcttacgatcttcatcccaacagcacaatcgtttcgtggcttccacagtaccatgactgtggtctcatgtttctgttgctcaccgttgtatctggcgctacttgtgttctcacttccccaaccgcgttcatcaagcgccccagactctggcttgaactcttgtcggaattcaaggccacgtgcactcccgttccctccttcacattgccgctcgtcatcaagcgtggaggagttcaccagggagcttcacccctcaacctttcaactctgaaaaacctcataatcatcaacgaacccatctatagagactcagtggaagaattttttcacactttttctccatttgggttaagcccttcttctatttctccttcctatgggttagcagagaattgcacctttgtgtccactgcgtggaggagcgttaatagtgacaacgatggtgtcggtgctggtgccaattcttcaagcttcccagattttccagctcacaacaaactcttaccggttgcaaggctcggaaacgtggaagaggaagacgtggaaatcatggttgttaaggaagaaacgttggagccagctgaagatggtgttgaaggagaaatttgggttgcttccccaagcaacgcttctgggtaccttggccacccttgttttacaagagaagtgtttcatggaagactaagaaacgtggttagtaagtgctttcttcgaactggggacagaggcatagtgaaaggagaaaaaagatatctttttgtcactggtcgctgtcaagacgttatggaactccgaaacggtcaaaaggttcatccacattacatagagactgcggcttataatagttgcacgaagttactcagaggtggttgccttgctgcgtttaaagtttcatcaatggtggcggttgtggcagagatgcagaggatcaaaaagggtattgaaaagggtgtgttgaagagaatttgtgagggaattaaggaagctgtttgggagaatgagaaggtggaggttggatgggtggttttggttgagagtgagagtgttccgaaaaccacttctgggaaattgcaaagagggaaggctaaggagaagcttcttgcagggggaatgaagattctgatggagatgcagtttggaaaagatgtttctgtttctaagatagcacagacgaaggtaagacaagtggcttgggaagaaaacgtaactggttcacttttatgtgtagaagctcatagcacattaatgtcacttctatga

SEQ ID NO: 24139 - DNA, 1374 bp, Glycine max
  Peptide Sequence Number=SeqID_140917
atggtactgaggaattctagattgatgaagccagacctcaaagacaaaggaatctaccagctagactcagagattttgaagtatatccagataatgcaatctcaaaggatggagatttggttcaacacatggcattactggttgatacagaaccaaaataatacctgggagttggtgtcactcccaacagagaaaactccaacagctgtcaaatggattttcaaattaaaattgaagtctgatggtactatagctaagcataaggccagacttgttgccaagggcttcatgcagaaggaaggactggattactcagaggtctttgccccagtggctagatttgaaacagtcagattgctagttgccctagctagttggaaaggatggatattgtggcaacttgatgaaaatcatcattccttaatgccccttagaagaaaacaattgagtcagaaagctgagaatctctacatttgtctatatgttgatgacctactcatcacagggagtagtgcatcagaaattgaaacattgaaggaaagccttaagggagagtttgagatgactgaccttggtgtcttttcatatttcctaggcttagaatttcaaaagcatgattgtggtctgtttatgcatcagaggaagtacttgttggaagtactaaagaaattcaagatgctagattgtaacccctctaaaacaccagctgaaatgagttgcaaattgggtaaatgtgaagctgaacctgtagtggattgtaccttgtataggcaaattgttgggagtctcatattcatttgtcattccagaccagaaatcactttcaatgtgggagttatcagtaggtttatgagtgatccaagacattcacatatgatgaaagagaaggttgagccacaacttgtggcttattcagactcagactgtggtggagatgttcttgacagaaaaagcataatggggcatgttttattgtttggaggtgctcccatctcctggtgctctaagaaacaggatgttgttgcactctctacttgtgaagcagagtatataactgcttgttcaatagcatgtcaagcttgttggctgtcctcattactagaagaattgggaatagttactactgatgttgtaaagttactggttgacagcaagtcagcaattgaccttgctaaaaatctagtctctcatggtcgctctaagcacattgaaactaagtttcatttcctaaaagatcaggtaactaaaggaaaaatcaagttggttccctgcaagacagaaattcagttggtagatatcttcacaaaagccttgaagatagacagattcaaggagctgagaatgatgatgaatattctagagctttatgattga

SEQ ID NO: 24140 - DNA, 723 bp, Glycine max
  Peptide Sequence Number=SeqID_140918
atggataaagaaaatctagcatatgcagcatgggaatttcaagatcaatcactactagtttggcttcaatcgtccttatctgaggccattctgtcaaaagttgttggctgtgtacatgcacatcaagtgtgggaaaagataaataatcattttcatgctaaaacaaaagcaaaatccagatatcttcgcatagaacttaggaataccagaaaagccgttggacaaattgtttctgttcaggaacaaatagatgctattcttgaaggtttgccaagtgaatatgagtccctggttactgcaatcagcagtaagattgatcagttcgaatttgaggagatccaatctcttcttttggctcaagaacaaaggcttgaaaagttaagagaaagtgttgttactcctgcactgaatttgactccagctcaaacaaaaaaggcagaggatattgattccaattcagcacctcgagtgcagtttactcaacacattgatgggggcagatcttctaattccagaggtagaggggacagatctggttatggatatagaggaggcaaaaattatggtaacaatgataacataaactatggaaataatgataacaggaattttggaaatggtgatcacatgaattatggaaatactgataggcataaaatacaatgtcaagttttgctacaagtttggtcacagtgtgttggagcaaggaagagagataggtga

SEQ ID NO: 24141 - DNA, 813 bp, Glycine max
  Peptide Sequence Number=SeqID_140919
atggcgaagatatcatttgtttttatgctgttggctctgccattatgtttagttttgggccaagaagattgggaggatcttctgggccaaggaggattctctcaagatgctttgaacaaggcccaggcagctttaggtgctgcttctgcccaagcagctgtcaatgattattttggacttgacgactctcctccggaagccgcgcatggagaacaatcatccttggctgactttttagacgccgacaatagtacaagtaacgacaaaggagcttcacccacagggtcaacaacagtagaagcaccagaagattcacctgtagacgacgttgatgaatccgatgattctttctcacctgcaggggcaccactaaattggcccaatgaggcacctaatcaagcaccaagcaatgcaccaatgggagcatcattagaagcacctgaattagcacctacagaaacaccaacagaagcacctgagttagcacctacagaaacaccaacagaagcacctgagttagcacctacagaaacaccaacagaagcacctgaattggcacctacagatgcacctgaattgacacctacagatgcaccaacagaagcacctgaatcaacatccacaaatgcaccagcaaaaacacctgaattggcaccaacaacaaatgcacctatgcaatcacctacagttgaagaggctgacgaagacgaattggcaccaacaaatgcacctactggggaaccagatgatgaagacgagtttgatgattctccatcagcactcacaaattacgataatgatgacgattcataa

SEQ ID NO: 24142 - DNA, 405 bp, Glycine max
  Peptide Sequence Number=SeqID_140920
atggcactcaaagccttatcatcttctattcaagaagaaagtgataaaggggacttgaatgaaatagaagaagatgatgatttcagattttttgtgaaaagattcaacaaatttctgagaaacagaggaaatcaaaggagatcaaacatcaatccaaaaaagaaaggaaaagattcctccttagccccaaaatgctatgaatgcaatcaacctggacacatgagattcaattgtcctatctttaaaagaagaatggaaaaatccaacaagaggaatttcaaagaaaataaagaaaagaaagcatacatcacttgggaagataatgacatggattcttcaagtgatccagaaaatgaaatcataaatctgggtctcatggcgaaagactatgaaagtagagaagag

SEQ ID NO: 24143 - DNA, 321 bp, Glycine max
  Peptide Sequence Number=SeqID_140921
atggcgcactctgacgagcgcatcattgcgttggaatcttctgttacggcgctgaaatccactgccagtgcattacaaaaatccttgcagagtcaaggagcaacacttgcttatgtgaagaagaagaaagtagtgataaggaggaggaagaattggagaaggagtttgaggcagaatttaatgacccgctgggttggatcatgtgtgcagaaaaattcttcaatctgcaacaggttgcgaagagtgaatgtttgcgattggcattcattagtatggaggggaacacgatattctagtttcaatattggaagaagaaagtga

SEQ ID NO: 24144 - DNA, 228 bp, Glycine max
  Peptide Sequence Number=SeqID_140922
atgccaaagggaattatccccttggatttaatgagtattcaacagaaaagtagccatggctgggtcgtattcaatggaaaatccaaccaggaaccaaacaacaaaggttataaaacaagaagttcttacataacacaagccatgaaagccgcacccaggtacaattccactcatgtggaacaaaacatagatttgaaaaaggtcagtgatcctagaaacactggttaa

SEQ ID NO: 24145 - DNA, 156 bp, Glycine max
  Peptide Sequence Number=SeqID_140923
atgaagcaatttctctttttgaatcttcctgacaccgagatcaattgttcacaagttgattgcaatcactcaatggctcattcttcttatccctacggcgatccaattcttgcttatggaccacaagctattctgtatgtctatattaagaattaa

SEQ ID NO: 24146 - DNA, 456 bp, Glycine max
  Peptide Sequence Number=SeqID_140924
atgcaggacaagataataaaaagaaatcattgttccatggagaggcagactatacaaacccagcagtgtgttgagagagatgctgcaattgcacgtttagaacagagcagaattgttcttgcagtgaggctggcagaacaccgtggtaagaagtataaagtcattgaagaagctcttgcttttattggagatgtacgtgatgcaggcagccttgttgcacctgatattttctatggacaaccaaactgttctgctgagaatatagcgactgagaaagcaaagagatctaatattcttatcaatatttttatctcaagtttcaattttgtgaagagatctcttggattggatcatatgggtggaatagtgggcaatgctgctttggttgcagttagcatgatagctttgcttcatttacatcaggtgcttgaagtattagagttagttgaaagttaa

SEQ ID NO: 24147 - DNA, 525 bp, Glycine max
  Peptide Sequence Number=SeqID_140925
atggatcttcgtgatattgatgtcaagataaaagatgaagatttggaaacgatcctgttagcctctctccctcctttctatgagagctttaaagattgtccaaagaaagcaaagaaatattttgttgttgccattattcataatgactcttcatctgaaaacgatttggttttggctgttggtgaacaaccacaacaacattctaaacaatggatactggactcaggttgttcttatcatatgtttccacatagaagctggtttgtaacatatgagaagaagtctagtggtaatgttctaataggtaacaatgctccttgcaagtcagttggtataggttctataaaaatcaaaatgtatgatggaattgttaaaacctcaaccgatgtttgtcatgttctaaagcttaagaaaaatctagtcattgtgggtgccatggattcaaaagttttttcttgttgggttgaaggtggagttatgcaaatcaaagggaaaatggaagtttggggtaatgcaggggactaa

SEQ ID NO: 24148 - DNA, 1960 bp, Glycine max
  Peptide Sequence Number=SeqID_140926
cctacctaaacgtggtgatgtatttgtgtttcattatccgcctgatacctcaattgactatatcaagcgtgtggtcggtttgccgggcgataaaatccagtaccgtgacaagcaactgaccattaacggtaaggtcatcaatctggatttcgtgcaaccatatcaatatgcgctcaatgtcaatgatgagtctgggaatgcgcgtgcagtggatgtgacggcgtcacgcttgagcgagcagttgggggatgtcaaacatgacgtactgattcatgacatcatgaaccagtacggccccggaagcttgggtgaccgcttgatgcagggcgaaaccattaccgtgccagaaggtgagtatttcgccatgggcgataaccgggacaacagctcagacagccgtgtctggggctttgtggcagaaaaacacctggtggggctagcatatgaaattctcaaagacttctacccaacacggtattggcttgatcggctttttgctggtattaacggcgtttggcatattgggtatggtcgctctaccgtcaaccgcatcgcgcatgatcccatgctgcaaaatgacagtgatatccgcaaggcgtttgaccgccagatggaagtagacagcattcacgaagtgacgggacgcgatttggaagtcagtggtggcgtggttgccatgcgctaccagaaaaagaatcagctaccagtttgcgcagttagagctgttgcaacaagcacttacacaccgcagcttctctgcgaccgtttacgtgccaagttggtcaaagagtccagtttagccgaaatcgcaacagatttgcatttgggcgatgcgctcaaattgggtgagggggaactgaaaagtgcaggctggcggcgtccttccattttggccgatgcactcgaggcaattgtgggtgcagtgtacctggacggtggctttgatgccgcacagcaagtggttgccttattgtatcgcgacaagctcagcaccatagatcccaaagccatcgacaaagatgccaaatcacagttgcaggaatacctgcaaagtaaaaagatggagttacctgaatatcagccgccgtgtggccgagcaacaagcggccaaattggccatggacaatattcaatcatgacagaacttattcccgctgcagacgatttccgttgtggcaccgtcgctattgttggccgtcccaatgtcggcaagtcgaccttgcttaaccatattttgggcatgaagctggcgatcacttcgcgtaaagcacagaccacgcgtcaccgtttgctagggatacataccacggaagacacacagtttctgtttgtcgatacgccaggattccagcaaaaacatctcaacgccttaaacaagtcgctgaacaaaaccgtcacccaggtgctgactgaagtggatgtcgtgttattcgtgatcgagcccatgaagctgggtgaggcagacgaactggtgctgaagttgctgcctaaaaacaaaccggtcttgctggttgtgaacaaggctgatttgatgggtgacaaaggcaacttgctgcctttgatccaggactttgacctgctgtttgatttcgccggcattatcccggtcagtgctaaaaagaatctttacctggatgagttattggctgctgtacgcgagcacttgccgcagcaaccagctatttatgctgaagatgagttgactgacaagaatgaacgcttcctggcagctgaactggtgcgtgaaaaagtcttccgcttgctaggcgatgaagtgccttattcagtcacggtagaaattgaaaagtttgagacggtcaaaaacctgcgccgtatttttgcggccattattgtcgataaagatagccagaaaccgatgattattggcaagggtggagagaaactcaagcagatttccactgaagcacgccaagacatggaaaaattattcggttccaag

SEQ ID NO: 24149 - DNA, 213 bp, Glycine max
  Peptide Sequence Number=SeqID_140927
atggcgagtttgctgaccatctcccacgtggcaaggaaaacgccagtggtgatggcgagttcataccacctgcaaatcgccaccccttctggcgagtctgagcacaggggagttgcaactgccattggcaacttgagggcaagttgcaactcccaccagcaagttagggaagaagaattagccagtactggtagcgatttaagggttatataa

SEQ ID NO: 24150 - DNA, 1893 bp, Glycine max
  Peptide Sequence Number=SeqID_140928
gtttctatcaatcatgccttgaacatgctgatctggcatattgccgaggcgggcattgagattgcggcactggtgaagcagggggcattggaaggggtcaccgaaaaaatgaccactaccaatgtccagggggaaacccagatgcaactggatatccgtagtcacgagattgcagtggcccagttgcggacatcggctgttgtggctgccgtgttgtctgaagaagaggatgatcctgtgttgtttgaaacgctggatgcgccttttctggtcagcatggatcctttggatggttcttccaatttagcgattaatggcgtggtcggcagtatcttctcggtattacccaataccggcgtagcaaccctgggcgagcaggcttttttacagccgggtcaggatcagcgggcagccgcgtatatcatgtacgggccagcgactttgctggtattgacgattggccaaggcacgcatgtgtttacattggaccacagcaagcaggtgtttgtgttaacgcagcaaaccgtcaatattcctgaggagacctcagaatttgccatcaacgccagtaatcaacgctattggcaacctggcgtgcagcggtatattgcagaatgcctgcaaggtgccgaaggtccgcgtgcgcgtgactttaatatgcgctggtgtgccagtatggtgatggatgtacatcgtattttaacgcgtggcggtgtgttcctgtacccccgcgatagcaaacaacccgtgaaggccggtcgcttaaggctattgtatgaagccaaccccatgagcctgttagtgacgcaagccggcggggaaagtatagatgggctggaggatgttctggcgatacgacctagcgcctgccatcagcgcgtaccggagtgttacatggcattgatctcgctcaggcaattactcgaccacgccgcggaaaatagttatggttatccggcattcaatatcaataatatggagcagatactctccatcatgaaggccgcagatgaagtggatagtgcggtgattttgcaggcatcagccggggcaagaggctatgccggggagtcattcctgcgcaagatggtagaagctgccattgagcaatatccgcatatccccgtgtgtatgcaccaggatcatgggacctcacccaagatttgccagatggcgatccgtagcgggttttccagtgtgatgatggatggctctttaaaagaggatcataaaacgcctgccacttacgagtacaacgtcgatgtcacgcgccgtgtcgtcgagtttgcacatgcggtgggggtttcggtagaaggtgagcttggtgtgctcggctcactggaaaccggcatggctggtgaagaggatggtgtgggtgctgaaggtaaactggatgaatcgcaattgttaactgacccggatgaagcagccgcttttgtagaggcgaccaaggtcgatgccctggcgattgcgattggtaccagtcatggcgcgtataaatttacccgtccgccttcagatgatacgctgtcgattgaacgtatccgtgaaattcatgccaaaatccctaacacgcatttggtgatgcatggctcttccagcgtgccgcagtccctgctggaacaaatccggcactatggcggcaatatcaaggaaacctatggcgtgccggtctctcaaattgtggagggcattaaaaatggggtgcgtaaggtcaatattgataccgatatccgcttggccatgactgctgcgatccgtgcccatctggcgcagcatcctgaggactttgatccgcgacaatatttcaaagaagcgaccattgccgcgcagcatttatgtaaagaacgctttgaggcctttggtagtgccggacaagcgagtaagataaag

SEQ ID NO: 24151 - DNA, 495 bp, Glycine max
  Peptide Sequence Number=SeqID_140929
atgggttcgtttctaaaatatttgcaacatggggcacttttttacgtgggaatgattgcatgcaagacccaaaccgccgttgccaatggcgagtttggtgtcaaagccatagggaaccgccagtcaaactggcgagttccaatagctgagggtgtagcaggtctagtctgccatggcagtgcagtgcagcatgcaggagcgcgtcgtcaaggccaaatcgccattaccattggcgatttgccttgcccacggatcgccaacatggctggcgggttgcttcaaaatattggtttttccattataaaagctgagctccgagagtgcgcagctacacttccttcgttcctttgcttccattgctttgcttccattgctttgctattgttcttcataagtttctcaggctgtgatttgtttcactccttatacgtggtttgtctcgtcttctcgtcttcatattacgtgacttctctgtacttgataagtgattcttaa

SEQ ID NO: 24152 - DNA, 426 bp, Glycine max
  Peptide Sequence Number=SeqID_140930
atggttatgggagatttcatcagcggactctccttccccgcatgtttgcattttagtggagaaaacaccgagactttttcaagtctcacaagttatccagaactacgtaggtctgagttcctcattggaggatacgtaggagcaagagcctcgcttttgtcgaccacactgccttttgttgccatgactcaagagctggtagcccgcggagacaccttacggttatccgcacctcgtcattcagtgatcccaagtgtgattgacgagcagagaccaatatggtcatctgcgccctttccggagatgtcagcattttccgatggagacttttcaagtctcacaagttatccagaactacgtaggtctgagttcctcattggaggatacgtaggagcaagagctttgcttttgtcggccgccccataa

SEQ ID NO: 24153 - DNA, 120 bp, Glycine max
  Peptide Sequence Number=SeqID_140931
atggattcaccatgtgtaagtttgagtcaacttagtgatggtgcagttagtgcagaggttgattttcttgaagttacaccaaagaaaaagattgaatggattaaagatttcaaggagtaa

SEQ ID NO: 24154 - DNA, 1623 bp, Glycine max
  Peptide Sequence Number=SeqID_140932
atgatttacgctatttcttctcagaacccattggtgcggagcatgccaagaatccataaacatcgcaaaaaaccatctctgccaccgaatttaagacctataacttgtttccaaaactatagtaaccccaacagcaacagtgccgtcaataacagacccacattcacagcgaacacggtgacgaggcacgttttcgttaaggagaagtacgaggagaaagagagggaatttgttggttactgcaacagcagcaacagacaaatgatgttgttgtgtgggttaggctattgggtgcaaggcttcaggtgttttccgtggctggcactgaactttcacatggccggcaacctcaacttgcacccgtccacgttgcagctcgtgcagaacttcgctaatataccaatggtggctaagccactctatggaatactttcggatgctatctatattaagggtgctcacagaataccttatgttgtcataggaggtcttctgcaagtattttcttggagtcttctggcattggtccccgttgcacacaaagtgcttcccaacttaattgcatctgtgcttctcagcaatttcggcgcatccattacagaagtagcacaagatgctcttgtagcagagtatggcaagaagcacaaaattggtggtcttcagtcatatgcattcatggcattagctgcaggtggaatcttaggcaacttgattggtggttatttcttactgaaattgcctcccagaatcatttttttcatattttcatccttactgtctctacaactagcaatttctttctcaacaagggaggagtctttaggcatagcacaactttcagctcaaaatcttgctaagagatccatctcagaaaatatcaaaaaccaagtctctgatcttgtcatggctatcagcgacaagagcatttctaagccccttgtatggattgttggatcaattgccatggttccaatgctttcaggctctatattttgctatcagacacagcgtctatatcttgatcctacagtaattgggtgttctcgagtaattggccagtttgcgcttctttcaggaaccgtgctttataaccattattggaaaaaaattccaccgagaaggctgataggcatggtgcaggttctatatgcttcatctctacttcttgatctcgttttggttaaccagataaatctcaaatggggaattcagaatgatgtgtttgctctttgcttttctggtttagcagaagttgtggctcagtttaagctccttcctttctcagttttatttgcaaatttatgtccaaagggctgtgaaggatctctcgccgcattccttgcatcagctttgtgtgtatcatcaatagccagtgcctttctgggtgttggattggcatcttgccttggcattacatccggtgattactcgggcttgacgaggggaattcttgtgcagttcattgcagctttagtaccattaagatggattcattctttaccaatgacacaactggttgagaagcgaaggagaagaagtatgagcagaaaagcacgcagaaacagaagagttggaaaagttgtgcttggttatgttaacgtctacaggcctgagagagaatga

SEQ ID NO: 24155 - DNA, 1254 bp, Glycine max
  Peptide Sequence Number=SeqID_140933
atgaggtttaggagccaaaggatagtagtggagatcaagggtgggccacaactatccagaactttggtttctgcccagacacttctcaaactccctgaaatagaagaggcttgtaggctatgggattgtgctcaggtctttgttgaaaggaaaagactgccacctacaagggaggttgatcatcgtattcctgtcaaattaggaatagatccggtcaatgtgtggtcatacaggtacccttacttgcagaagaatggaattgaaaaccaagttgtagagatgttaacattaggaatcataagatccaacaattgtccatactctagtcttgtcattctggttaagaagaaaaatggtagctggagattttgcattgattatcgagccctcaataagttgggaggcgcatttggacaccttagatttgtcctaacactacagattctgaatgagttctttgccaatttcaaaaggtgcagctttggtagaaaaaaggtggaatacttgggccatattatttctggagcaggcgtgaccatggataggaagaaagtggatgttgtgttgaaatggcttgtgcctaaaacagtgaaattagtcaagggatttcttggtttggctgggtattatagaaggtttattgaaggctatggcaggataacaagaccacttactaatctgttaaagaaagagggtttcaagtggggaaaggatagtgcagaagcttttacacaattgcagaaggcattgactactgcccctgtacctacattaccagatttttctcagccattcaccattgaatgtgatgcttctagcaaaggaattggggttatgttttccctaaataaaaaagtagtagcttatttcagtaagcgtttatctgaggcttctctaaggaaatcagtatatgaaaaaaaagttaatggctttagttttggctattcatcattggaggtcatatttggggggcagaaaatttacaatatatacttatcaaaagagtttaaaatatttactagatcaaaggataactactcaaagccaacagaattggttgcaaagcttttggggtatgaattcgatattgtttacaaaactggggccacaaataaggtggccgatgctttatcaaggagagaaaaggataaggagctgcagagagttatcaaaccttacttgcaaggggttaataatattgatagggaggttgaggctgatcccattctttctaaaatcaaggaagacttgtag

SEQ ID NO: 24156 - DNA, 918 bp, Glycine max
  Peptide Sequence Number=SeqID_140934
atgaagcaatctgagatgattattgcttttcacatatgccaaaggagcaaatatctaacctctccagttgaactattgcaacccttacctatccctaatgttgtatgggaagatattagcatggatttcataatagggttgcctaaatcaaaagggtttgactctattctagtagttatggacaaattaagcaagtatggccactttctgttattaaaacacccttattcagcacgatcagttgctgatgtgtttgttacggaaattatcaggctgcatggtattcctgcatcaatagtcagtgatagagactctatattccttagtaaattttggcaagaattattcaagatgcaaggcacaaaattgaaaatgagcacaagatatcaccatcaatcagatgggcaaatagaagttctaaacaaaatcctagaaacctatcttagatgtttcagttctaagcagcctaaggcatgggctgattttattccttgggtagaatattggtacaacacaacttatcaaggggcagccaaatgcaccccttttgaaatagtgtatgggaaggtgcctccttttctttgccaaatttattccaggggagatgaggtcctgcaacaactcaagttccatttgggaagagctcaagatcacatgatcaagtgtgccaatgcctatagaataccttcaaggatcaaagaaggggacttggtgtatttgaagatccgaccccataggcaagtatctatgccaagtaggttacatcctaaatcgacagcaaggttttatggtccttatctggtggtgaagaagattggaactgtggctttcgaactgcaacttcctgctgaagctcaaattcatttagtttttcatgtatcccaactaaagctggcaataggcacttatatagcttaa

SEQ ID NO: 24157 - DNA, 821 bp, Glycine max
  Peptide Sequence Number=SeqID_140935
atgcccaacaaacaacaaaatcccaaaaacaccaacgccactaacaccactctgctcagctcaagttgtttactaccgatcgggaatgcgaagcttcttaacaacaacaccaccatcacaaaaacactattctactccgttgaaacgatgtcgcttcacccaaaccctagcctcactcctccaccagccacaccagcgttaaagccctggctcaacaccaccgccaccacggagcccctcaaccctatggtcctcgccatgcacctctccgaccccaaatctaaaaccctaatccccaattccacactaatcataatggacagaacccttcttttatcggacgagcttctcctccgaatcctctccaagctccccaattcgcagcagcagcggaactccaactccttagtctgcaaacgctggctgaacctccagggtcggctcgtccgaaccttgcgtgtcctcgattggaacttcgtcctctcgggtcggttaattattcgcttcccgaacctgaaccacgtggacttggtcccaggttcgttcacttcttctgtatactcatcgattgtcgtaagccacaggctcgtttcgatgcacgtggattccgcgtggcgaatcggcgtcgaaaaaaacctgttaccggtcgagacggttgacgccggactcaaatcgctcgcgggcgggtgccctaatttacgcaagctcgaggtggcaggttgcagcgaggccgggatttcgacgattggcgcggaatgtgttactctgcaggagctcgagctgcagaggtgcgacgacgccgttttgggaggcgttgcagg

SEQ ID NO: 24158 - DNA, 141 bp, Glycine max
  Peptide Sequence Number=SeqID_140936
atggcacgtactccgaatgagattaagtttattgatgggtcaagagaaacccttaaacttgctgtaaggatcacgaatctttggttcgttgggactcccaacaagtctgaacaagctgaaatggttattgttgattctgat

SEQ ID NO: 24159 - DNA, 477 bp, Glycine max
  Peptide Sequence Number=SeqID_140937
atggaatctaaaagcgtagatctcagagcttcagccgcacatctacaacggtggggaggaggcgaaactgttgggggctttgttgtcaagggtggaggaagaaaaaggagaaaggggttagttgtgggtggtggagctcggagcggaaaaatgttgttgacggtgatggtggttaaggtggaaggggcgcgagatgaagaaagggcgacattgagaatggaacagcctatcgtgagagtgagagtgaagcagagtgtgagtggacatggtggagctcgaagtggaaagatgttgccggtgatgggggttagggcaggactttattggaacaaggatcaaggaaacatagtgaatgggaagggaacgagaggaagaaagggtgacattgagaatggaagagcctatcgtgagagtgagagtgaagcagagtgtgagtgggtgaaacacgggagtactttcccgagaaacaaagaataa

SEQ ID NO: 24160 - DNA, 177 bp, Glycine max
  Peptide Sequence Number=SeqID_140938
atggctgctagggtctcgatacgttttggcacgaaggagcgaaggttgctcgagtatttggaatctgagcaaagacttgaaaaatggtactctttgaatccatttgggactgctatggcagttgttggtttggtagcatgtcgtgcatatgcagttaaaaagaattcctctggttag

SEQ ID NO: 24161 - DNA, 1488 bp, Glycine max
  Peptide Sequence Number=SeqID_140939
atggaagccgctgacgtggtcgaaacgacgacgaatcaatctgaacgggattcggagaagaagtgtttgagaacagagattgatacttcagcgccttttgaatcggtgaaggaagctgttacaatgttcggggtggatattagaaaccccttcacatacttaatacatagtagtgatatgtggtggtcattgtggacaaatgcagccacaattgtggtagttgtggtggcagagactcccaaatttgcagctgaaatcgtgcaccatgcagaagagcttggcgctgaaaaactggaggagcaggctatgctattggagaaagaacttatcttgaaagaaagggaaactcttgatgtattgaaagaattggaaattgttgatgagaatgaagaaaaggaaaaccaagtgaatcaattgaatgttcttcaaccttccggggaaggttttatcccctacccctcatctactcctgggttgatactaatgaaattgaagcaggccaaattgaatttaactaaaactactaatgaccttgctgacatatcttctcttgaggaagagctaaaccaaaccaggttaaggctgcaaatagaaaaagatgctgaaattaaaggtgctccagatgacccttcagatattacaagagagctccagcgattgagttctgaggcagagaatttcaaaagaatgggagaatctgcaaaatcagaagttttgagaacaatgtctgagattgaacagacaaaaacgatgataagaattgctgagatcagattggttgtagccagaaaaatgaaagaagctgctagagctaccgaagcttttgcccttgcagaaattaatgttctatctaatcatgacagttcaccaggaaatcaggttactctttcatttgaagagtatactgctctgacgggcaaagctcgagatgcagaggaacaatctaagaagagagttgcaagttctatgcttgaagttgacgaaacaagtttgtcgaacatggacattttgaaaagggtagaagaagctacagaagaagttaaaactagcaagaaggcccttgaagaagctctagaaggggtagaagctgcgaatagagacaaagtagcagttgaagaggctttaaggaattggcgatctgagggtcaaaaaaggcgttcttctatacacaactctaccaagttcaaaaattgttgtttgtctcatcattggagagatcctcgattacttgatgtgaatggattgcatctggtaaatgatgaagcaaagccagtaaagccaaccctatcaataggacaaatacttagcaggaagctgcttcaaccacaagaatttgaagccggagaaggaatctcgatgaaacagaatgtgccactgggtcagatgcttgacaaacagaacaatgatcgaccagttgacagacaagttgagaaagaaaccggccataagctgttttctaccaagagaaagaaatttggatttgcatga

SEQ ID NO: 24162 - DNA, 1023 bp, Glycine max
  Peptide Sequence Number=SeqID_140940
atggcacaaaagggagtaatgttgcagttcttttcactgctctcaatctctaaggcctctctttgtttttcactgctactctctctctcttttcactattccattggttcaccgttgcactcctcatttcaccatggcatcatctcaaccaccaactcaacaaccaattccctaggtgatgcaattggggttgctgatccagctagattcagtagacagcatactagactcgctacagttgctcctgttgaagaggaggagaaggaagaacatatctttgatgacgagaaacaagacacggggaagacattggaatttgagatagtgattctatttaaggaatcactttatcatcctgatgttagcaaggatccacacgctgctgaattattcaagagcatccatcatgcatatgaagtcctatctaatgaagcaacgagagttcagtatgatcaagaacttcaatttggtcacaagccttacagggaaaaatggagttacagcactgaatttgaagatcaggcaagattctataggtgggaccgcatgaggaaaaaaatggatagggaaagatactgggagaattacaatgtcaatgaggactactacaccagtgaaacagatgaggaagaagatgaagtagtagatttagatgaagagaggggttcttttgttgaagtgcttagatcagcattcatgtcattatttttgcttcagacgcttggatcccgtttctcactcacattcagcagtctgatggcattgtttgataagaaattagacaccggctataaaatgggctatgtaatagcatggattttgggtgggaggggtggcatattgctaacactatgcttgtcatttgcaagttgggtttgcgggaaaaccagtagtagtgttgtcgcactagttgtggtggccttgtgggttggctcataccttgcaaggtatgcaccacttccccaaggtgctctattagctcttctctacatgtccattaagctacagtctgacctaatataa

SEQ ID NO: 24163 - DNA, 3069 bp, Glycine max
  Peptide Sequence Number=SeqID_140941
atggaggaggaaagttccaattgcatcgacaacgagagggatctcatccgcaacatctgcatcctagcgcacgtcgaccacggcaagaccaccctcgccgaccacctcatcgccgccgcgggcggcggcgtcgtccacccaaagctcgccggccgcgtccgcttcatggactacctggacgaggagcagcgccgcgccatcacgatgaagagctcctccatcctcctccgctatgccggccgctacgcggtgaacctcatcgactcccccggccacatcgacttctgcagcgaggtctccaccgccgcccgactcagcgacggcgccctcctcctcgtcgacgccgtcgaaggcgtccacatccagacccacgccgtcctccgccagtgctggatcgagcgcctcaccccctgcctcgtcctcaacaaactcgaccgcttaatcaccgagctcaaacttaccccctctgaggcctacacgcgcctcttacgaatcgttcacgaggtcaacggaatagtcagcgcttataaatccgaaaagtatctcaccgacgtggattccctcctcgccggaaccggcaacggcaccaccaccggcgagaccctcgaggactacgatgataacgaggatgtttttcagccgcagaaaggtaatgttatattcgcatgcgctttagatggttggggatttgggattcgtgagtttgcggagatttatgcttctaagcttggggcgagtgtgaatgccttgctgagggcgttgtggggacagaggtattataaccctaagacgaagatgattgttgggaagaaaggggttggggggaataagaagcctatgtttgttcagtttgtgttggagcccttgtggcaggtgtatcagggggccttggaaggggataaggggctggtggagaaggttattaggacctttagtttgtcggtgccgcagcgggagctgcagaacaaggatgtcaaggttgtgctgcaggcggttatgagccgctggcttccgctttcggaggcggttttgtccatggtggttaggtgtttgccggacccggtgacggcgcaggcatttaggatatccaggttgattcccaagaaggaggttattggggatgtggagggggttgagggtttggtggaggaggcggagttggcgaggaattcggtggaggagtgtgattgtcgggacgaggctccttgtgtggcttttgtgtccaagatgtttgctgttccggttaagatgctgcctggacacagggtggaggttggcaatggttatggtgatgaaggagagagtgagtcggatgagtgttttttggcgtttgctaggatttttagtggggttttgcatgctgggcagagaatttttgtgctttctgcattgtatgatccggtgaaaggggagtcgatgcagaagcatattcaggaggctgagttgaaatccctgtatttgatgatggggcaagggttgaaagtagtgacatctgccagggctgggaatattgttgccattgcaggccttgggcagcatatattgaagagtgctactctttcttctactaagaactgttggcctttttcgagtatggcattccaagttgctccaactttgagagttgcaattgagccgtctgatcctgctgatgtgggtgcattgctcaaaggcttgaggcttttgaatcgagcagatccgtttgttgaggtcaccgtgtctggaaggggagagcatgttcttgctgctgctggggaagttcatcttgagagatgcataaaggatttaaaggagaggtttgccaaggtaagcttggaggtctctccgcctctcgtgtcctacaaagaaaccattgagggagacgtattgaacgtgatggaaaatttgaaagttcttagcaggagatcatcagattatgttgaaaaaacaacacccaatggaagatgtgttgttcgggtgcaggtgatgaaacttctaccttctttgacgaaggtgctcgatgaaagctctgatttacttggagatattattggagtaaagtcggggcaaagaccgagtattcttgaaaacgataacccagttgaagtgctaaaaaaacgcatattggatgcagtggagggtgatattttgagcaggaatgaaaatgacaaggaccatgctgagaaatgtaaattgaagtggctaaagattttgaggaggatatgggcacttggaccaaggcaaattggtccgaaccttctctttactcctgatattaaagcacaaagcaccaatagctctgtcttaatacgtggttctcctcgcatatcagaaaggctgggctttgtggccgattctagtatcaatgactcagttgatgagacgtcttcaaatgcaaactcagctttatacatggatgctgagcaccttgagagtagtgttatatctggtttccaattggccacttcagctggacccttgtgtgatgaacctatgtggggtttggcatttgtcgttgaggcacggttatctccatttccaggacagcatgatgaatctgaaacgcaccaacaatcggagcagtacggcatatttgcagggcaggtaattgcaactgtcaaagatgcttgtagagcagctgtggttcagaataaaccacggctggtggaagcaatgtatttttgtgaattgaatacacctactgaatatttgggtcccatgtatgctgtactttcccgaagacgggcccgagtattgaaggaagagatgcaagaaggttcccctttcttcactgtgcatgcgtatcttcctgtttctgagagctttggttttgcggatgagcttagaaggtggacttctggtgccgcaagtgcacttcttgtccttagccactgggaagcacttcctgaggatcctttctttgtacctaaaacggaagaggaaattgaagagtttggagatggttctagtgttcttccaaatacggcaagaaaattgattaatgcagtcagacggcgtaagggccttcctgtggaggaaaaggtagtgcagcatggaacaaagcagaggacactggctcgtaaagtctga

SEQ ID NO: 24164 - DNA, 1869 bp, Glycine max
  Peptide Sequence Number=SeqID_140942
atggctgcttctagggagaaaagaagagcatctctggaagaaacgttgcaacaacttcgccatgtcacaaactccactgctgtcgctgcttccatgagctgggcctccgccgtgccgtcgacgatgacggcagagggagatggtggtgttgagcaccacatgctgacttttgatgggcctggtagtgataattgggcccggaagaagaagaagatgtcgtacctgttgcctcacttgcactctgggtgggcggttgatcaagcaatcctggcagaagaggagcgtctggtcgtgatccgtttcgggcacgactgggacgaaacctgcatgcagatggacgaggtgttggcgtcggtggcggagacgataaagaactttgcggtgatatacctggttgacataacggaggtgccggatttcaacaccatgtacgagctctacgacccttccacggtgatgttcttcttcaggaacaagcacatcatgattgatctgggaaccggtaacaacaacaagatcaactgggctctcaaggacaagcaggagttcatcgacattgttgagaccgtctaccgtggagccaggaagggacgtggtctcgtcatcgctcccaaagattactccaccaagcttttccctttccttttcctcctccttgttctcttgttcaattatggcttttctgagtctggtgttggtgctggctaccaactcatggtggcagttcctgtggagtatgaagtgaattttaaagggagggcttttcttgtggagaccaatcagactgcaccaaatttcagagtggcattgagcattgaggccatcaatgggaaatactcatgctcattggaagttttccttggggatgtgaaggtgtgggattctggccattactccaggttttacataactgagaaatgcttgctagaacttaccatggatggagatttaaggctgaaaggtccaaaagaaagagtgggatggaagactgggacttctggacaaggtgtgaagcaacttgatgtggcaactcgcttgacgtcttcccaaagcaactcaagtttgttctacttctcttttgaaatcgaggacaagaaggttgcattgtacttgaactatggtaagttgaggtattcttactggggttttcagcctaccatgaacagaagtattacatatattaagctgagttcaagagggttgttgttgtttgatgtcaaatacaagaaaatagcacaaattccatcggaggggattcatccacttagatttctagcactgaataatgaaacaggaaaccttggcctttatcactattcacccgagaaaggaaagtttgaggcctcttttcaagctcttaacagcacatgtgatcttccaatttcttgtaggccttatgggatatgcacattctccaattcttgttcatgtattcagcttttggcaaatgaaaacaaaggtggtgctgattgcagtggaggaatcacaggagggttttgcaatggtaaagaggcggaaatgctagaaatagataatataagtagtgtgcttaaaaatgttactagggtggactgtaaatgtgctgctgctttgtattttgggaatgcaagcacagatgaggcagaatgttacctttacagactagtgctgggtctcaaacaggtagaaaaaggcacaggatttagttacatggttaaggtcccaaagggaactgttaaaagccatgagaggcataatgttaaaagatgggtgttgattgtggctggaggggttgatggactcattgttctacttcttgttggaggatttggatattggttggttaaaaggagaagttatagcttacattctcgggccggcactacatga

SEQ ID NO: 24165 - DNA, 1206 bp, Glycine max
  Peptide Sequence Number=SeqID_140943
atgtctgatcacgaagaccatgcagactacgcagacaatgaatcctttgcaaagcgtaggttcagggataggtccaaggaggcattgtccaaacaagccgttaagttagccaaacaagctgaagagcatgaaaggttcatcaacaaggtgactcatcttttgggggttcttggctttggttggttttgcttcatctttggggcaaggccacaagccgttcccttggtatattgtttgttctatgtggtatttgttcctctccgttggatatattacaggttcaagaaatggcattactatctcctggatttttgctattatgccaatacaatcttcttggtttacctccttttctacccaagcaatgaaaagcttttcctggtttgcttttcatttgctgaggggccattagcgtgggctttaattgtttggcgctgtagcttagttttcagttcggttgacaagattgtcagtgttcttatccatcttttgcctggattggttttctttaccattcgatggtggaatcctgcaacctttgaagccttgcgaccagtgggaacagctagaagatctacatggccttacatcgaagataaatcctatctctggatgtggctgtttctggttcccttagcagtttatattctctggcaggttctatacttcctcattgttaacgtcttgcgccgacaacggtttttaagagatcctgaagtcatgacttcctacagggaactctccaaaaaagctcagaaagcaaacaatatttggtggcgtttaagcggcttacttggggatcaaaatcgcttgttaatgtacattgtgcttcaaggcatattcactgtggcaaccactgctctgactgttcccatattcttgtcatatgaattgtctgtagtcttccaattgctgaagatttctgcgtcggtgtggaatgggggaagtttcctaatagatgtgatgcctaggcagatactaacaaattttagtgcacatgtccttacggcttgtaatgtccctgccacatatttgtgtccgtacaaaagttgcttcaaaatctacaaggaaattgatatcgatataatcagatccatcttgaaaatctcatcaatgtgtgggaggtcaaagagtttcattcatgagggcaaatttcataacttctggctagaaaatggcattctcccgagtattaatcctccttag

SEQ ID NO: 24166 - DNA, 882 bp, Glycine max
  Peptide Sequence Number=SeqID_140944
tgagataactgttgagctcgacgatcacgagttcacgacgatccgctctcccgccgccggctcctcccgacgccgccgcagcctcccgtcggtgaagacacgatcggagcgcaagagtgatcgaaggaagagcaccgtgaagagagagatggcgatgatttgggcttcagttctctccaatcagagaaagaaaaagaagaaacaaaagacaaagaataatgaaaatcaggatccgcaatacgatgataatgccgatgaattaacgaataacacgacagtgccaccacctccaccgccacctccgcctctgccttcagtgtttcacagtctattccgaaaaggactaggcaagagcaagaaaatccactcggtgtcggcgccacctccgccgccgcctcctccgccgtctaaacgcaagagccagacccctccaccgccggagcctcctcagcggagaaactccggccgtccacctctccctaacagaacggtcaccttcaacgacgagactctaaacgccggcaaccagtcgccgttaattccagttccaccgccgccgccaccgtttaagatgaaggcgatgaagttcgtagttcgcggagatttcgttaagatacgtagcaaccaaagctcgcggtgtagctctccagaacgcgaggacattattaatgcgtcggaaactacaatcaataacgacgccgttactgacgccgtcaatgacaccgttaacgacagcgttatggatcccaacgttttctgtcccagccccgatgtgaatgcgaaagccgcaacgttcattgctcggctcaggggagaatggaggctcgaaaagcttaactcgttgaaggagaaagacaataatggttcattgccttgtagctt

SEQ ID NO: 24167 - DNA, 186 bp, Glycine max
  Peptide Sequence Number=SeqID_140945
atggggagggagagggggaaagaaggagtagccacaaaaggaagggatgttgtcagtgtgggtgtgctattgaagaagggatgttgttacaagggagtcaatgagcgtgtgacaccagcattggctcgtgacagatttctcacgtgtccatgtctctccaggggcaatatgggcacctacaaatag

SEQ ID NO: 24168 - DNA, 141 bp, Glycine max
  Peptide Sequence Number=SeqID_140946
ggtggtggtgacaaggactacaaggaggtacccccacctcctttgtttaaacctgcagggggacacatcaaccaagctgtgactttcaacagatcttattacaaggtaatcagttcaatggaaaaatggttgagtcactag

SEQ ID NO: 24169 - DNA, 587 bp, Glycine max
  Peptide Sequence Number=SeqID_140947
atgccccgccgtcgttcctggcactcttcgccacccttactgagccctccgctacttatcattctcttccccattgtgatcctcacgctcctcttcctcgccgtgccgccgatcctctccgccgtcacgcgcctcctccgctcggcatcctccgacgtcaagaccagctgggactccctcaacatcctcctcgtcgttttcgccatcctatgcggcgtgttcgccagacgaaacaacgacgacgaacagaccccgaataaccacgtgcaccagcacgacgacgatgccgtttcggatcgaaacgctgcgtttcgtcgtttgcattcggagggacaatcgcagtggttcgggttcgcagaagaaagaaaggtgtatggtaacgatacacctcttaaccagttgcagtcactggataccgggggaaaccggttgaggatgagacgaaacagcagctcttatccagatctgcgccagtgggaaactggcgatgaccggtacaagttccgcttctacgacgatttcgaaattgacaagccgttccgctcgccggctagggagcacttccccgccgtcgaacaccgcaaacg

SEQ ID NO: 24170 - DNA, 255 bp, Glycine max
  Peptide Sequence Number=SeqID_140948
atgcatcttattgtcatgctcgcgaacattccaaaggacaacgaatatgaactcgttggttgcaaagttttcaaggtatttttggagtcgttgcaagtgtgtcttgcaatgaccgtagaaaagtgccgaatgttgcaatggaggacacaatggtggtggtgccaacgtgcacagacggaagagcggccagtggtagggagttggaaagggtggcaaaggtccaaaatgtcagagtcgaagacacaatggcaataa

SEQ ID NO: 24171 - DNA, 330 bp, Glycine max
  Peptide Sequence Number=SeqID_140949
atgtcctcggttaaagagaaaaagatacttggaagacaagaaaatgaaaagtttgatgatatccttggtaggaaaaggccagggtttaagttggtacttggacagtggatgctcacaaaagatgatggggaaaagtttatgttctcctacctaaaacccattaaaggaggaatagttgcttttggcggcatgggtaaaggaaagattacgggtataggtaaaattggtgatgtagctccaagtagagcttgtatgccttggatcttgttcatcaatggagtcctttgcttcttgaagatcaatggcagtggaatggaggagaaaaggtga

SEQ ID NO: 24172 - DNA, 303 bp, Glycine max
  Peptide Sequence Number=SeqID_140950
atggccacttcatcatctatggatactttagagatgttatcggaggcatcaaactcattcatttgtaccttcaaagccctagatgagctctttctttcttcacgtttggagttggtttctccagttctgagctttggtaaagacccagaaaccaagccaagactgaagggcaaaaagtcatttctgcaatatttcatagtgtcattcgcccaggccagcaaccagctcattaaggctagtgaagtttcttcaaacctaagcaaggaactcgcctgtgtgagtgcagcttgcctgggtgagtaa

SEQ ID NO: 24173 - DNA, 618 bp, Glycine max
  Peptide Sequence Number=SeqID_140951
atggataagagcttgaagctcgcccaggctagcctttggctcacttgggcccccaaattacttcaaggtgaaggaaccagattgcctgggcaaactaattacttcaggagtaagcatcagctcgagttggcaaactccagctcgcctgggcgagctgccattaccccaagtgcccattttcctataaataggcgtgctagggaggctgaggggaggagggaaggtttagtacttgagggaattgcgagaattaagagagaagaggaagaaagaagagtaaatgaagccgaggcactgccaaatcctaactgtgatcaatctctatgttgttccttgttcggtgttctttgtatgactatcgctgtctctagaatatgtccattggatttaatgatgaaatctgtacaatttcagttgagcttagctcatcagtgggctaaacgcgcatccaacgttaagcgtagcttcagcgcgcttagtgcaagggaagaatctggtagagcatcaatatcaaggccacgcgctaagtgcgagatcagtgcgctaagcgcatcagttgtcttaagccaggctcagggcacaattggcgctaagctcaaatccatttactcatgctaa

SEQ ID NO: 24174 - DNA, 369 bp, Glycine max
  Peptide Sequence Number=SeqID_140952
atgatgagttcgttttggtggggttcgaacaactactcatccttctggtgggaaaaaatttcaatgaagaaagaacatagagacataggaaagcaaggtcttgaaaacctaacagatgcaaatcttatcaaccaagcgaatctcgaatggaacaagccatcaataaaggatttattcaataatgaagatgctgaaaacattctaaaaattccattgttgttcacggacgatgttggctgtatcctcaagaggcataacattgaaggtacttacattgtcaaaactgcataccatagtatcatggaggacattctcgacattgaccatttgaagatgttgagtcaaaggacgtttatgtttgaaagatga

SEQ ID NO: 24175 - DNA, 900 bp, Glycine max
  Peptide Sequence Number=SeqID_140953
atggcactaaatgagcaaaagggcaaggatgatatcccaaaaagtcaatatcagaaaggagtgaaacacttgtgtgagaaaggtcatcttaatgcggtgcctaagaagtacatacttcctgtttccgaaagacccaccaagagtagtgtagagcattcaaatgttgtgaagcaaaatcttcaattacccatcattgatttttccgaattgcttggttcaaataggccccaagtccttcgatccctagccaatgcttgtcaacactatggatttttccagctggtaaatcattgcatctcggaggatgttgtgaggaggatgatagatgtgaatgggaggttcttcgatctccctttggaggagagagctaagtacatgacaactgatatgcgagcactgattcgatgtgggaccagcttcagtcaaaccaaagacactgtattgtgttggagggatttcttgaaactcctgtgccatcccttaccagatttactcctccattggcctgcttcaccagtggacattcggaaagtggtggccaccaatgcagaagaaaccaaacatttgttcctggcggtgatggaagccatcctagagagcttaggaattgtggaagccaaccaagaagaggatgacaatattctcaaagagtttgaaaatgagagccaaatgatggtggccagtttctacccaccatgccctcaaccagaccttacccttgggatgccccctcactccgactatggcttcctcacacttctcctacaagacgaggtagaaggcttgcaaatccaacaccaagacaaatgggtcaccgttcaaccgattccaaatgccttcgttgtcaatgtcggtgatcacttagagtatgataatttctattcacttcttgttctttga

SEQ ID NO: 24176 - DNA, 198 bp, Glycine max
  Peptide Sequence Number=SeqID_140954
atgggtacccatttaggaaactatattggagagttcatggaatatgacgagaagaataatgtaggaggtagatatcttatatgtgaatcaagaaactatttcattagtttacttgtgaaaacactgtgtgatctctacgagattcgaaaaccaataaatggtacttccatcttaaaatacaaaccatgcatctattaa

SEQ ID NO: 24177 - DNA, 2793 bp, Glycine max
  Peptide Sequence Number=SeqID_140955
atggtggcgtgctattgcatacgtgtcactcatggagtggtggcatgctcttccatatgtgtaactcatggagtggcatgtagtggagacatgggtattgtctgtcctgggttttggagagactcaccaagggcagaccttaggtatgatgagctcgtggagcttgaaaaagatgatggaagtcacaaaccaagaggggggggcttgtggttgaacctttgcgttgtatctccttgctgctcaaagtttggtagcttcttctatgatcctgactatttcttggactttgtttgctgtatcgagctctatccccatgttttcttcattttgctattgttggaacaacaatctcttggtcgatggttccccgacttgaacgggaatcatggcgtctgtgtcatatgtgagtcgggccctgaggatgattttattggctgcctctgtttggtcgttggtctcaagatgttcgatagaggtgaaaaggtgtttaatgcttaccctcgtcaggaagtcttcataggtatgagttttgaattaggtgttattgtcgatgacaacggcctttggcagtggtcccagtatgtccatttcccacatggcaaaaggtcaaggggagctcagactatagagattgtcaggagggggggtcatcctgtctggttcctcctattgtccaaccataacttctttagtgtctatggtggaagtttggagtgtctcctagatgatagtcttgaggtttccgatcattttagtggttgtcagcttgaagagcatgtttgttttggtgttgctctccctcgccttttggccccaacttctcttgctagttttagacctgcaatgagtcggtgctttcctttctcttctaaaaaggctaagctaacagcttcgtcagctactgagagatataggagtcgaggtaatcttggcctgggtcgactatggattggtgggagaaacctagacagggatgctagtcttcaattccatttctggacttcctggacgttagtaggagcacatgtcatatttgcggagctctccaaagacttcttccaaatctgccacgtgttgggctatgctctgagacttcacgaccatgtcgttgacatagacctcgacgtttcgtccgatatgtttcttgaaaatttggtcgatcaatccctaagtaagcgtccaggaagctcaacacctggaacccggacgcgccatcaactagcccttaaatgctgggtggagtatctgacttctctaatgaagttggcattgaggagtttgtccacttcttctttgacagcttttcatcgttcttctctcatcttctttttcatcttctgtgatacctatttagccttgggacagatggcgtgcttgtggaaaataatgctagggttgattctcggcatgtcagatgactgccaagcaaacaagtctatgttcctatgtaagacatcaacgatgtgtctgtgctcatggttggtaagaagtttcgccacatggatctacatcaaattcatcatccaaccttgcttggcagacagtcagggctcgaacaagcgaccccttgtccatgctcatgacttgagtaccttcgaccattgtggggtgcggcttggcagactccctgtcatgacctctcccgccaaggtggggaacttcatcttcaaatctcctagagagctggtcttgactgaaggtggtcataaggttgaaatagcctctagtctctactcgctccctcacgaagccaaggagaccttggacaccatgaagttggtgattatgatggagacaaccatgggtcgtcttgttgatgtcaatgtctcggatggtgtggaggtggtgcttgtaggactggttgtcgaacgggtcttggttaattgtgtctttgtgttcctcgatcttctactctatctattattttgtctgcatcatggttcccatgttgatcctcctaccgcatctaaccccgacctgggaggtttcatcaaaggtagcttgatgggtacctccaagttgaaagtctccttaaggattgtagagaagttggcacttgttcgacttgtgcctcttgtccgacttgtatggttcgtacttggtgcttccttcttgcttgtcgctcttttgtctgactttgttcctgaatctggacatttcttccatctggatgtagtctttggttcgttcgcgcaactcgtccatgctctagggatctggacaacaatgtgtccaaatctatcaatgaatttgtggagagattcatcatctacttgttgcaaactggccaggagtccatcgtaccaagtcaatgtctcccctttgagggacatggggaagacacaacacaagatagcatcgtcattggtgtatagattttcctgggttaggaaagcatccagatgttcatccagatcattggtcccatcatatcgctccaggttgagtggtttccatcctagaggtatgggtgtgattccccttgggtgcgctcaagtaatgtgtgagcggagtgctcgtcaccctaggggcctccagctgatcgtggttagccttcagctttctaagtccctcctcatggcgtcactccatctctgcaatgcggttttcaagttgttggagagtattagtatctggcatgactattatgggaggattggagcctttgaaaggagtctcgcatttgaggccagaccgagtgctaaccatggctccacaatgggcgttaaatgtacttaccaaaatccgaaattggcacatgttagggtggacgtggctaaggagggctcctga

SEQ ID NO: 24178 - DNA, 777 bp, Glycine max
  Peptide Sequence Number=SeqID_140956
atggttctccaaaagctcctagacacttaccagccaattttccaaccgcccacaaccatacccctgacacgattacatgagcaccagattcatcttctacccaattctcaacttgtccatgttaagctgtaccgctatccatacttccaaaaacacgaaatagagctatgggtagaagatatgctttgttgccatcttattaggccaagtcgcagtccatactcttctccggtcttgcttgttaaaaagaaagatggcacatggcgtttttgcatggattacagggccctccacgccgtcacagtcaaggacaggttccttcttccaactattgatgaactcctggatgatttgcataatgctcagtggttctctaggttggaccttgcccagggatttcaccaaattagaatgttgccaacggacatccccaaaactacttttcatgctcacaatggccactatgaatacaatgttatgccgttcgatttatgcaacgcgccaccaacatttcaggtgacgatgaatgacttgttttggccctttgtccgtaagtttgttcttgccttctttgatgacatcttggtttacagccggaatttcgaagaacaccttctacacttggagtctgttcttcgcgcactctgccgtgaacaattctttgtcaagttgtcaaagtgtgccttcggacaacagtgcattgattaccttggacatatcgtcttggccaaggttatcagactcgcgattctatgtagaatcgcggaggcttcgtaa

SEQ ID NO: 24179 - DNA, 885 bp, Glycine max
  Peptide Sequence Number=SeqID_140957
atggataatgaagtgaatgagttggaaaggatcctggaggttatgagcaaggcggttcttcaggacatcctcacatatgtcatgagagcttatcttttaccaaaattatttacagtggatttggagtgtatgctaaatttctattggtggggcacaaatggtaagggtgttaaatggatgagatgggagaaaatcacagttcaaaaggagttaggtggtatgaatttccgtgatctattcgatttcaacctagcattgcttgggaaacagggatacttttatcaaggtggctatgatcttatggagtctttggaagaaaaggaaaggaaaattgtggaataccaagataagtttgtgagtagaagggctaatatggttggtcactctttagctagaaatgcattagataatccatatttacctgcaaagggaactccaatgatcaagtcagttgagcctgtggtgtttgagtatgtgaatgtaatgattaaaacatacttggaggttgcagttgagggccacgagctgagtacatgtcaaattcctaggctgaacgaactcttgaaggaactattgaagcgtttggaccaagggttatttggagcattttcgggagcagaggtttttaaggagatggagagaaggggggagggccaaaagagggataacattgtgggaggtggcaaaaggcccaaaaagaataggggaagcaagttttcccctatcaccatccctgggtatgagtgggtttctgcgaaaattaacttgtaccctactcagtttcaaacccacgagtctattgagaggttgaaacagaaggttgacgtgatagccttggatgatactgagttgttgattgtagagccttgtagcactgaggagtga

SEQ ID NO: 24180 - DNA, 1068 bp, Glycine max
  Peptide Sequence Number=SeqID_140958
atggagatcgcatgtgatgctaatcagttggatgcggatgttcttttaccaccccggaagcgtcttctagctggattgaagaaacagggttcagatagtgatgctactgcctcgccatctccagttgctgcttcttgtgttactgatgctgcttccccttcatcctcattgttttcaagtgaatttgaagcccgactgaagcatttgttgagttgccattctaataaccctaacctaacacctgaggaggttgtggaggcctcaaaagtggccgcaatcgctacaactaaagctgcagaggctgcaagagcagcagctgaagaaaaggctgcaagagcagcgaaggcagtagctgcagccaagagggctttagatttggttgcatctttctctgaggaggcggccggcaaggaaagaaatatgaaaaaaaacaagtcaaagaagcatctcccagttcagctgttgtacaaaaaaaatcaacgaattgaaaattgtgggacagatgaagaattggctcataagttacatcgagccatgaacagttcgccaagaatctccaagagttctccaaactcagactcaaaaggtagtaaacataagaagcctagaagctcttcaagttttgaaatgactgagggatctgaatctggtgtggcacttcgtcaagattgcttatctttgaacgatgaacatgcaatagcaggtatgattgattctgaaggatccatccaagaggtatgctcaagtaagaaagataaggtggttaaatatcatagacctagccaattagggatagataacggggaagcagagttgagtcagtcaaaagggaaaaagtttgaagattcatcttccataggtaagaagagaggaagggtgaagctaaaaaagttgcccttaagcatctgcacctcgaaagatagggtgcagctaaaggaagaaataagagtcagaagttattcgttgactggaacgaacacaggcaataatcctattaatactatgtctttgtttacagcggagtcatcatctgacagagtgatgcctattgaggctacatcaatgtga

SEQ ID NO: 24181 - DNA, 258 bp, Glycine max
  Peptide Sequence Number=SeqID_140959
atggcatctgcagaggatgagattgctaacatgaagaagactattgagaaaatggagggcttcaagaaggctcatattcaagttaaggtgttgcttccttcttttgactctgcacaagtggacgtgaattgcgacattgtggatggcgagatcgttagagagatgcaactgtgctctgagtctaagggagaagaagaaagaaaggaggagttgcttgaaaaagttgacgttggaatccaacctcttagagttgcttga

SEQ ID NO: 24182 - DNA, 291 bp, Glycine max
  Peptide Sequence Number=SeqID_140960
atggaacctaaaattgctggaaactatgtattgctctccaatatatatgctgcagcaggcaagtgggacaaagttgctaaaatgaggacttttcttagagagagcggactaaagaaaacactaagttgtcgttggcttgaattaaatagagatgggcaaaagcgtaagctagtcacagtgccttgggcttctgtttgcaaccctgttcatgaggggagttcgggactacgctctattaggagaatcaacgaagttgttgttctgcatctcggggttgaagtttgggtttga

SEQ ID NO: 24183 - DNA, 417 bp, Glycine max
  Peptide Sequence Number=SeqID_140961
atggcacaatattgcagagagttggctacaagggttgcacttgcttttctcaaaatagttggctacaaggatcaggaaacccatggctctctaatctggttttctcttcttttcatgcattgctgcaaaagttttaaaaaacctatttttttaaaattgaaatcaacttttcggttctcactcaaaattgaaatcaactctaccaacatcttatacaaacggacacatacacaatgcttgaagttttgtttcacttccattgctccgatagtggttcatggagatgccctagagaatgtggttgattttgatttcccgtgtttaacatgtaattaccaccatggtgtctattttgagaaagtgttccagagttggagtaaccactataactgttccaaagtgattgcggcatgctag

SEQ ID NO: 24184 - DNA, 315 bp, Glycine max
  Peptide Sequence Number=SeqID_140962
atgcagaactatcaacatgcaaagagatgtgattctgcaaaagcgaggaccaacataaaacgtgttatgcagcataagcgacatggtcatgctcagtcatcttcacaaccaacagttaattgcacttcagaatataatatgattgtttctgattcatcaaaaagtgaaaattctgaatccacacaaggttcaggctctaattttatgactcccttcgaggattgtcaatctccaactaatcagcctgtaatcaacactgaaggatattctgatcttggtgatcaactcatccaatgtagatattgtaatgcataa

SEQ ID NO: 24185 - DNA, 1548 bp, Glycine max
  Peptide Sequence Number=SeqID_140963
atggaatggagtctcactcttgattcctctcactcttcctcctccaccactaaccacaacatgttccccactttaggatttccggtcaaccttagcccctcctccgatcacaatcggacggtcctcggtgaagttgacttcttctccggtgctagaaacatctcatcatctcacaccaacaacgatcatggaaccccccttaagtgtgatccccatgtaaatactggtttgcaacttctcaccgctaacgctggaagtgatcagtcaaccgtggatgatggggcttcatcggatgctgaagataagcttgtcaagatcactgagctggcacgattgcaagaggaccttcggcgcatgaatgcagagaaccaaaagctgaaggagatgctcagccatgtcagcagtaactacgcgaacttgcaaatgcatcttgcagcagtactgcaacagcaacataaccaacgcactgagaacacggaacaagaggttgttcaaggaaaagctgaggagagaaagcatggaggaatggtgcctcctagacaattcctggatttagttccgagtggtacgaccgaaatagatgatcaagtatcgaattcttctttgggtgaaaggactcgatcaaccacacctcccagctgcaataaaaatgatgataaggataagaaagagactactgatattccacactctggcaaattattgaaccatacgacggatccatccactagtccggaagccgctatgagaaaagctcgtgtctcagttcgtgcccgatcagaagcacccatgatcagtgatgggtgccaatggcgaaaatatggacaaaagatggctaagggaaacccttgtcctcgagcatactacagatgcaccatggcagttggttgcccagttcgcaaacaagttcaacgttgtgcggaggacagaacaattttgacaacaacgtacgaggggacccataaccatccactgccaccagctgcaatggctatggcatcgaccactgcagctgctgctagcatgttgttgtctgggtcaatgaccagtgctgacggaataatgaaccccaatttgctaactagagctattcttccatgttctagcatggcaacactttcagcttcagcaccattccccacagtgacattggacctcacacacaaccaaaacgcgtttcagaattaccaaagacctcaaaccccattgttcccatcacagccccaggactttatcgctggatccacgccaccacaactgccgcaactgattgcacaagcgctctataatcaatccaaattctcaggccttcaactttctcaggatgtggggcctaataattcccaagctccaagaccgtttttgcagccaagccaacaggtctcgctcactgacaccatcagtgccatcaccgccgatccaaacttcacggcagcgctcgtctccgccatctcctccatcatcggtggtgctaatccaaacaataacagcgccaacaacagtagtagcaatcccaatgtcatcaatagtgctacaattaatcaatag

SEQ ID NO: 24186 - DNA, 114 bp, Glycine max
  Peptide Sequence Number=SeqID_140964
atggaggcttggactgttagatatctgaggggtcactttgtgggttctttgcctatagttgtagcatatgatggtgcctgccagggtcctctagaacaatgtccctatgaatag

SEQ ID NO: 24187 - DNA, 810 bp, Glycine max
  Peptide Sequence Number=SeqID_140965
atggcttctttacaaaccacggctacactctcctattcttcttctctaagaaaagtcaaagacgctatccatgtccctaaacctgcacgagtgacttattcggttccaaaagtaacaagaagaaagttgcaggttgaggaattaattaatggatcagtagactcaaccccattagagaagaatgccatcaccacacacatatatgaaggtttattcagccctagcaagaagtctaatatggccactgttcaactctattcgattctggaggcagtagctgacagaattgaaatgcacaaaaacatttgcgaacaaagaaacaactggaacacccttcttctaaactccatcaacatgatcactctcactgccacggccatggccggtgttgctgcagccaccagtggtgacactacaccgcttttggcccttaaactatcatccgctctcttgttttctgcggccactggaatgtcacttatcacgaaccaaattcagccctcacaactcactgaggagcaacgcaatgctacaaggttgtttaaacagcttcatacccaaatccaaaacataatcgctcttggaaatccaaccgaagaagatgtgaagggttcgatggagaaggtgttggcacttgatagagcttaccctctgcccttgttgggagccatgcttgataagtttcccgaaaaatatgaacctgctgtctggtggccttcatctcagttccaaagaagaagtagaacacaagagagtaataatggatggagtgaagatctagaaatggaaatgagggaagtgattgaggtg

SEQ ID NO: 24188 - DNA, 1269 bp, Glycine max
  Peptide Sequence Number=SeqID_140966
atggcttctttacaaaccacatctatattctcctcttcatccttttcttcttctctaagaaaagtcaacgcttctatccatgtccctaaccctccacgagtgacttattcggttccaaaagcaccaacaagaaagttgcaggttgaggaattaattaatggatcagtagattcaaccccattagagaagaatgccttcaccacacacatatatgaaggtttattcagccctagcaagaagtctaatatggccactgttcaactctattcgattctggaggcagtagctgacagaattgaaatgcacaaaaacatttgcgaacaaagaaacaactggaacacccttcttctaaattccatcaacatgatcactctcactgccacggccatggccggtgttgctgcagccaccagtggtgacactacaccgcttttggcccttaaactatcatccgctctcttgttttctgcggccactggaatgtcacttatcatgaaccaaattcagccctcacaactcactgaggagcaacgcaatgctacaaggttgtttaaacagcttcatacccaaatccaaaacataatcgctcttggaaatccaaccgaagaagatgtgaagggttcgatggagaaggtgttggcacttgatagagcttaccctctgcccttgttgggagccatgcttgataagtttcccgaaaaatatgaacctgctgtctggtggccttcatctcagttccaaagaagaagtagaacacaagagagtaataatggatggagtgaagatctagaaatggaaatgagggaagtgattgaggtggtaaagaagaaagacatagaggactatgagaggcttgggaacatagcgttgaaggtaaacaggagtttggcgattgcagggcctctattgagtggcatagcagcggtggggacttcatttgtgggtaatggatcgtgggcggcgttagtgcctctcatggctggttcattagcttcagttgttaatgcttttgagcatggtggccaaataggcatggtctttgaaatgtacagaaactgtgggggattcttcacgcttttggaacagactattcaagctacacttgaagagaaaaacttggacaaaagagaaaatggtgaagtatttgaaatgaaggtagcaatgaagttgggaagaagtgtttcggagctgagacgacttgcctcaaaatctgcttcctgttgtatgaaaggaatcacagtagatgaattcgccagcaagcttttctaa

SEQ ID NO: 24189 - DNA, 921 bp, Glycine max
  Peptide Sequence Number=SeqID_140967
atggttgaccaaggtcttattaaggaaccagtattttcattttggttcaaccgcaaaccggaggaagaggaagggggtgagattgtttttggtggtgttgatcctgctcactataagggaaagcacacttatgtgcctgtgaccagaaaaggatattggcagtttgatatgggagatgtacttattggcggtaaacccactggatattgtgctgatggctgttcagccattgcagactcagggacttctttgttggcaggtccaacgactgtaataactatgataaaccatgcaattggagcatctggagttatgagccaagaatgcaagactgttgttgcagagtatggacaaacaatattggatttgcttttgtctgaaattcttgcctatgatcatgagtggacacagccgaagaagatctgttcccgaattggattgtgtgcttttgatgggactcgtggtgttgatgtggggatcaagagtgttgtggatgagaatgaaagaaaatcatcgggtggtcatcatggtgctgcttgtcctgcgtgtgagatggctgttgtttggatgcagaaccagctgagccgaaatcagacacaagatcagatactaagttacatcaaccagctttgcgataaaatgcctagcccgatgggagaatcagctgttgactgtgggaatatctcttcattacctgtagtgtcctttactattggtggaagaacttttgagcttagcccagaggagtacatactcaaggtgggtgaaggtcctgtggctcagtgtattagtggctttactgctatagatattccacctccacgtggccctctctggatccttggtgatgtcttcatggggcgttatcacacagtatttgattttggcaaacaaagagtgggatttgctgatgctgcatag

SEQ ID NO: 24190 - DNA, 531 bp, Glycine max
  Peptide Sequence Number=SeqID_140968
atggaagaaactgttgatttgagaaatggtgtggaattggcagcatcagtctctgataagcatcttgaccttctaaggccatcagcacgaaattattcaatttttagaggtcaagcaatggatgttgcagaccatgaaaagggcaactataccctaattagaggtccagaggatttccaaacgggactttatgacaaaccccttccatgttatggttgtggaattggatggttttcgtttctttttggatttctatgtccacctctgtggtactatgcaacaatcctctactttggaaattattataggaaggatcctagggaacgggcagggttaggagcctctgcaattgctccttacccttgcatatgcaaagaggctgtttccggattcgaacccatgaccaacaagtcaccaaggcacaactttaccgctgcaccagggctcgccctcatcaaccataattatgcattaatatgctcagtagcattgctgatcgtaggagctattcttatgttacgctccccctaa

SEQ ID NO: 24191 - DNA, 771 bp, Glycine max
  Peptide Sequence Number=SeqID_140969
atgtccaccaagcaactctacgcaatcctagaggttgtcgcagacagggttgaaatgcacaaaaacattgccacaactgtaggttctggggcaccgcttttggctctcaaactatcatcaactctccttttttctgcggccacaggaatttcatttatcatgaacaaaattcagccatcacaactcgctgaggagcaacgcaatgctacaaggttgtttaaacagcttcagacacaaatccagacgacaatcgctctaggaaatctaacagaagaatatgtgaagagttcaatagagaagttccaaaggaaaaacaaaacccaccaaggaaaagcatcgagcaaggggaataatggatggaatgaagagctagaaagggaattgagggaagttgttgaagtggtaaagagaaaagacattgaggattatgagaggctgggaaacatagtgttgaagataaacaagagcttggccatagcaggttctttactcactggcattgaagcagttggatctgcatttgtgggaaacggatcattggcagcaatagtggctgtcatggctggatcattggctgctgcaatcaatggtttggagcacggtgagcaagtgggtatggtgtttgaagtgtacagaaattgcggcggattcttcaaactgttggaggagacaattgaagatgaggtggaagagaaagactttgagaggagacaaaatggggaactcttcgaaatgaagatggctttgttgttggggagaagtgtgacatag

SEQ ID NO: 24192 - DNA, 1092 bp, Glycine max
  Peptide Sequence Number=SeqID_140970
atggcaaactctaagctgaatatcattctcattcacattctcttcctctctttctcctccttcgcagaagcattagattcccagcttaagcaacaaaaccaagacgaagaagagagggttccattcgtgggcgtgaacatcggcaccgacgtctcgaaccttccagcagcctcggacctggtcgcgttccttcaactgcagaagataacacacgttcgcgtctacgatgcgaaccaggacatcctcaaagccctgtcggggaccaagattcgcgtcatcatcagcgtcccaaacaaccagctcctggcgattggttcctccaactccaccgcggcctcctggatcgaccgaaacgtcgtcgcttactacccccaaaccctcgtcagcggaatctccgtcggcgacgaggttctgaccagcgtcccctcctccgcccccctcattctccctgccctcgagtccctctacaacgccctcgtcgcctccaacctccaccaacaaatcaaggtctcaacccctcacgctgcttccatcattctcgaccctttccctccctctcaggcttacttcaaccaatccctcgtttccgttattctccctctccttcagttcctttcacgaaccggttcccctctcatgatgaacctttacccctactacgtcttcatgcagaacaaaggtgtggttcctctcgacaatgctctcttcaaacccctcactcctaataaggaaatggtcgaccccaacaccttgcttcactacaccaacgtcctcgacgctatggtcgacgccgcttatttctccatgaagaaccttaatatcaccgatgttgttgttcttgtcaccgaaactggctggcctgccaagggtgattctaaggaaccttatgctaccaaggacaatgctgatacttataactccaatttgattaggcatgtctttgatcgcagtggaacccctttgcatcctgagactacttccagacttaaggtctccgccgctgtcggaggcgaattggggtttgttttatgggaacactacgccggcttatctgcttcatgtgtctggaattgggacttttttggccaatga

SEQ ID NO: 24193 - DNA, 549 bp, Glycine max
  Peptide Sequence Number=SeqID_140971
atgggggagggatgttgtacgcagccttacccttgcatatgcaaagaggctgtttccggattcgaacccatgaccaacaatttacccaagatagatattcttctattgcctcctgaggttgaattgttcaaacatcctcatttgttgctgttgcaaataagaaattccatatataaacttcctggtggccgattaaggcctggtgaatcagatactgatggattgaagcgtaagctggcaaggaaactctccattatcgaagatggggatgggtcagaatgggaggtgggtgaatgccttgagatgtggtggaggcctgattttgaaacattagtgtttccttgtttgccacctaatgtgaaacagacaaaggagtgtatcaaagtcttccttgtgaagcttccagagagtcgaaaattcattgtgccaaaaaacatgaggttgcttgcagtcccattgtgccaagttcatgacaatcaccaagacatatgggaaaattatatcaggggtcccacagttgctgtcaaaattctctttcaacatgattga

SEQ ID NO: 24194 - DNA, 1584 bp, Glycine max
  Peptide Sequence Number=SeqID_140972
atggaggaaataacttcgacggttgcagtgccattcacacttgggaatttaatacaaaaggagcaagcagtgacaacccacatggagataactggtctcaaactcagggcaaatacatcatcatctttgatattaaatcctgcaattgaaagtgaaaagcacacagatattgggccacaaacccaaattgaagtgtcttcagaggcaaaggagaatcccgttggagctggccttgtctcagaaatggttagtcaaggagacaataatggtttatattctgaaagtctaaatcaggcaataaaagagaatgaatcattgttagctaaggattctcagtgtgatcggcatatctctcaatctgctgctggtggcaaaagtagtccttgtagggaggaatcttctgttttgaggactaattgtgaaagaaattcacctattaccatcaaggttgatgataacataattgatggaaagtctggttcgaccaagctgccacatgctagggaacatgaaagtgatgatggaagtggatcagatgagtctaataagaaaacatttgatgtgcgttgtgagatgcctgagaagccaacatgcttggaattgagtggtaatactactagtactaccccactttggggttgctcatcagtttgtggaaggagaaaggagatggaagatgctattgctgttaagcctcacctttttcaagtcacttcaaggatgttagtggatgatcatgtgagtgaaaacacaaaatactcaccagcccacttttttggtgtctatgatggacatggcggcattcaggttgccaattactgtcgggaacatcttcattcagtgttgcttgatgagatagaagctgcaaagtcaagtttggatggaaagaaagagatggacaactgggaggagcaatggaaaaaagcattctccaattgctttcacaaagtggatgatgaggttggaggagttggtgaaggtaatggtgttagtgttgaacctcttgcttctgagactgttggctccactgctgtagttgccattttgactcaaacacacataatagttgcaaactgtggagattcaagagctgtcttgtgtcgcggaagagaagcattgccattgtctgatgatcacaaaccaaatagagacgatgaatgggaaaggatagaagctgcagggggaaggatcatacaatggaatgggtaccgagttctaggtgttttggcagtgtcaaggtccataggtgacaggtacttgaaaccgtgggtaattccagagccagaagtgaagtgtctccaattagacaaaaacgacgaatgcctcattctggccagtgatggtttatgggatgtcatgacaaacgaagaagcctgtgacattgcacgaaagcgaatccttctttggcataagaagaatggcaacaactcatcatcagaacaaggtcaagaaggagttgatcctgcagctcagtatgccgcagagtatctttctagacttgccctccaaagaggaaccaaagataacatctctgtcattgttgtagacttgaagcctcagagaaaaatcaagaaaaaagaataa

SEQ ID NO: 24195 - DNA, 413 bp, Glycine max
  Peptide Sequence Number=SeqID_140973
cccgaatgtagttaacttgagcaggactggaattgagaatttggcaaaattggaggaccgaaaggaaccatggcttgttgtgctttatgcaccatggtgcccctactgccaggctatggaggaatcttatgttgacttagcagacaagttagcagggtcaacagggatgaaggttggaaaatttagagcagatggagaacagaaagaatttgcaaagagtgaactgcaattgggaagcttccctacgatattatttttcccaaagcattcgtctcggccaacaataaagtatccctcagaaaagagagatgttgattccttgatggcatttcgggttccttctttatgctattacgtgtatataccattcgtttacagattcttctgtgaactcgttggaagtgggaatggag

SEQ ID NO: 24196 - DNA, 447 bp, Glycine max
  Peptide Sequence Number=SeqID_140974
atgaggcaattttcttatgggatcatatttgctcaggctttgggcatgaaggtggtgaggaaggttgataagcctgagtacaaggtggaatttcttctcacctatatcttagcattatacttactagctggaacattttcatgttacactatagctatgctcgggtatggagaggagcacgagacaactgtgttggagttgacatataactatggtgtgactgaatactctaagggaaatgcttatgcacagattgccattggtactgatgatgtatataagagtgctgaggtagttaaccaagtcataaaagaggttggagggaagattactcggcaaccagggccaattcctggccttaatacaaaaaccacttcgtttttagatccagatggatggaaaactgtcttggttgacaacgttgatttcttggaagaactgaagtga

SEQ ID NO: 24197 - DNA, 594 bp, Glycine max
  Peptide Sequence Number=SeqID_140975
atgagatctgacggaagcgatgaggccaaaggttcgttaccatcatccagtccacgcccaaaaacacgtccagttccgcaaattgggtcaattaggatttcggagaggcccattggaggcgccgttaatttcaatttatctcaaagacggagcttggtaaagcccgttaacgccgaacctccacgcaaggattccattgttcctctcgcagcaacaaccatcgttgcttctgcttctgagacgaaagaggaagattttgaacagatagccagtgatctcgacaatgcttcacctcttgaaatcatggatagagccctcgacaaattcggcaacgacatagctattgccttcagtggtgctgaagatgttgctttgattgagtatgcgaaattgacgggtcgaccctttagggttttcagtttggacactgggagactgaacccagaaacttatcaactttttgatgcggttgagaagcattatggaattcgcattgagtacatgttccctgatgctgttgaggttcaggcattggtgaggagtaagggttattctctttctacgaggatgggcaccaagagtgttgcagggtga

SEQ ID NO: 24198 - DNA, 1130 bp, Glycine max
  Peptide Sequence Number=SeqID_140976
atggccaggtccaccactcctccgacgatcaaaccggaaaattacggccacagtccggttcactacgccgtcgctttgggcgaccacaccaccctctccagaatcacctcctcactccctcgtctccccgatccctctctaattcaaaccgaatccgattccctcgctcaagaaaaaatcgctgatcagatctccctcgtcctcgaccgccgcgacgttccttatagagaaactcctctccacctcgccgtccgacttaacgaccttttcgccgctcgcgccctcgctaccgccggcgccgacgtctccctccagaactccgccggctggaactctttgcaggaggcgctatgccgccgcgcctccgacatcgcgctcgtcctcctccgtctccaccaccgaaacgcctggtccaagtggcgccgccgcctcccgcgcgtcatcgccgcgctccgccgcatgcgcgacttttacatggagatctccttccacttcgagagctccgtcattcccttcgtcggcaagattgccccctccgacacctacaaaatctggaagcgcgacggcaacctccgcgctgacacctctctcgccggcttcgacggccttaagatccagcgcgccgaccaaagcttcctcttcctcggcgacgtcgatcacacgcacgacgtcccctccggttcgctcctcgtcctcaaccgcgacgaccgcaaaatcttcgacgccttcgagaacgccggaggaccgatgaatgagtccgacgttgccggattctgctcgcagacgagcgtgtaccgtcccggtatggacgtgacgaaggcagagcttgtaggcagaacgaattggcgaagacaagagaaaatagagagcgtgggggagtggaaggcaaaagtgtacgaaatgcacaacgtggttttcagtttccgatcacggaaagtggccggcggagattctgacgtggcagggagcgagcaggtgctgccgttggaactggacgaagacgacgacggttttctcgttgcggagaatccgaatttcgggttcccaatgccagacaagagaagacacagtagcttcgttcgagaagagagagagtgggtcccaatgggaaggaaaagcgtcgacctaac

SEQ ID NO: 24199 - DNA, 540 bp, Glycine max
  Peptide Sequence Number=SeqID_140977
atgccacagaccaaggaaaaggagtacgttagaagcttacggccgtcagtgtggctaacggagcagtttccattaaagaccgaggagcttctgccgttactcgacatactcgctaataaggtcaaagcagtgaggaggctcagagagttactcactaccacgttcccgccgggaacattccccgttaagtgggttcaggtggctataccggtggtccctacggtgagggtggtgattacgttcacaaagttcgtggagctgcaacctctggagcaattctacactccattctcgagcccaaggcatttgctcctcagtgcaagcagaggaggagatgagcaacagagcaaagcagaaaacaggtgctcttcttcgagctcatcgacgtggctgagacgaaataatagcgtgtcgaataagcaacgatgtatggcattggattcggacccttttgcgattcctgcgggatacacatggaccagtgtggatgataaatctcgtaaaatgaagaaatccaagtccgtcagaaagtctaagtaa

SEQ ID NO: 24200 - DNA, 4257 bp, Glycine max
  Peptide Sequence Number=SeqID_140978
atgaatgaagtttcaatcaataatacagaaagctacctataccttcatccaagcgagaacccggccatagctctcgtttccccagtattagactcaaccaattaccattcatggagtaggtccatggttactgcgctgagtgccaagaacaaagtggaattcattgacggaagcgcacctgaaccgttgaagacagatagaacctatggagcttggcgccggtgcaacaatatggtcgtatcgtggatagtacacttggtggccacatccatacggcagagtatactctggatggacaaagctgaggagatttggcgagatttgaagtcacggtattcgcagggagatcttctgcgaatctccgaccttcagcaagaggcatcaacgatgaagcaaggttcactttcagtcacggagtgctcatgcgctgctttcaccatcatcactcaacgcaagcttgaagatagagccatgcaattcttacgaggtttgaacgaacagtacactaacattcgttctcacgtgcttctcatggatcctatacctgccatatccaaaatcttttcttatgtagctcaacaagaaagacaactgctggggcacgcaggaccaaacatcaacttcgaacccaaggacatctccataaacgcgacgaggacaacttgcgatttctgtgggcgcattggtcatgtagaaagtgcttgttataagaagcatggggtgcctgcaagttatgatggaagaaacaagaataacaatggaagaaagacgtgtacccattgcggcaagtttgggcacacagtagatgtttgttaccggaaacatggatacccgccgggatacaaaccctatagtggaagaaccaccgtaaacaacgtgataacaatggaagataaagctacaaatgatgaagctcagcaacatgagtcacaagaggttgttcacttctcccctgagcagtacaaggcattacttgccttaatccagcagccgccggcaggaagcacggcgcagtccaaacaagttgcatcagtttcctcgtgcactgttaacacaccattaaacccaggtaattcactctctacccaaacacatcacacctcctggatcctagattcgggagcaacggatcacgtaacctgttctttgcataatctccattcctacacgcaaatccacccgatcacagtgaagcttccaaatggtaatctcgttcatgctactcacacaggaaccgtacatctttcatccaatttaatcttacataacgtgctctacatacccactttcacattcaatcttatttcaatatcaaaactcgtatcttctaataattatgaactaatcttttcttctacatcgtgcgtgttgcaggaagcgaacaatcatatgaagattggtatagttgaagcaaagcatggcctctatcatttgataccaaaccagataactaccaaagccatctactctacccttactcatcctagatgcagcatcatccccatagacctatggcattttagaatgggacacccatcgaatgaaaggctacaatgtatgaaaaactattatcctcttttgagcaatgataaaaatttggtctgcaacacgtgtcactatgcaaagcacaagaaaatccctttttcatctagcaactcgcatgcatctcattcctttgatttactgcatatggatatatggggtccatgttcaaagctgtccatgcatggtcataaatacttcctaaccattgtagacgatcactcgagattcacgtggatacatcttatgaaatctaaagcggaaacgcgacatataatcatcaacctcattgctttcattgagagacaatataacggcaaggtcaaaactataaggagtgataatggcgtagagtttctcatgcatgaatattatgcatcaaaggggatcgtacaccaaaccacgtgtgtcgaaaccccagagcaaaatggtatcgtagaacgcaaacatcaacacttgctcaatgtcacacgagcactcctctttcaggcaaacttgccacctgctttttggtgttatgctttgccgcacgctgcatttctaatcaactgcattcccacaccattcttaaataacatttcaccttacgaaaaactgcataaacatccctgtgatatatctaatctccgtgtcttcggatgtttgtgttatatcaacacaatcaaagcaaatcggcaaaaatttgatcccagggcacacccatgcattttcattggtttcaaaactcatacaaaaggatatcttgtgtatgatttgcattctcacgatgttgcaatatctagaaatgttactttttacgaaaatcattttccatacctgcctgaaacccaacatttaaacttagataactcaatcccatctccatctccgaaacccttttccggcaaagagcttgacccaccagaagaaagccactcatcacaacccataataccaatacactcctgtgatgaacattcaaccaaacaagacccttcacaccctaggcgttcaacacgatcaagacattccccgacataccttcaggattaccacagagtccttgcttcatctacaccagaagcttcagtgattgttcgttatccactaagctcagtactttcatactcgcgcctctcacctgcccataggaacttcgtgatgaccatctcaccagccacagaaccttcatcatatgccgaagcctctcgccatgactgctgggttaaggcaatgaaggccgagttacaagctttgcagatgaacaacacttggagactcacacttcttcctcctcacaaggcagctatcggatgcagatggatttacaagattaaataccgggctgatggttccatagaaaggtataaagcacgcttggtcgccaaaggttacactcaaatggaggggttagactacctcgacacattctctccggtggcaaaactcaccaccgttcgtgttcttctcgcattggcagcgcaaaatcaatggcacttgcgacaattggatgtcaacaatgcgttcctccatggagagcttgaagaggaagtgtatatgaaaattccacctggccttgaagttgaaaacccgaagcttgtttgtcgtcttcaacggtctctctacgggcttaaacaagccagccgacaatggttcacaaagctatcgagtttcttagtctcccatgggtttcagcaatctaactcggaccactctctcttcttaaaagtcactaagtcagccactaccatactcttggtgtacgtcgatgatatcatactcacggggaacagtatgctggaaatacaagatatcaccaccctcctggatcaagaattcaaaataaaagaccttggtgacttgaagttctttctgggactcgagattgcccgcaccaatgatggaattcatttatgccaacgaaaatatgccttagacattttgtctgattcaggtatgctaggttgcaagccacactcgacacccatggattattccatgaaattgcagatgcactcagggaattccctttctgacgagtcctcatcttcctatcgaagactaataggaagactaatatacctcaccaacactcgcccagatattgcgtacactgttcaacaactcagccagtacatgtcggctcctaccaccactcatcttcaagctgcttttcgcatattgagatacctcaagggttcactaggatccgggctcttcttcgcagcaaccgggactccccaactccgagccttcagtgattcggattgggcgggttgtaaagactctcgaaaatccaccacagggttccttgtctatctgggttcttcactcatttcgtggcaatcaaagaaacagtccaccgtctcccgcagctcctccgaagctgagtatcgagctctcgcatctactgcctgtgagctgcaatggttaacgtatattctccaagacattggtgtagcatttattcagccagccactttatattgtgataaccaatctgcaattcagatagcaacaaatcccgttttccatgaacgcaccaagcatatcgagatcgattgtcatattatccgccacaaagtcactgcgggtctcgtcaagctccttccggtctcatcctccatgcaacttgtggacatattcaccaaagctttacgaccagccacctttcagcacctttgtaacaagctgggaatgatgaatatccattcccagcttgaggggggctcttag

SEQ ID NO: 24201 - DNA, 402 bp, Glycine max
  Peptide Sequence Number=SeqID_140979
atgtctatgaagagcaagggagcatgtgtagaagtgagtggaaggaatgtcttacataggaaatgggctcttctgctttgtgtggcaagcttctgtgctggaatgttctttaccaataggatatggtcgatggctgaatataaagaaatttcgagggcttctactgagattgaaagaataaaactaaactctgagggctgtaatctaaatctagttgtaaggcctagctccaattacagtcaagtggaagtttcaaatacacagaatgttgtcaagaaaccaaagacatttgaatcaactccaaggaaaaaatatttcatggttatagggatcaatacagcttttagtagcaggaagcacagagatactgttcatgcaacttggatgccacaaggtgattga

SEQ ID NO: 24202 - DNA, 603 bp, Glycine max
  Peptide Sequence Number=SeqID_140980
atgttggaattgtccatcttgtgctgggtgcacaagaaaagtgatggatgcacaaagcaattgcccttagtcttgtatgtctcctttggaagtgtatgtgctctcactcaacaacacattaatgagctagctagtgatgttgatgttaaaaatgatgaccctttagagtttttgccacatgggttcttggagaggactaaagaacaaggtttggttatcacttcttgggcacctcaaacccaaatccttagtcacacttcaactggtggatgtgtgacccattgtggttggaattcaatagttgagagcattgttgcggttgtgccaatgataacctggccattgtgtgctaagcaaagaatgaatgatgctttggtaactgagggactcaaagtggggttaaggcccaaatttagagagactgatggcatcgtggaaaaagaagaaattgctagggtggttaaagatctaatgttgggtgatgaagggaaagggattcaccaaagaattggaaagcttaaggatgctgctgctgatgctttgaaagaacatgggtcctctcctagagcactttcccaatttggcactgacttggagaactga

SEQ ID NO: 24203 - DNA, 1200 bp, Glycine max
  Peptide Sequence Number=SeqID_140981
atgccactgtcgctgtctgccaccatttgtgccctcccaccagtctttgccaccgtcgtcgcattcaccattgtcgtaagtctctatcttccactcgttgttgataatgggattgtgtctgagattataggaagagccttagggagagaagttagttgtgatgaagttgaagcccctcaacagcgaaggcccacagtatctacacgtaggcaacgggaagctgcacttgttcctgagtatgttgagcatgtggtcatgcagttgacgagacaagccccacgacacatcagctttgatgactatgttcatcatttggcagtgacagaacattttgagttaaagttgtcttcccatggaaggaaggtagagaaattaggcaggcctacttcagagattgaaggcttagtggttgtcataggattaagtcctctgatcgcatgttccttgaacactggtgatcgaggacttatatctatttttgtggagaggtggcataaggaaactagtagtttccatcttccggtaggagatgtcaatatcaccctcgatgatgtggcattgttgctacatttgcccattataggcaccttccatagctttgaggctcttcatgtggatgaagttgtcttcctgttagttggattgcttgaagttagttcaaaagaagaagagttgggacattacaatgccatggggcatatgttcagctatcctggctgcgagacatttatcgtagcaacttgttggatctacgaatattttcctactgttgcttcttttattgctattgaagattatcatgagaggaaaccacgtacttgtcgttggaagtctgggaaggcattatcagtgttgacgtatcgtaagcgtttggatagattgatgcatgatgctatgtgttggattccttatgagagggttgtgcatcagtttgggtatgtgcaaaccattcctccataccctgctgctccatctctatactacatggagtggttttacatgatatcccatcccttcatgagtctgacacagcctggggatcctcctaaacatccgtttgtggttcatgatgagatattgtggaagcaatgtcttccaagattgaagattcaagaatcaagtttcaagaatcaagattcaagaataatcaagatcaagattcaagacacaagattcaagaaacaagagaagactcaataa

SEQ ID NO: 24204 - DNA, 648 bp, Glycine max
  Peptide Sequence Number=SeqID_140982
atggatgagtggagctcaagtttgggtcatgctttggtgtatggattctttgagcctcagtcaatacaccatgcaaaggatcaatatgctgaatgtgaacattacatacaaacatggttgaaggaatctcaacgaaaggtgtacctagaagcttacttaaatcatgcaatgaagacactaaagaccactgtggatggtaaaaatgatcaaggaactcctaagtggattgaagtaatgagtcatgttcaaagtggagactatgagtgtggctattatgtgatgcattggatgttgaacatagtaagtgggggtttaaagaatgattggagcatgggaaacaaaaaggtattcaaggttactagaagggttacctccctcaggtacaaaacatttgttgtggagggaatgggtgcggcgaaggccaacacgacacttcaagctcatcctgaaatgacatcggagaatatcgaagcattgcttgatgaaagaaaagaaaaaaaatcatatgctgaaagatacgatgacatggatgatgttaagagcttagaacccgatggtgttcctcttgattccaaggatgaacaagggatgacagtgttgttgattatagtcagagacaggttgatgattgagggtagagtttgttag

SEQ ID NO: 24205 - DNA, 1384 bp, Glycine max
  Peptide Sequence Number=SeqID_140983
atgctgggccaagccatcgagcccaacgccttcactctctcatccatcctcaaagcctgctctcagctcgaaaacttacaccttggtaaaaccctccacgccgtcgttttcatacgcggcttccactcgaataataatgttgtagcgtgtgcgttgatcgacatgtacgggaggtcgcgcgtggttgacgacgcgcggaaggtgtttgacgaattgcccgaaccggattacgtgtgctggacggcggttatctcgacgttggcgcgcaatgacaggtttagggaggctgtgcgggtgttttttgcaatgcatgacgggggtttggggttggaggttgacgggttcacgtttgggacgttgttgaatgcttgtgggaacttggggtggttgaggatggggagggaggtgcatgggaaggttgtgacattggggatgaaggggaatgtgtttgtggagagtagtttgttggatatgtatgggaagtgtggtgaggttgggtgtgcgagggttgtgtttgatgggttggaggagaagaatgaggtggcgttgacggctatgcttggggtgtattgtcacaatggggagtgtgggagtgtgcttgggttagttagggagtggcggtcgatggtggatgtttatagtttcgggacgattattcgtgcgtgctcggggctggctgcggtgaggcaggggaatgaggtgcattgccagtatgtgaggaggggtgggtggagggatgtggtggtggagtcggctttggttgatttgtacgccaagtgtgggagtgtggatttcgcatataggttgttttcgaggatggaggcgaggaatttgatcacgtggaacgcaatgattggggggtttgcacagaacgggagaggacaagagggggtggagttgtttgaggagatggtgaaggagggggtgaggccggactggatcagttttgtgaatgttctttttgcgtgtagtcataatggtttggttgatcaggggaggaggtattttgatttgatgaggagggagtatgggattagacctggggtggtgcattacacttgcatgattgatattctgggaagggctgagttgatagaggaggctgagagtttgttggagagtgctgattgcaggtatgatcattcgcgttgggcggttctgcttggagcctgcactaagtgttcagactatgtcacagctgaacgcattgcgaaaaagatgattcagttggagcccgacttccacctgagttatgttctgcttggtaacatttatagagcggttggcaagtggaatgaggctctggagatcaggaagttgatggaggaaagaggggttaagaaggtgccgggcaagagctggattgagagtgagaagcaaaagg

SEQ ID NO: 24206 - DNA, 300 bp, Glycine max
  Peptide Sequence Number=SeqID_140984
atggaggttggatctttgagcttcaatgaggaagaaggagcttcaccaccaagaattgccttggataagaagcttgaagaggatgctttaatggaggaaaagaaagagagaatgggggagcacgaaattgaaggaataaaagagggaaagaagtggaactttgaagtgtatctcataagactttcattcatcaaagttacaactagtgttacacatgcttctatttatagactaggtagcttccttcttgagaaaacttccttgagaagcttctttgagaaaacttccttgagaagctag

SEQ ID NO: 24207 - DNA, 567 bp, Glycine max
  Peptide Sequence Number=SeqID_140985
atgacgtctgaagcagccaaagcaactgcatataggattataagtgacttttatttgtcagcctcaaagggaagctttgtggcccatggacatcaagatgtgactactgccattgggcaaccagagcaccctgatcgtgtccatgttgctggagctggtgttacgatcaaacaatactttggaccaactttaaggagctctcacacatatatgtccatggctcccgaagaactggagcagctgacacaaaaaatcaaggaccaacttgaggattcgatcatagaaaaattgcaaatgcaatcacaaggacacacactgcctcctgagcctgaggttggtccttctattgctcatgttagcataaaggaaagttgtgtcaatccctcggggcaggacccagacacggggtcaataactgtccacaacgtccttttaggcaatgatcaagttaaggataaacatggagctgagggaccgacaaaacatgtagataggtcggatcctaatgtcgatcccctatacccgatgacattgaccatcccgcagcttttcctcatgccgttgtag

SEQ ID NO: 24208 - DNA, 882 bp, Glycine max
  Peptide Sequence Number=SeqID_140986
catcatgcagttgctgatgaggcgaccaaggatgacgagcatcatgcagtgcctgccttaagcaaactcttacctcttaggttaataaggaacggtcatcaggctggttcccagttgaacccgctagtcactctggtgaagttatggtgtgactgccctttctggcctgatgatggcatgtgccggttgcgggactgtagtgtgtgtgaatgccctgaaagcgagttccccgaatcatttaagaagcctgaccatcgcctttcaatgactgatcttgtttgtcaagaaggaaaacctcaggcagctgttgaccgtactttagacagtaaagctttcagaggatggacagaaatagacaatccatggacaaatgacgatgagactgacaatgatgagatgacatacgtgaatcttcaactgaatcccgaaagatatactggttatactggtccatcagcaagaaggatatgggatgctgtctactcagagaactgccccaaatattatctggaacaggcagagtatgataccggtaaccccaatgaggaccttacgacacaatccttgataaaacagctactttacaaccccaagcttcaagctgcatgtccaattccgtttgatgaagctaatttgtggaaaggccaaagtggacctgagctaaaacagaaaattcaacaacaattcagaaacatcagtgcaatgatggattgtgtaggatgtgagaaatgtcgattatggggcaaacttcaggttcttggtctcggaactgcattaaagattctcttctctgttgatggtcaagaaaactcgagtcatacagtgaccaacaccctatatgtttcacttgatgatctttcagctgcagctgcaaaggaatga

SEQ ID NO: 24209 - DNA, 480 bp, Glycine max
  Peptide Sequence Number=SeqID_140987
atgaagaatgtgaggtatgaagaagaaagtgtggcaaaggatttagctacttttgatgaaggtttcaaatttgttctagtttctcaaggaggtaccgataatcattcaggttgtgtaccattagatggtcatgtttatgcacatcctactattgatccaatctggagtatacgagatgttacaacagaggttggggttgttgttgtacatgcagcagttgcagaaaagcaagctgaaggacatggtgatttagggttcaaagaatcaaaaacatattttgcatgctatcagggggtagtgattagtgaactgttcaacattaaatgttgctatcagggaattgttttaatggttatttgtagaacatgtggtgtggtctctgaactctcatggcatcttgggcttaaattaagtaaagctaaagaaattccatgcattatatggcctctcattctcatatgtgaagaaaaaagggaataa

SEQ ID NO: 24210 - DNA, 267 bp, Glycine max
  Peptide Sequence Number=SeqID_140988
atgtgggtggggggaaagattacccgagcacacggacaagctctatcaatggctccaaacagagcttttggagaggttctggaagacatggccatggcaacaaacacggcgacgagagccatcacaagccaaagccatcgtcttgtgctgcaaccctttttctcaatctccgctgtcaccatcacacagttccccaatgtcggtgcttccgaaacaaagcaccgagcttttcacagacccagaagaaaatcactgaaggaacactga

SEQ ID NO: 24211 - DNA, 1368 bp, Glycine max
  Peptide Sequence Number=SeqID_140989
atgtcgtgttcttcttcatctgggtctgaagaggaggatgaggggttcgactcttaccggaaaggagggtaccacgccgtcagagtcgccgatcagttcgccggcggcaggtacatagcgcagaggaagctcggttggggtcagttttcaacagtttggcttgcctatgatactactacatctgcatatgttgctctcaagatccagaaaagtgctgcccagtttgttcaggctgcccttcatgaaattgatgttctttcatcccttgctgatggtgtcgatatggattcaaaatgtgttgtccatttgattgatcactttaagcacacaggtcctaatggtcagcacctttgcatggtgcttgagtttcttggggatagtttgcttcgtctaatcaaatataaccggtataaaggccttcctttggataaagttagggagatttgcaagtgcattttgatcggtttggattatttacatagagaacatggcattatccactcagacctaaaaccagaaaatgttcttctggtttctaccattgatcctgccaaagaccctgttagatctggactcaccccaatattagagaggcctgagggaaacataaatggtggtggagttactagtcttattgagaaaaagttgaaaagaagagctaggagggcagttgcaaaaatatctgggagaagttctccaataggaggaattgaagctccaaagtctgacagaaatcttgatgggattgatgtgagatgcaaggtggtagattttggaaatgcttgttgggctgataagcagtttgcagaagaaattcaaacaagacagtacagagctcctgaagtaatactgcaggccggttattcctttgctgttgacatgtggtcttttgcttgcattgcttttgagcttgccactggtgatatgttgtttactcccaaggttggacagggttttagtgaggatgagctaccttatatttcgttgctattaatgcaaaagggttccaaactagaggaaacttatggatcaccttgccctgatgatggaactccttggaaagatgccccggaagcaaaatccaaggacttctttgacagacatggggatctcaaaaggattcgaagacttaagttttggccgctaagcaaattgttgattgatagatataaattttcagagcgcgatgcctgtgagttttcagagtttcttttaccacttcttgattttgcacccgagaagcggccaacagcacagcagtgcctgcaactcccatggctccagggcatagagtctacaccaaatgaaatgagaaatgaatctagtgtggaaaaggtgggtgttgggatgagcaaccttcaaatcaag

SEQ ID NO: 24212 - DNA, 264 bp, Glycine max
  Peptide Sequence Number=SeqID_140990
atggcgagattgatggaagatgcaaatcctcaacgacaggcaacaacaataccgggaggtgtttacactcacccctttaagatggcaaagatgataaaagaagttctcgataaaaatcttgtggagcaggaagatcatcataaaatctccttggatgaggagatagatcccgaaatttcccttgatatattcaagccagaccccaatttcctagagaaagagaagcgttatgaagaggtgaagaaaacaatcttgtcaagatga

SEQ ID NO: 24213 - DNA, 366 bp, Glycine max
  Peptide Sequence Number=SeqID_140991
atggaagcattcagaaagatatatgctttcccagttgcaagcaaacaatttctggaaaaattacgggaaaaaaaaaataccctccagccaatttcgccaaatactacagatttgggtcctcccagtcatgaaagcttctcccccaacctcctcagcacttgcaaaagccaaggaaaactgcaaggtgaaaagggaagtcccagaaagcttaatcaatttgttgagtttcacaaaatgaaaccatacaacaccttgtatgataacactgacagccacaaacaatgcagatggagagagaggattgttaattgtattagtggggaggaagagggtgagaaatgtttgtgtgggtcagatgtcatgtag

SEQ ID NO: 24214 - DNA, 3306 bp, Glycine max
  Peptide Sequence Number=SeqID_140992
atggcagcaaagctcctgcattctttagcagatgacaacccagatctgcagaagcagataggatgcatgactgggattttccaactctttgatcgccaccatgttctcacggctcgccgcattagccagaagaggcttgcttctggtaattctcccttcagtgagggcagcttggaaagagattctgatatcatactccatcaacaaacagcaactgatactagcttaaacaagggtgtgaatgaaaggcaaagaatttctaccgaatcatcaagagcatcattctcttcttgttcatcatcggtgtcctctctggactgcaaggctgaagcagaggctccatatgaccggattctttttcctgaaactccttcaagggatgcagttatgaaccaatctaccatctctccccattttggatgtaactcccttgatctgagggatgtggtgaaagattcaatgtatagggaagctcgaggactgtcattgaggactacagccaaagaggaatctgccattaatgccacaaagcacagggattcaccgcgacctattcagttgtccaaatctgttgatggatcttacagagttggaatagatggaaaacaaagtgtgcctattgatctaaaggagtccatccgagtccttgctaaacttagagaagcaccttggtattatgcagaaactaaagaacttccgagatcatcacatgaagtaaaagatggacactggcattccatctcaaagggtgctccttggtttccttatgaaggtaaagaaataagccgtttatcttttgaatcgcgagaaaccatcaaatccacaccaaagctaaaagagcttcctagactttcactggatagtaaggaaggttcattgcgcagttacagcactgactcaaaagccactcaccactcaagaaacatttacagtggcacctccacctcaaatgacaaattccctaccctacaacagccttcagcaaccccaagtcgtccacctagtgttgtggcaaaattaatgggcttggaagctttaccggattcctctttggctggtgatggtcagtcaagttcaactgaaacttactcagctcaagataatggtcaattccctagatcatcaaaaaatggactcaccaggccactccgagtttctaattctccaaaaatgtctttgaaagacccaacttccccacggcgaaagaatcatgatctggttatgaaacccatccgaagttcaagggttcccattgaaccagcaccatggaagcagcaagatggaaatcaaagctcccagaaacagaatttaaggggcgtaaaagctccaacgagagcaccggattcctttccttctgtttatagtgagatagagaagagattgaaggatcttgaattcaaacaatctggaagggatcttagagcattaaaacagatacttgaagcaatgcaagaaaagggactattagagagcagaaaagaagaacaagctccaaatgttgttggaagtcaaagtgactatgaaccaaaagctaccaatcaaaatcagaatacaaggtcagtaaggcaacaaaacactcagagaaacaattttctatcttccacagtcaaaggatctgactcagcaagggcttttgaatcctcaatagtgataatgaaaccggcaaaacttgttgagacaactgtgattcctgcttcttcagtcattccaattggtggcctttctggttcccagaaacaccagaatggtgctgtatatgttgataataaaaccagtacatctactactcgagtagcaaaagataagtctcccagaaacattcaccgggatgtgtctgccagttccattgataagaaagcaagtagtagtaagactacaagattaatacaatctcaatctaggtctcaacaacttccaaaagaaaatagacaaagttcagtgaagcactcaggatctgtgagcccaaggttgcaacagaagaagttggagttagagaagcggtctcgtccccctgccccaccatcagattccaacaaacccagaaggcaatctggtaagaaggcaacagaatcgggttcaccaggtggaagacaaagacccaaatccctcaacgtaccgcatggtgatgagcaattgagtgagattagcaatgaaccaaggagtttaagtttccagggggatgaaatttctctgcaatcaaacagtttaactgtcaactcaaagatggatatggaagtcacaagtagtttacaaactgttgaaattgatgacagccaaagcccatctttgaaggctgtgaagcaattgatttcagagacagtgcagaaaaaatcaactccaaggttggatgaggatgagacagttgcagaactagcaacagataccccggaacatccaagtcctatctcagttcttgatggctcagtgtacagagatgacatgccatcccccgtaaagcagatatctgaagattcaaaaggtgaggatgctcaagaatccaaagaaaatgagattaaagatcagtggaaccctgcagatagcctttcatttaactgcactggatccctagagatcaatcgcaagaaattacagaacatagaccaccttgtccagaagcttcgacgactgaactccagtcacgatgaagctagaatcgattacattgcttccctatgtgaaaacacaaatccagaccacagatacatttccgaaatattattagcttcaggtctcttactcagagatctgagttccgagttgctgacatttcaacttcactcgtcgggtcatcccattaaccccgagctattccttgtcttggaacagaccaaagcaagtagtctactttcaaaagaagaaagcagccctggaaaagatgctaacatgaagctaaacaaagagaaatttcacaggaaactcatctttgattctgtgaatgagattcttggtgcaaaattcggctcctcacccgagccatgttttcagcctaacagtaacagactcacaaaaaaaaccttgagtgctcaaaagcttcttaaagaactatgctttgagatcgaaaaaattcaagccaagaagccagaatgctgcttagaagatgatcatgatggtctgaaaaatatgctgtgtgaagatgttatgcatggctcagaaagttggacagattttcatggttacttacctggggttgtgttggatgttgagagactgttatttaaggacttagtagatgaggttgtgattggtgaatcatcaggtttgcgagtcaagccatcggttaggcgcaggaagctatttggaaagtag

SEQ ID NO: 24215 - DNA, 1013 bp, Glycine max
  Peptide Sequence Number=SeqID_140993
atggagaatcagaaggtgggggaatcggtgcatgtgagggaggaggaggatgacgtggcggtggagaaagaggaggatcatggagatgttggttccagcatgaccttggagagggtcgctgcagctaagaaattcattgagaatcattacaagtctcagaggaagcacatccaagaacgcaaggagaggcggttaatgctagaaaagaagttagcgtcttctcaagcaccagaagaggaacagatcaatctattgaaggatttagagctcaaggaaactgagtatatgcggttaaaaagacataaaatatgtgttgatgattttgaccttctaaccattattggcaggggagcctttggggaggtaagactctgtcgggaaaagaaatcaggtaatatatatgccatgaaaaagttgaaaaagtctgaaatgctcagcaggggacaggttgagcatgttagagctgaaaggaatgtacttgcagaagttgcctgtgactgcattgtgaaactctattactcttttcaagatgctgaacacttatatctcataatggaatatttgcctggtggtgatataatgactttgttgatgagggaagaaacgttgactgaaactgtggctagattttacgttgcccaaagcgttattgccatagagtctattcataaacataactacattcatcgagatataaaacctgacaaccttctattggaccaatatggtcacatgaagctgtctgattttggtctttgcaagccacttgactgctcaagtctatcatctattagtgaaaatgaaatcctggatgatgagaacttgaatgataccacggatgttgatggagccttgtcaaatggcagaaatggcaggcgctggaaaagtccccttgagcaacttcaacattggcaaattaacaggaggaagttggcattttccacggttggaactccagactatattgctcctgaagtactactgaaaaagggttatggtgtagagtgcgactg

SEQ ID NO: 24216 - DNA, 357 bp, Glycine max
  Peptide Sequence Number=SeqID_140994
atgttctacttcttttgccttggtgatgagtatcttcagattgtgcattggaaaaatcacttaaaatttccagaggaggccagattgacacctgaagccaaggatctaatatgcaagttgctttgtggtgttccacataggcttggtactagaggagcagaagaaattaaagcacatccttggttcaaagatgtcatgtgggacaggctctatgaaatggaggcagcatttaaaccacaagtcaatggagagcttgacactcagaattttatgaaatttgatgagtgtgccttgtctacaccagtgcttgttcctaacaagagaagtaggtgcactgaagtggtggtgcgcttataa

SEQ ID NO: 24217 - DNA, 165 bp, Glycine max
  Peptide Sequence Number=SeqID_140995
atggcaatcatctcagagacaagaagaaagggaaagaaacaccacataacccttagaggggaaaaaattagaccttattgctacatctccaacaggaagataaatgcagggaagatcagagatgaagatagactaggctatagcgaaaaacaacaaagctgctaa

SEQ ID NO: 24218 - DNA, 453 bp, Glycine max
  Peptide Sequence Number=SeqID_140996
atgaggtcgggggtccaaaggtttctgtccaaacagcttatggtggaaaacaatccttatgatccaaatctgatggttttcatggattacagagactacatgaagcaaaatgttcaatgtccagaagcaaattttccaacatttctttatgcaatgcccatgtcccgtacaagagtgttctttgaggaaacctgtttagcgtcaaaagatgccatgccttttgatttactaaagaagaagctcttttcaagattaaatacaatggggatcagaattacgaaaacttatgaagaggtaaggtattggaaatgccaggaatggtcttatatcccagttggtggatcgttaccgaacacagaacaaaagaaccttgcatttggtgcagctgccagcatggtgcatccagccacaggcatgacttcaacacattttgatttaagggatacggtttaa

SEQ ID NO: 24219 - DNA, 267 bp, Glycine max
  Peptide Sequence Number=SeqID_140997
atgttcgaatgccctcaatgtccagctgcagaattagagctaatccaaaaagaaagaatgctctctggcgtttcctttcttgaggccaaagggtattccaagctgaaaggaaaaaaaaattcaaatgcatatacaaatagattctcctttcttctttcttgcgtaataatgtccttggcatggccatctttcaaaatagtagcaattactgaagcatattttggagcttctgacaaagatctcacaacagagtaccctattggataa

SEQ ID NO: 24220 - DNA, 581 bp, Glycine max
  Peptide Sequence Number=SeqID_140998
ccaacagtgagggcttatgtggtacgattgaggttatcagccctagttacgacacggtaccctggcgtaaacaagggtttcatgagtgcccttgtggagaggtggcactaagagacatcatccttacacctgccatgaagcttctgctaatgactcgccttggcatttctacagaggaggaggctagagcaatgactaccacatgttctagggttaggttgacgtggctgacagctgtatcaccggagtcactacaatggcatacctatatgaccatctctcctatgcgagctagtacaccaacaagtaggttggagtcatgggcgtttgcgcatctgcccaatgttggctatttcgagcctaagatcgatgatctgaatgacttgattgccaacaaatggaagccaacacaagtaggtcttttctcttacttcatcaaatgcgagatagatgtgtggtcttatctttcagagaggggcttcaaagttgggtgcaacttagagaggcaaaggaagaggacggccaaggccaaggacaaggatggtggcaagggcaacaagggtggccgaggcggattatga

SEQ ID NO: 24221 - DNA, 1154 bp, Glycine max
  Peptide Sequence Number=SeqID_140999
atttgtttgcgcgaatccatggccttggttttggaatcaactacggacagataggcaacaatttgcctcttccctctcaagtggctgttcttataaaatctatgaatgtgagtaggatcaagctctatgatgctgatccagatgttctacaagccttctctcagtacaatgtggaattcattataggacttggaaatgagtacctagagaacatgacaaacccttataaagctcaaacttggattcagcagcatgttcaaccttacctttcacagactaaaatcacttgcatcactgtgggaaatgaggtgttcaatagcaatgatactcagcaaatgttgaaccttctcccagcaatgcaaactgtgcatgatgcccttgttaatcttggactagaccaacaagtaaccgtcacaaccgcgcattccttcaacatattatccaattcctaccctccttcgtccggagcttttagggaagatcttgtgcaatatatccaagcccttcttgactttcatgctcaaatcaactcaccttttcttatcaatgcataccctttctttgcatacaaagacaacccggatgaggtttccttaaactatgtgctttttcagccgaatgaaggcatggctgatccaaacaccaatttccattatgacaacatgttgtatgctcaaattgatgctgtctatgctgccatcaaacaaatggggcatgatgatgttcaagtaaggatttctgagaccggttggccttctaatggtgatcctgaagaggttggagctacaccgcagaacgccgcattgtataatggtaacttgatcaaaaggatagagcagaaacaaggcactcctgcaaaaccatcggttccaattgacatatatgtctttgcactttttaatgagaatttgaagcctggtccagcatcagagagaaactatggactttactatcctaatggttctccagtttataacattggattgaagggttatctcccagagatgcctttggcagctaaatccaatattgtatattttgatcgagtagtttttaatgcttccatcgttcttaatctgcagactttgtctgtcaattttcttgtatgcataattacatgcttgatatttgctttggagctttcaagatggtga

SEQ ID NO: 24222 - DNA, 722 bp, Glycine max
  Peptide Sequence Number=SeqID_141000
atggagtgcgttgcagcgaggaacttggcggcaatggcgttttgcgtgagtccttcgtcgtcgaggttgaggttgcgacggaagaagctgtggagaagacgagccgcgtcgtcctcgtcgtcgtgcggcggcggccgcggcgtgcggtggctgaaggtggaggcaaaggcggggagcgagagctgcgttgcgaccaaagaggacttcgccgatgaggaagattatgtgaaggccggtggctccgaactcgttttcgtacaaatgcaacagaagaaagccatggaaatgcagtccaagctcgcggataagttgccacctataggagatgatatactggatctagttgtgattggttgtggtccggctggtcttgctcttgctgctgaatcagccaagttaggactgaaagttgggcttattggtccggatctcccttttacaaacaattatggtgtgtgggaggacgaatttaaagatctcggacttgaaggttgcattgagcatgtttggaaggataccattgtctttcttgacaataaggaccccatttttattggtcgttcctatggacgtgccagtcggcatctgcttcatgaggaattgttaagaaggtgtgtcgagtcaggtgtctcgtatcttagctcaagagtagaaagtattattgaggcaaccaatggtcatagtcatgttgtctgtgaatatgacattgtagttcccagcag

SEQ ID NO: 24223 - DNA, 456 bp, Glycine max
  Peptide Sequence Number=SeqID_141001
atgtcggaggcggaggagctgccccgttctatcatgcgccgcgtcgtgaagtacaagttgtcccgttgctccgaagacggagaaatttccgtcagcaaagacggtcttctcgcattctccgaaagcggtaggatcttcatccactacctttccgcaacggctaatgacatatgtaaggagtcaaagaggcagattatcaatgttgagaatgttttcaaagctcttgaggaaactgagttccctgagtttgtttgccctctaaaagcttcccttgaagagtttaggaagaagaatgctagaaagaaagtcgtagtgtcaaagggaaaggaagatgagccgaagaagaaaaggaagttggaaggtgagtcatctgataaaggcgaaggttctgagaaaggagaagataatgataaaggtgaggattccgataaaggtgtgagtggtgatgaccaatga

SEQ ID NO: 24224 - DNA, 273 bp, Glycine max
  Peptide Sequence Number=SeqID_141002
atgagtgggaaaggtggagtctgcatttgggagaaggaaactaaagcagcacaactttcttttcatttgcccaaggaaaatcctacacttcgcatgatgttggcggaaattatgagaactgctgtgtatatatgcacaggaatgagtgtagcaccgcctccgctttcgtctttgccacaaccttcctacacaaccggaattgccacctcacctaatgacaacaaccgtctcatcaccgtcatcgataacaatgcgttgatgaagaaaatttaa

SEQ ID NO: 24225 - DNA, 540 bp, Glycine max
  Peptide Sequence Number=SeqID_141003
atggcattaaccgacaaaaagcgccgcttcgtcgatgcgctgctgtcgggtctatccggtgcgaaagccgctatccatgcgggttacagcgaaaacggagcggcccaagcagccgcccgattgatgcgtgacaagcatgttttggctgccttggggcgcgtcgccgaagttaacaaaacagttaacaaaaaagcggttaacaaaaagggcaagacgcagcccccggtaggcgaaactccgcaggccgatgtggccttgccggcgcctgctgatgaaagctccatgggcggaatcggcctcaaggcgctgggcctcacgtcggatccacgggcggtgctggtggccatcatgaacgatgcacgcgaggaaccaaagctgcggctcgaagcagcgaaggccctcatgccgttcacccacgggaaggtggcagaccaaggcaagaaggacgcgcaaaaggccgcagctaacaaggtggctgctggagggcgattcaatgcgccaccgccgccgacgcatctgcgcgttgtcgggaagggctaa

SEQ ID NO: 24226 - DNA, 240 bp, Glycine max
  Peptide Sequence Number=SeqID_141004
atggtgagagtgaatgtcaatggaaggagagaaaacagtgagggggtacaaaaacttttattgcaattagacaatcatgcttatttgtcttcatgttacaatggcggtgaacgttggaggctacaaaccaagcattggaaccgaatgaaggcctctaatagggtggcgctaagcaagtattgtcgatggctatcttttgctacacaagcaatgatgagtcttacacgactagcaacatga

SEQ ID NO: 24227 - DNA, 954 bp, Glycine max
  Peptide Sequence Number=SeqID_141005
atgactgaagaccaggataatggagaactgaagattgcagctccagcagaggggaacacactcactaatgttggttggattgtaactgcagttggggggaggggggcatgctggagattgcagccacaggtagctggaaaaactaggattctggtggcctgtgcaaggatttggcagagggagggaaaaattagtttgcaacagttagtgttgttagttagaggggctaaattagatataaaaaggtccccgcggggagccggggaacgggggcggggtaaaaaatacccccaccacgggagcggggatggggagcagggtaaggtgaaggcggtttatgtgaagaacctgccaaagaatgtaactcaagagcagttgaagaagctttttgaacgccatggaaagatcacaaaggtggttcttccaccagcaaagtctggtcaggaaaagaacagaattggctttgtacattttgcagagaggtcaaatgctatgaaagcacttaaaaacactgaaagatatgaattagaaggtcaacttttagaatgctctctggcaaagccacaggctgatcaaaagtctggaggatcaaacacacagaagccaggaccaggattgcttcctagctatccaccacatgttggctatggtttggttgggggtgcctatggtgcacttggtgcaggatatgctgctccaggtcttgcacagcccttgttatatggaggaggtcaaactcccgctggaatggccatgatgcctatgcttttggctgatggacggattggatatgtcttgcaacaaccaggaatgcagccacaagccccaccctcacatcatagaggtggcaggggcggtggtggcagtgggagtggcaacaggaatgccggaagttcaagtaagggaaggcacaacaatgatggcggccatgggcgcagataccggccatattag

SEQ ID NO: 24228 - DNA, 960 bp, Glycine max
  Peptide Sequence Number=SeqID_141006
atgccttggggaaaagcaatttcttcatcagctgctaagtcatccaagcctgaggagccagttgaatctgatgagaaggttgattttgaggaggcaaatgatccagaggaagcaatggaagaggaaattgaatatgaagaagtagaagaagaagaggaagtggaagagatagaagaggaagtggaagaggtggaagaagaggaggaggtagaggtggaagaagaggaggaggaggaggaggaggaggaggaggaggaagaagtggaggttgaagaggtggaagaagatgatgccatgcaaaatcatagcagtgatgaagcaaaggtggaagatgaggatgagaagagaaaacatgctgaactcctttctcttcctcctcatgggtctgaagtatacattggtggcattcctcatgcctcagatgaggatttgaaatctttatgtgagcgtattggtgaagttgcagaggttcgaataatgaagggaaaggattcttctgagaacaagggctttggttttgtgacttttacaagtgtggaattggcttctaaagccattgaggagctaaataatacagaattcatgggtaaaaaaataaaatgttcgaaatctcaagccaagcaccgtctttttattggcaatgttcctagaagctggggtgttgaagatctgaagaagattgtaactgagattggacctggagttactggtgtggaactagtcaaggatatgaagaacaccaacaataaccgtggctttgcttttattgactattataatcatgcatgtgctgagtattcaaggcaaaagatgatgagcccaacatttaagctaggtgagaatgctccaacagtgagctgggctgatcctaaaaatgccgagtcctctgctgcatctcaggttttgactcatatgtcttccttctttttagctcagttgataattgatggttatggttaa

SEQ ID NO: 24229 - DNA, 186 bp, Glycine max
  Peptide Sequence Number=SeqID_141007
atgtggcattgggatatagatggtgtcacatcctctgccggattttattcttcatctgaggacattgaggctactttctctactatgatatctccacgattggtgttacctgagtcctggataccacctagagtagacttggtgaatcttgtgtttgaggatgaaggacgaggatacatctattga

SEQ ID NO: 24230 - DNA, 1323 bp, Glycine max
  Peptide Sequence Number=SeqID_141008
atgacggaggtgctccatttctcatcctcttcgtcgccagccacttgttcttctgatggcattctccaagaagcaccgccaccaccaccaccttcttcttctgtgagcgcggtggtggacgggttttctacggtcaccgactgtgacgggtgcggggtcacattcacagacagaacgcagcagcaggaggaggagctctctcttctggcaattcttgtgaccctcttgaggaaatcgcttattgcttgcaacaagagcgaggagggccatggcgccatggagattgggtggcccactaacgtgcgccatgtggcgcatgtcaccttcgacaggttcaatggcttcttgggcttgcctcgtgagttcgagcccgaagtctccacaagacctcccagtgctagtgcaactgtttttggagtttcaacagaatccatgcagttatcatatgacacgagagggaacagtgtgccaaccatactgctactaatgcaaaggcacttgtatgctctcggagggttgcaggaagagggaattttcagaattaatgcagataatagtcaagaggagtctgttagggatcaattaaataggggattggtcccagaagatgttgatatacattgtttggcaggacaaattaaggcttggtttagggaactgcctactggtgttctggattctttatcaccagagcaagtaatgcaatgccagactgaagaggattgtactgaactggccggccagctacctcacactgaagcttcccttttggactgggctattaatctaatggctgatgttgcccaagaggaagacttgaataagatgaatgcacggaacatcgccatggtttttgcaccaaatatgactcatatggcagaccctttgactgcattgatgtatgcagttcaaccttctgatgagaatggggaccacagtcttttggagtcctgtcagcaagatgacattgccactgaaaatgaagaggccggggaaacctttgtttacgagaaaactgaattagactgttcccctgaatctctccaaagcaaatattcaactgaaggagaatgtggcagtttgataggctctcctgagaatctggtttgtgaggaggacttgtattgtgagtttccacccaaaggaaacattgagaagagtaagagtggacaatcaagtaattccagtgctaaaaaggggtccaaaagaaccagaggcctgctccaacctgtgatccatgcaacagtggctgttgataaaaagggtattagcaatcttagccgcatagattcaagatcagagcggatagaagcctggcggtga

SEQ ID NO: 24231 - DNA, 438 bp, Glycine max
  Peptide Sequence Number=SeqID_141009
atggcggtgcggtccacagtgtcgcgtttcccgatggacacggacgcgcgcgagggctccggcctgctctggggtgtcaccgtcacgccgttcgccgccaccgacgagaacacccgcgctccgtcgtacggctccggcggcgacctcttgccccggtgcgagaactgctgggcctacttcaacacctactgcgagctcgagcagtggtcctggtcctgctccctctgcggcaacctcaatggactctcctccgacgccatcgaccgctactctcgccctcagtcctgcgccgagatgatgtcctccttcgtagatctcgaattgccttcgcaggaatccgcagaggtagcggcaatgcaggcgtgtccggtttatgttgctgctgttgacttgtcctgtaagattccttgcattttgcgtcacaaggcagctagttga

SEQ ID NO: 24232 - DNA, 1521 bp, Glycine max
  Peptide Sequence Number=SeqID_141010
atgctgattataatccctaataaatcagctgcagatattccttatttgcaaagcatatctttgatatgtatagaaggatgcaatgatcaagcttcagaggagtttctagaacttattaaaagtgcattgctggcagctctggaagctcttgctcctggttcactttttgggcttgctacattcagccacaaactaggattgtatgatgttcaaggtccaatacctgttgtgaaaaatgtttttatccctcctgatgcagagggaaccttgcccattgagcttgaagatgtcatgcctttgttacagtttctggctcctgtggaaacttgtaaggaccgtattgcatctgcacttgaaacacttagaccaacaacttcatgggagagaaccacggcagcaggtcaagggctggatggtgttctgataggtgggcgtggttttgggatggcaatggaagctctctgcaattaccttggatctgaatatgggaacacttttgctttagctagagtctttgccttcttgtctggtccccctgattatggagctggacaattggacacaagacgatatggtgaacaatatgcaagcaaaggagaggatgctgatcgtgctttactcccggagcagacacccttttataaagatctggctgctgttgctgttcaagcaggtgtatgtgttgacatattcgccgtaacaaatgagtacactgatttggcatccctaaaatttctgagtattgaaagtgggggttccttatttttatacacaagtaccgaggattcaacattgcctcaggacatgtatcggatgctgagtcgaccgtatgcttttggttgtgtcctgcggttaagaacctcgactgaatttaaacctggcaattcttatggtcacttctttccagatccacagtatgaaaatgttcaacacatcatatgttgtgattcttatgctacatatgcttacgactttgtgtttgagaacaacgttggattttcaagaactaaatcagatgttcctacaattcagattgcatttcagtactcagttgtagttcctcctcaggaactttctatttctaattcaggaggggtttctacaaatagaaccaagcattcccttcagcgccggctaaggatccgaacattgcaatttggtgttgctcagaacattcatgaactttatgatagctgtgatcccgaagttgttctatctttgcttgttcacaaggttatattagcctctttggaggaaggagttagggagggtagaattttgcttcaagaatggctagtgatcctcacagctcagtacaacgatgcatataagcttattcagtataataatggaagttccgtaagatctcagattgatgttgcattctctcaatgtcctcaattgcagcccctaccacgcctaatttttgctctacttcgaaatcctcttctccgctttcatgaagagggtgttcatcctgactatcgcatctatcttcaatgccttttcagacaaccatga

SEQ ID NO: 24233 - DNA, 162 bp, Glycine max
  Peptide Sequence Number=SeqID_141011
atgaacacaaagttcaagatcatcacaggatccaaacacaaacaacacatggggaggagaccagtcagggtcacgttgttttgcgagaatgctccaaccatgtgggatcgacatgggcttgaaggagcactcaaaccgggtgtattcaccctcaaggcctag

SEQ ID NO: 24234 - DNA, 636 bp, Glycine max
  Peptide Sequence Number=SeqID_141012
atggacatgcaaacataccttggtaatatggatcgtttaattgcggaatattccactcttatgccctttactactgatgcagagacattttacaaacaacacggacagttcttcatggtagttgctcttgtcggactcacaccggaccttgaagcattattgcgtctctccattccacatacctttggaccttcttccacgtctaccgggaattcctctgcccttgtatctcattcctctcatcatggaggacttggtattcactatcactactacaataattggggtcatgctgaagcaaaggtattcggtccacttgtaatccatcgcattatgcaaaggagcaagaagcagaaaacagttgctatatctagtgttgaagttgagtaccgtgctatggcagtagctacatgtgagattacatggcttagacaacttctccaacagctaaaatttggagacactcaagatactaaactgatatgtgacaatcaagtgcttttaggagaaatcatcactgactttgtcagctctagtgaccaacttgcagacatgttcattaaatccctcaagggctctcgtgttgacaacatttgtaacaagcttggatcatatgacatatatgctccagcttga

SEQ ID NO: 24235 - DNA, 519 bp, Glycine max
  Peptide Sequence Number=SeqID_141013
atgaagatcgttgcagaggcagaaccatttggcagtgacgagaatgtcatagacggtggggaggaaggggtggtggagatttgtgtccctgaccatggcggcaaacacaacggaaagggagaagcggaggtcggagggaaggatgcagcggctagggggctccacgcggaaccggtgactggcagcccggagggggttggaggagggtgcgtgctgccatgggaaggggaaggcggcatggtttctgctggtggtggtggctttgcaaaggaagaagatgggaaaagttggctggttaccttgggaagcagaggtggcatggtttcggctgggggtggtgacttcgcagaggaagaagatggagaggattgtctaggtaccatggtattcaatttcaggagaatgacatcaagtttggaatccatggaagcttgggctgcggcgagtttggccatggcggcctcgaggcggtccacgcaggcggcggaaagttcggcgtccgccattgaagagcggtag

SEQ ID NO: 24236 - DNA, 489 bp, Glycine max
  Peptide Sequence Number=SeqID_141014
atggtcactgctaggattttgctggaaaatgtcaagacaaagcatcctcagttgctatatgagtccaagttgtacagagttctccagggaggaactggaattccagatgttagatggtttggagtggagggagattacaatgttctagtgatggatctgcttggacctagtcttgaagatctatttaacttctgcagtagaaagctctcactaaagacagttctcatgcttgctgatcacatgatcaaccgtgttgagtttgttcattctaaatcatttcttcatcgggatatcaaaccagacaatttcctcatgagcttgggttggcaggtttactgtattgattttggtttggcaaagaaatatagagatagttcaacccatcaacacattccttacagatttatgtttctggctataaattctggctacaaagatgagaattatgccttggaaggcttggatggttgcttatacaagaaagggtaa

SEQ ID NO: 24237 - DNA, 903 bp, Glycine max
  Peptide Sequence Number=SeqID_141015
atggtttctttcagaggaccacaaccatccaacttcgtcccatttacacctaataagtgggaaaattttgaaaggagaaaagaaaaccaagggtttaagaacctctatataaagatagttaggcaatcacagcttctcatcagtatagaccaccttcccctctcttctgttactaatggctccctcatcaaactacatttatttcctttcctcactacgcttttgtttgctcttcaaatcactgttagagacagccagttcttcagcaaagtcacccatttcgacaaagacaatgtcaaagtgacagaacttcccaacaaagaagcaccagaagtaaacaagccagagcaacaaccacctttcattcccgagactatggcctatatgaccgagtttgagaactccaacaacaagaactacaacaatgatgcctataacacaaggttctccgaaaccagttacaacaacaagtattacaacaaggattcttatgagggtaaccaatatgagttaagtgacacaaagtacacagaagaaggatacaacaacaagtatcacaactcctatcagaacaactacaacaacgatgctgccaatgaaaaatactcctacaacaacaacaacaacaaaaattacaatgctcacaataacaggtacaatacttacaacagcaatgctgttagcaggtacaatggtgagaggcaaggaataagtgacacaaggtttttggagggtggaaagtacttttatgacgttggcatggagatgtacaatccaacaaactatggtgactcgtctagggaagtaaacactaacaattggtacaacaacagaggtgtcaactacaatggataccagaaccaggaggagtttgaagatgaacatgagaactttgagccatga

SEQ ID NO: 24238 - DNA, 258 bp, Glycine max
  Peptide Sequence Number=SeqID_141016
atggtgaatggtacacttgttattttatacgactctacatacatctatgctgctctggtgaaccatatcaggaatctgttcaccagggattggaacttcagtatccaacacatttacaaagagggtaattgttgtgcggatttgctaactagaaaaggttcttcatctgataagttagttattgtggatcagtgcccgccattcctcattctggctttactgtcagatgcatgctgcactctccatgttaggagttag

SEQ ID NO: 24239 - DNA, 155 bp, Glycine max
  Peptide Sequence Number=SeqID_141017
taaggacacccattcaggagtttctgcatgctcacagggaagatgggaggttgaagcttcactttgtgcagccagaggatgaagaaaaagaagaagatggtgacgacgaggattatgatgaggtagaaagtgtagtggaagaagaacatgtgtga

SEQ ID NO: 24240 - DNA, 427 bp, Glycine max
  Peptide Sequence Number=SeqID_141018
gaaaactttgccggtggaagaaatcttgaccattgacattaaacccgggtgtaaaaaggggacaaagatcacattccctgaaaaaggaaatgagcagccaaatgttattgcttcggatcttgtgtttgtcattgacgagaaaccccaccctgtgtttaccagagatggtaatgatttggttgtgacacaaaaggtgtcacttgaggaagctctaacgggctatattatccatcttacaacacttgatggcagggttctcaaaattcccataaacaatgttattcatccaacctatgaagaggtggtccccagagaaggtatgccaattccaaaagaccctttgaagagaggtaatcttaggatcaaattcccagcaaagttgaagtcagagcagcaagccggatttaagaaacttttgccgcattga

SEQ ID NO: 24241 - DNA, 222 bp, Glycine max
  Peptide Sequence Number=SeqID_141019
atgggcaaagaggaaaatgatgaaaatgaaaagaaagatggagaagatggagacgaggatgaaaatgcacaagaggaggatgaagaagatattagtgatgatgattataatcagatgaacctacctattagatatcagtatggagaatgttcttctgctcatcccgtgacagctatacaagcatggactgttgctcctttaattttacagtttggaagttaa

SEQ ID NO: 24242 - DNA, 294 bp, Glycine max
  Peptide Sequence Number=SeqID_141020
atgtctctagagttagggaatcagaagtgttccaaggaagagtttttgctcttgcaaaaaccccacctgcacttctttcaaaacgtcaacaagggttgcaaccaaactgccatgagagtcatagcggctttgacatgcatgacaagtcctcaaaattgttcgacaagtggtgatgatggacaatacgctgacagagtggtcaaaggcagtgtcaaaggtggtgcaaagggcacacgcgttctccttcacataaggggaattgagaaacaaagggtaagggatgagaaggcatag

SEQ ID NO: 24243 - DNA, 396 bp, Glycine max
  Peptide Sequence Number=SeqID_141021
atggcatctagtgatgatgatgatgatgttgcttatgatggtgatgctctcagtaccaatgaaaacgttattaaatgtgggatgaccactatggagaaagttgttcgtctaagaaataagggaataacatttaaggagataggattgaaggacacatccatgtctcgctatgatttgtggaaaagtgcacgtgtaaataagttagaagtggttgataatgaaaatgttaaacaaaagcgcaaaagaaaggatgatgacttgagcttgaaagagcaaatagcattccctataggcaaagtgaaagaattagagagtatgcttcacgctaaaaaggtggatgggcaacctaattcaacaacaaacaatatgaaagatagttgtatgcttctttcttga

SEQ ID NO: 24244 - DNA, 663 bp, Glycine max
  Peptide Sequence Number=SeqID_141022
atgagggttagttcaataagacaaatagcaatgaacaatacagagaagacatggtataaagaagaaggtgaatggacaaccagccagggaggcgtttgtggagctaggttaatggtgtactccatagtaaccacctcctccttcctacccttcgccttctccaccattcttagccaccgattactcacttgccttagggattgggaaaggttttggcagcgttctaaactcgacaagaagtgcagattaggacaggtggtgatcgatgacgccaatgatagagtctggcatctggaaggagtagaatgtgtgaagcaacaaagagagaaagataatagcaagaacaagaatggctgttccgccatctgcaatggcgagaaggagggtgccgccattgaagatggcgagaaggtggcttacctggcatacctggagcgtgccgccagtggcacaggcgagacacctgctgatgtggtgatctcgccattagctcctgcgagacatgccaacgtgatccatgtcgcctgtgctgatggcgggacatgccaacatggccagtcccgccattggctcctgcgagaccaagctggccgtgacttaggctaccaggctagggcatgttcttgctttttcaggaaaactagagcattgctttgtagataa

SEQ ID NO: 24245 - DNA, 222 bp, Glycine max
  Peptide Sequence Number=SeqID_141023
atgtcgaaccctagctttattggccaacccaatgaagatctgctaatagggatagatacatcaagtgaactttgttccttgacttgtgtgacatcaaaatcccaccaatcaaccctaaaatgtttagcttttcaaccctattttttgctcatatcgatgtgggacttggattatttccaacacaccccgtcacgtcaagcacttcttgggcttgatgcgtga

SEQ ID NO: 24246 - DNA, 232 bp, Glycine max
  Peptide Sequence Number=SeqID_141024
atggaaagtgaacaacatcctccacaacaaagcccaccaatcattatcaacattcatgatgaaggactagaaccacatgctcaatcatatgaattcacactacaacctcatcatcatcaagaagattatgggtacaatccgcagttcttcattgctagcaaagaagactttatgagcaacctcatggatatagatcttcgaacaccggagtcggcttatgcgtacatgcaaa

SEQ ID NO: 24247 - DNA, 294 bp, Glycine max
  Peptide Sequence Number=SeqID_141025
atggaacaactctcttccccagttaagggaattgaaagcttggcaacaagcaacgaacgcatcggtttcctaagcggctcctttgctaaaaattatctgacagaggagctcaacattcccagatccaagcttattcctctcaactcaccatcagaatatgaaaaggccttgaagaatggagctgctaataggggtgtcactgcaataatagatgagcgtgcttacatggagttgttccttgcaaccaaatatgaatatggtatcattggtcaagagttcaccaagatgggttag

SEQ ID NO: 24248 - DNA, 204 bp, Glycine max
  Peptide Sequence Number=SeqID_141026
atggcaagggacattggaaaaatacaaagagtgcatctaatgcttttcatagatatcaaggttcagggaaaccaggagaaagggcataagaaaattgattgtggaaagttcatggcttggctagagaacaataaaaaatcaggaggggttcagaaatctaagggtgcccaatttgagggaaagcaagctaagagtaggaaatga

SEQ ID NO: 24249 - DNA, 588 bp, Glycine max
  Peptide Sequence Number=SeqID_141027
atgttcaaaatttttaaaaccgaagtgaaaaagcaattgggaaaaattatcaagattgtaaggtctgactttggtggaaagtattatggtaaatatggtgttataggccaacatatgggactattcaccttatgcttgcaggattgtggaatagttcaacaatacaccatgcttgggactcctaaacaaaatggtgtaaccaaaaggcataacaaaacacttaaagatataaggagtagatgtaacttgtcggagtttctatggggagaagccttgaaaacaaccctttacatcctaaatagagttcctaagtccatgaatgctaagttcctcgagcttgatgtgccaaacccaggtgttccatctaataacattgatgttaagtctcccgagtctgtttctttgccactacttgttcaagttgttagtgttttgagtatttttccaattaagactggggttcagatcgtcccaactgagactacggtctcgattgttccaattgtgaccacagttgcgactagagaaataactagctctcaggccaatgatatgcttgatcctcctgttgtggatgagaatgcctaa

SEQ ID NO: 24250 - DNA, 600 bp, Glycine max
  Peptide Sequence Number=SeqID_141028
atggggtgcaagtggatcttgaagaagaaatctggatcatccactgaagaagtcatccattataaaacacatatagtagctaaaggctacaaccagaaggaagaaatggactacaacgagatattctctctagtagttggacactcctccatacgtgttttgctgaccctagtggcaaatctgaacatggagttagagcagctcaatgtcaaaactacttttctccatggaagattggaagaagaaattctgatgcaacaacctaaaggttttgaggtggaaggaaaggaaatttttttttgtagattgaagaggtctctttatgggctaaagcaatcaccaaggcaatggtacaagagatttgatgagttcattgtctctcatggatacattagaagtcccaatgactcatgtgtttattatagcaaggtggaggttggctcccatatctatgtactattttatatggacgacatgctcataacatctcaaatttttttggcaattcagaggttgaagtcactacacaatagtgcatttgagatgaaggacatgggtgttgctaaaaagattctgggcatggagatcaagaggggttga

SEQ ID NO: 24251 - DNA, 789 bp, Glycine max
  Peptide Sequence Number=SeqID_141029
atggtagtggacatgagggacaatattgatgtagcagagtgcataataaagcttattccacaatggcggtcttttggtgaccggattacccttgacggaaataagtcggtgccgaggttacctccagattcaatgcctgttgttgaccttgttgctagtgaccaagaaatggagttgtatccattggggaaagtactcgggcttggggaactacattggaatgatgaagtagtttggggcatttggtctctaataatgtcaggtgtgattacgcagctggggtattctttccctattaccagggctgacaacattgggagttgctctgttgaatacccaggtgatgacgataggatatgctcccaaggttggaaggagaatgtagaagttttgaaacctaaaccaactaactcttatgtggtaaaggagaaaagcctaacccctacgaagaaagaggctcttaaaagaatcaccgatccatcaaaagaatttgagtattacgtcccctacaagttaattcttatatcttccactgagagtgagaagttgatgctaagaggaaagctaaggaatctcataagaatgttgagggcacttagaaaaagcaatgaagttgtagaagcaaacttcatgatgatgaaccaagcaattttgatgatgccaaaagcccaagtgattgattcaagcttgattcaagacttcaagatcaagcatcaagaatccaatccagtattcaagattcaagagaagaaatcaagaagcaacaagtcaagacttcatataggataa

SEQ ID NO: 24252 - DNA, 132 bp, Glycine max
  Peptide Sequence Number=SeqID_141030
atggagattgttgattattggacagtggatgatagagatagggtggatgacaacgttggtcatctgaatgctttgacttgttcatcatgcccttcaaaaatgcctcataaagctcctaagaagaccattgag

SEQ ID NO: 24253 - DNA, 288 bp, Glycine max
  Peptide Sequence Number=SeqID_141031
atggacgtgtctaccgatcttggtcacaaaagtgcaagcgaattatttactcccgaccaatatcagagcttgttggcacttatccaacaaaatcataagccttcttcttcagatgttcatgcatccaacatggttcaatcttcaactagtaattatgttcttgaaaatttccatatgataccttcggtgaataaggttggggtttgcgatggctccgacgatgatccgaaaggcgattggggtggtgaaggactagaccagcataggaatagccaaggtcgcgagtaa

SEQ ID NO: 24254 - DNA, 261 bp, Glycine max
  Peptide Sequence Number=SeqID_141032
atggttcccttttgcaaacttattccccaaatggggtccttttggaacaatttccggcatggtgctcttttctacgtgggctgcatgcattttgcatgcaaaacgcaagctcgaatggtgacttcatgggcagaagacacgtcgaagcccaacccgccagtgctgctggcgacttcacgtggaagcttgtcccgccagcactgttggcgacttcatggctgtgcagaaatcgcagctctaactggcgatttccgaggctag

SEQ ID NO: 24255 - DNA, 2067 bp, Glycine max
  Peptide Sequence Number=SeqID_141033
atgagaatctcagaatctattgcagaatatgtagctcgtacacctaccttttcagatgatggagcagtaacacttggatccaaaagaagcactttgtttgaagttgatgctaaaactggatcaatcattaaaatccatgcgatgtctgatattgataatgcttctgcaccttggagtgatggcaaccaaggtgttacaaatatcctcaacgtaaacgataaggatcttgctgatcctatgaagcttaattcaccacagccgctgcttaagatttttaggacagattattctcttaaatctgttggtcctagctcaggaatagttttgtggactatggcagtagctgaattagaggctgtcttattatgccaacatacctcttttgatctagaggatgagtatgcttctgacagtagcctcaactttaggatgccatacccatgtcaagagataaaccaagtcattcgcctgaaaaagaattttcagtttgaaccttcactaactgaaagattacttgtggattatcatgaaaatgatatgctctcaattcctaactcaaatctaatacttccttcacagccaaatattgatagattattcaatggtcatgatgataatataatgctccctcaacagcctcttgtggagattacaacaccaggggaagtttatctgaacaggacaagtgaatggccaactccattacctcttatattgtttacggtctttcttgtggccttttcagtcatctatcctctagtgattaagaatcaagatgtaatgaaggaccaaaacagtgagtctgaattaaaaagctcgcctgctaagaaaaagaaaacacgaaaatcagggaagaaaaatgacactatcgataaaagggaaaagcacctgtctccagagaataaggatgttctgacacaaaagggtaattatagagaagtatggcagcacttcaaccaagttgatgaaagtgttgatggacgaaggattggtaaattatttgtttcaaataaagtgattgctaagggcagcaacggtaccattgtccttgagggaatatatgaaggccgagcagttgctgttaaacgtctcgttaaggctcatcatgatgtagcttataaagaaatccaaaatcttattgtgtctgatcagcatccaaatattgtccgatggcatggggtggagtatgatagcgattttgtttaccttgctttggaacgttgtacatgcaatttagatgatttgattcaaatttattcagatatatcagaaaactctgtgcttatgaaggaccaaggtttcagatgtttgataaagtcccaaatggagatggagaagtataatacacaatgtctttggaaggaaaaccgctatccatcgcctctattactaaaactaatgagggacattgtgtctggggttgttcatttgcatgaattgggaatgatacatcgggatttgaaaccacaaaatgttctaataatcaaggaaaaatccttatgtgcaaagctttctgatatggggattagcaaatgtcttttggaaaatatgtcttctttgggtaataatgctactggtggtggcagttcaggttggcaagcaccagagcaacttgttgaaggacgtcaaacacgggcagtagatatatttagtttaggttgtgtcctctttttctgtgttactgggggaaaacatccatttggagaacgtattgaacgggatatcaatattttgaaaaataaaatggatcttttcctagtggagttcattcctgaagccaaagatcttattagtcgtctattaaaccctaaccctgatgtaaggccaaaggcaactgaggtattgtaccatccttttttctggagttctgagatgagactttcctttttacgtgacaccagtgacagggtggaactggagaatagagagactaattctgatcttttggtgacattagaaagcattgctacagtggccttgggtggaaaatgggatgaaaggatggaaccagctttcattgctaacatcggcttggcaacatggtgggttggggtgggattttgctaa

SEQ ID NO: 24256 - DNA, 2799 bp, Glycine max
  Peptide Sequence Number=SeqID_141034
atggctttccaaagggaaactacaaccatgattggagtttggcttgtggtgttgatggttctctccaaagggttatcttcaacaggggttgtaccagataatttcactataccttcttttgtaaatattggggttctctattctttcaatactagtgttggtagaatggtgaaaactgctgtacaagctgcggttgacgatgtaaattctgatccatctattcttgctaacactaagttgaaggcctcactgcaagaagatactaaatacagaggttttctgagcattgccgaggccttgcagctcatggcaacacaaactgtggctataatcggtccccagacctctacaacagctcatgtcatatctcatatagcgaacgagctccaagttcctctgctatcatttacagccactgaccctactctttcttcgcttcaattcccattctttattagaactgcttttagtgacatttatgaaatgactgcaatagcagactttgttaactactttggatggagagaggttattgcagtttatggtgatgatgaccatgggaggaatggaataggtgcattaggggataagctttccgagagacgttgcaagatctcatttaaagcacctatgactcctgaggcaactagggaggagattacggatgtgcttgttcaggcggccttggaagaatcccgggttgtagttcttcacacaagtactgcttggggcccaaaagtgttaagtgtggcaaagtctctaggaatgatggaaaacgggtatgtctggataacaactacttttctgtctacttggctggatataggtagtcccctatcttcagatgcaacggatgacatgcaaggagttattacacttcgaatgtatataccagattcagagcgcaaaagatggtttttttctaggtggaaaaacttgactactggaaagactgctaatggttcccagggtttgagtacttatggtatctttgcatatgatactgtttacgctcttgctcatgcacttgatgcatttttcaaacaagggaaccaaattacattttcacgtgatccaaagttatctcaactacgtggagacaacattcatcttgatgctgtgaaaatattcaatgaaggaaagctgttgcataaatatatttatgaggttaacatgactggtgtatcaggtctattcaagtttacatctgatggagaccttgttaatcctgcttatgaaatcatcaatgtaattggaactgggactcggagggttggttattggtcaaattacactggattatcaattgttcctccagaagcactttattcaaaaccacctaatcgatccagtgcaagccaaaagctactccctgtgctttggccaggagaaacaacccataagccccgtggttgggtttttccaaacaatggaaggatgttaaaaattggagttccaaaaagggttagttaccgagaatttgtctctcaagtacaaggcactgacatgttcaagggattttgcattgatgtatttctttctgcagtgaacttgttgccctatgctgtaccctataaatttgtttcatatggggatggtgacagcaatcctagtaacactgagcttgcccgtcttatcacagcgggtgtctttgatgctgcagtaggtgacattacaattactacagaaagaacaaagatggtggattttactcagccatacatcgagtctggtctagtggtagttgcatcagttaagaagacagattccaatgcttgggcattttttacgccgtttacaccaatgatgtggactgtcacagctgtcttttttctactagtgggagctgttgtttggattttagagcataggctgaatgatgattttaggggacctcccaaacaacaaatggtcacaattttgtggtttagtttttcaaccatgttctttgctcacagggaaaatacagtgagcactctcggtcgctttgtgctgcttatatggttatttgtagttctaataattaactcaagttacacagcaagtttgacatcaatcctcacagttaaacaactttcttcacctgtcaaaggcattgaaagtttaagaagtagcaaagagcctattggctacttgcagggttcatttactcgaaattatttaattgatgaaattggtattgatgaatccagactagttcctctgaaaacaccagaagaaactgcagaagcacttaagaaaggtccccagaagggtggtgttgctgcatatgttgacgagcgtgcttacatagagctcttcctttcaagccggtgtgattatagcattgtaggtcaagagtttaccagaaatggttggggatttctcttgacacttgaagttgtacctgatcaagatagtgaaaatgaagttgcctttccgcgagactcgccattagcagttgacctttcaactgcaatattggagttggcagagaatggagacttgcaaaggatccatgacaaatggcttttgagcagtgcttgcctatcacaaggtgcaaagcttgaagtggacagactcaacctgagaagcttttggggcctctatctggtgtgtggattagcatgtgtgcttgctctcctcatatattgtattcagaccatgaggcagtactccaagcaccgccccgaggagcttgagtcttctggccatggctcaggatcttcgtgtctgcgcacattccttacattcatagatgaaaaggaagagatagttaagagccgctccaagagaaagaaaatggaggggatatcataa

SEQ ID NO: 24257 - DNA, 378 bp, Glycine max
  Peptide Sequence Number=SeqID_141035
atgagggagaaagtagaacaaacacctagcatggatagttgtctttaccttcatccgagcgagaacccagcggtagctcttgtttctccgattctagattcttccaactaccattcatggagcagatcgatgatgacagctttgagtgccaaaaacaaggtggagttcatcaatggaagtgtgcctgaaccaccaaaaacagatcgaacgcatggtgcatggcgtcgctgcaacaacatggttgtatcctggatcgtgcatttggtatccacttccattagacggagtattttatggatggacaaagcagaagaaatatggcatgatctgaaattgcgatattcacaaggcgatcttcttcgaatctccgatctttag

SEQ ID NO: 24258 - DNA, 396 bp, Glycine max
  Peptide Sequence Number=SeqID_141036
atgggtttcggctgttacagggagttgagggactttggatgtcaccttaaagggcaagtgagcaatgatgaatacggagaagaagggcttaaagggcaagtgccacctccagatgccggtggccatacattcttccaaactggagatggcccaacaacgttcaggttcaatccaagaaacgcagatgacatttttgccgagtttttcgggttctcaagcccgtttggtggtggtggctgcggcaatggcatgaggggtggaaggaccatgagtcagcaaggtccacgcaagccacatcccatcgaaaagacattgccttgcacccttgaggaactctataagggcactgcgaaaaaaatgaagatctctagggaaattgctgatgctagcgggtaa

SEQ ID NO: 24259 - DNA, 258 bp, Glycine max
  Peptide Sequence Number=SeqID_141037
atgaaaaagacaacacccacattgggtggtttgctttttatacctgttggtgtagttgttgctcatgtctttgctggttcctcatctatagaagtgtctggggcagctggagcaaccattggatttgctgcagttggtttacttagtgatatattaagcctcaccaagaatcattggagaggtttgcctgcattgacagaagttctattggagggtctgtttggtaggaaggaagtaggtgagaaattgggtggatag

SEQ ID NO: 24260 - DNA, 771 bp, Glycine max
  Peptide Sequence Number=SeqID_141038
atgaactgcattgcaatctatacttcaagtcctaagcaaaaaattctcccatggggactgcaggttgttagtggtgatgggagaagggtcaagcggctcaatccacttcgtttcaatgaatctagagatcataagttatatactgttttggtagagaatttgccagaggatcattcaaagaagaacattcaacaaatattccatgaagctggaaatataaagaggataaccattcatgacccacattctacttcagagtctgcaaaacaacataacaagcaagaaatgctaattagtaataagttacacgctcttgtggaatatgagactatggaggctgctgagaaagcagtggctatgttaaataatgaacaagactggagaaatggcatgcgggttaaacttctcaagggaatggggaagtatggacacaaaaaacaagcttggaaaggacatcattctgagaagaatagctcaaggcctgaacaaacaggagatgaggagaatcatggctctaatgatcatcatgaagatacccatgaggaagaagatggggatcatttgtcaaaggataagggtgggcagaggtatagaaatcaaggaagatcaagaaaacataaatatcgtgctggaaatggaatgggccatggaagtgcaccatcaactcatgctgctgaagcatcaaagtcacctcctggacccagaatgccagatggaacacgtggcttcgcagttggacgaggtcggcctcctgtccctgcttcgaattag

SEQ ID NO: 24261 - DNA, 585 bp, Glycine max
  Peptide Sequence Number=SeqID_141039
atgccttctcattcttgcatcctcaaccaccaccgccatcgctctctcccactccctctccctctccatctctctcgccgcaaacgcctctctctccctccaaccccttccctcatctattctcccagttcccgcttcgattgcgccactctcgagttacatccgtcgattattccgcagaatgaatgctgctttccacgcaatgttgctcctacgagagccttcgacgattttcactgtggcgttactcttactgttcgtaatagtactcgttactcagtggaagtgcttgatgctctgaaagattcgtttgacataccaatgcttgattattgggatgctgatgataattcttctgcgtatatgctctcttctagtgatggggaagacagtgatggtgaaatttttcttactccagtgaatgatcttgatttgccttctgtttcggcgtcaaataatgatgctctaacagtggctgctcatcgttttgcaaatcttgggaggggacgcaagaaatctaggcaaaaatttggcatgatctatgtagcactggcactgcatgttgaagctgtgtccaagtgttaa

SEQ ID NO: 24262 - DNA, 399 bp, Glycine max
  Peptide Sequence Number=SeqID_141040
atgggacatggtgttaaattagcagatgctcttgatggactagctggaggtattgctgcgttggcatttaccggaatgtcaatagctgttcttccaatttgttctgatcttgctatatttggagcttcaatggctggatcttgtgttggatttcttctacacaacagatacaaagcgtctgtatttatgggtaatattggatctttggcacttggcggtgcattagctgcaatggctgcatgtactggaatgttcttcccgctactcatttcttccggatttttcattgttgagtcattatcagttatcattcaggcattttgtatctttttctacttcatgtcgtcctctgatttaggatttgactccttgaaacgaagtttggaatatgtgtactaa

SEQ ID NO: 24263 - DNA, 615 bp, Glycine max
  Peptide Sequence Number=SeqID_141041
atggagcacgcgacacgtggcacagcgcggcgcacgagacagcagcagggtagcgcccctgacgcggacgcgtctgatagcgccctgctgctgggcgcgactggcacctgggtcgtgcccgcgtcaggggcactaccagtcgcgcccagcgacagggcactaccagtcgcgcccagcggcagggcgctaccagacgcgcccgtgtcaggggcgctaccctgctgcctcgtgcgccgcgctgtgccacgtgtcgcgtgctccatggaagcgccttcctggggagcgctttgtaataaaaaaacagaccccctaggagatttccgttgctatatgtgtcattttcattcttacaagtcacttcttcattggttgatacaatttcttgggttaatccccctccccccaaaaccgccacgaagaagaacacgaggagggagaaagagaaagtgtttgcgagggaagtcacgtgtagatctggtggcgtatgggtcagtggcgtgcggtgacggcacagaagatggtgctggatggtgcggtactaatattcaaactaatgaagaggttgcaattaagcttgttggattttaccctggtgttcttaatgtcattgattga

SEQ ID NO: 24264 - DNA, 213 bp, Glycine max
  Peptide Sequence Number=SeqID_141042
atggatctgcttggacctagtcttgaagatctatttaacttctgcagtagaaagctctcactaaagacagttctcatgcttgctgatcacatgatcaaccgtgttgagtttgttcattctaaatcatttcttcatcgggatatcaaaccagataatttcctcatgggcttgggaaggcgggcaaaccaggtggctgatcctgtttacttgtga

SEQ ID NO: 24265 - DNA, 1125 bp, Glycine max
  Peptide Sequence Number=SeqID_141043
atgggtccggagcaaaagacctttgtgattcttgttaacctagggatgggaaatgacccaattgtcaggctagtggcgaatggagattttgaggctaccccaagaaacgggttcccaaacgaggcgattgtggagggccccagcgaggtcccaaactggaagtcaaacggcaacgttgagcttgtggaatcggggcaaaaacagggtgggatgatcctcatcgtaccgcagggtagacacgcggtcaggctcggcaacgacgccgagatcagccaggagctgccggttgagaagggttccatttactcgctcacgttttgtgcggctcgcacctgcgcgcagtttgagtccatcaacgtctcggttctgcctgcgtcgcagacgatagacctgcagacactctacaacgtccagggatggaacccttacgcggtttctttcaatgcggatcaggacacttttaggttgctatttaagaatcccggcatggaggatgaccccacttgtggccccatcattgacaacattgctatcaagaagcttttcactcctcttaaacccaaagacaatgcagtgatcaatggggattttgaagagggtccatggatgttcaggaacacttcactgggtgtgttgcttcccacaaatttggatgaagaaacttcatcactgccaggttggatagtcgaatccaaccgtgccgtccgttacattgattccgatcactactctgttccacaaggcaggagagccattgagttgctctcaggaaaggaaggaatcatatctcaaatggttgagaccaaaccagacatgctctacagcttgaccttctcattgggtcatgctgatgataagtgcaaggagcctcttgctgttatggcctttgctggggaccaggctcagaacattcactacactcccaattccaattctaccttccaaactgctaacgtcaatttcactgccaaggctgagaggactagaattgccttctacagcatatactacaacaccagaagtgatgatatgagttctctatgtggacctgtggtggatgatgtcagggtctggttttccggctccaacgggcttcatgggttgggcttaggaaggcttgggctt

SEQ ID NO: 24266 - DNA, 492 bp, Glycine max
  Peptide Sequence Number=SeqID_141044
atgaatctccttctcgatcatttgcaccttttgtttgcaggatcacaacttccagacccagaaacttatagaagactaataggaagacttctatacctaaccatctcaaggcccgatatttgttacactgttcacaaactaagccagtttgtatctgatcctcgctcaggacatatgaatgcagccaacattctgctaagatacctcaagcacatagttggacaatgggtcctttttaaggccaaattagacacatccctccattcttatgtagatgccgattgggttgtctaccgtgacaacaaagcagcaacccacattgctacaaaccccacataccatgaaagaaccaagcacctagagattgatatgcattatgttaaagaacaagttgataaaggagcactaaagctgattcatcccatcaaaggaaaagctccagctcctttccaattccaattccaaaatctgtttgacaaatttccaagttaa

SEQ ID NO: 24267 - DNA, 360 bp, Glycine max
  Peptide Sequence Number=SeqID_141045
atggagtattacgatgctatcgatggtagttgggaagcttataaggtgcatctctggttgggaacctatggcattgccgaagaagctgctatggtttactacgatgtcgtaattcgtcttcatggccctgacgcattaacaaacttcacgccgccgcaaagagattctccgtctccatctccactgccggcggtggcggagactctagcagaggtttgtgaaatgaaggttattgctatattagataaattaaagaatgacaagagccaaaacaaggagctgttggattcatcaccaaatgaggatgacgatgattgggatggtgaagatcctgaagaaggcatcatttatgtggaatag

SEQ ID NO: 24268 - DNA, 441 bp, Glycine max
  Peptide Sequence Number=SeqID_141046
gtcgctcccaagacattggctgacgtgaaaggtggcactgtgatttcttacaaaggaagggtcagtgaaattaagtctataaagaaattcaaaattttcaacacaaataatttgtgggtaaacttagaagcaattaaaagtcttgttgaagctgatgatgctctgaagatggaaattattcccaatccagagtcgtacctttacactttacaagatggattggttattaggaaccaagctagggcaaatcctaaaaatccttccattgaattggggccagaatataagaaggtggtgaatatgagtttgactttcccaatctccttcacaaggaaaaacaagtttcttgcaaaacttgttgtgaagctggaaatacctcacggagctgtgatcaaagacaagggtaaaaataagaaggcagtttatgctaaggatgtttga

SEQ ID NO: 24269 - DNA, 1335 bp, Glycine max
  Peptide Sequence Number=SeqID_141047
atggagatcatgggatcagacagaagtgaacaattacagcacaagcctgtgcctgttctttctctgcctaaagaagtcgttttctcttcgccaagaccggttagtgagcttgatgctgccgcaactaaacttcaaaaagtgtacaagagttaccgcactagaagaaaccttgcagattgtgctgttgtggtggaagagctctggtggaaggcattagactttgctgctcttaaacggagctctgtttcattctttgatgtggagaaacaagaaaccgccgtgtcacggtgggcaagagcaaggacaagagcagctaaggttggaaaaggtttgtccaaggatgataaggctcaaaaattagccctccaacattggctagaagctattgacccacgtcatcgctatggacacaatttgcacatgtattacgatatttggtttgagagccaaagcacccaaccatttttctactggttggatgttggagatggtaaagaaataaatcttgagaaatgcccaagatccatcctacaacgccagtgcattaaatatcttggaccaaaagaaagggaagagtatgaagtaattgttgaaaaagggaagctggtgtacaaacaagatgggaggcttgtggatactgacggaaagtccaaatggatatttgttcttagcaccacaaggtccttgtatgtggggcgcaagcagaaaggtgcatttcaacactctagctttctagctggggctgctacaacagctgcaggaagattagtggctcaacaaggtgtacttgaggctatttggccatatagtggtcactatcaccctacagaagagaactttaaagaattcataagctttcttgacgagcacaatgtggatctttctaatgtcaagaaatgtgccatagatgacgatgctccttcaattgttgggtccaattcatttattgacattaatgaatcacaacaaattaataagggtcctactctttcttcttccaattatgtcaacaacaatagtgtcactattaatgcagcaattaacaaagagattgaaaagaaggtggtcgctccagttcttgacgtgcccaagaggctaacatgcaagtggtctactggggctgggcccaggattgggtgtgtgcgtgactaccctggacaccttcaaacaagggccttggagcaagttaacctatctccaaggcctgcttctgcacgcccatatagttatggtccaattccttctccaaggcccagtccaaaagttaggatgtctccaaggcttgcttacatgggcttgcccagcccaaggatctcaattcctgctgcaagttaa

SEQ ID NO: 24270 - DNA, 342 bp, Glycine max
  Peptide Sequence Number=SeqID_141048
atggttccttttacagtcttgagatctgagtacaccttacttcaaacaaatgtgaaatggcaattaggttggcctgttggtggctatcctggtcctcagataaatgagtttgtcaagcttggtggagaccagcttgttccatattatgctgacattcttggagccattttgccttgtatagcagataaagaagagaaaattagagttgtaggtgacactctttctgatatagggctttacttgctcacatctttgaaaggtacaccttctaagacggtgcttacatcagcacgtcttagaaggtcagcattcaaagacgatgctaacatcagcacgtcttag

SEQ ID NO: 24271 - DNA, 699 bp, Glycine max
  Peptide Sequence Number=SeqID_141049
atgcaatctattagcggttacgttctcttaattcaattgtgggcatgggaacgatgccctaaattagtcccatcgattgtgcctccacaacaacaaaacaatccacttggctatagatggttacaaaatagaaatcctcgtatggccagtgatagtgtggaacactgtcgttttaaattagacaccatgaaaaagggcgagggtgaaattatagaaacaatgcagttcatgttgtccccatatgggagaagggtgtcaaatttggaagatttggcatcgtgccttgataagatgactcttttagctgaggaagaggatagaattattgaggcacgtgaagaaacttctccttcgattccacaatttgaaagtcaacagtttgatatgttgggtaggagtgtggagacccaaggtttagggcaacgtagggaaagtatggatgcagaagcacatgttattcctgcgatgccagagcgccaacatggaatgtattacacacctgatcagtccacccaagagtcgtctcaaatgtcacccctgtattcgtacccatatcaacgctattctacaacggttgaatacggcctacaacgacggtggatgaccgtcgtagattccaacattgtggaatgtcgaaaccttcaacgacggtgcaacaatgactgtcttagaagtcgcagttttcaacgatcttcctaa

SEQ ID NO: 24272 - DNA, 525 bp, Glycine max
  Peptide Sequence Number=SeqID_141050
atgaatggttccctgagagtaatacataggcttgagtctcgtctttctttcttgtttgcttgtttatatgtgttcgttgatgtatgtgaatgtgaggttgtgttgagaaagtggatgatggacaaaggcacactagggtgtagtgggtggagaggttcgaagaacctagggaaattagcgagtggtgactacctgacatttggtgcgaaccatcaagacctgggaggattggtggcggtgattggaccctattgtgagttaagtgtgatagttacatgcttgggatgcgaaagtgttgaacggaggactcactcctacaacaacaactttcaggtattaacaatgtcgagtacattgagccgtctgcgggctcagtgtagcttacaaagagaacgggttacagaggaccgaggtgaccattcagacatatcgtctgaggagataaaggagtatcgggaactactgaggcagttggaatcgacgtttgaggaggagagtgacgattctttcgagggcacatcatag

SEQ ID NO: 24273 - DNA, 837 bp, Glycine max
  Peptide Sequence Number=SeqID_141051
atggaaaaggaaggatttacacgttgttggtggtggtgtttctgtgcagaggcgaaaatgtcagggaaaggacctggtctcttctctgcgatcggaaagataggcagagatatcctcatgaaggattacaactccgatcaaagattcaccttctcctcctcctccaccaactccggtctcgacctgaagtcaacactggtgaagagtagaggactttcctctggtgatgtggctgcggcatttaagtataagaataaagcggttaatgtcaaagttgatactgaatcaaatgtgttgacgacattcactgtttctgatgtagtgccatccgtgaaaaccattgctttgattcgtttgcctgattacaattctggcaaggtactgagattgtcttgggataaaagatacacaccccttggtttaaaccgctccccagctattgatttttctgggatgatgggtactcccagcattgtcattggagcacaaatcagcttctccacaaggatgggcaagtttacaaaatacaaaggtgataagggagactccatgaaggtgtcatatttataccagctagaaagattgaatgggggagctgttgtgggagagattagcagaaggttctctacaaatgagaacacattgacagttggatgtttatatgtggttgattctcagacagctttgaaggcaaagctgaacaatcacggcaaccttggggccttattgcagcatgagctaacacgtaagtcattcttgacaatctcgagtgcttttgaaacaaaggatttggacaagagtcccaagtttggtttcacactattgctcaagccttaa

SEQ ID NO: 24274 - DNA, 723 bp, Glycine max
  Peptide Sequence Number=SeqID_141052
atgaagggagaagcaaaacgactagcatcaagaatggaaggacatgcactcattgaagcatggctttcccccagatacaggtttttcaacacaagaagcactgcaaacaacttagtgacagtggatagcaaagtcattgatgatcaaacgcagcaccacgagtctcaagaagttcatttttcacccgagcaatacaaggcattgcttgctttaatccaacaaccatcccatgggaactcagcttccacttcatctaatgtcaaacaaatagcttctgtctcctcgtgttctatcgacccagcttcaatcacgggtaaattcttaccttctgtaaatcacacacacacactcacttcttggatattggactccggagcaactgatcatgtatcggcttcgttaactcactttcattcctataaccaactgaatcctcccattatggtcaagctaccaaatggtcactatgtccttgctacccattcaggcgacatatgtctttcagcctccataattttgtcagatgtcctttacattcctttgtttacctttaatctcatttccatatccaagcttgtttcttctaccaattgtaaacttattttcttttccacttcatgcatattacaagatacgaacactcaagtgaggattggtacagttgaagtgagaaacgggctttatcaccttactccaaatcatataacaacacccactgtttaa

SEQ ID NO: 24275 - DNA, 1056 bp, Glycine max
  Peptide Sequence Number=SeqID_141053
atggattctttaatgtgtggtgggtggctaaggattgctatttcttccaaggccaacagcttttacgttgtttcatacaaacccggaaatcagattgctgtaccattttcagttaaaccagagaacaattcaatggagcttgtatcccccagaataaattcagaaaatcataatctgcctcagtcaaactggcactttcctggttctagggagatgtcagagcttggagcaagaaaacctgatggttatgataatttgtcacaggatcctcatcaaggaggtattgttccgcattcacactctggagcacatggaccttccattccaccaccacaacaaattcagtcttctccttttgttcgccctgtttatgttcctcctaatggtccatgggatcgtcggggaattaataatcatttacctgtcagccaattcaagacaggagtaatgccaaataattttcatggtaatgctgttgtcagtccttttattcctgcttcagtaactccacttgctcagatacaaggaactccaatgcatccttataaccagcaggtgcctccatcaattataccaccacctttatcatccttgccacctcctcagcctgaaatgccacctccacttcctccttctccaccacctttaccccaggttcagccacccttggtccctccactgcctagttctcctcctccccctcctcctccaccactgcctgttcaagaagcagtcgatatggaatgttcagggcagtccttgctgtatcaatggcaggggaatctctgtaaaagtggggttaattactgtacaatttatgcatgcaaagcagattcaaatatttgtcgatattcaaatgccatacctgagcctgccgagtggccctcaaaattagacatgacaaaacgaacagatcttcgacatgtgaaatcaacatttgctgctactccatctcatagagttgatatgggatctcatcacctctcccctatgtccaaggttggacatctagagcctggagattgtaggactgacctaggaaagtcgtggagctag

SEQ ID NO: 24276 - DNA, 282 bp, Glycine max
  Peptide Sequence Number=SeqID_141054
atggcacaggacatgtggggcatgaagagatggttcttcaagaggcttagaaagcaagcattgagaacaatgaagcttttgaggtctgcattcaaagggaagaagctttattcgccactctccttcatggactatgtgatttttaagattatgtccgcgaagatggaatcaaacggcacacttccctctgcaccagaaatcaataccataaagtcagattcagggaatgaaagggcaatgcagacaaccttcaacaacaacaagccttatcctactaggtga

SEQ ID NO: 24277 - DNA, 1038 bp, Glycine max
  Peptide Sequence Number=SeqID_141055
atgcaagctgagttacatgctcttcaaatgaacaacacttggactctaaccactctaccgcctcataaaactgccatcgggtgtcgctgggtgtacaagatcaagtacaacgccgatggttcagtcgaacgttacaaagctcgccttgtggccaagggatatactcaaatggaaggcctggattttctggacacgttctctcccgtagcaaaactcaccactgttcgtttcctgttagccttagcaactcttcatggttggcatttgcgccaactcgatgtcaacaatgcttttctccacagcgagcttaatgaagaggtatacatgcaacttcctccaggtctcttggttgataatcctcaccaggccacaatgggtgatccattatccgctgaagcttcctcttcttatcgtcgtctggttggtcgtcttatttacctcacgaacacacaccccgacatagctcatgttgttcagcaattgagccaatacatggctcatccaactactgctcactctcaagctgcctctcgtgttcttcgttaccttaagggtactctaggttctggcattttcttctccgccactggttctctccagctcaaagcattcagtgattctgattgggccggttgtcatgacactcgacgttccatcatcggcttctccgtctatctcgacaattccattatttcttggtgctcaaagaaacagcccactctgtctcgcagctcctccgaagctgagtatcgagccttggcttccactacttgcgagctccaatggcttacatatctccttcaagatttacgtgtttcgtatgttcaacccaccaatctttactgtgacaatcaatccgctatccagatctcctttaaccaagtttttcacgagcgtactaaacacattgacttagattgccatattgttcgtgaaaaagttcaaagtggtctccttaagcttcttcctatctcatctttgatgcagttggctgacatttttactaaacctttacctccgactatgtctcagcttctg

SEQ ID NO: 24278 - DNA, 405 bp, Glycine max
  Peptide Sequence Number=SeqID_141056
atgggtgatcttcctgttgtaattatccctgcaatctgtgatcagaaaggaggtccatttggtgcacctgatgattgccgcatcagggctctctcttattccttttgctctttggcgcttgtagaccaaggtccttatattgtaatgaagaatatcgaaaggtcgttttgtcacagaatgatggaaactctaggccaaatcctggcagaaccaatgtcacccccaacaattgctacgtttttaggtttcctctatggtggagttaaatggacaaggaacctaataatagggcatgatgctccactgaaagtgatccaagactcaattcaattgttagggctaaagggacaaccagaaaaaagcaaaaagggtggcatgaatgaaaatattaagatgaatgtgtag

SEQ ID NO: 24279 - DNA, 815 bp, Glycine max
  Peptide Sequence Number=SeqID_141057
atggatataggacttggaactaggggtgcaatgaatggtgttgcagttggctctagttctcatatttatgttggaaatattcctagtcaatgggccagggatgagatcatgcatgaaacaaggaaggtgatccacaagggtcctcttgcattcattgatcttagctgtgagtttgcattacttatggaatttgaaactcctgaagaagctgcaactgtcatgttgcatttgagacaactacgaagagaaagaagtaactacaaccagcattttggtccaggaacagttaatgttggaattgggcatgcttatatggatggtggaaggcctatacctgcccctccccctccccctccccctcccaatcttgaccttaaagttaacaaccctgctggatcacctcatgctcgaactctatcagggagccccgccgatagcagtcgaacaaggatgtctcacttgtctaccttacttgcttcattgcgcacaaagtataatattaatcaaaacctaggtctcagtgataattatacgattggaaataattgtcctcccatgcgtgaagaagatatggtgccatccagcactctgtgcataactattccacgtagtagctctttgttcctcacagatgatgagttaatggccatttgcaatcttgccattggaaactctggatcaattgtgcagttgacacaaacaaacttgcagatgggatgtagttggtttgtcgaatgtagtaatgttgatggtgcagtttctgttctaaagaatctccgtggttgtccaggattgttcttccagatagaattcag

SEQ ID NO: 24280 - DNA, 1725 bp, Glycine max
  Peptide Sequence Number=SeqID_141058
atggtgtttgcatggcttatatccaggctatacaagagtaacaagacatgttgtatgagtgtacaaagaattgtggcggatcttattcctcggtacgcatgtcactgtccaactgctttggaagctgcagctaaagttgttattaatatgcacaacttgagtttggccttgatcagcagaggagaggattccagtggtattgcatttgaaactgctagagcctgtatttgtggcctagctgatgtttgctgcgatgcttcatcggtggcgcctacattagctgtaattagaggaatttgcgaagcagtttttcagaatgtgctcaccttttttatagccttattcgaagggaaggatgtcttacagatggttgacaagaatttcctgaatatgcaagatactcctgaggccttttctgagttgaaacaaaagattttagatgaagatgaatcttcattgactaaactgtccaagttgcgcgtgttatgtctacttcggatattcttctcttgtccaaaagatttgcttgcagcttgtttggatctctttggctctgccacaaaagaggcaactaatgccgaaggacagcgttttctgagcctggtgactagcacatttgatgatgataaggcagttcaccttttcgaaagagcaattggtggatctaaatcatgtacagattctactgggtcaggcatcagagacaatgaggctggtgaggcaattatgactgaagacaaccatgtttctggtggtgattcatctgttggcaaaagctgcttgcttatgcaggtccttgacaaggatcccttactgcggaaatggatgttgtgtagatgtaagaagttgcttgacttgctctctgatgtatcactggaaattacgtcagtactgcaaggaattcttggaatgtttcctcgacaaacagatttggaggactgtcaagcagatagtgatgaagataaatctgattcttcaatttacatgaataggaactacatggttcctaggatctctgaggaacatgaaagcattggtgaatcatctggaaaaggcagcagtttgagagttcatgttggttcttctgatggttttactgataaatatgtgatggatcatagctcagcagttcctcttgaccatgttcctgtgttaaaagtgggttcacattacgataatggagtctcaaagcccatgagcattggggtgggggaggaagggaatatgcccacacctagggactcggtaagccatcaaatgttctcacctgctgttagaacaccagtagactttaggagcaattcatttgaaggtagaaatgatttcctgaatgtagagaaaaatcatgtcttaaatatgaacttcaattcacctccgctgagatcctctagtggatctgttagtaattctttggcatctcctaatcatcattttatgtcaccaactgcttcaacaaaaggtcaaattgtctggtgctgtgatggggatcctgcagccatggatattgtctctgcttctaagcagttatggataggctatgtaggtcctgatgtgcctgaaaatcatattaggtttcacttagaaagatttggtactattgaacaatttattttcttcccagtaaaaggatttgccttggttgagtacagaaggatcattgacgcaataaaaactcgacactgtttacctggatgttttccttgccgtgtaaattcatggatatag

SEQ ID NO: 24281 - DNA, 1644 bp, Glycine max
  Peptide Sequence Number=SeqID_141059
atgtctgtctcaaatgagagtagtatcggttccaaagaccttgatcagacaccaacatgggctgtggcttgtgtttgcactgttttcatcttgatttccataactctggagaaaagccttcacaaagtgggaacgtggctaagggaaaaacacaagaaggctttgcttgaggctttggaaaaggtcaaagctgagttgatggttcttggtttcctttcactgcttctgactttcgggcagagttacattgttagaatatgcattcctgccgatgtggcagacaaattgttgccatgtccgtatgttggtacccacaaaggatcaagtggtgaagaggaacaccgtaggaaacttctttcttatgaacgcagatatttgtcagatgatgctaccccttaccaatgcaaggagagacatcagccacttttatctggaaatggattgcaccagttacacatcctcatattcttcttagcagtccttcatgtgttttacagtgctgtcacaatgcttcttgggagactaaaggtaggttggaactgtgctagagaatataataataaccatattcaagcccagacccaattaagattcgaggatggaaagcatgggaggcggagacttcatctcatgggtatgagtttgccaatgggatgcttctttagacaattttataggtctgtgggcaaggctgactacttggctttgcgcaatggatttatcacggtccacctggctcctggaagtaaatttaacttccaaaagtatatcaaaagatccttggaggatgacttcaaggtagttgttggagtcagtggtaacttgtttgacatacatgctcactatgttgttgacagtcctgtcctctgggcatcatttgttgtttttctgctactaaatgttaatggatggcatgctatgttttgggcatccttaattcctgttgtgataattttggctgttggaacaaaacttcaagccacactggcaaacatggctattgaaatcacagaacgacacgcagttgtccaagggattcctcttgttcaaggctcagacagatatttttggtttggtcggcctcagttagttcttcaccttatccattttgctttgttccagtattcttttgggctgagaaattgtttccatgctgactacaagcttgcaatagtgaaagtagctttagggcttggggtgctatgcctctgcagctacatcacccttccattatatgctcttgttactcagatgggctcgagaatgaaaaaatcaatatttgacgaacaaacgtcgaaggcgttgaagaaatggcacatggctgtgaaaaagaagcaaggagtgaaacttggaaattccagggtgcgagccctggatggaagctccactgcttcaacaatacactcttctggtcccacactacaccgatacaaaactaccggtcactcaactcacttcacaccaaactatgatgaccaagatgattaccattctgacactgagttgtctcccatttcaccaacagcaaacttgatagtaagagtggaccatgatgaggaagaagcaaaagaaaatgaacacccaacagccaacaatcaagaggtgcctttacgtttgacaagcctggaaagaagcatgaaatag

SEQ ID NO: 24282 - DNA, 930 bp, Glycine max
  Peptide Sequence Number=SeqID_141060
atgacgaaattaaagacgaccttgtctcctgaaactaaggcagttgcacctaagtggattgaagttaagagtcacgttcaaaccggatgttatgaatgtggatattacataatgcattggatgtggaacatcataactagcgacataaagagtgattggtccatgtggtttgttgatgagacaccgttagacatcgacaacatcaccacaattcgaaagaaatgggcaacatattttttaaagacaacaataaatgttctaccacgaagcttcccactgcagcagttaagtgaacgaatgaagtgtccacggtcattggatggttgcttggtagagggtatcattgtttttgcatcagtgatggctaccttggggctggagattttgattgaatctgcctcacaagttattttgaagatgatattatcatttgaccttgcttttgctttgattccgctcctcaagttcactagcagcaaaatgactagcagcacaagcattgaagaggtgtgtttcctccttgtttgtggattgatgaactataaagattgcaggcatgccaatggaaggcgaccaggggatgaaaattatgattcaagagagttgttgaggagtttgtcaaatgctcagggaagtggaagattttgcacgaaggtaaactctgattggcctgaaaggatgcaaattttatctttgggccaagacaaaagactagtaccaatttctatgaatagcaatggttcaacgcaactgtatacaggttttgataaaaggggaactacttcaacgacggtccttaacaaaacccgtctttataggtttctatgccaacaacgacgggtgcgcagaccaccggcgttgaaacttcaaagaacaacgacggtgtactcaccaaccgacgttgacatactgtcaaacaacgtcgagtga

SEQ ID NO: 24283 - DNA, 534 bp, Glycine max
  Peptide Sequence Number=SeqID_141061
atgggtttctttaagccattaccaaaggtcgtgcaatggccggtgcaatttccaaagagcaacgaagacctcacccaactttgtttgaagacaaatgctataagaaaatgtggacatgaacatttctacatccgacgcgtcgaacgaatgggagcgcaaggttcggcggaatctatggatatagatgaactgagagttcttaatgtgtttaattgcctttgttcagtggtagagatcgaaagagggtttcacttacagctggaggaaaacgcaaagataatattttggccatacattaacaactttgacttttgtagggtgtgggggtgcgagatatatagaaattcacggcaatgtcaattccgtatggaggtctacttcgttgctgtcaatgagttggaagataataaacttcttgttcttcatggagcaatgggaatatcgattttcaatataattgctatcacaaggtcagttattcttgagcttgttctagtggcagaaccatccattttaattagagtaattagataa

SEQ ID NO: 24284 - DNA, 204 bp, Glycine max
  Peptide Sequence Number=SeqID_141062
atgtttggtggacttgcagctggtagcctggctgttcctaacagatcaaatgagccaccggagcaattgtatgccacccaactttctcagctgcaagagatggggttctttgacacgcaagagaacataagggctcttattgctacatcagggaacatacatgcagcagttgagcttgaaggtcatccggaagaacttggttaa

SEQ ID NO: 24285 - DNA, 165 bp, Glycine max
  Peptide Sequence Number=SeqID_141063
atggcatcaagctcaatgtcaactactaggtcatggagtactaaggacaataagacctttgaaagggctctagctatttataacaaggacacccttgaccgttggaactatagagaagatacacaaggttttattcaatggtttagtatgcatacaagagcttaa

SEQ ID NO: 24286 - DNA, 345 bp, Glycine max
  Peptide Sequence Number=SeqID_141064
atgcagtcaacaggatcattgaggcaatgtggaatccatcatgtctctaaaccatgtgctgacaaagtatgcagacaagggtgcattacccctatcagtttcccaggtaacatagttaaccaaccaccagtgtcatgtgctacggagcaaaagggtaaagctgcgtacgaggatgccgaaatggacccagagattcagcatttgatagaaacattgttctgggagattgatatctgtcctccaaatctaataggagatataactctccaggtgaacaaaacagagaaagcaagaccgcctcccaaaaagctgcaaagagtttacaaaattgaagatatgtgttaa

SEQ ID NO: 24287 - DNA, 474 bp, Glycine max
  Peptide Sequence Number=SeqID_141065
atgaaatttaatgacaaaagtggtgcaataactgttttgacagattggagacatttgcctatgttgcaaaaggttgattttgggtggaaggaggccgtcaataccatgtctttatttttgcgggtttgtgcaggatcctatgagatgtacgtgtgtatgatccctttggatattgcttacacagagagaaggagtggtgcagcagatcaagaatcagcccttgtaacacaacagcaatctgaagatatagctaaagaattggttgatgaagacaagttcttcacagaatttgcacagtcaatgaagagaatgagagccattgatgtcctcacagactcggcaggagaaatacggaacaagtgttcaggagaaataaaagaagagaatagctatggagaaagatttcgatacacatttaaattgcctctcttccaatttgacagatggctttgtgtaattagaaaaggagggtaa

SEQ ID NO: 24288 - DNA, 285 bp, Glycine max
  Peptide Sequence Number=SeqID_141066
atgtgttcaattcacaggggacaagcagagaaagaattcagggtggaagtagaggctattgccaagaagacaaaaaaccaaaggaaaacaaagtggaggagaaaaaagcagaggaagaagaaaaagaaagaaaaagagaaaaagtcgcaggaatcaaaagatgacaaggaatccaaggaggaatctgcaccgccagaacatcgatctttttccttggtatatgtgaacagtggtaacttagaacaatggctacatggagctataagccaagaaagggatacttaa

SEQ ID NO: 24289 - DNA, 249 bp, Glycine max
  Peptide Sequence Number=SeqID_141067
atggcattacctgcacaagaaattcaaacacatctcttccacctgcccaaggttcaccatagttactgtggtgctcctcgacgaggagctcactgggacaaggtcgggctgtgtgattatctgaatcagctcccttatagtcatagggtgataatatgcaagaatttgaattcggattcaaacagagatagaggaaggatagttatgagggaaacatgggaagagtttcagaaattgggagagaaatga

SEQ ID NO: 24290 - DNA, 477 bp, Glycine max
  Peptide Sequence Number=SeqID_141068
atggcactggccaaagaccaaacaattccacgtgattcaagcctgagcagcaaggttcaaaactgtgttttcagtgagactagcgtggaggttacctccatgactgttcatagggtcaatgagtaccacaaatctgtgttagaagatcgggaagatggctcaccaactactaatggtctcagcaatgattcagctataacacattttcctcctctatgtggcagtgtcaaagggtatgcttataagggcacaaactatcagcttgaagaagcagaacccctgattaatttgaaagggtatagcaatctcattcaaggtggtggatctttgcttggctttcagcagaacaagatgatccctaaaaactgttacatgaaagaaaatgatcagaaagagagaaacaacatggccaaagttcatcagggttgctctacccagcaccaactattcctaatgctagtagcctccacaagatga

SEQ ID NO: 24291 - DNA, 507 bp, Glycine max
  Peptide Sequence Number=SeqID_141069
atgggaactatctatgtattagtcttaaactgcagaaaggacattaattggtctacatctgaccctgtagatcctggggtttttaagtccaaaaaatatcttaaatttatagatagcaaaaaggttgatggactcaacaattgtaaactagcaagtgaagaattgggaactgaagcaacttttagatatgctgctatttctacaaagaagaaaaatgcattattaccttctttgtcccataacctaacatgtttttctctctttgtgcttatatctgtcattgttcaagttcaagtaacgaatcttctgatcaacaagcaagtgaagatggcatgttccatatattgcagtttgtgtgaagttgatcgagtggtacttgtacttaaggttcgtgcttttgcattgcttatgcctgagttgattgatcttcaagatgacctacaaaagtatttgcttattcaattctcttgtcccttgaacctcaatggagaagatgttataggatag

SEQ ID NO: 24292 - DNA, 207 bp, Glycine max
  Peptide Sequence Number=SeqID_141070
atgcttaaaagggaaatcattcagcccagtaccagtcccttctctttacccatcatgttggttaaaaagagagatggaacatggataaaagaagataaggttcaagtagttgatgtctcgctaagcgaggcagatccgcttagcgagtggcatccgctaagcgaggcatacagctcgcttagcgggttaggaaaccctagaagatga

SEQ ID NO: 24293 - DNA, 234 bp, Glycine max
  Peptide Sequence Number=SeqID_141071
atggcttgcacccacattccgctttcgaaattgccccatgtgtggcatctcttgtcaatgtccggatttacacgcgattctcctcaaatttcagccagcccgcatcaattagaccttgcaccttatgcttcagggccctacaatgctcagtggaacgccccggggcttctccatgacaagcacacgttgcgttcgagtcatttttccggaaaaatggaggttgaggaaacctag

SEQ ID NO: 24294 - DNA, 1725 bp, Glycine max
  Peptide Sequence Number=SeqID_141072
gtgaccttgtttacggtgcattgtgcgggatgctttaactatcttattgcagataggtatccagattccaaaagaacatggattggtgcagtgtacccaaattttaaagaagaaagtctttgggacagatatgtcactgcaatatactggtccattgtcactcttactaccactggctatggggatttacatgctgagaacacgagagagatgctgtttgatatagcttacatgctcttcaacttgggtttaacatcatacatcattggaaacatgactaaccttgtagtccactggaccagccgtaccagaaattttagggacacagtgaaagcagcttctgaatttgcttcaagaaatcatttgcctcatcgcattcaggatcaaatgttgtcacatatatgtttgaggttcaaaacagaaggactgaagcagcaagaaacattgaatgatcttccaaaggcaattcgttcaagcattgcacaccatctgtttttccctgtcgtgcaaaaggtctaccttttccaaggagtctcacatgatttccttttccaactggtttcagatatggaagctgagtatttcccacccaaggaggatgtgatactgcaaaacgagtcttccacagaactttatgtgctggtttctggggtagtggatctggttcgctacatcgatgggcatgatcatgttcatgggaaggcagctgcagtagatgcatttggagagattggagttttatatcatataccacagcctttcacagttcggaccacagaactttctcagattttaagaatcaacaaaacatccttaatgaatgtcttacacgcaaatccaggagatgcacaaattataatggataaccttttaatgagattaaaggggcgtgaaggttttggctttgaatatccatgcacagattctggacggtttccacatgaagtgcttcaaggaggtaacacgagaggaggcccttctcatgagtgtacaaataattcacttgagcattcattaatgcatgaaggagagtgcatatatattggaaactcggagaccagtttgcataaggggaccaatgatgatcatttagtcagcaaacataacatgatccctgagcatggtagaagagatattcatgcccctgcaaataaagggaatctagacattgttgaaattctgcttgaaagagatgcatatcctatcccaaattccttagggatgacacaaaaagctcaagtaaaacggccaaaaaacaagagcatttgtgcccaaaaaatgagttgtgaaaatgagaagttagatgaatttagaatacagatagcagagccaaaaatccttgaccttgacaggaatggctcgaccagaaacagaagacaagatggtattagatctatcaagttcccattagagaaaacaaacacaaactccaattcaagaaattctaactgtccaagtgatagagaatcggcaaggctcaccaagaagagagtaacaatccatttgctacacagcgggagtacctcacgaggtcagcatggaaaattaataatcctgcctgattcattagaagagctgctccaaattgctggtgacaaatttggtggcttcaaccctacaaaagtaattaatacagagaatgcagagatagatgacataaatgtcatccgggatggagatcacctctttcttcagtgcagcaataatgaagatttgagttcatga

SEQ ID NO: 24295 - DNA, 195 bp, Glycine max
  Peptide Sequence Number=SeqID_141073
atgaccataataaaggggtttcggactgtggaacttcgtgtggattctgaaagtgtagtgaggagcatttctggaggtgaggaagagaaggaaatagaagtgcagatactttggcttagtattgcttgtgtggctgatgagggtctgatgatgtttgaacaacctaccagttttgagatcattgcttttagatga

SEQ ID NO: 24296 - DNA, 222 bp, Glycine max
  Peptide Sequence Number=SeqID_141074
atgtatgataatgattacatttcatgtagtatagggagatacaactgcagtaattgtcttagtgcatttattatgaagacaaagtggaagttcagaaggcaatccaatagcagagtaagcagggatagaaagcgtgtaggaagtgtgtacgtattgggaaaagtaagggttcagcagcaattgtgcagtgtatttattaggaatacggattcgttggtgtaa

SEQ ID NO: 24297 - DNA, 207 bp, Glycine max
  Peptide Sequence Number=SeqID_141075
atgattgaggagtacttgtgcaaaataaaagggtttgttgatgaacttgctggcattggtgttcgtgttcttcatgaggaatacgttgatgcactcctcgaaggactaccgtctaattacgcattggtggtttccattattgaaagcaaaaagcgcactccattcatcgaagaaattgaagctttgctctatggtcacgaaacttga

SEQ ID NO: 24298 - DNA, 1013 bp, Glycine max
  Peptide Sequence Number=SeqID_141076
atgggtacaatctcagggactaaattgcctattcactcgttgatcaatctattgaaacctttttcctctactacatctcaacttcccaatgactctagtggtaatgttccaaattcattgagtgactatgtggtttctatgccacttctagattttccttactttgcacctaatgatgatacttctatttttgcatatagtgtatctaccacaaccatagatgttgttcttccacctattactgatgcttctactcatgatgttgctactaatgaagcttttgttccagttatatctgaacaattgccttccttgaaaagatcctctaaaataactaaggccaacaacacttggtctcttgtccctctccctgctaataagcattgtattggatgcaaatgggtttataagttcaaacacaaagcaaatggaactagggatatatatagagccaaattagtggctaaaggctacactcaacaagttggcattgatttttcagacaccttttcacatgttgccaaacttacttctatcatagtacttctagatgtggctactgctaagatttggtgcttgcagcaactagatgtcaataatgctttcctcaatggaaatctatttgaggaagtctacatggatttacctcaaggttacaaatcacctaaactaggacttgtttgcaaactaaataagtctctttatggacttaggcaagcttcaaggcaatggttttgcaaatcatcactagtggttctcctagtgtatgttgatgacataattcttgctggtcatagttctacatgtgttgccaagaggaaaaacgccttgcctttgctggatgacattggttacttaggttgcaagcctgccttcctcccaatggatcctaacttgaaattaacccttcttgatggtgaatcaattcttgatccatcattgtataggcgtctcattggcaggctcgtgtacctaaccatttcaagacctggcattaccattgttgttcacaa

SEQ ID NO: 24299 - DNA, 675 bp, Glycine max
  Peptide Sequence Number=SeqID_141077
atgtcacctgctgatacaacttttgttccccttgttccccctgggttttctcctttaccaactcattctcctaacaccactatttttgtacctcaaaattctacttcctttgtatctgtctcaattcagcctcaaagttcaaagtcaactacccttgctacatcctcttcagagtctatttctataccaaattatgtaccacctaaaactgtaaaacaagctttggcaaatacaaattggcttactactatgcaacaagagtatgatgccttgctgaagaatatgacttgggacttagtatcattacctcctaatagacaatctattggttgtaaatgggttttcaaggaaaatgttgatggttccattaacaggttcaaagcacggttggtagccaagggatttcatcaagttcatggttttgattttcatgaaactttttctcatgtgatcaatcctgttactattcagattattcttacttttgctctgtctcataagtggaaattatttcaacttgatgtaaacaatgtttttctgaattggtcacttgaagaaactgtttttagggcacaacctcctaattttgaagttgcagataagtcactagtctccaaactcaacaaagctatctatggcttaaataggccccaagacaatggtttgacaggctaa

SEQ ID NO: 24300 - DNA, 279 bp, Glycine max
  Peptide Sequence Number=SeqID_141078
atgggtttggagaggaaacttgataatatttggattggcctttacaaattacgtgctaatgtggcaagatttattcatggcagaacgcagatggggttggggtcacagatggatctttgtggaaggaatcaaaacaagaaaatatggaaaccgaaggagaagatcgcttgtaacaagaatggcgatgaggagtggaagggaaggtcttttactgtaaaggaggatgatatgaaatggcttgagcaatgctatgtgggtttagtgaattcgcccgaataa

SEQ ID NO: 24301 - DNA, 264 bp, Glycine max
  Peptide Sequence Number=SeqID_141079
atgttattatgtccaagtcccagctattggaccgattgcccaaattttggtgggatatggcattgggatttgagagttttaactttcaagttcaacagtacatggaggtacttgcaagctgctactgacatgttgcagcacacgttacaagacctattcaacgactattcgcacaaggaaggggggacattcatcggtgaaagtctgttcacaggtttcagaacagatctcaaaacatgcactaagtctcttgttgctttataa

SEQ ID NO: 24302 - DNA, 321 bp, Glycine max
  Peptide Sequence Number=SeqID_141080
atgtctctttacttggtgaaggcaaacagacacaagatggtgctcctccaaaagtcccaggcatgtccatgtccttctcatgttcctttgtctatgtccatgtcatgtccaacatcgtatctgaattcgtgcttcttagctctccactcacctctcacttcctccatccatgaaagcaaagttgcacaggcaccaatgttctcacaacatcaggcaaaaagtataaaatgtaaatcatcctccttggtgcctcccaagctcattttcctcttcatctactctcatcgacgcaaaaggcattcctcttctagcatcgtttaa

SEQ ID NO: 24303 - DNA, 157 bp, Glycine max
  Peptide Sequence Number=SeqID_141081
atggagcgtgaaaatgattggggcatgccagaacgccagagtgacgtagagaaattaagaattaaagatcgaacagctatttatgacatgcatgatgcatgtttgggtgttgctattttagaaattaagttgaagattcaacgacagcttcgtgaaa

SEQ ID NO: 24304 - DNA, 384 bp, Glycine max
  Peptide Sequence Number=SeqID_141082
atgggttcaccttcaatgcggaggaagagaagaagaggcaaaatgaccttagcctttgtttggttggaacgttcctcacagacaaatctgatgaaggagatcgaggatggcttacgtttgacgcccagtcaaaggagtgaagatctcagagggtggtggacaattcccatgtcaaggtggaaggaaattgggacttgctttggaaaacaaaagttcctccaaaaatcaaattgcttacgtaaaaagcatttcgtcagtacaagtggcgggatccgccacgtggacagcaactcgccaactccactggcgagtccacccggcgctgccacgtgtccaactcgccaaccccactggcgagtccccttcaaaaacagacccccctaa

SEQ ID NO: 24305 - DNA, 993 bp, Glycine max
  Peptide Sequence Number=SeqID_141083
atgccatggctgtgcaatctgttatctgctctaatcatttcctcttggttgctattgaaaatattccaagcagctgatgtcccaatagaatgggaagagcactatgtaggaactgaaattgaccctagaacgcagagctttctgacatgggaaagtttagaatctgtaaggaaaaataaggttggcttgaaagggccaatggccacccctattggaaaagggcatcgttcgttaaatcttactctgagaaaagagctcaatttgtatgccaatgttcgaccttgctacagtcttccaggctacaaaactcgatatgataatgtcaatctaattacaattcgtgaaaatacggaaggcgagtacagtggacttgaacatcaggttgtgagaggtgttgtagaaagtctcaaaatcattacacgtcaagcaagtttaagggtagctgagtatgcttttcactatgccaaggctcatggaagagagagggtttctgccatacacaaagccaatattatgcaaaagactgatggccttttcctcaagtgttgccgtgaggttgcagagaaatatcctgagataacttatgaggaagttgtcattgacaattgctgcatgatgcttgtgaagaatcctgcacttttcgatgtactagtgatgcctaacctttatggtgatattatcagtgacctttgtgctggcttgattggaggattgggcttaacaccaagctgcaacattggtgagggcggtattgcacttgctgaggctgtacatggttcagcacctgatattgctggaaagaatttggctaatccaactgctttactgctgagtggtgttacaatgttgcgccatttggacctccacgacaaagcagaacagattcagaaagctatcctcaacacgattgcagaagggaagtaccgaacagctgatctcggtggcagttcaaagacaactgaattcacaaaagcaatcattgatcatctttaa

SEQ ID NO: 24306 - DNA, 120 bp, Glycine max
  Peptide Sequence Number=SeqID_141084
gtgatcttgataaaggaagctttatttactaccgaaggtgaatacatggtagctatccaggcatgcgaagatgctatttggcttcagaggatattcgaagaacttgggtacaagaactag

SEQ ID NO: 24307 - DNA, 384 bp, Glycine max
  Peptide Sequence Number=SeqID_141085
atggatgaagatgaagggggtctgttttaccatggatgccgccagcagtactggcgagaaacgcgtgccgccattgtcaatggcaagaagcttggtgacgtggagggtgccgccattgtcaatggcgagacagctgacatggacgttgtctcgctgctcccaatggcgagaggccttccacagctttgcatgcagactagggctgaaccatgcaggctagggctggacatagtagggctgaaccatttgcaggctagttgggtcacatgcattgcaactgtgcaaggttcacatggatacagtgtgcctgttaaatggccagaagactttggagaaaattggcttcacgggcatgctttaatggcttgtgtagttttcgtttaa

SEQ ID NO: 24308 - DNA, 222 bp, Glycine max
  Peptide Sequence Number=SeqID_141086
atgacctcaatcacacaaaggttgaaagacctaagtgagactaatgaaaatgatgaagaagctaaaagacaagaagaactctcaaggccacatatctcatggactattcgcaaaacaaagaagggacccttcgcaagaaatggaacctccgaagatataattttagaagaaggtgcacttgtggacaccaatttccagactcctaccaatgcatcctactaa

SEQ ID NO: 24309 - DNA, 471 bp, Glycine max
  Peptide Sequence Number=SeqID_141087
atgaataaagggtcacttgattactggaggaattactttggagctgcgaactctgatatatttggcatcattgaccatgcgatcatggtggctgcttctgattgccccaaggagttcaggttgaggagggatgggattgcagagaggttgttttcttgcagattgagtcgatgtttgggatgtgagagggtggaattggctgtgccagtggatgatgatgatgatggtggtggtgaaggttgcaagagtggctttgatggggatggtgacgagttcaagtttgaagcgggtgcaagtaaagagagcaaggtcaatagtgccagagattatcctggagagatgaacacgaaccaagttagcaattacagctatggggaagctgaggcattgactgatgagattgaaaaagagtctcaatacgttgaggaggtgttcagaatcaaggatattttccttaactacgaagaagag

SEQ ID NO: 24310 - DNA, 228 bp, Glycine max
  Peptide Sequence Number=SeqID_141088
atggagatggagagacttagcctttctcagggaaatgttctgatagatgtgacatcgaggcattgggagacttactctattgtgttggctttggacaacctggcacaagtcatggctaatcaaggaggtggtggaggagaagttgtgtaccatggtttagattgctttcaaaggaatgacccacttaccttcaaagggggttatgatcctaagggtgttgaggcttga

SEQ ID NO: 24311 - DNA, 285 bp, Glycine max
  Peptide Sequence Number=SeqID_141089
atgaaagtcaaactcatgcgttatgcaacaattactctagactcaagcctacatgcaatgcggtaccatttttcagtgaaaaacctcgtcaggtgcctaggagtacatgaccagacatgctcacaatggggagaccagtcagggtcacgctgttttgcgagaatgctccaaccatgtgggatcggcacaggcttacaggagcactcaaaccggatgatccccaaggcctgcactccgaagagtccgtcagggcctctccctcctgattcagtgcgcctcaagtga

SEQ ID NO: 24312 - DNA, 240 bp, Glycine max
  Peptide Sequence Number=SeqID_141090
atggtgatcaaccttagtgacaaggtagttccaaaccgagtgacatgcccccaagtacaagtattttcccttatgataaactacaagccttggatcttcttcatcaatggagtcctttgcttcttgaagatcaatggcagtggaaaggagaggaggaaaggtgattggagacataacctcaaggagaagatgagtcaagaaaaagctcaccatcataggaagtcatggataagagcttga

SEQ ID NO: 24313 - DNA, 879 bp, Glycine max
  Peptide Sequence Number=SeqID_141091
atgcccttaccaaacgcatgcaaaactagagtaatgagtgaaatagaggaagttcaagagtggatgaaggccgacatggaggccatgaaaaagaaaatggccacaatgatggagcccatgatgagcatgaagaagataatggaggtcaatgtagctacagttgtcgctaccagtgtcgttgctaaggtggacccgactcccccatttggcctcaaccaaagaaatcctccaacctcagatatggtaggtcagggaggcaaagagttgggaagtatgggcgacccccattttgtgcaagttcagaacaagcatgctttctcaccatatcgcttgcctctcaactatataccacccaatgttgcgcacactccttatgagaatgtcaataactccactcccatactcattaagagccaacaacctcaatctgatcatccacatgtctctcaacccatgggggagacacatgaacctcgcctcagatatgtcactgaggggcaagcagttggtggtgtacccctgccaaacactttggaaggccctcaatttcacccacaacctcaacccttgcattttgcggtggggagagtccctcctgctatggtggaaaggaagaaattggatcacatagaggaaaggctatgggccattgaaggaggcaaagattatgtttttgttaacatggaaaagttgctcctggtacccaacatggccattcctcggaagttcaaaacgctggattttgataagtacaaggggactacttgccccaagaatcacctgaaaatgtactgttggaagatgggggtgtgcgcaaaagatgaaaaattgctgatgcatttcttccaggaaagtcttactggggcaatcatcacctag

SEQ ID NO: 24314 - DNA, 561 bp, Glycine max
  Peptide Sequence Number=SeqID_141092
atgaccttaatagcagcaatacaagccatagtctatgccttctgttttgagacagatttgagtcaatggaagttgggttcaggtatcaggcttctaatagcactttatacgggaattgtggctactggattagtgaacattgccacttcatggtgtgtaccgaacagaggtccattgcttgcatctattttctaccccctttgccctgtgctcgtggcttttgctagttccctgttattacaagagcacctatacttaggaagtaacttgcaagaaatatatatttctcttgcatcattttatttacataattatttcacacctagttcggaaaaattgttgaagtacaactgcagtgcagtggagaccacctgtccaattaacgacactcaggaacctatccggggaagatcttgcccaaatgacctagagcaacttgagaatcaactggaggcagcactgaggaatattaggtcaacaaagactcaattcatgcttgaccagctttctgatcttcatcaccgggtagatgtgtgttttttcttccttagaacattctga

SEQ ID NO: 24315 - DNA, 267 bp, Glycine max
  misc_feature (205)..(205): n is a, c, g, or t
  Peptide Sequence Number=SeqID_141093
atggatgctcggaacggacaactctcctcttggcaaggccttttgcatgcgttagaagctcctttttccccatctcaatataacgacccttctagcacactttttaagcttacacagcgtggaacagtcaacgagtaccttactaaatttgaatcactagccaatcacattatcagccttcctcctgctttcttgatcaattgtntcatcttcggattgactcctgaaatctgtcaagaggtcaaggcttcacagcctttgaccatg

SEQ ID NO: 24316 - DNA, 396 bp, Glycine max
  Peptide Sequence Number=SeqID_141094
atgccaacactggcccttccatataaaaaagaagcaatggggctgaagggtggaagggctggtcgtggacaacgtcagagaatgagaactggtttcaaggtgagagaccttctgacaaaggtcctccaatttggtggacaaacaggcaatggcatcctcgatgcggtcgatgttggttttagatcgggtggagtcagccatctcaatgaaagcaccaagatgacgcgttggagacagaaagataaaagaaatattagaaaagaggatattagaaccaagtgcaattgtaacaaactcaaccaattcgaagatgcccctactactaacagaataacaaacatctattaccctccactacagcaagcactaacagaatgcccttttgttgacaaataa

SEQ ID NO: 24317 - DNA, 576 bp, Glycine max
  Peptide Sequence Number=SeqID_141095
atgggaaaccctctaggaagtttctcagaaagcatgcaagtgagaacaaagcacgttgaaaagtctagtgttagtttgtggggccagtcattgatcttggaagtaggcaaagctgactgtaaagagtgtgagctgctgagaagtaaacaatcagggatgttacaaatggtatccgacaaacctagcggaagttggtgggcatgtaacaccacagaaaaatcacaccaaaatgagagagatctagagactatacaggtgagggattgtacatttgaagataacttaaaggaattaattggtactacctatattaacaagatgcatctacttttcagtagcccgtcacataagaacttcacagttaagtgtgcttggcttggaatagttatgagatgggcagagctaattatagaggtcttggaaaaggctacctatgaagtcagtggtggcctttctaaaccccagcataagccattaagggtggggaactctgccacacttgtcttcattcgccaatatcttactgaaatcaccaatgacgcatcagagagagcacccatcaacaatattggttaa

SEQ ID NO: 24318 - DNA, 549 bp, Glycine max
  Peptide Sequence Number=SeqID_141096
atgtcctacaacacctcaattcacttcgcaactagtatctctccattcgaaataacctttgaccggaaaccacccagcatccctcaatatctcataggatcggctcaggtaatagttgtggatgagttaccgactaacggagagacagtcttcgctagtttgcagaagaagcttttgaaatcacaagcgtgcatgaagaatctagcagatacccacagaacagaggatgttatcgggaatgaaactcatttaatggtccttatccaatgggagggtcttcattcagatgaaacattatgggaagactgggccagtttaaaggaagcttaccaccttgaggacaaggtgttgcctaatggggacatgaccaagagcaagggcaaggatccacttgaaggacttggaggacctatgacaagggctagagcaaggaaagcaaaggaagctcttcaacaagtgttgttcatactatttgaatacaagcccaagtttcaaggagaaaagtccaaggttgtgagttgtatcatggcccaaatggaggaggactaa

SEQ ID NO: 24319 - DNA, 342 bp, Glycine max
  Peptide Sequence Number=SeqID_141097
atgcaaatcaagatgaacattgatatccgcttgccgctaaagaacgagagcaggccaagggagaatggaggagaagaggaggaacagacacaagccgctggttggaaaaaggagatgaaacacacaatgccaaagcctttaactgcattagaggttgtggcaactgaagcgaccactgaggccatggtgacaaacccttaccaactagtggttgttactaagacacaaccaagaggggacaaagagggcacaatggaggaagaaagagttggagaaaagaggagaaaaatgaatgggaaagacctcaacataacccattcaaaaaaagaacccagaggctaa

SEQ ID NO: 24320 - DNA, 486 bp, Glycine max
  Peptide Sequence Number=SeqID_141098
atgtaccttgatgctcatctattaaatttaattgcctttatcgctgaccacttacccataattctttactatgatgttgatattaatgtaaggcacaagtactcttttaagttcgagaatgcttggctaaatgaggaaggccttatagaggtggtccaaaatggatggctcaaaaatccgacaggggatgttactgaaaaaatttcaaagaaaaatgattctagcagtagagatctaaaaccttatggcttaaagatggcgatcaaaacatttttagtgcaacacaacaactcttgggcatcacaacttttgtcatattggcctgatgcagatgtttatcaaggaagagatgcatcggttcaacaagatgtttatcagattacatggagtgtgcctcatcctgactttgtgaaatgtttatcaaggaagagatgcatcggttcaacaagatgtttattagattacatggagtgtgcctcattctga

SEQ ID NO: 24321 - DNA, 171 bp, Glycine max
  Peptide Sequence Number=SeqID_141099
atgacttttaaaaaggctatcaggccaggtcagaccaagcttttaaaaaggctaggctcaagcctttcaaagcctggtctggcctggcctattctcacccctagtggagtggaaggtgacgactaccatgggattctactacacacatctaagaagataggagaagattag

SEQ ID NO: 24322 - DNA, 372 bp, Glycine max
  Peptide Sequence Number=SeqID_141100
atgcgcggtaaatacgtgctgaccaatctgatcgcgcaccgtctgcatcaccaccactttctctttgcgatcaagccagctgcggtgcaccagccagcccgccggtttattcaccgcaaccagccatgcatcctgataaatgatctccagcatcaggcgtccggcggcgcaaacagcgcatcaagctggctgagcgtcagcagcagcgctgcatggcacggcgtggacccactgcagccattcgagcggctgcagggtatcgagacagaaaggttgcgtgctattaaaggcttccgccgccggggcgtgcgtctgccagtggccgtgttcgcgcatcaccgcttcgacctgctgcagccgctgaataatcag

SEQ ID NO: 24323 - DNA, 356 bp, Glycine max
  Peptide Sequence Number=SeqID_141101
atgtgccagacagtgcactgaccctgaggaagcatgaactgagcagtgatttgttctcctgtcttatattcaatgagttggaggcttttaacccaagagaccaattggcttttgcatttgtcagagaccacatgaaacccaagctgaagctgaacatctacgaggttgaagtttttgaacaagtgacaatggagtacaggcacaatctgaaaccaagtgatttgtacatagccaagaaattgtccatgacaagaaaaactgtaagggcagaaccagatttgttgtatgaaaatggaagctgttgcagcaggtgccaccattatcttaccaccatgtggggtgattctcatcaatag

SEQ ID NO: 24324 - DNA, 442 bp, Glycine max
  Peptide Sequence Number=SeqID_141102
atgagtccggtagcatgcggagacgccttatggttatctacaccttgtcatttggagaccccaagtctgattgacaagccgagaccaatgtggtcatctacacccttcccggagatgtcaacgtcttctggccgagaccgcaaaaaattctcacttctgctatcgcgactcgaggagaccaatgtggtcatctgcacccttcccggagatgtcagtgtcttctggccgagaccgcgaaatagtctcacttctgctatcgcaactcgagggtccggtagcatgcggagataccttatggttatccgcacctttcgtcaactagaggcaagcaagctcgttgacacgcaaagaccaatgtggtcatctgcacccttcccggagatgtcagcgtcttccggccgagaccgcaaaaaagtctcacttctactattgcgactcgagg

SEQ ID NO: 24325 - DNA, 261 bp, Glycine max
  Peptide Sequence Number=SeqID_141103
atggtgtggcatcatcagaagcaggctcctggccaagccacctgctcatcaaactcatccatgctcataatggatggcaagcccaagccttgtaggctctgcatgataatggactgccccctgtggatgctctggagcatggagtgcagcatttgggatgtgaatataaagtttgatggtcctacagataaaggagatggaagaacagatgtggatgcaaatgggacagatggaataggtgctggagctgaggaagggtga

SEQ ID NO: 24326 - DNA, 330 bp, Glycine max
  Peptide Sequence Number=SeqID_141104
atgaacaaaaaagtaactgcaatagggaacaatcaaagtgatttgattcccattgatttggagattaacgccacttgtagaaggcataatcaagagagaattagaaaatttttgcaggacctagaggtagcaacaattccagaagtagaacctcaatcttttaaggcatcttctagttttcctatagcagagcattctcatttagatcctattgaagactacatcatggttgaagagctaagaagggttactctagaagattattcaagttctaatgtgccacaatttttcaccagcattgcactgttggatcgagtggcctttgaataa

SEQ ID NO: 24327 - DNA, 648 bp, Glycine max
  Peptide Sequence Number=SeqID_141105
atgtacagcaatatccagggcgtgctgacgattggcgcgtctgacgatacctctgataccattctgccgtttctgcttaaccgcgtaacgtcagtgtatccgaaactggcaatcgacgtccgcgtgaagcgtaatccgtttatgatggagatgctgaaccagggcgaagtggatttggtggtgaccacctccagtccgggtaacttcacctaccaggtgctgcgcacctcgccaacgctgtggtactgcgcggcagactatattttccagcgcggtgaagccattccgctggtgctgctggacgagccaagcccgtaccgtgacatggcgatcgatcatctcaacgaagcgggtatcccgtggcgtatctcctacgtggcttccacgctggcggcggtacgtgcggcggtaaaagcggggctgggtgtcaccgcgcgtccggttgaaatgatgagcccggagctgcgcgtgatgggggcggcagaaggcctgccggtgctgccggatacgcaatatctgctgtgccgtaatccggacagcgataatgagctggcactggccatcttcaacgcgatgcagtccactaacgatccttacaatctgagcgcgaatccggacggtacgctgctgctggatgatgaagagtaa

SEQ ID NO: 24328 - DNA, 300 bp, Glycine max
  Peptide Sequence Number=SeqID_141106
atgacggtgcgtctgttgcccgctgccggccatcgccaggctactgtggtgttttcgccctgcgcctgcctggagacgcaaaacttcttgatgaaagctcgattgccactgtttacaaccttctcacctaaccactacccgtgcaatctctacctaagagccactcttagatatgagaaccccgctcactccctctcaatcacactcccgtgtttacaaacaaatcaaagacacaccagagattgctctctgaacaatagagatcaactccacacactagagatcaactctacacactag

SEQ ID NO: 24329 - DNA, 234 bp, Glycine max
  Peptide Sequence Number=SeqID_141107
atggggatcgcacccacaaagacacccagtggacctgaagaagtccaacagggccctggggtttccagctctggttacgggcctctgtcggccctacagggtgccccgtttcccccagcatgttcatgtcgttgtggcatagggattgtgcccgcaagacacctagtggactcgaagaaggccaacagggtctttgagttgccagctctaaatacgggtctctgtcagttctag

SEQ ID NO: 24330 - DNA, 222 bp, Glycine max
  Peptide Sequence Number=SeqID_141108
atggcccgcaccaagaaaactgggcaaatgacatatgaggcagtaaaggaaattgctaataagattgatgtactgactgttgctattgggcgactagaacaccctggtcgtgtacgtgctgctggagccggtatcacgatcaagcaatactttggaccagctccaaggacctcccgcatgtcttcgtctgtggctcttgaagacctggagcaggtgatgtaa

SEQ ID NO: 24331 - DNA, 267 bp, Glycine max
  Peptide Sequence Number=SeqID_141109
atgtcgcgaaaccttacggattgcgcaacaatcccttctttgacttctggaatgttgcagaactttacggattgcgaaacaatgcttccttttaactcccgacatgtcgcggaactccacgaattgcctaacgatgggtgtcaagtacctcgaagcggtcaagcgaagattcttctttgcgctaagcacgctgaagctgcgcttagcggtggatatgcgcttagcccaactgttgagcttaacctaactgctacattttgcaattaa

SEQ ID NO: 24332 - DNA, 306 bp, Glycine max
  Peptide Sequence Number=SeqID_141110
atggacgattgggaactcatggtaatattggtcactgcattgattcgtggagaagaagtgaagtgtgaaaatggatttttgggtgctgagaatgatattggaaccaagtattcaaataatggtgctttcgatctcgaatgtgtcttaaatcacgttttaaagtatgggaatatgtggagtttaatgtggaacgggaaggtgaacagattagccgttgaaaaaacagctatgatgaccaaactgaaaagccatgtaagtagccgtgttggttccagtagccatgtaaggaaccgtagaggcgcctag

SEQ ID NO: 24333 - DNA, 459 bp, Glycine max
  Peptide Sequence Number=SeqID_141111
atggatatcttggtgcattttatggagaaaattggtgaagaaccatgtatgattcacaaccaagaccggaacaaatttggcattttttgtgcacatggagatgtctaccactttgcagatgaattgaaattgtcactatgtaatctatacactctttggtttaagtcagctgttaatgctggtgatgttggtgtgggtgcaacaatgagtgaaactattagtgtgaatgcaacaataggtgaagttatgaatgaagtgttgaatgatgtttttaatgagaatgtgagcttaaatgaagatctaagtgaaaagaatgttgctgaaaatggaaaggtagctcatgaaaatgttgaaggtcaagatgaggtctttgtaaatgatgagaatgagacttttaatggtcctctcaatgtcaatgggtcgctagacaatgaatatgatcctttgagttatgaatag

SEQ ID NO: 24334 - DNA, 300 bp, Glycine max
  Peptide Sequence Number=SeqID_141112
atggtgttggacatcaattgtgaatgggatcaaacatacatggattgtgacatgttcgggagtgatgacagacggaatggagacaatgaggctgaaaaatcagttgggagcaaaggtgaagctgggaaacaacattctttagaggtacacaatgttccattgaatggagccaaatgtgtatttggaattttgtccctattttttattattaacttttattgcgttcaacttcccttttctactacactgccaagtaccattgccaaccaatatgggttcactcagtgtggaaaaggataa

SEQ ID NO: 24335 - DNA, 324 bp, Glycine max
  Peptide Sequence Number=SeqID_141113
atggcaggactaattatagtcaataggaagctaccctttctccattacatcacaaggttgggaagattggtagaaagttggctgaaactgtcactggcaatgagaaggttgccagagaagataaatgacagaggaggtaggaagatcaatgacagaggaggcaagcaggaaaaaggtggaataaaggccttttgcacaaaaccacaattcaagacctttctattgagtacaacattccaaattgaagactacaccttagagggcccttggaatataagatttttggcaacaagttgcccttatttgagatactattgcacataa

SEQ ID NO: 24336 - DNA, 282 bp, Glycine max
  Peptide Sequence Number=SeqID_141114
atggtgctagactcgtcttctccttccatgctcatgttttcctctatagtgataggtttcagtcgcgtgattgatgggactcgcatgctagggttcatcctttgcatcctttcatggtaccattatcgtgcttgcaaagtttgtgcggacttggttcacgatgcaaagggcaagcggctcagggttaaggcacctgtcaggagtcatctaatctgcaatccttccagacctttggtgactcatctaatctgcacatcactaccaggaagtccctttgtgtga

SEQ ID NO: 24337 - DNA, 1275 bp, Glycine max
  Peptide Sequence Number=SeqID_141115
atgacacagataaacaatgctggatcaaatgcatatagctataagccacttgttgaggcttcagatgaagatcttattgaggtggttacaacaaatacacttggcttgatgatatgttgtcgagaggcaatcaagatgatggtgaaccaacctcgtggaggtcatattttcaatatagacggggcaggttcagatggaagaccaactcctaggtttgctgcatatggagcaacaaagagaagtgtggtgcatttaacaaagtcattacagagtatatccagagagttgcagtattcaactgcactctcaactaaaaagatcgtgaagggattgaaaatcccgagtatgaaatgtgggagcagcaggatcaagttcttcttacgtggctgcaatcgatgctttctatgtcggtcctttctcgagttcttggttcagctcattcacacgaagtctgggagcagattcacgattattttcatatgcaaatgcgagccactgcgcgtcagctccgaactcacctctgaacgacgatgcttggcagaaagtcaatgcgagcatatcgattctattctcgaaggcctctcgccaaagtatcactcaatcattgcaattatcgagagcaagtttgaacttctgcctatcgcacaggttgaagcacttctccttgttcatgaatctcgcttgaataagttcaagcaatctctctttgaatctccttccgtcacaagcatgctcaaacagtgcccaacaaacatgagcctgaaagtttttctaattttcgtggtggatctagccgctgtggtggtttttagtgaaggttttaatcgcagtgatggacagcatggtggcgctggcactgacgccagcgggggtaccagcggtggtggccgtggccatggcagtggtcgcttcgcaaattttcagagtcaggtgtgttttaaatgtggtcacactgcatcagcgtgtcatttttttgttttgatgcaaattatcaaccaaactcatctcttgtgctccatgatcccgcatctcagagctacggtccctcactctcagaatagttctaattctgggcagcagacttgtgcaggccatagtcaagagccttttttcgttttgatgcaaattatcaaccaaactcatctcttgtgctccatgatcccgcatctcagagctacggtccctcactctcagaatagttctaattctgggcagcagaatagtgataattctgggcagcagacttgtggaggccatagtcaagagcgtaactga

SEQ ID NO: 24338 - DNA, 381 bp, Glycine max
  Peptide Sequence Number=SeqID_141116
atgggggagggatgttgtacgcagccttacccttgcatatgcaaagaggctgtttccggattcgaacccatgaccaacaagtcaccaaggcacaactttaccgctgcaccagggctcgccctccctatctgttattctgttagagtagtaactatggatgctctttctaaatcaagctttgagaaatatagctccaaggcacgtgaatcactagcatcttgggcacctgactgcattgggtttaatctcattgaggctgttctatgccatatatgtcggaaggaacgaccgggtgctgtcttagtatttatgactgggtgggagaatataagctctttaagagatcagcttaagcaatcctcttttaggagatcccaatag

SEQ ID NO: 24339 - DNA, 508 bp, Glycine max
  Peptide Sequence Number=SeqID_141117
atggctttcgctcattcgaattcagtttctcagtcatttcccaactccattgctgaaaaacttgatgattctaactatcttcattggcatcaacacattgtactagttattaaatcacataggttgcaacgttttattgtcaatccagttattcctccttgttacctcacagaggacgatcgaattgatgatcacgtcaaccctgattacgaaggatcaaacgctcctgttatggctgcaatccactctttcaaaatcggtattattgcgtgttcttggctcaaatcattcctatcaattactcttgatggcaagacgattgaggagtgcttgcacaaaatcaaagggtttgttgatgaacttgctagcgttggtgttcctgttcgttatgaggaatacgttgatgcgctcatcgaaggactaccatctaattacgcgttggtggtttctgttatcgaaagcaaaaagcgcactccatccatagcaaaaattgaagctttgttctatg

SEQ ID NO: 24340 - DNA, 1113 bp, Glycine max
  Peptide Sequence Number=SeqID_141118
atgtctgactcacacactgcagagtcttcgaggactctgttacctcctttccaattcatactcaaactttattccattctctctaacaatctgcttcctgctccccacctgcctcgtgtgcaggatcttacaatgcaatttcccaggatgattaccaatcacattcccttcattgttgacaaaagcctccaatcctcactaccctttcccttctttttgttccacatcttagtgatcactggatgtaaagatgcggaaagagaagggtcggcttacgagtactgctggagaaattttctatcagcccaaactcttcagcacagggagacatccatgtcattcaaaacaatggatgatggccaggttttattgtatgctaattcagtgaatgcacgttaccagaccattccttacccttggttggtttttggtgagaaagttaaggtcaatgctgttttcatccgtgattccactggtgtatctgattcaatacttatcctttttggtggtgctctaagtaatgggatacaggctgggcatctgaaaatgttagatgggtatgttgacttcttcatggatcataatttagctgacagctatgtgaagcttaaggaagagctcaataagcttatccagaagaagctggaagatcctagcattgacattcacaaggaagggaaatacttgatgcttgctgttcaggagctggtttcaggggatcaatgtgaaggaaggtttgtatttggccgcgaaagccggaagcctaaggcctccaatgatgaaaacaaatttacgaaagatggaacaaatcccaagagcttgctgcagacactgttgatgcgagcagggcactccccaccaaaatacaaaacgaaacatcttaagacaaatgagtttagggcactggtggagttcaagggaatgcaatttgttggcaaaccaaagagaaacaagcaacttgcagaaagggatgcagctatagaggcattggcttggttgactcacacctctgacaataatcagcatgaagatgataagtctcctcctgatataactgacaacatgctaaaactcctagggaagcgtagaaaatcaaagcaaggccatggttga

SEQ ID NO: 24341 - DNA, 210 bp, Glycine max
  misc_feature (59)..(59): n is a, c, g, or t
  misc_feature (93)..(93): n is a, c, g, or t
  Peptide Sequence Number=SeqID_141119
atggttacatttaagaggtctggtcatcttgaggtgattgggtattcagactcagactntgttggatgtgtggataggagaaaatccactctnggctatgtatttcttttagccagaggagcaatatcgtggaagagtgcaaagcaattagttgttgtttcatctaccatggaagctaaatttgtagcatgttgtgaggctacaatttag

SEQ ID NO: 24342 - DNA, 351 bp, Glycine max
  Peptide Sequence Number=SeqID_141120
atggcacggagtgtgttttgctctttgcccctatttgggaacctaggacaatatctaggggtctctaataactactccccaacaattcataactcacacggctgttttctagaggtatcatcactcaagataataatattgtggcggtatggaataccagctgtcgcaacctacccttcggcgggagggcgacgcgtgactcgcgggatgcgtgttccacgaaaggaatacgcgcggagtcgccaccaacgtttatttgaggaaagcgtcggaaaaaccggaaaagtcgcgatctacgaacttttaagtgaaaggttcgggagttgtatttacgcgcggggaaggtattag

SEQ ID NO: 24343 - DNA, 1563 bp, Glycine max
  Peptide Sequence Number=SeqID_141121
atgccgtctcgtgctaagcgcagccatcctgagctaagtgttattccttgcgcacctcactcctacgctaagcgctattcgttgcgatggcttcaagaaaaaggaaaagcacgacttccaggccccaacctagctatgatacaaggaggtttacctcagaagaagcctagaacagatacgccgacaacatcctcagccggaacatccttccgaagaggaacgcgcaacctacacaagcgtctcaccaacttagctgatggcagtattgatgtcgcggtggtcaaggagatctacgcaaacctctatgaccctgaagataactcaccaaagcaggtgagagtgagagggcatttgataaagtttgatgcggacacccttaacacatttctagagaccctagtggtattagagcctggggagaccatccccacatattccagattttgtagactaaggatggatcctcaagagatagcggctcgcctctgtattccaggcgggggctttgttctgaatgttgaaggcatgctgtggaagctactgaggagagacctcaccaccttagcacagacttggagtgtgatatcatattctaacctggcccctacatcacatacatctgacctgaacttggacagggcacaattagtttatgggttggtgacgaggatggacatgaacattggagcattaatttcaggacaaatctcactcattgctcagtctaactcctctagggctagggccagagtagctgagatcccttcctcatccactcctcaagaccctcttatacccacttctgctccaccaccagctccagctcatccaggaccttccatagaccttatcatggtgatgctcgagagcttataccggggacagtacctgttgatgcagaattttcaaaacttagctctgtatcagccgtttatatccttggaggagttcactcggcaggtggcctggccaggagcccagccttctcctataggagtgggtgaggcctctgcaacccaggagcctcagccacatcaggatgagtcttcctcatcttcagagccagagactgtagcaccagagccattcatctatgaggcagatccaggcaccacactggaggagactcaggaggctgctacaccaaagattaccccacagcaagcagcagaaccttccacaccagttctagatttgtcttcacacagccatcccaggagccatctacacctgtcttgggcttgtcatcccccactacttcaccagcaggcaccccagtgcttcacctcacagatgaagaggaggatattatggaccaggaccaaccaaaagaccagtgtctcgctaagcctggtttatgcgcttagcgagtatgtcccgctaagcgaggcaccagctcgctcagtgagacacaagaatttggaagagaatctgtcttgcaagcacgctaagcacgagattggcgctaagccacagttcactaatcgtgcgaacctagaggcaactgagcagaccaagggaggcatcttgaagagctttgaaggagtatttgagagattgtga

SEQ ID NO: 24344 - DNA, 228 bp, Glycine max
  Peptide Sequence Number=SeqID_141122
atgcagacgcaccaccaccacctcatcaggccgatccccgctgggtcactaggcatggagcgttatctacaacgcttggttcaccagcaggcggctaaccaccgagggcagtttagggatgaggtcgcatggcccggagattggcccgaggcccaggcagaggaggcctgcatggatgaggagatgacagatttgctcggtttcttgggagggagcggagccacatga

SEQ ID NO: 24345 - DNA, 372 bp, Glycine max
  Peptide Sequence Number=SeqID_141123
atggacatagaaatagagatgacaacacaaattttagaggcaataatgaccaattccaaggtaaaggcagaggaagggattttgaaaagtctagggtggagtgctatagatgtcattgtagaagcaaagcttcatggtgaatcaaaggtgatgacaaaaagctcaaagaacaactcaagtgaatcaaagatcaatcaaagaacaactcaagtgaatcaagaacaattcaagagcaagagtcaagaatcaagattcaaggttcaagatctcaaaaatcaagatcaagattcaagactcaagattcaagaatcaagagaaggcttaatcaagataagtatgaaaagtttttctcaaaaattgagtagcacatga

SEQ ID NO: 24346 - DNA, 162 bp, Glycine max
  Peptide Sequence Number=SeqID_141124
atggtgacagattccccttccttcatttgcagcatttcaaaatccttcctcaagattcaacaattggccaatactctattgaccggaaaaagttctccatggcatgttctaatggtcatagtgaccatcaaaacgaggaatggaagcttgcacaaaatttga

SEQ ID NO: 24347 - DNA, 291 bp, Glycine max
  Peptide Sequence Number=SeqID_141125
atgccaagatgtgagcaacgaagaaggagaccaagtgttggtcaagctacgacctcgccgtcaaacctcagcaacatgagggacatactccaaactcacaaagagtgggaatctcttaagagagactacaaccttgaggacaaggttgttttggaagcctgcagggatgttatgaaccacccagaatcagcaatcacaaagcgaaactcagaaccaagaacaaaacaaaataaagaagaaggaccaggggcaaaaaggagaaacaataggccaagatacctagatgattag

SEQ ID NO: 24348 - DNA, 573 bp, Glycine max
  Peptide Sequence Number=SeqID_141126
atgaagctaaatacaaagaagtggcaaaggaaactcatttttgatgctgtgaatgagattcctggtgaaaaactaggctcttttcttgagccatgcttgaagcctaatgaactcgtagcaatgaaattcgtcagtgcacaaaagcttcttaaagaactttgctttgaggtacaaaaacttcaatatgtgaagccagattgtagcttagaagatgagggggatgaactgaaaagtatgctacgggaagatgtgatgtgtcactcagaaaactggacaggtttctcaattcaattacctggggttgtgttggatgttgagagacagatatttaaggacttaattgacgagcttgtgattgatgaaatggctagtttgaaagtgaaatccggtaggcacagtattctcaagagtttgttttggaacatgtttgtcatctctgagtttggcttctgtaattgtaaggccaccaacttccttgccatgaaggcattgacggacctatgttgtcctgagggggtgcagatgcacgggactttgatgaaggcatttgattgcattgccactagatattaa

SEQ ID NO: 24349 - DNA, 402 bp, Glycine max
  Peptide Sequence Number=SeqID_141127
atgtatctgtggtctggatttgtattttcacaaagggaagctatgattatagcttctccacctgcctcccctcctcctcctcctccttctcctcctcatcctcctccttctgacgcatcggcttcactgtctgtcgtgaagcagacacgcaaagcctcatgcctacgatcattgtctactagacttcctggtgctgagagaccaatggtccatgttgatcctgctaccgacaaggccgacggtccccacaggaagaaattaagaacatatttggggattatggcgcgtgataaggcggaatttgaaatcccagaggcttttgacagtaggacgaaaaggaagttacttcagaccgtgggcgagagatggaggcagtttaaatcagacctcacgaggaaatag

SEQ ID NO: 24350 - DNA, 264 bp, Glycine max
  Peptide Sequence Number=SeqID_141128
atgactaatgcaaattgtccgcaagaatcattgcattcagtctcaaacaggaatctaaggcttttggactggagagggatgatcttgaagcaacagtcgtgtttggccattgttgattcaatggagtttgttgagtcgaaccctctctttcaaaaccccaaatccatgtcttattttatgcttctcctcaaacttggtgtgggattggcgtttggagggctgatttgtaaggacaagtttggttgtgctgggaatagctcctaa

SEQ ID NO: 24351 - DNA, 1623 bp, Glycine max
  Peptide Sequence Number=SeqID_141129
atgaagacgcattttcacttgcgggcgctgagcttagccctgctgacagggatatttagcgcccacgcggcggagacgccggtcaaaggcggcacgctgatttatctggaacagcaggcacataccaatctttatccgccggccgggggtttttatcccaacggcggcattcttaatcagatcaccgacaaactgacgtggcaaaatccgaaaacgctgcaggtggaaccgtggattgccgaaagctggagcagcaacgcggataaaacggaatacacctttaaaattcgtcctggcgtcaccttttccgatggcacgccgctggatgcgaatgccgtagcgaaaaactttgatacttacggactcggtaataaagcccagcgcctgccggtatctgaagtgattaataattacgaacgcagcgaagtgattgatccccagacggtgaagttttatttcaaacagccctcacctggatttttacagggcacggccaccattggctccgggctggtttccctcagcacgctgcagcgcagtttcgaccagctcggcgatgcgcgccatattattggctccgggccgtttgtggtcagtgatgaaaagctcgggcgggaagtggatttaaccgcgcgcaaagattaccagtggggtccgaaaaacagcacccagcagggaccggcgaatctggctggcatcaaatttatcgtcacaccggaagatagcgtgcgcatcggcgcgctgctggccggtcaggccgattttattcgccaggtgcaggcgtatgacgaaaaacaggcacagcagcaggcgttcccggtttacgcagcgccgacgcgtggcgtcaacgacagcatcagcttccgcccggacaacccgctggtcagcgatctgcgcgtacgtcaggcgctgttgcacgcgaccaacgcgcagcaggtggtgcaaaccctgttttcacctaactatccgcaggccacctcggtactcgccgcctcggccgccgggtatgtcaacctcgcggacaaactgaaatacgatcccgcccgcgccgggcaactgcttgacgaggctggctggcagcccggcagcgacggcatccgcgccaaagcgggtcaaaagctggccctgaccgtgtatgaatcgctgccgcagccgcagaacaaagaagtgctgcagctggtggcccagcagtggcgtcaggttggcgtccagctcacggtgaaagccggtgacgccggcagccgcacgctggacaacctcgatccgctaaaaacgccgctcacggtctcggaagtgggccgcgccgacccggacgtggtgaagagcatgttttatcccgccaaccgcgatgcgctgctgcaaaaaggcggctccagcgacaaagtccggcattttcgtgacgaccaactcaacaagcttttggtggcgatctcggccgaagtcgatccggcgaaacgtctggcgctcaccggagacgcccagcgttatctgctggatcaggcttatgtgatcccgatctttgaagagccgcaggtgtttgccggcgcgccgtggctgaagggcgtgagttttgaagccgtaggccgaccgtcgttctacggcgcatggctggaaaaacattga

SEQ ID NO: 24352 - DNA, 258 bp, Glycine max
  Peptide Sequence Number=SeqID_141130
atggaatttgcatttgcaaccaatgttcttgctgtgaaggcatcaccattggatccattcccatcaggagctagaaaactcgtctggaacagtgctttaaaaggttttgatgatgctccacagcctaaatcaaaggctcctgctaggtggattgtcgtcaagtattttaacgatcctagaccattggagccagagagattaaaggcgctttggatccagtgggcacagtattatctccgagttagagctgagagctag

SEQ ID NO: 24353 - DNA, 1221 bp, Glycine max
  Peptide Sequence Number=SeqID_141131
acgctgtttaacatcattgaagaaccgctgcgcaacttcggctcgctcagcgccgccgcacgccagcagcgggtgcacgaggtggcgcagcgcgtggcactgccgctggatctgctgacgcgcaagccgcgcgagctgtccggcggccagcgtcagcgcgtcgccatcgcacgggcgttgatcccgcaaccggcgattctggtgctggatgaggcaacgtcagcgctggacgtcacggtgcaggcgcagattctgcaattgctgcaacagttacagcgcgagctgggcctcacctatctgtttatcacccacgatttggccaccgtacgacgactggcacacagcgttaccgtgctgcgcgccggcgaagtggttgaacaaggtgacaccgtcacactgtttaatgcgccgcagcatccctacacccgcgcgttgattgacgccattccggttttccgtccgctgattaaggagcgggctgccctcaccgctggtgtttcttgctcacgtggccgcgcacacccgtcatatccgcctcggcaccggcatcatcaccctgccgctggaaaatgccctgcgcgtggcgaagacgcggcggtgctggacctgctgagcgacggacgactggagatggggctcggctccggcggcacgccaacctcatttttgccttcatacgctgctcagcgcgtggcgcggcgacacgctggcccatccggacaatcatctctatccgccggctccggagctggcgcagcgcgtgtggatcgccaccttttccgttgcaggcgcgacgcgtgccggccaggccggtcacgggctgatgttatcgcgcacccagccgcggccggcgggtcagccggacctgtcgctgcagcagctgcaaaacccgatgatcgatgcttatctcgcggcgctgccgtcgggcgttgcgccccgcatcctcgcctcacgcaccgccgccaggcggagcagtttcgcaaggcgggccacgacatcaccggcagcacgctggagagccacgcgcgccagctcgatgcgcatatcggcgatgccgacgcggtgctggcttcgctgctggccgacagcacgctgacgcgcgccaccgacatcaccttccaggtgcactctatcgatccgccgcacgccgatacgctgcgttcggtggcgttaattgctgaacatattgcccccacgctgcgtgcgctgggtaccgcttaa

SEQ ID NO: 24354 - DNA, 249 bp, Glycine max
  Peptide Sequence Number=SeqID_141132
atggtgtcaccacaagggaggaacacatggacatttgatgatcacgtgccttatgtagagaagataacgattttatccgaagagcaagagaggatcactaagcctgtggcacatggtcatcacactgatatgtctgcaagcgaacattcgttcggtggtgttgcggaaacacatcctcattttttatggccgactatgatcccttcacagcaacatgatgccccaatggcaacacctacgcctcattag

SEQ ID NO: 24355 - DNA, 1056 bp, Glycine max
  Peptide Sequence Number=SeqID_141133
atggcttccagaaagagaaagagtattggtacaaggcccacatctcagtatgatacaaggaggtttcactcctttgaggcctggacccgatacacaaataatgttctaggaagacatatactgcctgagaggaaggtagaaatataccatactgagctggacgagtttaaggctaaattggagaggtgtaacttccataaacgcctcaccaatttaattgacatcagcatagatctagctttggtgaaagagttttatgccaatctttacttccccgaaggaccttcaccaaaggaagtcagggtcagaggccacgtggtgaagattgatgcagacagcctcaacacctttctggagacacctgtggtactagctgagggtcggggatttgttttgaatgctgaaggccaccctaggaagattcacaggaaagatttaacaactcttgctcaggtgtggagtgttctctcgtactccaacctggctcctacttcccacacctcagacctgacagtagatcgagctaggctaatctttggtctagtttctcagatggacatgaatgtgggagctctcatctctggtcagattacatctatggcccagtgtaactcttctagacttgggttccctgctcttatcatcgctttatgtaagtccaaaggggttgcttctggcagcttggtctttgaacgcctgagcctggtcattaacttggcctatatcaagaaaaactgttggaaccctgatgatatgacaattactatcagagaggccaggagagcgaggacaaggccagctgaggccccttccacatctacagctcctcctctagaacgtaccctagcagctccttccgcctcatctcctgcagattttcagcattttgaagccatgcttcaaagcatccatcaggggcagattatcttattacaaagtttacagatggtggcacctccagactctattcctttagtagagcagtttaatgagtgcgtagcctggcccggaactcagtcttctcttcatagggaagatgaaggtcccatagcccag

SEQ ID NO: 24356 - DNA, 123 bp, Glycine max
  Peptide Sequence Number=SeqID_141134
atgcattggcatgtgcatgttcttatatgtcatggggggttaagtgcactgaccttgtcggatgacccagacatgggtgacaagcgtggtaaagaatctaagcatttccgaggggatgcttag

SEQ ID NO: 24357 - DNA, 423 bp, Glycine max
  Peptide Sequence Number=SeqID_141135
atgttacaagcaccaggtggtctagtggacaatgatcgtagacgtgaggctttgtgtgtccgcttcacggcagacggcgaagccaatgtgtccgaagtaggaggaagagaaggaagaggaggaggaggaggaggaggaggaagagtggaggcaggtcgaaaacccatgatcttttatacaatgacatacaaaataagattaatgaaaagaggatcagccataagttttttttggaagacaaaaaaaacaaagaggggaacaagcaacaatttgaaggttgtacattcaggaactaaagaattcaaaataactagtaataagagggatttgtttttgggattttcgaagcaccaagagcggctacgcaagaagcttgcacttgaggagggaaggatatttgcagctaatgaacaactttcttaa

SEQ ID NO: 24358 - DNA, 267 bp, Glycine max
  Peptide Sequence Number=SeqID_141136
atggaggccatgaaagagcaaatgaccataatgatggaagccatgatgagtatgagaaaaatgatggtggtcaacatagctacaattgttgccgtaagtaccaccactgaggtgaacttgactcacccatctaggcccaatcaagtccaaagtaagcatttcttcccaccatatggcttgcctcccaactatacgccacccaatgttgcacacgctcccaatgagaatgttgacaactctgttcccatacccattgagagccaatga

SEQ ID NO: 24359 - DNA, 168 bp, Glycine max
  Peptide Sequence Number=SeqID_141137
atgtcttcctcccccaagactatgatcaaatgcccttccactacaaatttcaacttttggtggagcgttgaagatgtggggtccaatctgaattgggagatcaatctccccccttacgtctcggcggctgctgtcaaaagcccgcaagaccacggagctcggacttag

SEQ ID NO: 24360 - DNA, 699 bp, Glycine max
  Peptide Sequence Number=SeqID_141138
atgtcctcaccttcagagggctacacgccctcacctttagaggactacaagtcctcgccttcagagggctgcacgccctcaccttcaaagggctacataccctcacctttagagggctacatgccctcagcttctgaggactacacatcctccccttcagagggctacacgccattgccttcagggggctacatgcactcaccttcagagggctacacatcctcgaccacaatgccgatctccccctacggaagatcgcgcccacaagacacccagtggacccggagaagtccaacagggccctggggtttccagctctggttatgggcctctgtcaatcctaccgggtgctcgtccccccagcaagggatcgtgcccgcaagacacccagtggacccgaagaagtccaataggatcctggggtttccagctctgattacgggcctttgtcagttctatggagtgtccgtcgcccccaacatggtcatcgagccccctattaaccggactttcatcaagaagtactgcgccccaaggcaggcgcagggcgagataccacagcagcctggggatggccggcagtgggcaatagacgcactgccgccacctccagagcccctcagctcatttacaaaggctagagcattgcctacgacccatggccaaccagcaggcgaccaagtccaaagccaaaggtaa

SEQ ID NO: 24361 - DNA, 216 bp, Glycine max
  Peptide Sequence Number=SeqID_141139
atggagaacaaaaacaacaacagtggcgagtcggagctgcgggtggtggttgtcatcttcctcttgaagggcagatcgatcctccttggtcgctgccgctccgctgtcggcaatgccaccttcacccttctaggcggccacttcgaattcggtcactcccttactctctctcatattatgtttttttttccgtcaaacattttgaaaacgaaataa

SEQ ID NO: 24362 - DNA, 348 bp, Glycine max
  Peptide Sequence Number=SeqID_141140
atgaaggattgggggaattttctccaccaaatccttgaggaggattatgaggattctactctgattacaacgttcttcttgtgtggaggttcggcggcaagcagaggcggctcgtggtggccaccagtggttatgggtggtggagaagaaggtgttagggtttgggtgggcgtttggagaggaggagagggggaacattgtgttttccacgctaaagaaggtattcataatttgcagatctcgcttagtgagctcatctcgctaagcaggagtccacttttcgcgcttagcacgacaattcgtgctgagtgcaactccctctgcactaattgtcactcagtgcgctaa

SEQ ID NO: 24363 - DNA, 624 bp, Glycine max
  Peptide Sequence Number=SeqID_141141
atggatgttcatgtgactactcaagaaccccttttggaaaacgcccctacaccactactactacctcaaaaaacgcccaaaaccccaacacaaagaaccatgagaaaggcattcaaaggcacatcacatctggccaagcttctcccaacaggaacagtgctaatattccaaaccctatcaccacttttcacacaccaaggccaatgccaaaccctaacaagcaaaaccatgaccacatgtctcttaaccctttgcagcatctcgtgttttcttctgtccttcactgacagcttcagggatgagaggggaaaagtgagatatggggtggcctcattgaaaggtttgtgggttttggatgcttcaattagggttcctgttgatgaggctgagaagtataggctgaggttcattgatttcttccatgctttcatgtcgatcttggttttcttggcggtcgcgctcttggatggaagtgttgttagctgtttttttcctaagccttctgaggaggccaaggagcttcttgtgactttgcctattgggattggaattgtttgcagcgttttgtttgttgcattccctagccaaagacatgggattggcttccctctctcacgtaattag

SEQ ID NO: 24364 - DNA, 4824 bp, Glycine max
  Peptide Sequence Number=SeqID_141142
atggggcaacacaggcaatgtggaggtccttttgaggcgaaaatttatgaacaactggacaaggatgtttcaaggactctgcacgaataccaatttattccagagaagccatctgttagaaatgagacatatgagagagttgccccctctatccactatagttcccttgatggcattccacattctaggactttattatctagtggacgatctttcctcaatgggaatgaatctgcaccttatggatacggaattcaaggtcatttacctggtctaaatcttttgtctcggcaaggtaggcagaatcatcttttgccatctgcttcaggagaaaatgatggcattccacgaaagaacccatttgttgatgtaacagctgacattcataatggggctcacccaataactctgattgacagccctctaatgccatctgacgggagggttatccacgtagaggaattatcaaggcttcaaaggaagcgaaagaatgatgacactaaaatgcaacaagaacttgaagcacaagagagaaaaaatagaaaagagcttgaaaaacaggatattctaaggcaaaagagagaagaacaaacaaagaaagaaatggagagacatgaacgtgaaaggcagaaggaagaggaaaggttattgcgtgaaaggcagaaggaagaggaaaggctattgcgtgagagacagcgagaggaggagaggtaccaaagagaacagaggcgtgaacaggaacggcggcagaagtttttacagaaggaatcaatcagagctgagaaactgagacagaaggaagaactacgcagggagaaagaggcagccaggatcaaagctgccaatgagagagctattgctcgcagaattgctaaagaatcaatagaacttattgaagatgaacgcctggaactcatggagttagctgcatcaaagaaggaactctcttcgatactggctcttgactatgaaactattcaaaatcttgaattctatcgagatggacgggcatccttcccacccaagtctgtacagttgaaaagaatattttcaattaaaccttggtcagattctgatgagaacgtgggtaatcttctgatggtttggaggttcttgattacctttgctgatgttcttggaatatggccatttaccgtggatgaacttatacaagcttttcatgaccatgacccaaggttgttaggtgagattcatattgcacttctgaaatccattataaaagatattgaagatgttgcaagaacaccctctactgggttaggatgcaaccaacacagtgttacaaactctggtggggggcatccacaggtagttgaaggggcctatctgtggggttttgatataagaaattggcagcggcatttaaatcccttaacatggccagagattttgcgacaatttgctttgtcagcaggatttgggccccaattgaagaaactgagtattgagcaggtgcatccttgcaataataatgagggcaatgatggtagagatataatttctaatctacgcagtggagcagctgttgaaaatgctgttgctattatgcaagagaagggattatctaaccccagaagatctaggcattgtttgacacctggaactgttaaatttgctgcatttcatgtcctttctcttgaaggaagcaaaggccttaatatattagaagttgcagacaagattcagaaatctggacttcgtgatcttacaacaagcaaaacaccagaggcttctatttctgctgctttgtctagggatacaaaactatttgaaaggacagctccttcaacatattgtgtacgtcctgcatatagaaaggacccagctgattctgaagcaatttattctggtgccagggaaagaatcaggatgttcaaaagtggatttgtggaggcagaagctgctgataatggtgaaagggatgaagattctgaaagcgatatggaagaagatcccgagattgatgatttaggaactgaaacaaatgcaaaaaaggagagttccaattatgagggatttaatgcagactctgagatgagaaatagaaaggacagcgttgaggttttgcaaactcatgatactagccttgagaaagtgggtgaggatttagcttcaattgttgccaaagactttaatgaacataaagatgttagtacctctagtggaattgctgtttgcaacaatgatgtggttgatcctaatgtcaaaggaatagctgttgatgaaagcattccaggtgaaccatggatacaagggcttacagagggagagtactcggatcttagtgtagttgagcgtcttcatgctcttgttgctttgattggtgtggcaactgaaggaaattcaattcgtgttgtacttgaggaacgtctagaagcagcaaatgctttaaaaaagcagatgtgggcagaagcacagcttgataaacgccgtatcaaagaggattactttgctaagatgcagtctgtctcttatttggacaaaacgaatgagctgactgttgtatttccctcagcagatagtaaacatagcccagtgcttattgctgatgataaaaatagtaaggctttgctcaattctcatgacctgcatgaacagagcattgaattacaggaaaatcagaatcatcttcagagttctccattaaaagtcaataagcagatgcaagattgttctactggcccagataattattctttccaacactcaggatatgttgttgaaaaatcaaggtcaaatttaaagtcatacattggtcacttggctgagcaaacttacatgtataggtcattgcctcttggtttggatcgaagacgtaatcgatactggcagttcacaacatctgctcaaaatgatccaggttgtggcaggatttttgtggagttgaatgatggtcgttggaagttgattgattctgaagagggttttgatgctttattggcttctttggatgtacgtgggattagggagtcccacttgcatatgatgttgcaaagaattgagacgtacttcaaagaatttgttagaaagaatgcccaaaatgttaacatgagaatgcaaaatggagaccctgtcgagagactcaagacagaatctgttgaaatggcttcaaaccaagattgcagtgctaatattcatggttcttcctctgtatgcattgataatctggatgcatcagagacctcaacatcttttgtggttcagcttggaagaaatgaagctgataacaaagatgcttgtatgagatattgggactttgagaaatggatgcgaaaggaatgtctaaatttctcagtactttctgcaatgaagtttgggaagaagtggtgccaccaactgcagtccatatgtgatttgtgccttcatgcctatttctctgggggagctccatgctcttcctgctgtagaaccttcagtgcttgtaagagcaaccctagttcttccaaacatattgttcattctgaaggcaaagtgaagattgacattgattgttttcatgcttcgtcctcattgtctttgaggatcagattgctcaaaatcttattgtcaattgttgaggtctctgtttattgtttgtttgaattcactggagctgatagtgtttggttatgggttttaggtaacccttcccctagaagctctgcaacctctttggagagacagctgcaggaaatcttggagtacaaagctggatgcttcctcatcaagcgaagaccttcttcaggttataatctgatattgacggcattggaaggtgctataaagagggagtatttggattcaaactatgaaactacttttgagctgttgggtttgtttagtgcttctggatgtcacactaaggattccattgatggtgaaaggatgtctgtacttccatgggttccatatacatcagctgctgtagctctaaggctcctgcaacttgatgcatgtatcttttacacctcacagcagaagctggagtctgagaaggataagaaaattggaattgtgatgaagcttccatcaaaacatgcttctgccagaaaatcttacaatgctggtgcaattgaaacttcacatcaggctgaacgtgctgtagagaactgggttgatcttggagctggtcttacgagctgcagcagaggacaaaggacccaacagggccgtggccgttctcatggtggaagaacatcatcaaaaaggagggtggttagttcaagatccggttctaaaaagagaagtactacctctagaagcaggaaaatgggaaaattacttgaatggaaagggagaccatgcagacaaggaggaaatgcccgtggtcctcgtagcattagaagctggcagaaatcagaagccaaggtggatgtgatcactggtgagagggataccccaaaagatgtcatggaggaagcagctggtatctttgtccaagaggagattaatgaaggtgaaatggaagccgctgcactaaatgctagtagttcagagagatcaggctatgaagatgatgtttatcaagaaataggtgatgagtatgattatctggtggacaataatgatggatatcagggtgtatttagtgggaagtctgagaacttattacatggaagccactataatgtggttggtaaggaagatatggatattgatgacaatgttgacgatgatgatgacgacaacgggaaaattgatcttgatgttgaaggttacataattgggggcaactcagatgcaagggacaggaaagaagaaaatgcagaacaaaacatggatctggatggagttggttctacatcatcagactatagtgattaa

SEQ ID NO: 24365 - DNA, 624 bp, Glycine max
  Peptide Sequence Number=SeqID_141143
gcatcagaggaagacgaagaggtgcaggcccttagggcagaactcgagcaagcccaaacagtcaaagaaaggttcaaatcagcagctctgaagatccgaaaggagaatgccgaactgagagatataaatatagcaaccaccaaagccttggaacaagagaccaagagggttcgtagggaggagcacggccggaacaagttccgaggggctctgtggggtagcaacaacgagcttaagctccggagagaggaaagggaccaatcacgagtagacagtttgatcttgaaagatgagttgaagaccaacatgttagctattgtcagcaaataccaagaagagctaaatctagccacgacccacgagcataaagtggcggacgagtatgcccaagtgtacgcggaaaaggaggctagaggaatggtgatcgactcgttacatcaagaggcaacaatgtggatggaccgattttctcttaccttgagcgggagtcaagaacttccccgattgctagccaaggccaaagcgatggcggacacttactccgcccccgaggagatccatagacttctcggctattgtcagcatatgatagatttaatggcccatataattagaaaccgctag

SEQ ID NO: 24366 - DNA, 356 bp, Glycine max
  Peptide Sequence Number=SeqID_141144
caggaagcctggcaactttctttcgagacatggttgaagaaaaggctaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacggttaccccgcctacttgactacttga

SEQ ID NO: 24367 - DNA, 324 bp, Glycine max
  Peptide Sequence Number=SeqID_141145
atgactttactttctctttatggtttcctcaccgttgagaaccgcagaactcattctcagtcacaagttcgaatccacttccatcaaccagatcttccattgaataagaacggatcaaacaaagcacaccaaatcaaggagctgtgggtgattcttcctaccaaggcggaagtcctcaaccaacactcaatctcggctctacgactaggctacgaaacgaaagcgaagggtccgcaaggcattcgatcttcaagcgaaagggacgggagggtcaatttcattcagttgagaaagggacagatgcggatgccgctctcgaagtga

SEQ ID NO: 24368 - DNA, 714 bp, Glycine max
  Peptide Sequence Number=SeqID_141146
tgccgtagacgcatttgtgaaagagggcttgcagggctgaaagatggccgtaatgcggcggccaatacgtctggctggcgccaaaaggcggaagatgctgcgcctgaattggttcgactggttgagacggatgattcactctgcttggcgcatggtggaaaaatggtgtcattacagctgaccgaggcggccttgcctgtgcaagaaggtccggtggaagtatgggtagaccgctggtttatgcaggtgcaaaccgcagaccacaccaagcacgtactaacttcggacaagccggaaactgagctgggctgttcacatagtatcgccggaccacaacactggaccctggctaccatcaagcgcctgccgcagcagtttaaccagtatgtggccggccacgattttgtggtgttactgtttaccgccaagtggtgcgatccgtgccaggctttttatcctgcatttaacgaggtggcgtctcagtatccttccatttcgtttgctattgcagatattgatgtggccaccgacctggccgctaatttccaggtggcacaagtgcccgcattgatggtgttgcgcgagcgcgtgattattgatcgggtcacgggtgccatgcatgcccacgagttgcaacaccatctccagatgtggcaggcctttgacatgacggcgattaacgaacactttagccagtccacttccaacgcttaa

SEQ ID NO: 24369 - DNA, 399 bp, Glycine max
  Peptide Sequence Number=SeqID_141147
atggtagcctggcccaggacccaaccttctcttcatatggaagatgaaggtcccacagcccaggtacctcagcatctggaggatgagtcatctgaggccaccatcccagagccatttgatataggacaagaggtagaggagacacaggtgagacaggtagctactgccactcctgagcgatcccttgaggctacttcagagccttctgcactagtggtaaacctaccctcacctcagcctgcagcagacccctccactcctcttctagagatgctagaggacccaactacaccattcctagctatggacacttctcctccaactacttcagtgcttcatctaacagatgaggaggatggtcagacacaggacaccccggaccagtcacaggaattttga

SEQ ID NO: 24370 - DNA, 1176 bp, Glycine max
  Peptide Sequence Number=SeqID_141148
atgctggcgattgcactggtgattatggtgattttcctgttcctgaaaacgctggcaggcaccttgattcccagcctggctgtaccgctgtctttgctgggcacgtttagcgtgatgtatttcgccggttttagcgtcaacaacctgaccttgatggccctcaccatcgctaccggttttgtggtggatgatgcgattgtgatgatagaaaacatttcgcgccatatcgaagaaggcgccagtcccatgcaggcggccttgcaaggctcgcgggaaatcgggtttaccattatttcgctgaccttttctctcattgcggtgctgattcctttgttattcatgcaggatgtcgtcggtcgcctgtttcgcgagtttgccagtacgctggcgattgccatcctgatctcaggcatcgtgtcgttaacgctgacgccgatgctcagcgcacgcttgttaaagcgtgccgatgcacgtcacacggcggcttggcaacactggctggagcaacgttttattgccctcacccatggctatgcacgttctttgcgctgggtgctggcgcatcaggcccaggcactggcagtgaccttggtgacactattactgaccttttggctggtgtggtgggtgcctaaaggttttttcccgattcaggataatggcttgattcaggcggccatagaggcgccgcaatcatggtcattccaccaagtgtctgagaagcatcatgcgatagtcgagcaattattgcaggatgccgatgtagacattatttcttctgtggttggcgtagatggcatgaataaaaccctgaatgaaggtcgcttgctaatcaaactgaaaccactggagcagcgtacaacacgcattcaacaggtcattgagcgcttgcaacaaagtgtgcctgaagaccaggggtttaccttgcgcatgcaaccggtgcaggatttaaccgtagaaacccgcaccgggccaaccagttaccagctgaccgccgtcagcctcgatgctgtggccttgcggcaatcactgccaacactggtgcatgccttgcaacaattgccgtcactgaaagacgtgaccagcagcgagcagtctgcgggcttgaaactgtatctggatgtcaatcgtgatgcggccagtcgcctaggtatcagcatggcagcgattgatgat

SEQ ID NO: 24371 - DNA, 579 bp, Glycine max
  Peptide Sequence Number=SeqID_141149
gtcaagccgggcaccatccatgtctatcaccaggcactgggcaatgtgacttcatttgccaccgtggccgtcaaaagtcgcgtcaacggtcaactcacggccatccattttcgtgaagggcagttagtcaaagcaggtgacctgctcgccaggattgatgccaaacctttcgaggcgcaattggcacagattcaagggcagcaactcaaggataaagcgctgttgtcaaatgcgttggcggacttggacagataccagacgctgttgaaacaggattcgattgcaggtcagcaggtggatgcgcaggtttcactggtgcagcaatataagggtgccgtgctgtctgatactggcgcggtagaaaatgcgcagttacaggtggcatataccagaattgtggcacctatcagtggccgtatcggtctcaggcagattgatggcggcaacaatatcaccactgccgatacgttggccgtgatcaaccagatttcaccgattgctgtgacctttaccttgccagaaaatatggcgcaggaagtcagccgcttgctcgatcagcgcacgcatagcggattaccg

SEQ ID NO: 24372 - DNA, 870 bp, Glycine max
  Peptide Sequence Number=SeqID_141150
atgccgctggcgaggtggctgccggtggtgctgctggcgcagctggcgctgctgatcctgtgcgcctggctggcggtgcggctggcgatccggccgctgacgcagctggccggcgcggccgacgcgatgagccccgaccgccgcagcccacgcctggccgaggacgggccggccgaagtggcgcaggcgtcggcggcattcaatgccatgcaggaccgcatcgccgcgcacctggccgaacgcatgcagatcctgggcgcgatttcgcacgacctgcaaacgccgatcacgcgcatgaagctgcgttcggaattcatggacgactcggccgaccgcgacaagctggcgcacgacctgcaggaagtcgagcagctggtgcgcgacggcctggcctatgcgcgcagcgcgggcgccgccaccgaaccgcccgcgcgcatcgacctggacgcgttcctggacagcctggtgtgcgactacaccgacatcggcaagccggtgacgctgcaaggccagtgtcccggcccgtggctgacgcggccgcgcgccttgcgccggatcctgggcaacctgatcgacaacgcgctgaaattcggcggcgcggcagaagtcctgatcggcccggccgaggacggccacggggtatcgattcgcgtgctggaccgcggccccggcattcccgagcaggaattgcaggcggtgctgcaaccgttctaccggctcgaaggctcgcgcaaccgcgacagcggcggcacgggcctggggctggcgatcgcgcggcaactggccgacgtgatcgacggcgaattgcggctgcgcaatcgcgagggcggcgggctggaggcgcaggtgctgctgcggcccgccgcctga

SEQ ID NO: 24373 - DNA, 1410 bp, Glycine max
  Peptide Sequence Number=SeqID_141151
atggaagttgagcatttgcttgcagaacctagaaatgatcatgcttccctggatggtagtttggattctcatacaactttgaatggaaaggatgatttggaactggaggcccttgatggattgctggatgatgttgaaatcaatgatcttgaaggaactgttggtttccctggtgattttggatttgctgacaaatttgaggaggtactaggctctggtccttttgtaggttcactcttgcaaaactcaagttctgaaagtcattcttccggattaagcggaagtagcattgttgatggggtattagaatcaacagaagtacctattgcacaatctgaatgcaaaaatgattctctagatgagacaataacctatgaatcacatggtgccttcaggaacaatccaagtcaaccatcaaaagtaaattgcagatacaacatttcacttgatatacaacatctgcaagatttggataacaaccgtcatttagctggtggtatattgacttgtaagaaggaaaagggtcctgttgaaaaaggccaacctgctgcacttagagagaagagattccgaaagcctactcagaggtacattgaagaattttcaaattcaaggtcaaaggaaaaggcaccaactgctggtacaaaaactaaatatttaagtgactcatcatgtgatgatgtacttcatataagaattaaagcattcaaaaagagtccaagtgaaaagtctagtattgaaaatagagatgtgatgcttcctgagttgcaagttcacaaagggcgtccgaagaaagagaaacttgagtatgacaacgagtcatttcccttggaatctgaggatgaatggttgacatcaaaaagatctagaaggaaagatcgaagaaagcatcagaagatgtggactctccctgaagtgttgaagttggttgaaggcatatctgaatatggagttggtcgatggactgacataaagaggtttctgttttcttctacaagctaccgaactcccatagatctcagagacaagtggcgaaaccttttgagagccagttctgcacagaaaagcacgagagaggctgaacaaaatgacgagcttgccctgcgtcccttgccatttaatgtggtacatcgtgtgcaagaattggctaaaattcacccatacccaagggaacgtggatcaaagaagttgcgtgttagccaagctggctcttctgtcattgctaaagattctcctccccttagtcttagcaaaagaaatgaaccggaagcatctaggggatgggtcattgagtcacacatcccatcctaccctaaggcccttgattgtgctacgctagagcctggagctcatgatgctcatcatgattggggtaaacaatgctgtgtgcttcatcttgcagcattttag

SEQ ID NO: 24374 - DNA, 519 bp, Glycine max
  Peptide Sequence Number=SeqID_141152
atggtggtgaggattcggctatcccggttgggatgtaagaacaaacccttctatcgggtcatggccgctgatagcagatcccctagagatggcaaacacctcgaagttctcggttactacaatcccttaccaggtcaagatggtggcaagagaatgggtctcaacttcgacagagtgaaatatttcgtccaagtgaaatgggttcggtctcttgaaccatccaacccaccttatatctaccggtcagccaggctccctagtggattggcaatgccggtggataatatggttaatgaaaagtattggctttctgttggagctcagccttcggagcctgtggagcggcttctattccgagctggaatgctgcccccacctccgatggtggcaatggggcgtaaaggtggaccacgtgatactcgcccagttgatgctctcactggacgtgtgctaaatcaagaaaaggcagctaatgccaataacaatgagcagcagcatgacactcctgaaaacccttaa

SEQ ID NO: 24375 - DNA, 825 bp, Glycine max
  Peptide Sequence Number=SeqID_141153
atgggagtagtttctgaaggaaacggcgacgttttaccatggctgaaatcgatgccggtggcgccggagtaccggccgagcgccgcggagtttcaagatcctataagttacatattcaagatcgagaaggaagcttccaagtacggaatctgcaaaatcatccctcccttcccaccttcttccaggaagaccgcaatcgccaacctcaaccgctcactcgcggagaccggctccacattcaccacgcgccagcagcagatcggcttctgcccccgcaggcccaggcccgtccagaggcccgtctggcagagcggtgatcgctacaccttcaccgagttcgagtccaaggccaagtcctttgagaagacatacctcaaacgccacgccaagaaggcctccggccttggcccgggccctctggagactgaaacgctgttctggaaggcgacgctggacaaaccgttctccgtggaatacgcgaacgacatgccggggtcagccttttccccgaaatgcaggcgcgtaggggatccaagctcactggctgacactcagtggaacatgagagcggtttcgagggccaaaggttcgctcttacagttcatgaaagaggagattccgggcgttacttctcctatggtctacgttgccatgctcttcagctggttcgcgtggcatgttgaggatcatgacttgcacagcctcaattacctccacatgggcgccggcaagacctggtacggcgtcccccgtgacgccgccgttgctttcgaggaagtcgttagggttcacggctacggcggagagattaacccgctcggttag

SEQ ID NO: 24376 - DNA, 894 bp, Glycine max
  Peptide Sequence Number=SeqID_141154
atggctttttttactggtagtttgctgattgagaccctgttctcactcgatggtctgggcctgctgtcttatgagtccatcaatagccgagattacccagtggtgctgggcaccttatatctgtttaccttagtgggattgttcatcaagttgctgggcgatttcgcttatgtgctagtggatccacgcatcaagtttgatagtcaagattccctggccggggaggtgatttctaatgaccggcccctggtggtgcgctatgagcaacaatggtattttccgttgttcagtgagtatccggaatctgttttcggcggcaacctgccaatcaaggcggattaccacgacccatttatcaaggcgcaactgagcaaggcaggcaattttgccatttatccgctcaacccttattactacgacacgcttaattacttttccaaggccgagcattacccgggcaaaccggacgatgaaaacctgctaggtactgacattgccggttatgacatcctggccaggctgctgtacggttttcgcgtgtcggtcacctttgccttggggctgacggtggtgggcgtggtgctggggatcttttttggtgccgtgcaaggctattttgccggcaagaccgacttggtgatacagcgcctgattgatatctggggctcaatgcctgagctatatttgttgattatttttgcctcaatttttgaccacagcctgctgttgctgtttggtttgttgtcattgtttggctggattactttgtctgactatgtgcgtgcagagtttttgcgtaaccgccaacttgagtatgttaaatccgccagggcattaggcttatctaactggcagattatctggcgccatatcttacccaacagcctcacgccg

SEQ ID NO: 24377 - DNA, 323 bp, Glycine max
  Peptide Sequence Number=SeqID_141155
aatcaagagatctcgctaacatgtctcttgaaactctttttggaaagcttcaggaacataaaatggaacttatgagactaaatcaacatgaagaaaatgacaagaaaaagaaaggaattgcacttaaagcctcatcttctattcaagaagaaagtgacagagaagacttgaatgaaatagaaaaggatgatgattttagtttctttgtaaacaaattcaacaagtttctaaggaacaaaggaaatcaaagaagaacaaatttcaatccaaagaaaaaaggagaagactctccttgtgttccaaagtgctatgaatgtaattaa

SEQ ID NO: 24378 - DNA, 426 bp, Glycine max
  Peptide Sequence Number=SeqID_141156
atggttagaataagaggattgcgtcttgttttaggtagagttataagaagagccttaaggacacaagcaactgcaactgttgttgaggatgttgagcatatagatcatccaactgacgaggattttctagacaagccccacaatacatttgtttcaacagattatgtttatcatatgacaaccacaatttggacaggagaggaacatcctgagttgaagttgttctttcatgggaggaaggtacaaaaatttggaaggtctacaccagggattgaaggcatagtggctctcacaggattaagtcctttgattgcatgttccttagacacttgtgacatgggacttatatatgtttttgcagagaggtggtgcttctataacttcgatgctctttgccgtagaccatgcactggagctgctagttga

SEQ ID NO: 24379 - DNA, 1653 bp, Glycine max
  Peptide Sequence Number=SeqID_141157
atggagcccattgaatccgaatcagttagttcctccgccaaagaccagcaactgggtgaaccttcttccactgttcaccccctcgatcacgatcctcaaccttcagatctcaatcgcgttacccctgttgatgatgcacttggtgaggagtttcagaacaagttggatttgaaggatgggggtgagagtgagaataatggttcgaacttggaagatgggggtgaaaaattgagcgaggataaaggttcaaacttggaagatgcgagtgaaaaattgggtgatgaaggtgctgctgccccagaaggtggcaagggagaagggtgtgatggtgatgttggtggtgttgctaatgattatggtgttatcggtgatgatgtagttgttgctgaggatggtggtgttgttcgtgatgatttagttgttgttgatgaggatgatgatgacggtgttgctgttcgtgatgatttagttgttgttgatgaggatgatgatgatgatggtgttgttcgtaatgatgtagtagttgttgttgatgttgatggttggaatggtagtgatgaggggtgtgattggattgagaatgagaatgtgaatgagagtgagagtgataaggtgggagtggaatataaagatgagaggagcagcggtaaagctcaacagtacccgttgaggccagaggctgaagactgtgcattttatctcaaaactgggacttgcaaatttggattcaattgcaagttcaatcacccgcttaggaggaaaaacctggctaaaaacgagaatgcgggagaaagagaagagcaggaagaaagatcaggccagacggaatgcaaggcttgcaagtttaatcacacaagaggaaagagttcatcagcatcctctactgcagagcttaacttccttggcctgcctattcgtgtgggagagaaagagtgccattattacatgcgtactggctcttgtaagtttggagcaaactgcaggtttaatcatcctgatcctacagctattggaggaggtgattctccttccggttatggtaatggaagttctatttcgttgcaaggtgtatcacaatcatctatatcctcatggtcttctactagaccattaaatgaacctgctccttttgtgccggtgatactttcacataatccaggggtttctccccaaagttctgaatggaatggataccaggcaccagtctatctatctgagaggagtctgcatccaccttcaacatatgtcatgaacaacccagctatagaatcaaatgtttatatgcaccatcaaaaacaaatgcaggttgaagagtttccagaaaggcctggtgaacccgaatgcagctatttcttaaaaactggggattgcaagtttaaatctaattgtaaatttcatcatccaaagaatcggattgcaagattacctccatgcaacctcagtgacaagggtctacctttgagaccggagcagactgtttgcacatattaccgccgttatggaatttgcaaatttggaccagcttgtaagttcgatcacccaccaccctcaactatggctggacttgatcaacaatcctcgtatacaaactcagctggtgttgatgtggctgaaaatggagatgccgatgatgggaatcagcagtctgtgtaa

SEQ ID NO: 24380 - DNA, 555 bp, Glycine max
  Peptide Sequence Number=SeqID_141158
atgatgagtgagagggaaaatacaatatcttatactagactaacatcttttcttcgtaaagatacctcatttcttagtccttggagttggccggttcgaaatcgcaatgctgctgccgtgaatattgagacttcaagttcaagaaatgtcgagcagtaccttcttcaacctggatcatattttgaatctatatggccacctatcttcgaatctaggaggaatctgcgtccaccttcaacaatttatatgcactttcactataataaacaaattgaagagcttccagaaaggcctggtgaacccgaatgcagctatttcttaaaaaccgggcactgcaagttcaaatctgattgtaaatttcaccatccaaagagttggattgaaagattacctccatgcaacctcaatgacaaaagtctacctttgagaccggagcgaaaggtttgccggtattacggccgttacagaatttgcaaatttggacgagtttgtatgttccaccaccctcaactatgcaagacttcatcaaaagctcgtgaactcaaactctgctag

SEQ ID NO: 24381 - DNA, 658 bp, Glycine max
  Peptide Sequence Number=SeqID_141159
aaactgcattgcattgagtattaattctgtgcaatgcaacaggcttgaggtggcattgcttcttatagtttatatcgcatatgggtatgcagagggaggtgctgttacgtatgttttgctaactctaagtagttggttccttgtcatttcttggcttttcgctccttaccttttcaacccctctggtttcgagtggcagaagactgtggaagattttgatgattggacaagttggcttctttacaaaggaggagtaggagtaaaaggagaaaatagttgggagtcttggtgggacgaagaacagatgcatatccaaacttggaggggtcgtattttggagacaattttgagtgcaaggttcttcttgtttcaatatggtgttgtgtataagctgcatcttactggaaatgatacatcacttgcgatctatggattctcatgggctgtcttggttggaattgtcttgatatttaagatctttgcctacagcccaaaaaaggctgctaatttccaggtagtgttgcgatttgcacaaggggttgcatctataggccttgttgcagctgtgtgtcttgttgttgcctttactcaactgtcgatagctgacctttttgcaagcatccttgcatttatccctactggatggggaatattatct

SEQ ID NO: 24382 - DNA, 534 bp, Glycine max
  Peptide Sequence Number=SeqID_141160
atgacagttactcacttaagatggtttgttcatgtgaggagaaggctaatagaggccccaaaaattagtttcaactccacattgcggctgggaaatgtcacacaccatgaatacattcaggttggaaaaggaagggatgttgggttaaaccagattgccctctttgaggggaaagtggcaggtggtaatggagagcaagtgcttagcagggacatttacaggcttggacaactttttgatttcttcagaatgctttctttcttcttcacaactgttggttattatgtctgcaccatgatgacagtccttacagtttatatattcttatatggaagagcatacctggcgttttctggtcttgatgaagctgtctcagagaaggcaaaattgcagggtaacacagcacttgatgcagctttaaatgctcaatttttggtccagattggcgttttcactgcagttccaatgataatgggttttatacttgaattaggattgctgaaggctagtaccagtggtactgaaagtacatag

SEQ ID NO: 24383 - DNA, 1269 bp, Glycine max
  Peptide Sequence Number=SeqID_141161
atgggcacggccactgttgcgcacgttgtcactgtggatgtcgagcacgtaggcgtcttcctgggcgatcaggttggtgatgtccttcagcagccagcggcggtcgaccgcagtgaccaccacgtccacttcgtagccgccgccggcctggccccactccaccggcaggatgcgctgcgggctggtggctgccagccgggccagcgcggcacagtctgcacgatgcacggtgacaccacggctacgggtcaggtagccgacgatcggctcgccagccaccggctggcagcagcgtgccagctgcaccagcaggttgcccacgccctgcacggtgaacttggacttgcccaggttctcgcggcgcgcggtcggccgcggcagggtcggcgcgggcgccggctggctcgctgcacgttcggcttccagcagggtacggctgacctggttcgggccggtatcgcccagcgccacctggatgtagagatcgtcaacgctgtcggcatggaacttcttcgccgccaccgccaggtccgagtgctgcaggcccagacgcttcagctcgcgctcaagcagttcgcgcccggcctgcacgttgcgcgcgcggtccagcttgtggaaccagctgcgtaccttttcgcgcgagcggttgctggccaggaagccgttggccggcatcagccagtcgcggcgggggtcggcctccttgccggtcaggatctcgacgcggtcgccgctgcgcaggcgataggtcagcggcacgatgcgaccgttgaccttggcgccccggcagcggtggcccaccatggtgtgcacctggtaggcgaaatcgagcggcgtggcgccctgcggcagatccagcacctcatccttcgggctgagtgcatagacccggtcttcggtcagctcggcatcgagcgccccagccagctcattgccctgcccgtcctgcgcctgctccagcagctggcgcatccaggtgatcttgcggtcgaaggacttctccgcgcccttgccaccctccttgtacttccagtgcgcggccacgcccagctcggcctgcgagtgcatctcatgggtacggatctgcacttcgatggtgcgcccttccgggccgaccacggcggtatgcagcgagcgatagtcgttggccttgggccgggcgatgtaatcgtcgaactcgctcggcaccggcgcccacagtgcatgcaccacgcccagcgcggcgtagcacgcggcgacgtcgtcgaccatcacgcgcaccgcacggat

SEQ ID NO: 24384 - DNA, 741 bp, Glycine max
  Peptide Sequence Number=SeqID_141162
atgatgtatcgcatcacccgcggcaatgcactaccgcgccgggagcagggacatccattatttgatgagtccatctttcgtatcgcgcagaatatgctgcaaaaaattgaggcccgcattgcccaccctttaccagaggacgaaagctggtttatttatcaatacattatttcgtccggcatgctggtggaagagcgtgatgatgtcagcatgctgcgcaatatacgctccagcgatgaggcccggcaaatcacctcccggctgatcgccctgttttcctcggtggttgatatcgatctgacgcatgacaccgcgttatatgaagggttgctcattcatatcaagccgctgctcaaccggctgaattatcgtatctatatccgtaatccgctgctggaagatatcaagggcgaattaacagaggtgtggccattaactctgcgggtggtgaatcaggtatttgccgcctggggcgagaacgcggtttcggaagatgaagtgggttatttaaccgtgcatttccaggccgcgatggagaggcaggtggccagaaagcgggtactgctggtgtgttcgaccgggattggtacctcgcatctgttgaaaagccgggtcctcagggcctttcctgactggaccatcgtcggcgtactgcctgcgggtagtctacatacgctacagcgacaggatgatattgaattggtcatttcaaccattcatctgccggagattgcgttaccg

SEQ ID NO: 24385 - DNA, 159 bp, Glycine max
  Peptide Sequence Number=SeqID_141163
atggcaataacggaaagctacagggctccaaatgaggtgattccaaaacgacgtgaaagaacaagggtggagatgataggaaggaaaaaatcactctttccagcgagggcaacacacaaaggttgtgaaagtcctttgatacagccagggtgttcttga

SEQ ID NO: 24386 - DNA, 1299 bp, Glycine max
  Peptide Sequence Number=SeqID_141164
atgtcccaagttgacattcaaacagcacttaggagtttgtttcctgaagatttttccactagagtacagtcccagcaaattgatcaaaaccctcctacatcatcttcatcttctctgagatcaatatccacaggtagccctgaatactcatcacttatattcagtattccaggcacatctcaaccccactttccacctgagactcttggagcatcatcatcaagagtagagccaacaatgcagccagtgccaaatagtcctcaccaacgagccattgatattcaagcattgacagaagtcccttctctaacccaattccccacaccagaaactgaacatgatgcaatcatgagagcaatcctccatgttatatctccaacaacttcttatcatcatgagcagcagcaccaccaaaacttgccttatagtaataattttcttcctgtggtgcgtcctgatgctagtgctttccagaggtatagacaagacttaggctccaacatggcctcaaatttcagaaggcaaagcctcatgaagaggtctcttgtgttctttagaaacatgaactttatgagaatgagagaacgcgttcaagcaacgtctcgtcccaccaatactcagcttcatcatatgatatcagagaggagaaggcgtgagaagctaaacgagaattttcaagcacttagagcacttcttcctccgggaacaaagaaagacaaagcgtctatactaatagcagcaaaggagacattgaggtctttgatggctgaagttgataaactaagcaacagaaatcagggattgacgtcacttttgccagccaaagaatctacagctgaagaaaccaaggtagctagtttatcaccaaatgaaagattaagtgtcagaatttcacatgtacccgaatcaagcacatcagaagagagaatggtggagttgcaagtgaatgtgagaggacaagtttctcaaactgatttattaatccggttattgaaattcttaaaactggctcaccacgtgagtttggtttccatggacgcaaacactcacattgcagaagggaacaatgcacttcatcaactaaccttcagattgaggattattcagttaagacgaaggaacttcgaaagtgcagttctgattgctaaggtggtttggtttggtgtgctttgtcaccatcctcagatgatacaaataacattcaattcaaaaaaaggaagtgaatgggacgagtctgccttcgaggaagcagtaagaagagtagttgctgacttggcacagtaccaaatggaccaataa

SEQ ID NO: 24387 - DNA, 654 bp, Glycine max
  Peptide Sequence Number=SeqID_141165
atggacaaaggcgagggacggtacggtgagagcagcgaacccatggatcagttccaccataatgaagctatatccgccattgttgacgagggtttcttggccgaggaagaaggtgtcggtggtggtggaggaagtgaggttatggaatctggggttttgaggagggttgacgggtttcataatcaagggtttagaaggaacgagaaaccacatggtggggttgttgggatattgggaaatgagggtttggtgagagaaggtcaaggtggtggaggaagaggaaatgtaaatagggttgatggaaatggtgaagtttggtggactactgatgttaaacttgaaactgagcttagtaagtataagtataggcctgtgaaggaggtgaagtttttttatgagaaggcaagtgagaagttaaaggggtattgccaggttttgttttttgacccttttgctgcaactgcttgcaaggaaaggatgaatggaagaggaggaggccgcgatgttcactgccttcgtgccagtgctcgtcgttgcccttcgtgctggtgcttgtcgccgcccttcgtgccggtgctcgtcgccactgtggggtcgtcgctactgggtgcaggggttgagcttttaattggaggagggctgcgttctgattga

SEQ ID NO: 24388 - DNA, 255 bp, Glycine max
  Peptide Sequence Number=SeqID_141166
atgcccctattcgaatgcaatgcaactaaaaaaacaatcttatttcgatgcggtgtgactcaaatgcagtttgcaacagtcgaacatcaaagccacacagtcatagatagaggcctctataacgatgtagttccccattgctggaaggttgtggcattctgcctgcaaatgggagatgggaggttgtgcttagaaagcaaccttaacccctttgctgaatcaatgaataagaaagttgagagcgaaccaggctaa

SEQ ID NO: 24389 - DNA, 219 bp, Glycine max
  Peptide Sequence Number=SeqID_141167
atgggtgtcatatcccagttgaaaaaggcaatgggcatagacaactgggagtctcaattaaattttattccaaccttggggacaaggttgaatatgaagggggtgatttatctcatggatattctcattttttacactatcatgtcagcaattgttggtggtgtgagtggtgcgcgtgctcggctaggcgaggtatttgggttccaaagtggcatatga

SEQ ID NO: 24390 - DNA, 204 bp, Glycine max
  Peptide Sequence Number=SeqID_141168
atggaaattggggttatatggagactgatttcatctaaaccacccatggaccctgctgatccagacactagcccacctgcggcaactagtcgattgttgttgttggatttgccaagggcaacaaagtcactgtgggtgggcacaacatatgtgcatcactcttgctctaatttgcttttggagaaagggaaggggcagaattga

SEQ ID NO: 24391 - DNA, 240 bp, Glycine max
  Peptide Sequence Number=SeqID_141169
atggactatgaaatccagaacaatttcctcttctttctcaacatcaccattaatttcatctacaaagacaaaacaaaaacaatatcaataataagtcaagtcgaccacaatgacggcacaaacgaagtggaagaggaaggttggcaccacggtgacgggcgaatgagcgctcggaggtcaccgtcatcattggtggctcgtgttgtggaggtgtcgccagatcaatttttgcactattag

SEQ ID NO: 24392 - DNA, 948 bp, Glycine max
  Peptide Sequence Number=SeqID_141170
atggtagaagggaactgtagtgttgttattcagagaatcctaccacaaaaattcaaagaccctaaaagtgtgaccatcccttgttctataggggttgtatctgtgggtaaggctctcattgatttgggggcaagcattaatttgaagtctctttccatgtgccggcggattggaaacctgaggattactcccactaggatgacacttcaactagtaaaccactccatcacgaggccttatggtgtagttgaagacgttctagtcaaagttcgccaattcacattcttggttgattttgtaattatggatatagaggaggactttgagatccccttgattttgggtcgtccattcatgcttaagactaagtgtatagttgatataggaaatggcaacctagagatgagtgtggaggaccaaaaggctaaccttgttgtgcaaagcctaactttccactccccattggaaagagcattcatgaatgtcattgattgtctgaccaaggagaaggagaaagatctcaaggcttgtctggaggacttggatagattgaaggagattccctttagggaatatgcttttgaagagctgaaaaaggatagcacaacagagaagcctaaagtagacttgaagatcctgccagctcacttgaagtacgtgattttggaagagaacgacgtcaagcctatggtgattagtaatgatttatcttttgatgaagagtctaggttggtggaagtgctcaaaaagcacaaggcagccattgggtggcatatttttgacctcaagggaattagcccttcttattgcatgcataaaatcataatgtctcagtgtcacactcgttctcggtctcactctcgcgacactaaaaccagtgtcggcactatcattctcagtctcactctcgctcatgatctaggtgtcactctcactctcgctctcacg

SEQ ID NO: 24393 - DNA, 420 bp, Glycine max
  Peptide Sequence Number=SeqID_141171
atgtttcagaccactgcctacttcccaacatatggaaggaactcagttgcttggtgtaaaatgggtggtagtttctccatttacactgcattatacgtgctaaaatttctgtcatctgaggttgatgatttacatgctgtagctcaacatttcccagaatctaaccgtgctatcagtgcaaatgttggtcatagaagtgacgtagtgcttctgtttgcttcaaaatatagtgacattaaaacaattgtcaacctctctgagcattatgatatgaaggcaggcattggagaaccctttggaaaagattatttggaaagaatcaggaaggacggtttcattgatgtgaagaagaggaggtctggtaacctttcatttactcagtgttattcattagtgaatgttgtccgccacatgttttga

SEQ ID NO: 24394 - DNA, 1494 bp, Glycine max
  Peptide Sequence Number=SeqID_141172
atgactattacaagaagcatgggtacccacctggacacaaattttacaagtgttatcaaaagtagccaagatgagtggatccttgattctggagccacagatcatgtcacaaccttcccacatttgttttctttatgcaagaaaataaaacctgtaatggttaggcttcctaatggccatacagttatgaatgataaatgttttatccaggatatgaaccagcagaagattggtacaattgagatggtggaagaactctacagactcaagatgattcctatcaagtctaagtacaagtctgattttgctgctaatagaaagaaactagatcctagggctgccacttctgtatttttgggttttaaaccaaacactaaaggattcattatgttttatcttaaagccaaggccatatctgtctctaggaatgtgatcttctatgaggattgttttcctttcattggtcaagacaaacctaatgttttcactgtccttcctattctttcttctcatgccattgatcaacctgatggtgtctcatcagaattaccagttgataatatcatgcttgtaccaaataatgttgattctaatcccttaactttagagcagtcctctaatacaaccagaagatctctaagacagacacacaaaccaagtaagtataaggacttccatgtttcatacccatcttcaactatagctagttattctgcagcttctaaggatcctgtctgggttgaggcaatgaatgcaaagattaaggctttagaacttaatgatacttggattttaattgatatgcctcaacataagaatgttattggttgtaagtgggtgtataagatcaagcacagatcagatgggtcagtggagagacataaggccaggttagtggccaagggctactctcaagtggaagggcaagattacctagacaccttttctccagttgccaagctaaccacagtgagacttctattggccttaactgctatcaataaatggtatctcaagcaattagatgtgaataatgttttcttgcatggtgatttaaatgaagaggtgtacatgatgcttcctcaaggtatgcaagtagccaagcctggccaagtttgtaagttgcaaaggtccctatatggactgaaacaagccagcaggcagtgctattacacagttgttgacaatgcttttaagataaaagatttaggtgacttgagatacttcttaagttttgaagtagccagaaaacctattggtatcaatatttgtcagaggaagcatgccttagacattcttagtgatactggtatgcttggatctaaaccaatatctactccatcagattatgctactaagttgcatcaacaatcaggggctcctctttcattggaagatgcttcctcttttagaatgttgattggaaggttgatctacttgaccaatacaaggccagatatagatatcacttatgttgtgcaacatctaagctaa

SEQ ID NO: 24395 - DNA, 393 bp, Glycine max
  Peptide Sequence Number=SeqID_141173
atggtcaaagtggttggggctattacaactgcaaaagatgatgttgtaataaccataaaggggttaaaggagtgtgacagaaagaagttgctcaatctaactaacgaaaatcgggaggggtcttccaagaggaaaggtgatttccaagtggtggatgaattctctaggaatggcaacttggggcttattggcgaatacggacatgttgaacaaaatatgataatagttaatgtctatagcccatgtaaggaaagggttgacgtaagggggtcttcaaatggagacacaagggacataaatggcttcaatgattttattgacgatatggagcttagagatattcctatagaggggaggcgattcacttggtaccagagcggtggatatgcataa

SEQ ID NO: 24396 - DNA, 345 bp, Glycine max
  Peptide Sequence Number=SeqID_141174
atggcgggattggtgaattgtaaagtcatggagattcctttttccttcttgagtataccaatgagggcaaatcctaagagggaagtaacttgccaaccaatgatttctaaagtgaaggcgaaactagcaacatggagaggcaaacacttgtcttttggagtgttgagggatcagtatggtgccgagatgttaggaatgtgtgtaaagaaggtggggaggagaactggttttgcaataatttacgttgaaagctacactatggaagagcaggctacagatgcttggtactggaaagatgggactagaaacacatatgtggttaaagaggtgtattcctctttctaa

SEQ ID NO: 24397 - DNA, 303 bp, Glycine max
  Peptide Sequence Number=SeqID_141175
atggagaagtatatggagggggatccagaggaattcgaagaggagggacacaatttgagactaaaagagaatattccaatgacaacagggaagatatcagaggtggataataatcgctggccaaattctttcattgtacacaaggaggcaaatattgggaaatcttcatcatttatggaggacgagaataaagccataataacaggagaggaattggaaaaagtttcagaatttgaaattcacatgggaaaaggaaaaactaatgtacaccaatatagagaattgtcaggcaacaatcgataa

SEQ ID NO: 24398 - DNA, 1632 bp, Glycine max
  Peptide Sequence Number=SeqID_141176
atggttgctgagaactacccttctcccacatacttcatcctcctgttcataaccataacacgtttgatctccacagtgggcaaaacctcccaatggacgaaggccctgtcgctgactccggaactcgcctccgtctccctcgacgacaccatcttctgcaagctccgtgacgacccagaggccctccaggggagggcctccagggactacgggaacctcgtccgcgaggttcccttggcagtcttccacccagcctcagcgagcgacatcgcgaggctgatcaagctgtcgtacaacggctctgtccccttcaagattgcggcgagggggcaagggcactcgacaaggggccaggcgatggcacgtgagggggtggtggtggacatggcggggttcagagagagagggaatggagtggggataagggttgtgagtagtgtggaccctaataataagaatggttactactattatgcggatgttggaggggaacagttgtggatcgatgtgctacacgccacgctcgagcatggacttgcacctatgtcctggactgattacttgtacttgacgctgggagggactctctccaatgctggcatcagtggccagacattccgctatggtcctcaaatcaccactgtccgggaaatggacgtaatcaccggaaagggagaatttgtgacttgctctcagcagacgaattcggagttgtttcacgcggttcttggaggcttaggacaatttggaattataacaagggcaagaattgctcttgcgccagctccgaagagggttaaatgggtgagacttttgtacaatgacttttctgcttttaccaaagaccaggaacaactaatatctgtcactggaaggaaacaaaatgtttcactggattatttggaaggattgctgctaatgcaccaaggacccataaataattggagatcttctttcttccctttagccgaccatgcccgaataatttcgctagtaactaaacacagcgtcctctattgcctagaagttgccaaatattatgatggccaaaatgaaaacaatgtggacaaggaactccaagttttactacaaggattgagctatatccctggattttactatgaaaaagatgtctcatattttgagttcttgaatagagtccgaagtggagagttgaagctacagtcacaaggactatgggatgttcctcacccgtggcttaatttgtttataccgaaatctcaaatcatggaatttgactcgggcgtgttcaagaatatcatccttaaacgaaacatcaccacaggacctgtcttggtttaccccatgaatagaaacaagtgggacaataggatgtcagcatcaatacccgacgaggatatcttctacacagttggatttttgcattcaagtgggtttgataattggaaggcctatgatgctcaaaataaagaaattctacaattttgtaacgttgctgggatcaaggttaagcaatatcttccccactatcgcacacaagaagattgggcaaaccattttggccctaaatggaggacttttgtagaaagaaaacaccagtttgatccaagaatgattctatcacctggacaaagaatctttaacaattaa

SEQ ID NO: 24399 - DNA, 803 bp, Glycine max
  Peptide Sequence Number=SeqID_141177
atgctgcccaaacgttgtatccaagaaggggacaatttctcgagctcccgtattcgtaaattgcatctgtgtcatatgcatttcttcatgcattcatccattccacccatgatagatgtcggagttttgattcgcactagattttatttcactttagtaaaacatgggatcaagtcaaaagccttcgctaaaaagaggttctatcaagtcaaggttaaaggcctagataccaccaacatcaaggaattagggcggttgatggaacctctccaaatgcaagccttctgcaagacttacggaaagatcttagagttgaccatagcagaggtatccatagaagccattgcatcactcacccaatactacgaccagcctttgagatgcttcacgttcggagacttccaattggtaccaaccattgaagaatttgaggaaattctaggatgtcctctcgggggaagaaaaccatacctttcctccgggtgtctcccctctttgagcagaattgcaactgtggtcaaggattcagcaagaggtttggaccgcataaaacagactcgaaacggcatagcgggcctaccacggaagtacctagaagacaaggcgaggggtatagccaatcaaggagattgggtctcatttatggatgtgttagctttgctaatttttggggtcgtcctctttccaaacgtggatggtttggtggacctagcagcaattgacgccttccttgcctaccaccatagcaaggaaagtccggtggtagctgtcttggcagatctatttgacacatttgaccgaag

SEQ ID NO: 24400 - DNA, 1851 bp, Glycine max
  Peptide Sequence Number=SeqID_141178
atggcttcttcttccaccttcactgcaatgtccgcctgcaagctctcctcctccgccgccatctcctccttcccctcccgccgccgctccaacgccgtcgttctgtcgaggcgcagccgcgccgccagggtctccgccatggccaaggagttgcacttcaacaaagacggcaccgcaattaagaagctccagagcggtgtgaacaagctcgcggatctggttggggtcacgcttggtcccaagggaagaaatgttgttctcgagagcaagtatggctcgccgaaaatcgttaacgacggtgtcactgtcgctaaagaggtaattattgtaaaaaccgacaaacttatcatccatggcgagtcttggttggatgactgtgtgaaactgtctttatgtcagagggttgagttggaggatcccgttgagaatattggtgccaagttggtgagacaagcggctgccaagacaaacgacttggctggtgatggaaccacgacctcggttgttcttgctcagggtcttatagcggaaggtgtcaaggttgttgcagctggggccaaccctgtgctcatcacacgtggcattgagaagacagcgaaagctcttgtatctgagcttaaacagatgtcaaaagaggttgaagatagtgagttggcagatgtggcagcagtcagtgcagggaacaattatgaagtaggaaatatgattgctgaagcattgagcagagttggtagaaagggtgtcgtgacccttgaggagggaaagagtgctgataacagtctgtatgttgttgaggggatgcaattcgaccgtggttatatttctccatacttcgttactgacagtgagaaaatggctgttgagtatgagaactgtaagctttatatgataaccaatgcacgggatcttatcaacatactggaggatgctattagaagtggacaccctatattgattattgctgaggatattgaacaagaggctttagcaactcttgtggtgaacaaacttagaggatcactgaagattgcagcactgaaggcccctgggtttggagagcgcaagagccagtaccttgatgatattgccatcttgactggaggtactgtaatcagagaagaggttggccttactttggacaaagctgggaaagaggttctcggatatgcctccaaggtggtgctcaccaaggatacaaccacaattgttggtgatggaagtacccaggaagcagtgaacaagagagttgcacaaattaggaacctaattgaggctgctgagcaagagtatgagaaagaaaagctgaatgagagaattgctaaattgtctggtggtgtggctgtgatacaggttggcgcacaaactgagacagagctcaaggaaaagaaattgagagttgaagacgctcttaatgctacaaaggcagctgtagaggaaggtattgttgttggtggtggttgcactcttctgagacttgcatcaaaggtggatgcaatcaaggatagccttgataatgatgaagaaaaagttggagctgatattgtgaaaagagctcttagttaccctttgaaattaattgccaagaatgctggtgtcaatggtagtgttgtcagtgagaaggtattgtccagtgacaatccaagatatggatataatgctgccactggtaaatatgaagatttgatgtctgctgggatcattgatccaacaaaggtggtcagatgttgcctggagcatgcagcctctgtagccaaaaccttcttaatgtcagattgcgtggttgttgagataaaggaacctgaggccatacctgctggaaaccccatggacaattcaggatatggactctag

SEQ ID NO: 24401 - DNA, 1038 bp, Glycine max
  Peptide Sequence Number=SeqID_141179
atggagttgaaacttcaggggcagaggcgcataaggtacatgatgcagtcgcaagaaatcgtgaccggaaaaggtgctggacacactgtcacgtgccggtgggcgaagctccaatttcgatgctgtgagcagcaccatgtagatcggtgtggggcgacccagatccagtgggtggtcgccgaaaaagtcaccggaaaatttcccaaaaaagtcgtcgatgttgcgtcagtttccagaaaatgtgccagaaacaaggaaaatcgtcaaagaaggagaaagaagatcgctggaaaatgtgcggcaagtataaaggtccaccggaagaagggcaaccagcaaaagggctcaccgaggacaataggtcgccagaaaagtgacggtggccagcagtggccagagaagtcaccggaaaagaagaaaagggtcgtcgaaaagcggaagcagtggcggttgcggcggcgtataagaagacggtggaggcaagatgttgtaacagttgcgagccagcaagatgcaatcgaggcggtggaagatctccgcgttggggtctctctcgatcgcgacgtcggagacagtcacctgcagcgttcccctgaagcggctgagcctgcctctcactctggccaccgcgccgagcttgacgagcgcggcgaagcgcgcagcgagttcgtggcggcggcggcgggcgacggagggagagttggcgtcgttgagccagagcacgcaggggacgcaggcggtgccgtcgtcgacggcgaagcggaggaagcgatcatgcttgagatcgggattcctctgcggaaaaacgacgtcgtggcgtccgaagaagggaaaggggattgggttagagagaggagatcgaaggctaagagtttcacgtgcgtgttgtgcagtgccactgcgttggtgttggtgttggtcgccttctgcatttctgaaaaatcgaggcagcagaagattgcaatttctgccggcgacggaggctgctgcggcgacactctgaggagtgggaaggtctctgcctgcgcttcagattag

SEQ ID NO: 24402 - DNA, 2604 bp, Glycine max
  Peptide Sequence Number=SeqID_141180
atggcttccactttgcttccctttctattcctctcaatggttctgttaccctttcaaaccatagcccaaaccaaaagcaacatagccattggtgagtctcacacagcaggagccagcacctccccatggctggtttcatcaccttctggtgactttgcctttgggttcctcccacttgaggacactcctgatcacttcatgctttgcatttggtatgccaagattcaagacaaaaccatagtatggtttgccaacagagaccagcctgcaccaaagggctcaaaagtggtgctcactgctgatgatgggttggtgctcatcacggccccaaatggtcacatgttatggaagactggtggactcactttgagagtttctagtggtgtcttaaatgacactggcaactttgtgcttcaggatggtcactccaagactgtttgggagagtttcaaggactatagagacaccttgctgccatatcagactatggaaaagggtcataagctttcttctaaacttgggaggaattacttcaacaagggaaggtttgtgctctttttccaaaatgatggtagccttgtgatgcactctataaacatgccatctgggtatgctaatgaaaactactatcaaagtggaacaattgagtccaacaccaacacatcaacaagtgctgggactcaattggtgtttgatgggacaggagacatgtatgttttgagaaaaaacaatgagaaatacaacttgtcaaaagggggtagtagagcttcttctaccactcaattttattaccttagagcaactcttgattttgatggggtgttcacactctatcaacatccaaagggttcttctggaagtggaggttggagccaagtgtggtctcatccagataatatctgtaaggattatgttgctagtgctggtagtggtgtttgtggatataatagcatttgcagtttaagagatgataagaggccaaattgtcggtgcccaaaatggtactcgctggttgaccctaatgatcccaatggtagctgcaaaccagattttgtacaagcatgtgcagtagataagcttagtaatagacaggatctctatgattttgaggtgttgatagatactgattggcctcaatcagattatgtgcttcaaagaccattcaatgaagaacaatgcagacaatcttgtatggaagattgtatgtgttctgttgcaattttcaggctaggtgatagctgctggaagaagaagttgccactttcaaatggtagagttgatgccacacttaatggtgcaaaggccttcatgaaagtgaggaaagacaactcctccttgattgttcctccaatcattgtgaacaagaataataagaacacttcgattttagttggctcagtgcttttgggtagttctgcttttctcaatctcatattggttggagcaatctgcttgagcacttcctatgtttttcggtacaagaagaagcttagaagtattggcagaagtgacaccattgtggaaaccaacttgcgtcgcttcacttatgaggaactcaaaaaagccaccaatgactttgacaaagtgctaggaaagggagcttttggtattgtgtatgaaggagtcatcaacatgtgttctgatactcgtgtagcggtaaaaaggttaaacacttttctcatggaagatgttcataaggaattcaagaatgaactgaatgccattggcctcacacaccataagaacttggtccgtttacttggattttgcgagactgaagaaaaaaggttgttggtttatgagtatatgagtaatggcactttagcaagtcttcttttcaatattgtggagaaaccaagttggaaactgaggctacaaattgcaattgggattgctagaggacttctatatttgcatgaagagtgcagcacacagatcattcattgtgacataaagcctcaaaacatactccttgatgattactataatgcaaggatttcggactttggattggccaagcttttgaacatgaaccaaagcagaaccaatactgccataagaggaacaaaagggtatgttgcacttgaatggttcaaaaacatgccgatcacagctaaagtggatgtctatagttatggggtgttgttgcttgagatagtttcatgtagaaaaagtgtagaattcgaggcagaagatgaagagaaagcaatcctagctgaatgggcttatgactgctacattgaaggaactcttcatgccctagttgagggtgacaaagaggcattggatgacatgaagaccttcgagaaattggtaatgattgccctttggtgtgtgcaagaggatcctagtcttagaccaactatgagaaatgtgacacagatgcttgaagtcactgagaaacacgctagaaaaggacagcgacagaataggcaaccgaaaagttcttcgccggaaaataagcggcaagttgaaggtggtggccagaaacacactgaaaaagacggctgcagaataggcagccaaagttctttgccggaaaatgaatggcaagcagaaggcagtactggcttaaatcctcataagaaccagcaaatgccatga

SEQ ID NO: 24403 - DNA, 553 bp, Glycine max
  Peptide Sequence Number=SeqID_141181
aggactatacgtcctccccttgagaggactacacgtcctcgccttcggagggctacacgcccttgcctttagaggactacacgccctcgccaatagaggactacacgtcctcacatccagaggacttcacgtcctcaccttcggagggttacacaccctcatcttcagaggactagacgtcctccccttgagaggactacgcgtcctcgccttcggagggctacacgccctcgcctttaaacgactacacgtcctcgccatcagaggactacacgtccttgccttcataggacttcacgtcttcaccttcagagggttacacaccctcatcttcagaggactatacgtcctccccttgagaggactacacgtcctcgcctttggagggctacacgccctcgccttcagaggactacatgtcccccttttcagaaggctacacgccctcgcctttagagggggacacgtcctcgccttcggagggctgcacactccctcgccttttgagggctacgcgtcctcgctttcagacggctccacatctgcaccttaa

SEQ ID NO: 24404 - DNA, 318 bp, Glycine max
  Peptide Sequence Number=SeqID_141182
atgggaggaaaatgcgcggagtcgccaccgacctttattcgaggaaaacgtcggaaaaaccggaaaaggtgtggtctacgaactttaagtgtgaaaggttcgggagttgtatttcgttatcatgggtcaatgagactttttcttgggaatggtgaacaagtcaccgacgcacaggattttggttggcaatcaaagggagaggaccaccttaggtcgtgggcaaggtttatggtgagttgggactttggctcaaggcttgtagaatggatggacatgatatatgttagggtgttggtctggccagtggttcagggataa

SEQ ID NO: 24405 - DNA, 431 bp, Glycine max
  Peptide Sequence Number=SeqID_141183
atggccacaatggtggaggccacgatgagcatgaagaagataatggaagccaatgcggttacagttgccgctaccagcactgttgctaagacacatgaaattccccaccacaatctaaccgacttcaagccttgcctcggatatgccactgaagggaaagcagttgttggtatacccttgcaaaacactttggacggccctcggtatcacccgcaaccacattggaagaattgttccttgtgcccaaacgtggtcattcccaagttcaaggtgctggactttgacaagtacaaggggactacttgccccaagaaccatctaaagatgtattgtcggaagtatcagtacaattctgatatgactcctgataggatgcaactacagaacatgtgcaaaaaggggcatgaatccttcaaggaatatgcccaacg

SEQ ID NO: 24406 - DNA, 201 bp, Glycine max
  Peptide Sequence Number=SeqID_141184
atggttgcgcaaaaacacctccttttggtttccgccacattacggaatttcacggatcgcagtgttgatatcgtagcaacgaggcgggtcgttacagggtggtttgtaggtggtggaatatcagtgtgcgtaggtggtggcagaagtgtttgggaaaaggttgtttgtgatgaagggttaaggcaaagtgttttggattag

SEQ ID NO: 24407 - DNA, 336 bp, Glycine max
  Peptide Sequence Number=SeqID_141185
atggagagggagatgataacaatgatagtagacatgttatcggtgttctactatgagaagatggtgggttacacgccttcaagctttgtcggtttagttttcaccggcaaaaggatcgaagtgggtctgagaagaggcaactttaattatcctgctttgacgaataagaagcctggggcaaatagagagaatgagaaggaggaaggaacccatgctttgactttcgtttctacatggccaaatttcccaccaactcaacaatatcaatactcagccaatattagcccttctcattacctaccaccctatcaaccaagaacactcaatcatccataa

SEQ ID NO: 24408 - DNA, 192 bp, Glycine max
  Peptide Sequence Number=SeqID_141186
atggagtacatcaagcttgaagaagctgggattcaatggattgagaagagcaaagaagatcaaacagaacaagaagaagctacagagaagcccgagtccttttgggtagatgatgctagcaaagatggacaagctcatgagaaaaggttggatgctatggagcaccacatgtggatgatatatgatccttag

SEQ ID NO: 24409 - DNA, 510 bp, Glycine max
  Peptide Sequence Number=SeqID_141187
atggcagagaagaaaaagaggataaagagcattgggcacagacccacaacccccataacaaagaaggagaaggaaccaacaaaagaacactatgagtcttcgtacaagtttagttatgcaaagaaggagatgattcaaccaaagtatgtcaatttggcgtggcttagaagtgaaggctttgcttttcctgagttaattgagtatcgtgtgttgaagaagctagtggagatgaagagcacctactacactgacctggtgtggtcaaacaccattgggcaatcctcagaaggcattatggcaaatcagttgggtctcaaggaagttggattttcttttaacaaggttaagaagtacaagtctatgatgaagaatccttctgtctatgatgttattgttacaaaagcaaagggaaacaaatgttttggtactggaccactcatgcctgagcacaagcttttggcctatgtggtttctttgattattactccaagggggaacaatgatgcttag

SEQ ID NO: 24410 - DNA, 1770 bp, Glycine max
  Peptide Sequence Number=SeqID_141188
atggaaccacagaaaagtccattaatggatgaaagcctatgtgatgtttcccatgatactgagtttggggacacacactttggtggaggggatcttttttccattttggagagcctagaagacttgaaagattttccttccaccaacaatgaagctgctgttattggcccaactttcaaagaaaatgagcaaaactcaaaaaaggtctcaatatcttcacgtgccccacaagattctgaaactgagcctgaaatctcaccaaaaagcaagagacaaaagcttagtcccacattggttgaggaaccacagaaggtgtctcacataaccgtggagcgcaacagaagaaaggaaatgaatgaaaacttatcgatcttgaggtcacttatgcctttcttttatgtcaagcggggagaccaagcatcaataattggaggtgtgattgattacatcaacgagttgcagcagcttctacagtgcctagaggccaagaaacaaagaaaagtttacaatgaagtcctaagcccaaggctagtttcaagcctgaggccttcatcactaagtcctggaaaaccacccttgagccctagaataaaccttcccattagtccaaggaatccacaaccaggtagcccttacaagctcagattgcagccaggttacctttcccccaccatagccaactctcctacttcttcagcttcttcttccatcaacgataatatcaatgagctttttgccaattcaaagtccattatagctgatgttgaggtcaagttttcaagtccacatgtgcttctgaagactgtgtcactaccgattcgaggccaggccatgagaataatatcagctcttgaagacctagcacttgaaatcctccatgtgaacattagcactgctgatgaaaccatgctaaactcagtcactattaagatacctctttatgatgatgatgatgtaagaagtcctaaagaatcctctcctacaagtgaaaaggtagtgaacaataacccttttgaagaacacccactacaacaaaatagtcttcataaggagtggaaagcacttaatgacctttctattgacaacatcatagaaccttcaactattgaagaggtgcttgttgatgaacattggcttatggctatgcatgatgaactaaatcagtttaaaagaaatgaagttttggaactagtacccaggcctacaaagctactagccaaaggttataaacaacaagagggtatagactttggtgaaacctatgctctgatagctagattagaagctctgagattgttgcttgcatttgcttgtattatggagtttaaattgtaccaaatgtatgtgaagagtgtttttctaaatggatacattgaagaggaagtctatgtttctcagccttctagtttggatcataaaaatcctactcatgtgtataagcctgagaaagctctctatggacttaaacaagcacccacaatgggagagtttgaaatgccaatgatgggagagttgaactatttccttggtctacaagattgcaaggaacttctcaagaagcttgatatggataaaagcaaggaggctgcaactcctatggccacaaattgctaccttggtgtgaataaaaaaaggaaactcattgaccaaacaaagtatagacgtaccattggttctttaatctacttgaatgctaataggtctgacattatgtttagtgtttacatgtgtgcttgctatcaatcatgtcctaaagggtcacatttctga

SEQ ID NO: 24411 - DNA, 342 bp, Glycine max
  Peptide Sequence Number=SeqID_141189
atggtgcgtggttcacactcgacgcgttctatggaatttcgactggcccagggcaccgttactcttttttcgaatttcactcctcaaagagggattggtggtggtgttgttttttgcgcgtgtttttttttcttcaatggtgcagaggaatgtgtgacggattctgtggagagtctgggtttcagaggtgtggatgagagttttggagatacaactcactggttcgtttttcattcccaaaccccacctcatgcacaaatcaacactccttcttgttggacgccaatccaagttgagaggaggattgagttcaatgagcattggaaagtaggatttgactaa

SEQ ID NO: 24412 - DNA, 327 bp, Glycine max
  Peptide Sequence Number=SeqID_141190
atgggaagttatgacgacaactcgggcaattcgcctatccccggcggaagtctggcgaagccggttctgattgcgctcggcgccctgctgatcggcaagatgctgaagggccatagcgacgatacggcggatgctccagcgcaacctgtgccggaccagtcgcaggcaggcggcggcttgctcggtggtatccttggcgggcttggtggcctgctcggcggcgcggccgcaggaaatgcttccgcggctcccacggcgccggggcctctgggtggcggacttggcggtcttctcgatcaactgaaacaggctggccttggcgacaag

SEQ ID NO: 24413 - DNA, 588 bp, Glycine max
  Peptide Sequence Number=SeqID_141191
atgtctgttataagctggataatactaggcttgattgccggcttcatcggcagcaagatcgtcaataaaagcggccagggcctgtttctggatattgctctcggcattgtcggcgccatcgtcggcggtgtgatctcgtctcagctttttggacgtggcgtcaccggcgcattcgatccgatcagcctcgtcattgcgataatcggctcgataatcgtgttgtgggtgtaccacgcaattaccggcaagcgttccatcgcaagctcattgcttgccctgcacggaactctcaacatcgaaaccgtgctgattgcggtatttgtcggcgctgtgcttggcgactgcacgggatacctgatcggccgctttggcggccgacgactgatcctcagatacggacacctcgtcaaactcacgccggaacggctggatcagttcgagaaacttttcgaaagcaagggaatctatgtggtggcgaccgcgcgtttcgttgtgcttctgcggcagctcaatggcatcgttgcaggttccatgaaaatggacccgctgcattttctggcggcgaatattattggtgctgctggatga

SEQ ID NO: 24414 - DNA, 1428 bp, Glycine max
  Peptide Sequence Number=SeqID_141192
atgacgcggcgcttgagactagtccggcgagattccggtgaccggatggcggcacgtgggcttcacgcgccagaatgggcgcgagctggtggcggcacgtggctaggttgctggccacgtgatctgcagggttgtgtcatgcttctcaaggcacacccaaccccgaactcgccggatccccaaccggaatataagctctttggcactattgtgcattcaggctactcccccgaatctggtcactactatgcttatataaaggatgcaatgggtcggtggtattgctgtgatgattcttgtgtaactgttgcaacccttcaggaagttttgtcagaaaaggtttacattctttttttctcgcgaactaaccaaaggccagtgtcaagtagtaattctcttgcttcaaatggtgtaaagcctcattccaatgggagccaaacatctgaatgcccaaaggttggtgtaccaccaaaagcagtgcatgcaaaatcgaattctgagctatcttcttggaaggatataccaagagtttctaagactgctaaagcaccttccagctcacgagtgaagtttgacattaatggaagctcttcttctaaaagaaattctgctcctgtgagtgtgaatgggaaagttgatgtttgtaggaatcagccttcagcagtaaatgggcatgtgaaagattcagcttctttggagaatggtaaggaagattcttcattacccaccaggaatggcattgacgaaaataaagtttctgttgacaaattgaaaagaaaggagtcaacagtttcaaatggacacactggtaatcagacagttgatattcattctgtaaagtcagatctcaaggaagatactgacagaagcaggataatagcaggtagagtgcctgacaattttaagcaagaaagcaatggcctcaacaacaaacctacaatattggggaataagagaaaactacagggggacccatgcattttacttgcacatgatggtcagtctcaagcaagagttcaagaactgaaggacattcttgggaaagaggcaaagtcagttttgaggtcaattggctggactgataaggtctacgaatttatgcgttcaaagaagttacgtgcacaagaagctggaaatttgacaaatggagatgaaataagtgtgatgctagaggaaacgtggcttagaataatgctgttggcaacttggcatgtctggttaagtgattgtgaagattggaattttttagcatttgttgggacaaaagggagggcgagccttggcacaatgggtaagattgcgtacaatgatcttccctcgtaccttcgcatagcaaggagcccttgggcactggggtgcaaggatgaagaggagtcaatgcagataggaacagttaaggcagctagttaccggaggatcattagataa

SEQ ID NO: 24415 - DNA, 339 bp, Glycine max
  Peptide Sequence Number=SeqID_141193
atgaagaagaaaggaaaaagcttaaagaagccatgggaacccaagggaagctctccagctagcactccaagccaagagaagatccttcgtgacgacttctcgacacacgacatggtccagacccttcgtgacgacttctcctctgccgcctggcgggtgcagttctacgtgtccccatgcccacaagagatcgacactgtgggagcaaagacggtatttcttgaagaagaggatcatcggcgtgagagaagggtcgcgagttccagaatgagatttcgaaaaccttcacgtgaaagagagaggatgaagattataaaggaaatacataaacctttttga

SEQ ID NO: 24416 - DNA, 861 bp, Glycine max
  Peptide Sequence Number=SeqID_141194
atggctgctttccaaagcatcaacaacattgaaactcaacaaattccaccagagctcctcatatctcaaatcatgcaactccatgcaagcatctccaagcttgaatccctaaggccatgcaagcaagtcaatagtcacttcacccacctagtgaagctttgcaccctcccttcaaccattgacatcgaagccttgcccaaagaggtgcaagacatgcgtgatagcctcattaacctaagtggccacgccgaggggctcctagagctcgaattctcgaccttcataagcctcacacctgagccaatgaaaaatgtaaccctattcccttattacgggaactatgtcaagctagccaacatggagagcaaaatcctcaaagaaaacggggttttgagccctaagaaagtggcctttgtagggtcagggccaatgccactcacctccatcgtcatggccactcaccacatggaatccacacactttgacaactttgacatcgacgaaaaggcgaacgaggtggcacgaaagatcgtggcttcggactcggccctcgagaagaggatgaagtttgagacacaggatgtgatggaagtgagggagagattagggcaatatgattgcatctttctggctgcgcttgtgggaatgagtagggaagcaaaagtgaagattttgggacatataaggaagtatatgaaggagggagggactttgcttgtgagaagtgcaaaaggggctagggctttcttgtaccctattgttgaggaacgtgacatggtgaattttgaggttcttaccatctttcaccccacaaatgatgtgatcaactcagttgttcttcttcgcaagcctaaagcttaa

SEQ ID NO: 24417 - DNA, 834 bp, Glycine max
  Peptide Sequence Number=SeqID_141195
atggccctgcagatgacttggcagccgagtctcctgagtcagaaacgcaaaaccggaaccggtcctcccttagggctccgtaacctaggcaactcgtgctacctcaacagcgtcctccagtgcctcacctacactcctcctctcgccaatttctgcctccgtctccaacactcttctctctgtgattcttctgggtcttcgtgtccgttctgcatactggagaagcagattgcacggtcgctgcgattggatctcacgcacgacgcgccgtccaagatccagagctgcatccggatcttcgccgagaacttccgctgcggccgccaggaggacgcgcacgagttcctccgctacgtcatcgacgcctgccacaacacctgcctccgcctcaagaagctccgccgcaaaggcgcagaggccaatggcggcggcgacgaagctggtggcagtacagtggtgaaggagattttcggtggcgccttgcagagccaggtgaagtgtctgtgctgtggatatgagtcgaataaggttgatgagataatggatattagtcttgatgttttccatagtaactcgcttaaagactccatgcaaaagttctttcagcctgaggttttagatggcaacaataagtacaagtgtgatagttgtaagaaattagtggccgctaagaagcagatgtccatacttcaagcacctaacatccttgtgatacagctaaagagatttgagggcatattgggtggcaagattgacaaggctgttgcatttgaagaggttttggtgctttctagcttcatgtgcaaagcaagccagatggaaatatcacgatag

SEQ ID NO: 24418 - DNA, 1011 bp, Glycine max
  Peptide Sequence Number=SeqID_141196
atggcggatctgaagaaccgtaatttcctcacctacgcgtacattcttctctacattactctctccagcggccaaatcttcttcaacaagtgggttttgtcttctaaggaaattaacttcccttatcctttggggttgactctacttcacatggtcttctcctctgttctgtgttttgtgttaaccaagattctgaaggttatgaaggttgaggagggaatgactcctgaaatatacgctacttcggtagtgccaattggggccatgtttgcaatgactctttggctgggaaatactgcctacctgtatatttctgttgcttttgcacaaatgctgaaggcaattatgcctgtagctgtttttgtgcttggagtagctgcaggacttgaggtaatgagctacaaaatgctattaatcatgtcagtgattagttttggtgttctagtagcttcttatggagagataaatataaactggattggagtagtttaccaaatgggaggtgttgttggtgaagctctgagacttatcttcatggagatttttgttaagaggaaaggtcttaagttgaaccctttatccgtgattgcaatttgtttgttccttccatggatatttctggagaaaccgaagatggatgaacatggaccatggaacttcccacctgttttgcttatcctcaactgcctttgtacttttgctctaaacttatcagttttccttgtgattacacatacaagtgctttaaccattcgtgttgccggagttgtcaaggattgggtggttgtcttactgtctgctgttctgtttgctgatacaaaggtgagggtggagagtgatgcacaatcttctactttttgtttaccattgcctgttggtccaagagccattgctggggtagcagcatataataattgcaagttgaaaaaagaaacctctcgtgacacctcggatgattccgaccctgaatcttcccaaatgcaagagtctcagcctttaacgagtagatag

SEQ ID NO: 24419 - DNA, 834 bp, Glycine max
  Peptide Sequence Number=SeqID_141197
atggagcccttcatgtctcaccaaaaaggtggaactgcagtgcttcttcttgttgcttccgtttcagggaatgcagatgcaggtggaaacgaattgtcagaagctgctccaccaattctaaggcaattgcgacaggagaccgcctctatgcgtggaagtcagatgcagcagtctcacttgccgtctctcttgtctgtcatgctccacatcgttatcccacttgcttatcaagaagtgtcccctgatcaggcacagctgctcgcaatgcttgtgcagattcttggagcagaacggtgtattgaagttggtgtttatactggatactcttcactagccatagcattagttctgccagaatcaggtcatttagttgcctgtgaaagagatgccaaatctcttgatgttgccaagaagtattatcagctagctggtgtttcacataaggtggatgtaaaacttggacttgcaatggattccctagaatctttaattctgaatggtgaagcaggaagctatgattttgcgtttattgatgctgagaaaaaaatgaacgagaaatattttgaactgctactacagctggtgagggttggaggtcttattgtaattgataatgtcctttggcatggaaaagtctctgacccgctggtaaatgaccctaaaactatcagcattagaaattttaatgaaaagttaatggaagacaagcgtgtaagcatcagtatgatgaattctgtcaagttgatttataatcttttaactcttttggagagtccaggtacctattggagatgggatgacaatctgtcgaaaaagatgaccatttttgaataa

SEQ ID NO: 24420 - DNA, 216 bp, Glycine max
  Peptide Sequence Number=SeqID_141198
atgggtgaaatgtccaagttgagaagtgcaaggctcaccatggaggttgctccaccaagatatgtgtcggttacccggtgccgggtgaagaaaatgctggacaccattaaggaggaagagaatgattttgctgctgacaaacgtttctcttcaccatcttgtggctcttcctctctaagccttatagagaggccagttttcttgaagaacttctag

SEQ ID NO: 24421 - DNA, 645 bp, Glycine max
  Peptide Sequence Number=SeqID_141199
atgaaggattccatacccatctcctttcgtaatatcctttacaaattcatttccaaaactcttgcaaatctcttaaaaccttttcttgagaaatgcgtttccaaggagcaatctaattttgttgaagggcattccatcctagataatgcccttattgctttagagattattcaccacatgagatccaagactaaagcttccttagaagaccaactccagaaaatgatgagttcatttcagtggggtaataaaagtgactcatccagaggaatcaattggctcaactgggagaaattaactatgaagaaagattttggcttaggtttccaccatctccatggatttaatcttgcaatgctagggaagcaagcatggaaatttaccccaaacgaagatgctataattactaaggtattgatcaagaatggtttgaaatggagagtaggaaatggtcacttgataaacgtgtggaatcaaccttggctcaaacatggcagcaattctcatgtcacgaccccaacaccaagtgggcttgagaatcatacagttgcctcacttattcatcatgagaattcatcttggcgtagcattcaaagcaaaatattttctcaatggaagatttttggatacccctttaaggaataa

SEQ ID NO: 24422 - DNA, 132 bp, Glycine max
  Peptide Sequence Number=SeqID_141200
atgatgctgaatgtttctaacagcattacgcatgagaaagttgcgttaaatcttaccattggtgctgctattgttgcaactaggtgtggtgttacttcaagacatcaagtaatggataacgttagtgaatga

SEQ ID NO: 24423 - DNA, 238 bp, Glycine max
  Peptide Sequence Number=SeqID_141201
atggggcgtactgcgtgtggacaccaaagtccgttgggagggaagaaaagaagagcaactcgacggtggaagcttcgcgttcggaatttggctctgaggagccacagtcacggaaatgatagtaataataataataataaacaacaacagcagcaacagaaagaactcaaagaagtggtgtttcagattccgaagaacaaagtggcagcgaagcctctgaacggaacaagagcaattg

SEQ ID NO: 24424 - DNA, 1083 bp, Glycine max
  Peptide Sequence Number=SeqID_141202
atgggaaatgaggtgattctgttgaatttctggttaagcccttatgggatgagagtccgcatcgcactagaggtgaagggcatcaagtatgagaatagagaagagaaccttagcaacaagagccctttactcctccaaatgaatccagttcataagaaaataccagttctcatccacaacggcagatccatctgtgagtcactcattgctgttgagtatatcgatgagttttggacaactgaaggggaagagaaagaagctgcaaaggaagaatttttggagtgtctgaagttattcgaagaacaacttggggacaagccttattttggtggagacaaccttggtcttctggatgttgcactagttccattgatctgttatttttatacctataatttatatggcaatttcatcaacgaggacaagtaccccaaattcattgcttgggctaagaggtgtactcaaaaagagagtgtgtcaaaatgttttcccgaggagcatagggtcaaggagtttatttcgaagaagaaaaagaatttgaacaggttcggtatttttgggatgacagctaagatagctttggcagagaaagtaatcaaatataagtacatggaacaagatctcaccaacaagagccccttgcttcaggaaatgaacccagttcacaaaaagattccagttctcatacatcatggaagaccaatctgtgagtctctcataattgttgagtatattgatatagtttggcacaataattgtcctttgcttccctctgctctctaccataaagctcaagccaggttctgggctgattttgtagatcagaaggtgtatcatgcttctaggaaaatatggatttctaggggatatgagcaagaggagtttcatggagacaagccttattttgggggtgacacatttagatttgttgatgtagctctcattcctttctattgctggttttatacttatgagacctttggaaacttcaaagtggagggaaagtgcccaaaacttatctcctgggccaagagatgcatgcagaaggaaagtgtatcagaaactcttgcagatgagagggag

SEQ ID NO: 24425 - DNA, 369 bp, Glycine max
  Peptide Sequence Number=SeqID_141203
atggaaaaattagattggaaagctagtagcactcgggccaagtccattggcacattggtaacaatcgctgggaccttgataatgtctctgtacaaaggccaggcagtcataaataataatccaccttttaaattgtttcctcaaaaacttgtctcatcgatgcaatttgactgggcatttggagcactgttgcttgcagctcatagttgttttctcacaataagctacatacttgcgatacggatagtgagagaataccctgcagagttggtgggggtactaattcgcattacattaatctctatactatctgttcctgttgcactggtttccgtaaaggatctaaaagcttttgagactgggatttaa

SEQ ID NO: 24426 - DNA, 252 bp, Glycine max
  Peptide Sequence Number=SeqID_141204
aaaacggttacagcttgggttgtgtgggtgtgggtgtttgacgcagtgcttgtggttggtggccgcgtgagtgagtgggttactgtgtttgcgtgggtttctgttctaacgtttcgatttctagggaaggaaatgaatagtatgggcaagatgattttgggggggagggtggcggttgagtggtggctaggccgatggtggtggttcgcggagggggagagcggcggttccgagtggtggctagtggtgtag

SEQ ID NO: 24427 - DNA, 996 bp, Glycine max
  Peptide Sequence Number=SeqID_141205
atgaaggaactgggcttggtttcaatgatgctgatggcagagttgttggacgtgatcgtcaacactctaagcaaagcagccatgaagaagggcatgaatgactttgtattcatcatgaaaagaacacttccgccactctcctgtaacacccttggcctattccttgttgttggcatgctcagttgcattaatcagtcgatcaagtttttcggcataggttacagctctccaactttggcctcagcactgtccgatttggtgcccgcctttaccttcatacttgccgtcatcttcaggatggaaaaattagattggaaagctaatagcactctggccaagtccattggcacagtggtatcgatcgctggggcattgttattgtctttgtacaaaggccaagtcatcataaataataatccaccttttaaattgttccctcaaaaacttgtctcatccatgcaatttgactgggtatttggggcactgttgcttgcagctcatagctgttttctctcaataaactacattcttctgacacggatagtgagagaataccctgcagaactggtggtggtactcagtcgcattgcattaacatctatactatctgttcctgctgcactgatttcagtaaaggatctaaaagctttgagactggggtttaatatggagcttatagctattggatgttcagcaatttttgtcttatcctttcgaggtgttatccatatatggatcatggggaagaggggccctgtctatgttgcaatgtttaagccactcgaaattgtcttcgcagtcatcttgggggttacttttcttggggactctctttatattggaagtgtgatcggagctgccataatagttgttggtttttatgctgttatttgggggaaaagtcaagagaaggtggaggaagattgtacagtctgcagctctgagtcatatgataatgaggtccctcttttacagaacaagagaacgggggaataa

SEQ ID NO: 24428 - DNA, 544 bp, Glycine max
  Peptide Sequence Number=SeqID_141206
atggctttaccagaggtagttcgttccgacattctctttgtcttcattatcacacgacaagctgtttctgtttgtgttctgattcacactgatcatatgcaggttgggttgagactgctcctttcacccgttacttccaaccttcttctccgcacagcatgctgttcaatagggcttgcgcttcccgtgtattccacgtttaaagctattgagaacaatgacccatatgagcaacaaaggtgcctattgtattgggcagcttatggttcttttagtgctgcagaaatgtttgctgaaaaattattttcctggattccactctatcatcacatgaagtttgcatttcttgtttggctacagctgcccactcttgatggtgcaagacaaatgtattctagtcacttgcagccattcctgttgaagcatcaagctagaatggatctgattgttgaatttgtgtatggtgcaatgagtaaaattattagtgcatacaaaccagaattggagcttgcaagaactcttgcagtgaagtttttaatgacag

SEQ ID NO: 24429 - DNA, 1230 bp, Glycine max
  Peptide Sequence Number=SeqID_141207
atgaccttttttcctggattagttgatcctgaagataaaactgcccaagtctggttgatttctctacgtagggataaagcactatcctggtttatatctaagaccgtaattctgtttaaaaattcagctggatgtgaatcctcggatcgggtcaacatgttgaaatcggagtttgtggcggtatcagagaaaaatgctgagctgaaaaaacaggtgagagaattgactgaaaggcttcagcttgcggagcaagggaaagaccaggctcaaaagcagttccttacattaggaaaacagcctaaagctggaccttttggtactgtaaagggattaagaaccaaccctactgttgttcctgatcaatctgtgaatccaagattggcaaagatattagagaaagttgcagttaaacaagagcttatagtttgtcttgcaaacaccaatgtgaaggagatgctggaggtctggttcaccaatatcaagagagttggcataaccaattatctagttgctgctttagacgatgagactgcaaagttttgtgaatcaaatcaagtcccagtgtataaaagagatccagatgatggtgttgataccattggaagaacagggagcaaccatgctgtctctggtcttaaatttcgtattctaagagaatttttgcagttgggatatagcgttcttctatcagatgttgacattgtatatttgcagaatccttttgatcatctataccgtgattcagacgtggagtccatgagtgatggtcatgataacatgacagcttatggctataatgatgtgtttgatgagcctacaatgggttgggctcgatatgctcatactatgaggatatgggtttacaactctggtttcttctatatcagaccaacaatcccttcaattgagcttttggatcgtgtggcaacacgactttcaaaggagcaagcatgggaccaggctgttttcaacgaggaactgttttacccctcacatcctggttatgatgggcttcatgctgccagaagaactatggataggtatcaattcatgaacagcaaggtcctgttcaagacagtgaggaacgatgctagcctcagcaaattgaagccagtaattattcacgtgaattaccaccctgataagcttccccgaatgaaagcaattgtcgaatactacgttaatgggaagcaagaggctctcaaacctttccctgatggctcagattag

SEQ ID NO: 24430 - DNA, 381 bp, Glycine max
  Peptide Sequence Number=SeqID_141208
agacagcaattaaagtgtttcaaagtatcactaggtgctgagaatggtgataacaaaattgaaactcttggtgtttgccatttagacacatctgattggaacccgaatcatattatatttactaggcttggaattaaacctgggaaggctccagtcaatcttagcagtgatgactatgtaccctttgtggagctctctttctatgtatgtcttgcatgtgccttgttttatccacaattttttcaagatagctgctactatataagtactaacttagcatctgatttgttgctggtggtggtcaaggctcaaacaacagttgaagattcacattacaagtctgagaggctatttttacatgtagaaatctctgaagtctaa

SEQ ID NO: 24431 - DNA, 1671 bp, Glycine max
  Peptide Sequence Number=SeqID_141209
atgaaggtagaactgcgagatgagaaacaagatgaatggtacaaagccacatcagtgtctaatgacgagtcatatggccaagggtacataaccacttcagaatccgctgaacctaattacctagcttcatatactgctactaagcgcaaccataaccatgaaaagttccatcaaccttacatagctgggtacacaacaagcaatgctgcaaacaaagccaatcaacacatagcagggtatagaaccaaaacctatgattccaatacaccatacatagctggttacagaacaactagtgcttcccataaagcccaagaatccaatacaccttacattgcagggtataggaccaacacttatgattctaatgcaccttacatagctgggtacacaactagtgcacatatggctaacaatcaaccaaattacattgcagggtatagaactaggacaacccgtgattccaatacaccttacattgcagggtataggactagaaccacacatgattccaatacaccttacattgcagggtataggactagaaccacccatgatcccaatgcaccttacattgcagggtataggactagaaccacccatgatcccaatgcaccttacatagctgggtacacaacaactactgccaagaaagctccaaaagagccattccatgatgataccactgaaccttatatagcccaatatggagaaaccaaacccaaaaaggacctaaaagagtcatcccatgatgataccactaaaccttacataacccaatatggtggaaccggtaccaaaaatgacccaaaagaatcttccaatattgtggaccacacagaggctttcaagacaggatttttcgccttagatgatcttcatgttgggaatgtgatgactctccaatttcccatccaagaggtttctcacttcctaccaaaaaaagaggctgagtccattcctttctcaatctcacaactccccagtgttcttcaactcttctcaatctctgaagattctccccaagccaatgccatgagagacacacttgaccaatgtgaagcagaacccatcacaggggagaccaagatttgtgctacctctttagagtccatgcttgaatttgttggcaaaatcattggtttagagaccaagcataatattatcacaaccacacttcccacggcctcaggtgtccctctacaaaagttcaccattttggaagtatcagaagatatcaatgcttctaaatgggtagcttgccatcccttaccatacccttatgccatttactattgccacttcatagcaacagggagcaaggtgttcaaggtctcactaggtagtgagaataatggagatgacgacaaaattgaagctcttggcatttgtcatttggacacatctgattggagcccaaatcacatcatatttaggcaacttggaatcaagcctgggaaggattcagtgtgtcactttttcactataaaacatcttatgtgggttccccagcctttacaggccaccatttatggtgcaattgaaggcaagaagggatatccaccaataacaccaacagtgatgactcctggaggacctcttgatctctcatctgttttcttctggaatcatataatcaagggtcgcactgaggatgtcagacgccaatag

SEQ ID NO: 24432 - DNA, 528 bp, Glycine max
  Peptide Sequence Number=SeqID_141210
atggcattgagactgagactcaaagtgtcttcaattgggtcaccttttctgcagttaggttcttctgcaactgctgccttctcattctcccaaccatgctctcttcccaaacttgcttttcatccaccacgcttgcaactcaacaaaaattcacacccaataaggttccttgttcgggctggtagaactgagtccaaaggtgttaccttgggcttcagggccccacaatttcagcttccagagcctcttactgggaaggtttggacattggaagattttgaagcatatcctgctctattggttatgtttatatgtaaccactgtccattcgttaagcacctgaaaaaagacattgtaaagcttacaaaattctatgtggagaaaggacttgcggtgattgccatatcttcaaattccgtagccacacacccccaggatggtccagaattcatggcagaagatgctaaactgtttgactatccttttccatacctatatgatgagatgcctatgcagctctatgcctaa

SEQ ID NO: 24433 - DNA, 471 bp, Glycine max
  Peptide Sequence Number=SeqID_141211
atgagggaagatagatccaaaactagcagaatcagcaagatcaaacacaattcaaaaaacaaaacaagagaaacagttggtcagaacattgggaattcccagtcaacgataatcacagaagtgatgaagattgtgatgagacccaaaagccgaaacagtaagaaaaaacagaaaggtggagtctttgacgaaaataaaacctgggtcttggatccagcgagaggaatatggcgattaggggcaacagagtcggaaacgaagaagccattggggaacaagaaagcgaagccgcatccaataaggacaccaattgcaactgaggttaggacccgtgatttgcgaagagagggaaacagtaatgaaacgatcaaggttgttgttgtgagaaaaagcattcattcccctttgaactttgagagtgatgctgattgcgtaacaagtttctcagattcttctttcaccctcacctaa

SEQ ID NO: 24434 - DNA, 348 bp, Glycine max
  Peptide Sequence Number=SeqID_141212
atggttagctctgccagggtttatgaaaaagccgacactatctcaacacctaaagaggaggatctcctccataggagtacgaaaaagattgaggaacttctaaaggctatgttgaaggatcttccatatcttttgtggataagttattggaacctgtcggagaaggagaaaagccaatggagttggaagaaaacgctgcacgctaagcgaggaataagtgaccacgcgctattcgtgcaccatgtgctaagcgcgcatgcacgtgccatctggcttcccaagtggcttctcgcgttgagcgagggtggcgcactaagcgagtgtgaagcgctaagtgagactctctag

SEQ ID NO: 24435 - DNA, 729 bp, Glycine max
  Peptide Sequence Number=SeqID_141213
atggatcttaaaaaaacaaggtgttacaagaatcttaaggagaggcttactagaataaagtatgagaaaactgttgttatttcaggaaatgagggagaggcgaggtccaaatttgatgctatgtcaattaatgagattccacctataaataataagattgcgactgttaataattcaaaaagtggagccattgctgcaggaactattggaggttcatcgtcaaaggtagcaggagagcctaaatcacgaaataatgtagtttatactaaacagaaaaagggtgcacttatccaaaacttgactgctcggatggtgaaggcgaatattagcaaagatgacaaggagaaaacaggtgttgatatagtggcgagtgcgaagctgaagatctcaaaaaatgaagtgcatgaagtctcgaagaagaatgaaagcttgcttctgcttaacatgaacatccctacgttagaaaacaaggggtatgaagaacattttgttcacgtgcatgtggaccaggaggtcgtggaatttgtagcacgtagacgtcagtttgaagaggattcaaaattatccatggctaagtttcacatggacattagtagtacggtcttgatggagaatgaagattcaaatggagaaagtgacagtcagtcgccaaatcaacccttaattccttatgaatattataacttggaaattgtcgtggcacaattgcgagtggatttggtgttttga

SEQ ID NO: 24436 - DNA, 657 bp, Glycine max
  Peptide Sequence Number=SeqID_141214
atgggtgactcagacaaatgtgggttgtatgtctatgacaatcctccccaactggttgttcttggaagattttataaggggtcaacgaccatccacaacgttcctctgagcaataatcaattgaaggtcgatgttgaggaagttcgagatgctaatgcttgcaattttgtacccactaaagaggtgtcgtgggatgctaccatgtttggggtgcataatgataactttccattgtatataaagcaggaacatctttctgaaatagcacatgatggtcaatgtctgagcatctctgttatacaattgtggattttgcatatgactgaaacaagtatgcgagcagggaatatcgatgtgtatggattcctcgagccatactccatacaaaaatttgggcaatcgcaatttgaatcagaagattatattaagaaatggatgcagaattcactgagagatgtgtacctaggagcctacttgaatggtgctttgaagggattcaacaacagtcatggaagtaaatccaagggtgttgctagatggattttagttaaatattttactgatcaaagaccattggaatcagagagaatgaaggcaatttgcattcagtgggcaagatattatctaaaagttaaaaatcaaacactaggagtttaa

SEQ ID NO: 24437 - DNA, 554 bp, Glycine max
  Peptide Sequence Number=SeqID_141215
catctattattgaaaggtacattgcgaaagaagctattgagttttgtttcaagtacatcgaaaaggccaaactagttggggttccagagtctcgacctgacgaaagagtgagaggagaaaacgagtggatggagaaatatctcaaagtgtgtgcaaaaagtgagtcgggactcagcatgaccacaaatcgacctccactccctatggctaacatagacccgggtatagggtctaatatctcaaagacggtgaaagaaaataaagaacaagcacgttcgtctcctaaggagaaaatgagtggagtcgccaccaacgtttatttgaggaaaacattagaaaaaccaaaagagggtgaggcgagactcaagggtgcgtcttccaagaaaggaaaatgcacgagagtcgccaccaatgtttattcaaggaaaacattagaaaaaccaaaaaggggtccgcaacttttaagaataagggctcaggagttgtttacgtgcggggaagcttttgtggtcgacaagagcgttgcccttgctcctacgtatcctcaagtgtga

SEQ ID NO: 24438 - DNA, 102 bp, Glycine max
  Peptide Sequence Number=SeqID_141216
atggagggattaggtggtgcagtagagtcaccggaagtgccgtggcgacattggcctacaacggtgattttggttgcactttgtttgaaaggatttggttaa

SEQ ID NO: 24439 - DNA, 255 bp, Glycine max
  Peptide Sequence Number=SeqID_141217
atgtggaagaggatatggagggtggaattggtgttgtggatgcgctggtggctccagaacgatgagctcttgaagccgaagcggaggtggatgaacccttatatttcaatcggtgaaatcaaaagaaaaatgaaaaagaagaagattgcaagttataggagtcgatttgatgaagaaatgagtaagataggaaggtttggaggtttgggaatggaggaacgtcgcaaggggaagaggctgcgcaggggtttctga

SEQ ID NO: 24440 - DNA, 228 bp, Glycine max
  Peptide Sequence Number=SeqID_141218
atagaacgtgaaaagataattgattccttggagagtcttgatgatgaaaatgctgttctcagggaagagcttcatgcccgtactattgagtgtgagaggatcgaaaaagaaaacaatgccttactgttttttcaagatagctgctactatataagtactaacttagcatctgatttggcacagtctactgactcagttgctgggggtggtcaaggctcaaacagttga

SEQ ID NO: 24441 - DNA, 936 bp, Glycine max
  Peptide Sequence Number=SeqID_141219
atggcatcactaccccaaatgtctaccacattaggagcttgcatgagctcaaacaagactatcaacccacgaccatgcattgcccaattaaacaacaacaacaacaacaagaggagtactcctttcagcaatttaattgccaatcaccaaattgtcaatggtacgttgtttccatttgcattagtagggcaaaagaagcccataatagagttatggaaacagtgccaaaatgaaaaatggaaagcacgtgccgggaaaaatcctgagttcctgccacattcagatgtagagagtgttgtcaaagagttttacgatgctttcaataaaaaagacattgaaaaattgaagcaattagtttcagatgattgtgagtaccaggactacctcttctacaatccctacaaaggcaaggaggtgatggatgcgttgggtccaaatattaaaattgctgtgggaaagggagatatcagagtggaagaagatgtgagagtggaagatgtcaaagagagcaaacctatggctactgtgttttggcacttgggtttgggggagaggtggctagggtttgttagagagaggaatggtaagaacggcaaggtaaccggcttggaggaacttccactaaaaccaggtgaaatagtactggatcagacaagttcaagcaaggaatttcctaaaggatttctagaagctgaattcacacactctgcctcaaacatagtcattgagctaccattcgtatcaaccaaggattgtccctccgatggacttcctgagttcgctctgttggccgctccaacgtcggaaaatcctcgctcctcaactccctctgcaaagaaaaattgtgttctcaatgtcaggcatgtggtgatttcttctgtgttgaagcttgaaagtctccatgaggaggtaggacttaggagagaggatttgtga

SEQ ID NO: 24442 - DNA, 324 bp, Glycine max
  Peptide Sequence Number=SeqID_141220
tcacaggatgttgcacaagattttggagcagtttgtactccagaattttaccttttcaaaaaggatggtcgaaggccctttgagctggtttatcatggtcaatttgatgattcacgtccaagtaataatgtacccctcactggaagagacttgagcttggcaatagatcgtgttcttagtggccaacctgtaccatcagagcaaaaacctagtttaggactctattactttcacgtgcttaaggtcattgtttttctatgcatgaagtgttggatgcagcataaagtggcacccaaggaagaagttttgattgataaactgtaa

SEQ ID NO: 24443 - DNA, 844 bp, Glycine max
  Peptide Sequence Number=SeqID_141221
cggcggtgatgcggggcttccacaaatgttgcatcctcgtcacatggtaactccaatggaagaacaacaacgttcgaggtggaaacccagcgtcgaggttgcacccaattgccctcgctgcgcctccaccaacaccaaattctgttactacaacaactacagcttgtcccagccgaggtacttctgcaaaggctgcaggcgctactggaccaaaggcggctctctccgcaacgtccccgtcggcggtggctgccgcaagaaccgccgtggaaagtcatcgtcgtcgtcgcggctacaacaccaaagccatcaacgcgcttttagctgtgagaacacagagtcatcatcagtaggtgatgatgcccaacaaaataacaatgtgtcacgtgatatagacatggctctcgtgttcgccaaattcttgaacccaaaaccaactactggtgaggataacaatggttcaccttcttccaacaattacttaacaccggaaagtgtagaaattgagaatgatgcagtggttcagtcacagaataaggcttcatcggatcctgttattgtagagtctgagaatttgagtttggttgagattgatgagttggagaggttattaggtgtgtgtggtgatgaagatggtctttggtctgatgctaccttgtcgtcttcggttacttgggaaccaccattgaaggagtcggaatactcgatgccgttgaatgaggatgatggtgatcaattgttacccatcatcatttctgcatctacgatgagcgacacttgctggagtaattggagttcctttgatctttcaaccatggacgcgctctcatcaagtccttcttaa

SEQ ID NO: 24444 - DNA, 3270 bp, Glycine max
  Peptide Sequence Number=SeqID_141222
atgtcaagcaatgcattaactctttttatcttgtttcttaacatcttgtgtccatccatctctggagctctgaaccacgaaggcctctctctactttcatggctttcaaccttcaactcctccaactctgctaccgccttctcttcatgggatccaacaaacaaagacccttgcacatgggactacataacatgttccgaagaaggttttgtgtcagagatcataataacatccattgatatacgtagcggtttcccctcacagctccattcttttggccacctcaccactcttgtcatctcaaatggaaatctcactggtcagattccaagttcagtgggaaacttgtcctctttggtcactttggaccttagcttcaatgctttatcaggaagcattccggaagaaataggaatgctatctaagctgcagttgctgttgctgaattcaaattccttgcagggtggaattccaaccacaattggaaactgttcaaggcttcggcatgtggaaattttcgacaaccagctctctggaatgatacctggagaaataggccaattgagggctcttgaaacactaagagcaggaggaaatccaggtattcatggagaaattccaatgcagatatcagactgcaaggcccttgtttttctgggacttgcggttaccggggtttctggggagattccaccaagtataggagagcttaagaatctcaagacactttcagtctacacagcacaactcacaggtcatatcccagcagagattcagaactgctcagccttggaggatttgtttctgtatgaaaatcagctttctggaagtattccttatgaattgggctccgtgcaaagcctcaggagggtgttgctgtggaagaacaatttaactggcaccattccagaaagtcttgggaactgtacaaatctcaaggttatagatttctctttgaattctctggggggtcagatacctgtgagtctcagtagtctactcctgttggaggagtttcttttgtctgataataatatttttggagaaataccttcctatattggcaacttttccaggctgaagcaaattgaattggataacaacaaattctctggggagattccacctgtcatggggcaactgaaggaactcacactcttttatgcctggcagaatcaactgaatggaagtataccaacagaactatccaactgtgagaaacttgaagcacttgatctctcacacaatttcctcagcggttccattccaagttcactctttcacctagggaatttgactcagttgttgctgatatcaaacagactttcaggtcaaattccagcagatattggcagttgcaccagcttgatcaggttacggctgggatcaaacaactttaccggtcaaattccatcagaaataggtcttttaagcagtttgacctttattgagttgtcaaataatctactcagtggagatattccctttgagataggtaactgtgctcatctagagttgcttgacttgcacggcaatgtgctgcaaggaaccattccttcctcattaaaattcctagttggtcttaatgtcttagatctttctctaaacagaataactggaagcattcctgagaacttgggcaagcttacgtctctaaataagttgattctgagtggaaaccttatctccggtgtgatcccggggacgctggggctgtgtaaggctttgcagttgctggatataagtaacaataggatcactggttctattcctgatgagatcggttatttgcaagaattagatatcctcttgaacttgagttggaattctcttactggccccattccagagaccttctcaaatctctcaaaactatccatcttggatctctctcacaacaagctcacaggtacactcacagttctggttagtcttgacaatctagtgtctctaaatgtctcctacaatagcttttctggttctcttcctgatacaaagttcttccgggatctacccactgctgcgtttgctggtaaccctgacctttgcattagcaagtgtcatgcaagtgaagatggccaaggcttcaagtcaataagaaatgttattctctacactttccttggggttgttttaatctctatttttgtcacttttggagtaattttaactctcaggattcaagggggaaactttggaaggaattttgatgaaggtggtgaaatggaatgggctttcactccattccaaaaactcaacttctccatcaatgacattttgacgaagttgtcagaatcaaacattgtgggaaagggttgctcaggaattgtttatcgtgtggagactccaatgaagcagatgattgcagtgaagaagctatggccaataaagaaggaagagccaccagagagagacttgtttactgcagaagttcagacccttggatcaataagacataagaatatagtgagacttttaggatgctgtgacaatggaagaactagattgctcttatttgattatatatgcaacgggagtttgttcggattactccacgaaaatagattgttcttggattgggatgcaaggtataagatcatactgggagcagctcatggtctagaatatcttcatcatgattgtatccctccaattgtccatagggacattaaggctaacaacatcttggtaggtccacaatttgaagctttcctcgcagattttggccttgcaaaacttgtgagttcctcagagtgctcaggagcctctcatactgttgcaggttcttatggatacatagctcctgaatatggatacagtttaaggatcacagaaaagagtgatgtgtacagctatggtgttgttctccttgaggtcttaacggggatggaaccaactgaaaataggattccagagggtgcccacattgtcgcatgggttagcaacgaaatccgagagaagagaagagaatttacatctatccttgaccagcaactagtattgcagaatggaacaaaaacctctgagatgcttcaggttctaggagtggctctcctatgtgtgaatccatccccagaagaacgacctactatgaaagatgtaacggcaatgctcaaggagatcaggcatgaaaatgatgatttcgagaaaccaaattttctccataaaagcatggttaccaccaatccaaaagcagcagttcactgttcaagtttctccagatcatgtgaacctttaataatagaatcaacatcttcttcttctgtatag

SEQ ID NO: 24445 - DNA, 831 bp, Glycine max
  Peptide Sequence Number=SeqID_141223
atggacaaaagaggtgccaaggttgatggcaaaaagtctgcaccgcccaaaaatgagacacaaaacttgtcaagatccttgccatctccatggtctacttctacgcaggcttatcataatgttgagcatgctgcaacttccaatgtaaatccagctacttctcttttttatccctcctggtcgggaagtcagatgccaacagcatatgatgcaatgtatcaaagttggtcattctccaacatttatccaatggcagcagcagaggttggacaatgttgtctattagattctggagatgaaatgcaaaggatttcttgtgacaagagcttacaaccttcaatcccaaaaaccaatggggaaggactaccaaggagtgtgactagcgaaagcaaggaaacaacagttgtaggccatgatgttaagaatgccggtgcagcaacaacatttaaaataaaggaaagtgatgaaacaaaagaaagaagaaaaaggcagaaaaatatgatatcagacaagagaaaaaagagaaagatcatgaagctgcaggatatcccttcaactaggcaggggcagtccagtatgatgcaaggaaatgggccagcttcacagaatgtgagtagtaatgaaacttgcaatgttattgcatctgatcattttgaagcaaatccaactgagctgcagaatcagaagttgggtacagaacccgatgcatgtggcagtaagcctcaactgaaaagaaaggaaactgctgaagaaaaagaacaaagaagaaagcatcaaaagaagatagcatctaagagatcaaggatgaagataaaggtacacaatgcataa

SEQ ID NO: 24446 - DNA, 573 bp, Glycine max
  Peptide Sequence Number=SeqID_141224
atgcccctggcgtatgagcagctcggtcgccgtctgcgccgcattggcgttgtcgagccagatgcaacggttggcgatcgcgggcagataacgattgatcagcaccagcgcgggcgtatgggcggcgtagcgcagcagcgcctcctcccccatgcgcgtgacgtgcgccacgatggcttcacatccctgattgatgagaaaatcgaggccgcttttttccagctcggcctgatgcccgccgctgcacaacatcaaacgcacgccggcctgccgagtgatgtcttccacgccccgcgccagacgcgagaaaaacggatcgtcaagattgccggtcagcaaccccagcatattgccgcttcttttcgccagcgccagcgcggcggcgttgcggtggtagttaaactcgcgcatcgctttctcgacgcgttcgcgggtcaccggttcaacgtaggcggtattattgatcacccggctgacggtggccgtggaaacgccggcgcgccgcgccacgtctttcatggtggccatggcatgtcctgttgtgccgttcggcgcccggtgcgccgcgcataa

SEQ ID NO: 24447 - DNA, 1236 bp, Glycine max
  Peptide Sequence Number=SeqID_141225
gcgctgacttacgctggcatgctgctgtttttccgcaacgaaaccggctttggcggcaacaacggctttaccggttttactaccctgctcggtttcagcgtcaccgccaccggcacgcgtatcgcactgtttatcgcgaccgtgctgttgctgctattcagcctggcgctgggctttgctctggcgcgcagtaagtttggtcgcgtgctgacggcggtgcgtgatgcggaaaaccgcctgatgtttattggttacgatccgaagggcttcaagctattcgtctggacgctctccgccgtgctgtgcgggctggccggtgcgctgtatgtgccgcaggtcggcatcatcaacccgagtgaaatgtcgccgaccaactcgattgaagcggcgatttgggtggcgctcggtggacgcggcacgctgattggcccgctgctaggtgcggccatcgtcaacggcgtcatgactgagcaactgtttacccaaccgcacccggcggatcgccatcgtcagcaaaccgatccggtgctgctgctggagaacatcaacgtctcgtttgacggcttccgcgcgctgaccgatctgtcattgcagattggcgtcggcgaactgcgctgcgtgatcggcccgaacggtgcgggaaaaaccacgctgatggacgtgatcaccggcaaaacccgcccggacagcggccaggtgatctacgaccaggataccgatctgcgccagctgtcgccggtcgaaatcgcccgcgccggcattggccgcaagtttcagaaacccacggtgtttgaagcgctgacggtgtttgaaaacctcgagatcgcgctgaaaaacgataaatcggtgtgggccagcctgcgcgcccggcttagcggcgagcagcgcgatcgcatcgacgaggtgctgaaactgctgcggctcggcggcgaacgccagcgtcaggcgggtctgctgtcgcacgggcagaagcagtttctcgaaatcggcatgctgctggtgcaggagccacacctgctgctgctggacgaaccggcagccggcatgaccgatgccgaaaccgactacaccgccgaactgttccgcagcctggcgggcaagcactcgctgatggtggtggaacatgacatgggctttgtggaaactattgccgaccacgtgacggtgctgcatcagggccaggtgctggctgagggatcgctgcgcgaggtacaggcggacgatcgggttatcgac

SEQ ID NO: 24448 - DNA, 1239 bp, Glycine max
  Peptide Sequence Number=SeqID_141226
atgtcgaagctgatcttcgtgttcctttcgctcattcctcttctctgcacctccttctccccagagagaccctcagatcgacgcgtcctcgttttgctcgatgacttcgccatcaaatcctctcattcttttttcttcaactccctcaaatctcggggcttcgatctccaattccccctcgcagacgaccccaaaattgcgctccagagatacggccaaggtgcaggttttggaggatccattgacgcggctgcaattttggattttgttgattcgggtcatgatttgatcgttgctgctgatagcaatgcatctgatttaatcagggaaatcgccaccgagtgtggagtggactttgatgaggatcctgctgctgtggttgtggatcattcaggatatgcagtctcggctactgaaggagatcatacattgattgctagtgatgattttatcaagtctgacgctcctgtacttttccaggggattgggcattcactaaatcctaccaatagcctggtgttgaaagttctctctgcatctccttcagccttttctgctaacccaaaatctaaattgacaagtcctccatcactcactggaacttcgatctcattagtttcagttatacaggcaagaaataatgcccggatattgatctctggctccttgagtttgttcagcaaccgatttttcacgtcaggtgtgcagaaggctgggagtccaactaaacacgagaagtctggtaatgagcagttcttgaatgaacttagcaaatggattttccatgaaagaggtcacctcaaggcggtgcatgtgcaacaccacaaagttggggaagctaatgaaccagccatctataggatcaatgataatttggaatactctgttgaagtttatgagtggtctgggacaacatgggaaccttatgtagctgatgatgttcaagtgcaattttacatgatgagcccctatgtcttgaagactttatcaactgacggcaagggccattatttcacatcatttaaggttccagatgtctatggggttttccaattcaaagttgagtacgaaaaacttggatatacaagcttatctttatcaaagcagattcctgttcgtccctttagacacaatgaatatgaaagatttataccagcagcttatccctattatggagcagcattttcaatgatggcaggcttcttcatcttcaccgcagttcatctatacagcaagtag

SEQ ID NO: 24449 - DNA, 591 bp, Glycine max
  Peptide Sequence Number=SeqID_141227
atggaaggtactctagctcctcagacattccgccttctcgattccattggccctcaaaagcttgtgatcttggtggatggcggcagctctcataatttcattcaaactcgcatggctcgctttctggcccttccttcctccccgacaacacccttgcacgtcatggtgggcaacgggaacaccttggactgtgatatcatctccccacagattctaggcccggtaaccacggattatacgtccctcaccatgaactttccatattttggccacacagttaccctaattgctgatgcaccccccacacccacacttgcctcatcacatcagttaaaacgtttcgcacaaaaccacaacatctcagccttattccatatcacaccagccttggcccaacccacccctccttggcaaatttccctaatagggattcttttacaaactaattccgcaaatggggctgttttactacgtaaaacccatgcaaaatgtcagcaacaatggcgaaacctcctcgtgcaaacacgtggcagtggactcgccactgcagctggcgagaaaggcaaaacgccactgctgatggcgagatag

SEQ ID NO: 24450 - DNA, 1245 bp, Glycine max
  Peptide Sequence Number=SeqID_141228
atgattgatgccattgcaaagtgtggtcttggatttactggtccgtatgcagaaatcctaaaaacaacatggttggaaaggataaaatcagaagagggattacagtcaaaagatgttgagaaagagtgggccactacaggttgcaccattattgcagacacatggacagattataaatcaaaggccataattaatttcttagtctcatcaccatccaggacctttttccataaatctgtggatgcctctgcatatttcaagaacaccaagtggctggctgatctttttgattctgtaattcaagagtttggctctgaaaatgttgtgcaaattattatggatggctgtgttaactacactggtattgctaatcatattgtgcagagttatggaactatatttgtatctccttgtggctctcaatgccaagaacttatcaggactggaatcacaaagtctgtatccaccttcctgtctttacagtctatgttgaaattgagaacaagattgaagaatatgttccacagccatgaatatgcctcaaacacttcgaatgcaaataaaccacagagtctttcttgtattgctattgctgaagatggtgatttctggaggacagtggaagagtgtgtggccatctctgagccttttttgaaagtattgagagaaatatcagaagggaaaccaactgtgggttccatatatgaactaatgagcagggccaaagaatcaatcaggacacactacataatggatgagaataagtacttctttaatgtactggagaaattgcttcctgtaccagatatgaggcgtgacatcaccaatcaaatctatacttttacaaaggcacatggaatgtttggctgtagcctagcaaaggaggcaaggaatacagttgcaccttactcattgcttattcgttgtagggctttggtgggagcatggagtaccttttggcaaattctctctgagaagcggaacaagattgatagagaaacatttaatgacctagtttatgtaaactacaatctcaagttagctaggcagatgagtgcaaagtctacagaagttgatctgcttcaatttgatgatattgacatgactgctgagtgggtggaggagaatgaaactgcaagtccaacacagtggctggatcgttttggtcctgccttggatggcaatgatttgaatacaagacagtttggttcttctatatttggtgcaaatgaccctatattttga

SEQ ID NO: 24451 - DNA, 1116 bp, Glycine max
  Peptide Sequence Number=SeqID_141229
atggtgattgattgtagggaacaacataagaagctcgatgcaattgagacggaacttgctggagctagacaagagggttttgtttcaaaacccttgatagagactaatggaacttactcaatgagaaggccgttggtcgtgataggtatactgacaaagtttggtcgccagaagaatagagatgcaattcgaaaggcatggatggggagtggtgcatctttgaaaaaaattgaagaaggaaagggcatcattgtgcaatttgttattggtagaagtgaaaatcgtggagacaatcaagataaagacattgatcgtgagaataggctgactaatgacttcataattctcgacattctaggtatatcatttggcattcacttttctatgaaaatcctattgagttgtcttattctgaatttggaaatggaacctccagagtataattttttggatagattcaataatgcccctgagaattctgcccatgcaaaaattgaatctaccaagttgataaaagttagaatagggggaaatttcaccactgagaattctgttgcaagcaatttgtcaccacaaccaattgtgctggtcaagttagaccaagataatcatgtggaaacaaatgatgcattcccaaagaaggccaaattgttctttgctcatgctgcagacaaatgggatgctgagttttatgcgaaagtcaatgatgatgtctatgtaaatattgatgccttgggagctacactagctactcatttggacaaacctcgtgtttacatgggatgcatgaaatcaggggaagttttctctgagctagaatatttaatgattctcatactggtatctgtgaaatatgacaggaaccataaatggtatgaaccagagtggtggaaatttggtgacaaaaaatcatactttcgtcatgcatcaggagagatgtatgttatatcacaagctttggctaaatttatatcaataaacagatctattctccgtacctatgcccacgatgatgtgagtgctggatcctggtttatcgggcttgatgtgaagcatgttgatgaggccaagttttgttgctcatcttggtcgacaggtctccctctcttttcatga

SEQ ID NO: 24452 - DNA, 210 bp, Glycine max
  Peptide Sequence Number=SeqID_141230
atggttccttttggggtgccaccttttgacctcggccttggcccttgggtaggaaaaaaggaaagggtttcgtacagaaaacgccaagttttagccatggcatcgaagcggatcttgaaggaactcaaggatctccaaaaggatcctcctacctcatgcagcgccggatcatgcctctgttacgcgctaccttgcttgtgcgtttcataa

SEQ ID NO: 24453 - DNA, 147 bp, Glycine max
  Peptide Sequence Number=SeqID_141231
atgaagcagttagaggaaggaaatctaaactggggtctttgcaatgatggtgtattggtagtgatagaagatgagctgtatttgcttgtgagaacagcagtgccacatgcaattgaagtaagagaaactcattctgtaatcatttag

SEQ ID NO: 24454 - DNA, 1086 bp, Glycine max
  Peptide Sequence Number=SeqID_141232
atggctgttcttaaaccagtaagttcttgctttggagcaaagtatcaagctctagcaccatggagaattttaaggggtctggtgtgtctactagtgcttctttcaacagcatttataatgttagtgttctttggttttatcagtgctgttataatgcgactttttagcgtcatttacagcaggagagcaacttcctttttctttggtgcttggctagccttgtggccttttctatttgaaaagatcaacaagactaaagttgtgttttctggagatattgttccttctagagaacggatcttattgatcgcaaatcatagaactgaggttgattggatgtatttatgggaccttgccttgcggaagggatgccttggatacataaaatatatacttaagagtagcttgatgagacttccagtttttggttgggcatttcacatactagagttcatcccagtggaaagaaagtgggaggctgatgagtcaatcatgcgctatatgctttcaacattcaaggatccacaagatcctctctggcttgcacttttcccagaaggcactgatttcactgagcaaaagtgccttcggagtaaaaaatatgccgccgaacatgggttaccagttctgaaaaatgttttacttccaaagacaaagggcttctgtgcctgcttgcaagaattgaggagctctctcgctgcagtttatgatgtgaccattggctacaaataccgctgcccatcttttttagataatgtctttggggtggatccttctgaagttcatattcatatctgccgctttccccttgatagtatcccggtatctgaagaggaaatgtccatgtggttgataaatagattccagacgaaggatcagttactttccaattttcaaactcaaggtcagtttccggatcaagcagcagaaagggacctctctgctgttaagagcattttaaattgtatgacaattgttacagtgacagcacgcattgacttgatcatcgatatcatagtcctcacgagtatccacaccccattcaaagcacaaagagctaggaggatcatgctgcgatcaacttag

SEQ ID NO: 24455 - DNA, 1125 bp, Glycine max
  Peptide Sequence Number=SeqID_141233
atggggagtcatatgagcaagaagatccctgaaacttcttctattggcctcagcaccgaattgcactacaaaactgagttgagttcctatgaggctgcttgcaagcttgattctgatttgcagtcctttgacaccacgcttcaagctagaacaaatcaggttatcaacactcttgctgttggtgttgaagttcgagccctttcatttgattctctgaagcaaatcacagaatgccttttggagatgaaccaggaagttgtcaaggtaatcttggactgcaagaaagacatatggaagagccaggaactgtttgaactggttgaggaatactttgagaatagtctgaaaactttggacttctgcactgcattggagaagtgcctaaaacgcgctcgcgacagtcagttgcttattcatgtggctcttcaacagtttgaggaagaatcatcaggatcaggaggagacaaccgctacccgaggacattgcaagaatttaagaacttcaaggccgctggtgatcctttcactgaggaattcttccagatatttcagtctgtttacaagcaccagatattcatgcttgaaaagttgcagcttaggaagaacaagcttgataagaagctcaaatacatccattcctggaggaaggtttcgagtatgatctttgtggcgacttttgctgcagtcttaatctgctcagttgtagcagctgctatcgcagccccacctgttgctgctgcgatagctgctgctacgtcgatcccaattggatccatgggaaaatggattgactccctctggaggaactatgaaaatgcattgaaggggcaaaaggaagtgattagctcaatgcaggctggaacatatgttgccataaaggacttagacaacattagggttctcattgataggcttgaaattgagattgagtctctattgcataatgtggattttgccattgaggaagaagctgtgaaagttgcaatagaggagatcaagaagaagcttggagtgtttatgaagaatgttgaagatttggcagttcaagctgatatgtgtagccgtgacattaggagggcaaggactgtggtcctgcagagaatcataaagcatccccacaattga

SEQ ID NO: 24456 - DNA, 759 bp, Glycine max
  Peptide Sequence Number=SeqID_141234
atggaaatgaatatcagagtcctaatctcaggtcagatttctaccattgcccaaagggccaggaaggtaagagctcgactagcagatgttccttcttcttctgcaccaccagctcctcctacttctgccatgcctacaccagctgcccatgactctcaacgctttgaagccatgcttcagagtattcatcaaggacagattttattactgcagagcctacaggtggtagttcctctagggtccattctatcggtagaacaattcattgagaaggtatcctggcctggaactgtaccttctactgtgagagagggtgagggccctagtgctcaggtacctcaacaggtacatgatgcatcttctaaggctaccatccctggagcttttgattttttaggtgcaggagtaaaaataagacctgatgaggctgtttttcctgagccaattgtagcagttatacatgaaacagttgaagcaggtgagtcacaattgagacaggaggctgctactcctgagaggacaccacagaccctagaagatccactctcaccagggatggggctatcttttgctcggcaagtaacagatcctcctacaccagtacatgagagacaagcagatcctcctacacccatcatggaaatgcttgaagaccctaccacgccagtcctgagactgtcatccactcctccagctaccccagttttacatctgatagatgaggaggatatgcaagaccaggacacacagggcacatag

SEQ ID NO: 24457 - DNA, 1488 bp, Glycine max
  Peptide Sequence Number=SeqID_141235
atgtcccttaattcatgcggctttcaaagcttgtaccttggcagttccaaatgctccaacctcgttttccaggatgttaggaaactgcaacagtaccaagatgcattagacaagtgctccaacttcgaccacccatttggtgaatcttgtgcagattgcaccggtgcaatattaagcttaagagatagtttatataatcaagtgaccaacaacaacaacaaccacactgaggtagccatatgtgcggtagcagctattgttgctgttgcagctgggaaaccaaatgatcctgccgttgacaaagtcttacgctgcttgccaccttcagcttctggatcagacaagaaattgagccaaatgaaactgacaaaaaaaatgtcaattttcgggtccccaggatcattgtggaaatccttgttgagtgtgccggtagttatccttgcaatattgcttgtggttataatggtaaaacgtttgtccaagaagaagcttcgtagacaggcaaacttgaaagagatcgctgcgtggtctggattgtactggttctgcaaaagggaaattgagaatgccatgaattatggcggtgaaaagatatgccttggacgtgggagtgcagggcaggtgtatagaggtattctcccaagtggtcaactcgtggccatcaagcatttaacaaagagtaacacctctgagtctttcactcgagaagttgaaggtctttcaaggcttcgccatcctaacctggtttgcctctttggatgctgcatagaaggggatgagagatatttagtctatgaattctgtgcaaacgggaatcttgctcaacatctcttaagaagagatagccacttgacatgggaaaccagagtaagaattttgagagattgttcatatgcactcaagtacctccaccatcatatagaaggctgtgttgtccatagagatataaagcttacgaacattcttttgaatgagaaataccaagcgaaactgtcagattttggactggcaaaagtgatggggattaaagagagcaaggtttttactgatgttagaggaacaataggctacatggatccagagtacatgagtaatgccaagctaacctgcgctagcgatgtttacagttttggtattgttgctctacaaattctgtcgggacagaaagtcatcgagttggatcttgatgccagagatcaactcactaggaaggcaagagatgtgagcatgggaaagcgtccactgtcagattttgaagacccgcgactaaatggaaaagttgataagacagacttcgaagccatccttcagattgcagttttgtgtgttgccaaatcaagcaaaggtcgtccaaccattgagcttgtttttgaggaattggacaaggtctgcagggatacagaaacacggatgaagcaaaagaaggatgagagcttatcaacaacatccaccccgagctccaaatcgtcaaaatcggcgcctctatga

SEQ ID NO: 24458 - DNA, 729 bp, Glycine max
  Peptide Sequence Number=SeqID_141236
atgggattgttgtccaagtccaagagtactatgcctgggactaggagagaaagccaattcctgaaactagtacaccctggtggctttgtagagctacactctaacccaatcattgcatctcaagtcatgaacaaaaatcctaggcactgtgttacacgacccgacttcttccaatttccttggattgtggtcaacccagaatccattctcacacccggcaacgttttctacatcgtaccttgtcacaccatccgtcataagatcaagtccacaaatattgtcactgctaacacaaaccacacccttcactttcttcctaatcaatcttctattgatcctcacagacaaggtcaaatctctaactccaacaaaattcgatgcttccaaaaacaatcctcattttccgcgtcaacgtcatgcgtgaaattgcccagagagggacacaaacacggcaaaggaggtaactactgggctcaatcttctgtcagagaaaaacatgtttattattctagcgactacacttcacgtgactcaggaaaagaagaggcgcgcagccgtagtggtagattcagccactctgagcagatccctacgctgaagccgtgccttaagaaggataagagccacagtactagatcgcgacgaaatcttaaagttagatttgagtgcaatgacgacaacgtcgtcaacagcgccaactttacaacaaaaatctaccgttacacctaa

SEQ ID NO: 24459 - DNA, 339 bp, Glycine max
  Peptide Sequence Number=SeqID_141237
atgaacacttgtcctcctgagttcaggggttgcgatgccaacgcattcgacaaaaccgtcagagcatttcgacagcacaaggttgtcgggaacccatcgtcaccccacttgtctaaaacctcattcacatcgccgcactcaccaaatgccacatattgggacgtgttgaacttcagcacacatgtacctgcaccacagcaccagataaaattaaacgctaatatactagaaaagagtaggcattgcatgaaagaagagggaagagaaatggatttgaccttgtggaggatcattgggtgctggcgatacgagtggggaaaactctgcaggtgttgctag

SEQ ID NO: 24460 - DNA, 2250 bp, Glycine max
  Peptide Sequence Number=SeqID_141238
actaagagaaccaacagcaagagggagcaacaaggcgttataccacaagaaaacgttgtcacaaggacaccaccagatgtaaagaaacaaaaggcagatgatccaaaccaagttgacacctcaaatattcaagcacaaaatttcacattccgtgagcttgcaattgcaacaaagaatttccgccaagaatgtttgttgggagaagggggcttcggcagagtttataagggaacaattcctgcaaccgggcaggtggtagcagtgaagcaactcgaccgaaatggggtccaaggtagcaaggaatttctggttgaagttttgatgttaagtctcttgaaccatgaaaatctggtcaaactcactggttattgtgctgatggagatcaacgtcttttggtctatgagttcatgccagggggctgtttagaagaccgtcttcttgagaggaaaacagatgaacctgcattagattggtacaacagaatgaaaatagcatcaaatgcggcgaaaggactatggtacttgcacgacatggccaacccttcagttatataccgggacttgaaatccgccaacatcctgctggataatgatcacaatgcaaaactatctgattatggactggccaaacttgctggtaaagataagacgaacattgtaccaacaagagttatgggcacctatggttacagtgctcccgagtacgtaagaacgggtaacctcaccttgaaatcagatgtgtacagttttggagttgtcttgctagagctcataactggacgccgtgccattgacaccacaagatcgcacgatgaacaaaatctagtttcatgggcacaacccatattcagggacccaaaaagatatccagacatggcagatccaagtctgaaaaaaaatttcccagaaaaggatctgaaccaagttgttgcaattgcagccatgtgcttacaggaggaagcagcagcgcgtcctttgatgagtgatgttgtaactgctctcagttttctttccacctctcctccagaggttgttcctgaagcccagagtgctgctcctgaaaatgaagctggatctggtaaggacagcgatagctcctcctccaatgaagaagaggagaatgtaactgctgaaactcaggttagtgcaaaataccaagagagcgaagacgcctcagagaatgagtatgattattatgggaatgaaaaccaacaaaagtacagtccacaagacatcaaacagaccaaggagttctactccaaatcaagccgcaagagcagcaccagatcaaagaacggaaccacttcttctagctacagaagcagctccacttcagattcagagaatggaagcaacaaaaccagtaggaaaagcagcagaaagaacggcagcaagaagtcttccttaagccagaagagcggtaagaaatcttcattgagccaaaagagcagcagcaagaaatcttctgtgagagtcttaagccacaagaaaagcaaggatggaagccattcccctaattcaagacgcagtagcagcagtggcggtgatcttttggatcgtagcggaagcaggccatcagaagggaatgtttcaattggcctaatcagcagtgagaactcagacattggcgctgttgacgacgttgtcgtcattgcactcaaatctaactttaagatttcgtcgcgatctagtactgtggctcttatccttcttaaggcacggcttcagccatcgaattttgttggagttagagatttgaccttgtctgtgaggatcaatagaagattgattaggaagaaagtgaagggtgtggtttgtgttagcagtgacaatatttgtggacttgatcttatgacggatggtgtgacaaggtacgatgtagaaaacgttgccgggtgtgagaatggattctgggttgaccacaatccaaggaaattggaagaagtcgggaattggctttctctcctagtcccaggcatagtactcttggacttggacaacaatcccattagaaaatgttttcttgtgtttggaggttggggaggaagctgtggtgagacacaagactacgagcatggaagtgttcgttctaagacgatgacatcacgttcttgttcatctcctatggccaatgccgatcaaaaacatcagaatctctacggtgtcgagtttctgcacccaaaccacgtctcaacgaatgcgtgtttgggtatttcacttcaacacgtatccatgtcctcaatgctataa

SEQ ID NO: 24461 - DNA, 294 bp, Glycine max
  Peptide Sequence Number=SeqID_141239
atggaagtgcagcttgaaaacagctttgaccctgttcttctcgcttctccatcttgcagaacgaaacatctcgttcactcactcccctgcaagtggattccttcaatgtggttcaactcattggcccaaagcgaaacagagagaacgtggaaggaagcagaatgggaacagagaatgagggtgatgaaaactggaagcaaacagagtaaggtggatctgatgttatgcttcgttgctcctctgttgttgtcgtctctgttctgttcgcagcaacggcttataagaaacagatga

SEQ ID NO: 24462 - DNA, 168 bp, Glycine max
  Peptide Sequence Number=SeqID_141240
atgccttgcaacgtagaagaggccaattgcagacccgtcactgcaaccacagcagacacgttgacgcttcaacttgcttccaatttccttttaaatggactcaacatttccaagtccaataccttctgtcaaggcccacttcacaatactagtacaaaacaaaaatga

SEQ ID NO: 24463 - DNA, 270 bp, Glycine max
  Peptide Sequence Number=SeqID_141241
gtcattgttgctgacaactacttcactggatctaaagacaaccttaaaagatggattggccatccaagatttgagctaattcgtcatgatgtcacagagcaattgttgattgaggttgatcaaatctatcatcttgcatgccctgcttctccaatcttctacaaatacaaccctgtaaaggtgggggttcttagattctacttttatatttctgtcatttaccatgatcctgtcagctgtctacatgatttatttcttgcacaggagtag

SEQ ID NO: 24464 - DNA, 1215 bp, Glycine max
  Peptide Sequence Number=SeqID_141242
aggactacacgtcctcaccttcagagggctacacgccctcgccttcagaggactacacgtcctcaccttcaaaggactacacgtagaggactacacgtcctagccttcagaggactacacgtcctcaccttcagaggacttcacgtcctcctcttcagagggctacactccctcaccttcgtagggctacacgccctcaccttcagaggactacacgtcctcgccttcagagggctacacgccctcgccatcagaggactacacgtcctcgccatcagagggctacacgtcctcgccttcagagggctatacatcctcaccttcagaggactacaggccctcacctttagaggactacaggccctcatctttagagaactacacgtcctcctcttcagagggctacacgccctcgccttcgtagggctacacgccctcactttcaaaggactacacgtcctcgccttcagagggctacacgccctcgccttcagaggactacacgtcctcgccttcagagggctgcacgtcctcgacttcagagggctgcacgccctcgccttcatagggttgcacaccctcgccttcataggactcaacatctgcaccttcagagaactcaagggatcgcgcccacaagacacccagtggacccggagaagtccaacaaggccctggggtttccagctctggttatgggcctctgtcagtcctacatggtgcccgtcccccccagcaaggtcacgccatcatgacataggtaagtatgcacatcgctcaactgatttcttatgtcatctattgtttgccgggatcgcgcccgcaagacacctagtggacccagagaagtccaacagggttctggggtttccagctctgattacgagacttggtcaattctacagagtgcccatcgcccctaacaaggtcatcaggccccctattaatcgagatttcatcaagaagtactgtgccccccaggcaggcgcagggcgagacaccacatcaacctggggatggccggcagcaggcaatagacgcatcgccgccacctccagagcccctcagctcatctacaaaggctggagcattgcctacgacccgtggctgaccaacaggcgaccaagtccaaagccaaaggtaagcaaaagtactaggtccatgaccgacaagtcatcaggcgtccagctcaagacgttaaaaaaacactactag

SEQ ID NO: 24465 - DNA, 219 bp, Glycine max
  Peptide Sequence Number=SeqID_141243
atgactgaagcacgtcaaaaggggggtaggagcttgccacccagctcgcccaggcgagcaaggttgcttcctccagaagcaacagccttctggaggaagaatctggaaggcccaactttcgaagaagttacgaaaactcacggattgcgaaaaacacctcctttcgatttccgtcacattggctccacaaactcaatttcaaattcaagtgaaatatga

SEQ ID NO: 24466 - DNA, 351 bp, Glycine max
  Peptide Sequence Number=SeqID_141244
atgattgacattccactacttgttgctgataattcagcagatcaagttgatcatcaaattcttgaaaatgatgaacaaccaactaaagaatatgatctcttagaaaatgttgatgcagcattaaggaggtctactagacacccccaagctcctcctccaccaccattgaccaccggtggccaccacgagctgtcgttgcctgccgccgaagaagaacattgttatcagagcggaatccttagaatcctcctcaaggattcggtggagaaaaattttcccaatccttcatttcatagcttccctgagaaccttgcgtttggactgacgagcgtgaacgagagagacctctga

SEQ ID NO: 24467 - DNA, 132 bp, Glycine max
  Peptide Sequence Number=SeqID_141245
tgttgttggcagcagagaaggggtggctggagcggaggttttagggataagtaacgagcaatacattattgttgtccatcaatattgtagtactgaatcggatgtttgtgtgaaagttgatccattcactct

SEQ ID NO: 24468 - DNA, 282 bp, Glycine max
  Peptide Sequence Number=SeqID_141246
atgtgggaaattaaggaagggaatagaggggatagggactattcgggttgtgatctggatggggaatttagtaaacgagtgactgttgctgacaggataggatttgaggattattgtcaaacatggagctgtaacggaaagagatttgaagaagagtacaacgcaaggtgtggactgtggaagggaatcgccgaaaataatatggatgcttcagaaaattcatgtatctaccacgatttcggtattatccaaactcgtggtggcttgttatcccatgtttga

SEQ ID NO: 24469 - DNA, 234 bp, Glycine max
  Peptide Sequence Number=SeqID_141247
atggagataggtaaagggaaaatgaaagaagataaagagatgccaaacctcaatgttgttagcagtagcatgtcagaaagttgtaggtggaatgaattggaagcgagaagcatgaaagctggattgagtgttttggaatgtgagaagaaaagggctgaaaatgaggttgaggtatggaacgactggaacctggaatcatttgtaaattttaaaatatataattctcataaataa

SEQ ID NO: 24470 - DNA, 381 bp, Glycine max
  Peptide Sequence Number=SeqID_141248
atgtacaaagataattggacccaaccttggcccatgggctcagaaatctaccctgaggttcatgagaaccttagggccttcttcagcagctctagcccaatcctcttggagcctcttgcgcatggctctagtgactggtcccttcttatggaggattgcatcatcgagtgtcgagcccacagggaatttgtttcactcagaaaatgctttaaagcactttccaatgctaaaaatcctaactatacatacaaatggatgatcaagtcacaagcatgtaaaaatcgagacatgcagcacgcgctaagccgaaattcactaatgtgcgctaagcggttcaaaattgcgctaagcgcacgagcacagacaaggccacctatttaa

SEQ ID NO: 24471 - DNA, 748 bp, Glycine max
  Peptide Sequence Number=SeqID_141249
gtttaagaggcagccagagaagagtgcccctgcttcacaaaatggaagaacttcagctcctattaaattctctaacgataccgaaaggctccagcatgttaatagcatacgcaaagcccctgttggggctcagatgaagcgtgttattgatctcctatttgagacccggaaggctttaacgatagagcaaataaatgaagcgtgttacgtggacatgagggctaataaagatgttttcgagagtatgaggaaaaacccaaaagtaaaatatgatggggaaagattctcttacaagtcgaagcatgccgttagggacaaaaatcagctgcttttcctggtacgtaagtttccagagggcattgctgtggttgacctaaaagattcttacccaaatgtgatggaagacttgcaggctttgaaagctgcaagggagatttggctgttatccaactttgactctcaagaggacattgcctacccgaacgatcctaaagtgcccattaaggtggatgatgacctaaagcagctttttcgggggattgaattgcctcgtgatatgattgacatagagagggatctacaaaaaaatggaatgaagcctgctaccaacactgcaaagaggaggagtgcagcgcaaatggaaggcatttcatccaagcctaaacctaagaagaagaaaaatgaaatcactaagaggaccaagctgactaatgcccatcttccggagctttttcagaacttaaagtaa

SEQ ID NO: 24472 - DNA, 1425 bp, Glycine max
  Peptide Sequence Number=SeqID_141250
atgggagttgtgactgtttctggctcagcttctcggactccattaggattcaatacgaagttttccactcatcgtttgaagagacctttaattgtagcatttaaaggggataagcacaatgactcagctttggttgcaacacaagagaaaattcctgtgccggttgaaacggcaaagaagacgcagaaaaaaaggataggaaaaagtaacaaactacctaagagagaaagttctccatcttccatggatgtggactacaatgaagctgctgctatgcttgaaaatatatacaaactcagccctgcttctcataccggtaatgcagaatgtatagatgataaaatcaaaagagtctctcggagagggaagaaggttgttgatgaaagtgaagaaaaggagttaaagggtgatagggtggtcagaaggcagaacaagaacaagaaagctaaacggttgactcttgatcagagaatttcattaaagaataacaaaagaggggacgaagtcattccgactcgaaagaaaagaaactttaggaacagaattgagaagattgaagaacttattagggaatattcagcactgcttcaagtgaaagaagatttacagaaggagctagcaagagaacctgcagatggtgaactagctgatgcaacaaacatgagcattactcaagtaaagaaagcaatagatgttggtcaagctgctagaaacaaactcataaagcacaatctccggcttgtcttgttcgtgatcaacaaatattttacagattttgcaagtggccctaggtttcaagatctttgtcaggcaggagtaaagggacttataacagcaattgatcgttttgagccaaacaggagatttcggttatcaacatatagtttgttttggataagacatgctatcattcgttcgatgactctctcaagcttcatacgtgttccctttggacttgaatccgttcgagcagaaatccaaaaggctaaaactgagttaacatttaagcttcagaggtcaccaacagaggaagaaataatagaaagagttcatatatcccctgaaagataccatgacataattaaggcatcaaaatccattctttcgctgaactcaagacatacaactacacaagaggagttcattaatgggattgttgatgatgatggtgttaatggtgataataggaagcaacctgctctactaaggcttgctcttgatgatgtgcttgattccctgaagccgaaggagagcttggtgatcagacagagatttggacttgacggcaagggtgacagaacgttgggagaaattgctgggaatttgaatatatctagggaaatggttagaaagcacgaagtcaaggctcttatgaagctcaaccattcagctcgattggattatcttcgccgttatgttgtataa

SEQ ID NO: 24473 - DNA, 1029 bp, Glycine max
  Peptide Sequence Number=SeqID_141251
atggacgatagcttatgcgatattttcgatgacaaagagtttgggagcgaacactttggtggggacgatctctttgccattttggagagcctagaatcggacttcaccgacttccctcctcccattaacgaagaagctgttgttgctgctgtctccaaagacaataacgaggatgtctcaagattggtgtctcaaaagtcaacctcttcgagtgctccacttgattccgaaactgagcttgaaacctcttccaaaaccaagaggcagaagcttactcctactactccagaggaagctaacccagatggacaacaaaagatgtctcatattactgttgaacgcaacaggagaaagcaaatgaatgaacacttgaccgtgttgaggtcgcttatgccttgcttttatgtcaaaaggggagatcaagcatcgataattggaggagtggttgattacatcagcgagttgcagcaggtgctccaagccctagaggccaagaagcaaagaaaagtctacagcgaagtcctgagccctaggctcgtttcaagcccaaggccttcaccactgagtcctcggaagccccctttaagcccgagactgaacttgccaattagcccaagaactccacaaccaggaagcccttacaggccaaggttgcaggcgcagcaaggctacaacaacatcatttcaccaaccatgtccaacgtctctctcgacccttctcccacttcttctgccaactcctccatcaacgacaacatcaacgagcttgttgcaaactccaagtcccccactgctgacgtggaggtcaagttttcaggtcctcacgttcttctcaaaacggtgtctcaacgaattccagggcaggctatgaagattataacggcacttgaagatcttgcgctcgaaatcgttcatgtcaacattaactgtgctgcggatgataccatgctaaactcattcactatcaaggtagtgtccggttcaagtgaaagttcagagaagaaagtgagagtgtggaaagagggctga

SEQ ID NO: 24474 - DNA, 357 bp, Glycine max
  Peptide Sequence Number=SeqID_141252
atgtgtgctaatacacatgatgtaacagaggacaaagtggagaaatatgcacggcatctccgtgtctacgatgattcgtttgcaaatttgaagcaccattcactctctctgctatgcggggtcactgtggacatgcaaatcatgcaatcacaatacctccggcgggttcgtaggaagtttctccagattctaatacatgcatatgaagtagcatggaaaattctgcttcagaaaaagctggttattggaactggattatgtcatggccttgttcttacatatacatgtcctgtatgcattgactttgaaatctttcgactccttgcagaggtttcccggtatgttcctctgttctaa

SEQ ID NO: 24475 - DNA, 654 bp, Glycine max
  Peptide Sequence Number=SeqID_141253
atgagtgaggtacacgggagaaacttcacgctagcgaggattaaagtagaaggccaacgtcgtcacacaacctgtgaaaaaggtttccctgacaacaacgttggaaggtacaacggtaacgacgcggaacaagtaatcataataatatcaaatggtgtggaagagggtcaatcagaaggattaaaagaaaggccatcttttgcatgtgccacttggcctctgacacaaacttttctcttcggaaccaatcatttttcatcaacttcagcttttacacaacacttcatttacacttttgtgcttagcttcatcaacatggacaacatgggtgacccaaagagcatcatacatgagctgctacaaggtttggaattggcaaggcaactccaagtgtatctccacctgccaacttcgtcccaagaaacacgtgacctactgatccagaagatcatatcaacatttgaaaaagcacttgaaatggtaaattgtaaagggccagtgccagcgggtgagtcatcacattatcccctaggggctgcattaatccgagtgtcagattcacctttgagcagtagtccccgcagtgaagactctgatagagatttcaaggaccaggaccccaatgctttcaaaaagaggtatgtatggttctaa

SEQ ID NO: 24476 - DNA, 241 bp, Glycine max
  Peptide Sequence Number=SeqID_141254
ggtggtgcaagggagacgcacgcagagcctttgtgactatgaagcacggacactccagtctcttgtcgtgtgtccacgtgtccatgttcgtgtcgtatccgatgtccgtgtcgatcacgcggtgacaacatggagggtggctcctgcacatggtgatggtgctagttggtgcgacacatgcaggttggaggaggtggttcaggtgccggtgcctgtgtgcgatgcggagaagatggagtag

SEQ ID NO: 24477 - DNA, 288 bp, Glycine max
  Peptide Sequence Number=SeqID_141255
atgattgataagaaacctacaagaaaaggactgaatccagcaaccagaagtggaaatacttacagaaatattccatcctctagaacagtgatgttggagacagaagaagatcccaacatgacagaatttgaatgtgttgatgaatatttggaaggaaataaatccttgctaagatccttgcgtagtatggtgggtattatctctaaaagatctttgaagttatggggaatggtgaaagaaaggaaggtgattgtggagcctggtgtcaggcatagaatccgtttgtaa

SEQ ID NO: 24478 - DNA, 345 bp, Glycine max
  Peptide Sequence Number=SeqID_141256
atgacgctatcattcgcaaaatccacaagatcatgctcgagcgcttatttaacagaggcaaaaacggttaaagatggcaaggaagcagtggatctgtgtcgttctggggaaaattttgacataattttcatggacaaagaaatgcctatcatggatggtcacgaggcgacaaaacatctaagtgctatgggtgtgaagagcatcattgtgggaatcactacccgtgctgatggaaaagataaagaggaatttctagcttctggatcgaaccactgctttgagaagcctcttgaccaagcaaaggttgaacaagtcttgcaagagcatgagaattttggcatttga

SEQ ID NO: 24479 - DNA, 1278 bp, Glycine max
  Peptide Sequence Number=SeqID_141257
atgttggaggttaaaaaggagctcaacgatttcaattttgattcacggcttccagatggactcaatttatgtttttcttcttctcccaattgcaacaccgatacctttcttcaggaatcaaccccaattgcagggacaacaaaagcacgagctagacgctggacagaagaagagctaacctggttgccaaattggtcctttgcagctgcatacctccctgggcgaactgacgtccaatgtttgcatcgctggcaaaaggttttaaatcctgatcttgtaaagggttcatggacaaagaaggaagatgatcgcctcattgaactggtcagaaagtatggtatcaagagatggttttttattgcaaaatacttgccaggtcgtattggaaagcaatgccgagagaggtggcacaatcatcttgatccaaccgtaaagaaggatgcatggacagaggaggaggaactaatacttgcttactattaccaaatatacggcagtaagtgggcagaaattgcaaggattcttcccggaaggactgacaatgctataaaaaatcattggaactgctcaatgaagaagaaattggatgcatcacccttagggtgtgacataaaagttgcctcttccggtttctgtgcttctggaataaggcctgaacatgttgtggctaaagtggagggtcaaagtttcaatggaatggtttctcccaagcagagtcactggttgaatcgcagtgttgataacattctaacaaaattgattcttcaaaatgattcaggagaggaatcttgctctgcttcatccagggggactcctactcctagggcctcaagacagtttttggataattctctggattgtttacctctttccagtactgttacagatgaggcctatgagtcactgaaacggcaaaaggtttatttttcagatacagagcttaaagtgggtgatgaatctgacagtccccttttgaatttgagctactcaaaatctgccaaccgtgagaagaaaggtcaagctggaaatggaggcaattacaactcaaacaacactatgccacatagtgtagatgaattcagtgaatgtctaagtccaaaaacacacatggcattggcatgtgcatacaataacggttgtactcccccaacgtctatactcaagaatgacacaggcgacatcaacccagaaactttgctaagaaacttagcaatgacctatgagaatgttccttctattataaggaaaaggacacccaagaaaggcaagctgttgtga

SEQ ID NO: 24480 - DNA, 1011 bp, Glycine max
  Peptide Sequence Number=SeqID_141258
atgggaaaaccccgagatgagaagtccgaagcaaccaatacacatatcagcagtagcacaataggcaattctaaacaggctatagagaaatcaaatgaacatcctgaatggttacctggtggctggaatgtgtggacttcagaaaactcgaaaaagtggtgcaaatatgggtcatggtgttacattgctccaagtggacacaaattctactccaaaccagaggtgttacgatatctcgagactgtaaacagctacagtcacacttccaagaaggaaaagatatgcaaaagcaatgtttttgaggattcagttgataatggacatgctaggatttctgaaactgatatatctcccaaaaataagttggctgagaatgttacaggaatcagcaatgacaaaaactcacgtgtaaattcaaagaaatccaagaacaagaaagagcttacaatgcctaggcggttgtcacagcgacttgctggccatgaacctgaggtactgcttactgaaaaagctattaaatatgccactagaaaattctgcaatgacaagccagctactactgagattttaactaatggagtgtctgggcatcttcatatccgggaagaatccaagcttgttctgcaggcatctgacaggttgaaaacattatatggtgaatcatcaagcaagagtgacaagtcatatgatccccaaactgttcccaatgaacaactgcagaggcttgaagctgaaaatgttgctgatgacagatcagatccactgttccccacaccttttggggactggtcacatccgtgcctagaatttgaaattgagactctttctggtgcgttgctagttgatgctcccactgccactgctgctgctggcattttgcctgttatgactcctgatgttaatgccccagcaaataaggaattacttgataaccccaaccaatcccagaccaagaaagagtttagtactgtttgcaagccatcgaacaaattctggaccagttcgagttga

SEQ ID NO: 24481 - DNA, 1170 bp, Glycine max
  Peptide Sequence Number=SeqID_141259
atggctgtacccgtcgaggaagccattgcagctctatccacattctcgctcgaggatgagcaaccagaggtgcagggacctggagtgtgggtgtcaactgagagaggtgcaacagaaagtccaatagagtatagcgatgtttctgcttacagactatctctatcagaggacacaaaagctctcaatcagctgaatgcccttacccaagagggaaaggagatggcatcggtgctttacacatatcgcagttgtgtcaaagcccttcctcagttagctgctgacatgcaacgtttttctaggcctgagcgacgcattaatggtcctacaatatctcatttgtggtctatgttgaagttgcttgatgttttggtgcaacttgatcatcttaaaaatgctaaggctagcatacctaatgacttttcatggtataaaaggactttcacacaagtcagtggtcagtggcaagacactgattcaatgagggaggaattagatgatttgcagattttcttgagcacaagatgggctattttgttgaatttgcatgttgagatgttccgtgtgaacaagtatccttctttagaattggactttgcacttctctttccagagcgccacattcttttgcgtgttttgcctgttcttgttgtcctagtgacatcatcagagaaagacagcgagtctctgtataagaggaatgaagcagtcattcctgcatttccagatctgcatttgtctcctgctgcaatattgaaggaattatcaacatactttccaaaattttcttcccaaactcgtcttctcacccttccagcacctcatgagcttccacctcccatccgtgctgagcatgatgattttgttattcgttttgcttctgcaatgaatcagctgttactgttgaagtcaactgatggttctgatgttgaatggagcaaagaagtcaaggggaacatgtatgatatgattgttgaaggttttcagctattaagcagatggactgcacgcatatgggaacaatgtgcttggaaattttctcgaccatgcaaagatgcatccccatcattctctgactatgaaaaggccctaattaagggtttagcctctcatggccataagggaccttacactagaaaagggatatgggaactaatgaaggagaagggatga

SEQ ID NO: 24482 - DNA, 1275 bp, Glycine max
  Peptide Sequence Number=SeqID_141260
atggtgctcgcagcgactgtcgcaacattgacagatcttggtttcttatggtttagagaattctatttagagtcttcacgagtcattcagtttccaattgaatgctctcttccctggatgttggtggattgtgtacttgagtcaccaaattctggtcttctcgagagtgttctgatgccatttgacatctataatgattcagctcagcaagccttggtgttgctgaagcaacgatttctatacgatgaaattgaggctgaggtggatcattgttttgatatatttgttacaaaattgtgtgaaaccattttcacatattacaaaagttgggcggcaagtgaattgcttgatccttccttcctctttgcttcagacaatgcagaaaagtatgctgtgcaacccataaggctcaatatgctgcttaaaataactagagtgaagctgcttggaaggatgattaatttgcgaagtttgatcactgaatggatgaacaaggttttccgtgaaaatattgagtttctatttggtcgttttgagtgtcaggatctgtgtgccatagtggaattagagaagctgttggatgtcttaaaacattcacatgaactactgtctagagatctttctgtagactcttttagtctcatgttgaacgagatgcaagagaacatttcccttgtatcattttctagtcgacttgcctcacagatttggtctgagatgcaaagtgattttttgccaaatttcattctctgcaatactactcaacgttttatcagatcatcaaggactgttcctgttcaaaagccatcagtaccctctgtgaagcctagtttctattgtggtactcaagatttgaattctgcccatcaaagttttgcacgactgcatagtggattctttggaatacctcacatgttttctgttgttcgacttctgggatcccgatcattaccttggcttattagagcccttcttgatcacatatcaaacaagattactttgcttgaaccaatgattacaggattacaagactctttgccaaaatcaattgggcttcttccttttgatggaggtgtgacaggttgcgtgagactcgttaaggagcatcttaactgggagacaaaatcagagctgaaagctgaggttcttcatggcataaaagagattggaagtgtattatattggatggggcttctagatattgtgttggtcagtaacatagtgcaataccaatttatttattgcaattggcatcaacataagttcaagacttaa

SEQ ID NO: 24483 - DNA, 1293 bp, Glycine max
  Peptide Sequence Number=SeqID_141261
atggcatcggaattgaaggagaagttgcgcgaattggtgaaggccatcgtggactccgacgactactctcttcaagccgccgacgaagccatcgccacactttcgtctctcaaacatttgaagtcgccggacgactttcctcttcctccccaatttcgctgccccatttcaacccaattgatgtccgatcccgttatcttatccaccggccagacttatgataggccatttattcagaggtggttgaatgagggtcaccgaacatgtcctcagacacagcaggttctgtctcacactattctaactcccaattacttggtccgagacatgattctccagtggtgtagggaccgtggaattgacttacctggccctgttaaggacattgatgaagctgtcaccaatgcggatagaaaccatttgaattctttgcttcgtaagttgcagttgtctgttcctgatcagaaagaagctgccaaggagcttcgccttttgacaaagcgaatgccttccattcgaacccttgttggggagtccagtgatgtcattccgcagttgctgagtccgttatcgtcgcccggtgcggcttctactgatcctgatctccacgaggacttgatcaccactattctgaatctctcaatccatgatgataataagaaggtgttcgccacggatcctgcggtgatttctctgcttattgatgccctgaaatgtggaacaattcaaacaaggagtaatgccgcggccactattttcaccttgtctgcgattgattccaacaagcacatcattggagaatctggggctattaaacatttgcttgagcttttggatgagggacaaccattcgccatgaaagatgctgcttcggccatatttaacctttgtcttgtgcacgagaataaggggaggaccgttcgagatggggcagttcgggttattctgaacaagatgatggaccacatactagttgatgagttgttggctatattggcactgctctccagccatcctaaggctgttgaagaaatgggtgattttgatgctgttcctttgttattggggattattagggagagcacatctgagaggagcaaggaaaattgtgttgcaattctatatacaatctgttttagtgatagaacaaagttaaaggaaattagagaagaagaaaaggccaatggtacactgtcaaagcttgcaaaatgtggaacttcaagggcaaaaaggaaggctaatggtattctcgagaggcttaatagatccccctccttaactcacactgcttag

SEQ ID NO: 24484 - DNA, 357 bp, Glycine max
  Peptide Sequence Number=SeqID_141262
atgggtgtgaggaaaaggtgggagtgttggtcgacgaggtgtttgtctgcgcatggaggtgagagggtagtggggtttggcgaggtgcgtgagaaatcgggaagaagatcagaacgtcattggtggtgggtgataggcgaggatcactgtgagcatcggaaggggggatttttcaatgctattatgagtttcccatccaattacccaaatagtccaccttcagtgaagttcacctcagagatatggcaccccaatgtatatcctgatggccgggtttgcatatcaattcttcatcctcctggtgaggatccaaatggttatgagcttgcaagtgagcgctggacacctgttcatacg

SEQ ID NO: 24485 - DNA, 240 bp, Glycine max
  Peptide Sequence Number=SeqID_141263
atgcggagtcttcctccagaagctaaatggttaggccgcaatccaaaatgttgtgtgcttgtcgtcgtaattaaaatacatgtcgccgcaacattcacttcgtcaccgtggattcaaatcctcgttcacgcaaacacctccacgcacagaagtgtatctgatgacactgtcaagcctcgctctcgtgattttcgtaatcgaagatcgggtgtgagagagaatgaaggacctactgtgtga

SEQ ID NO: 24486 - DNA, 264 bp, Glycine max
  Peptide Sequence Number=SeqID_141264
atggtaaagctcgtggttgaacatgcaggatttgttacatcaaaagtagcatgttgcggtcaaggaccctacaatggtcttggactgtgcactccggcatccaacttgtgccctaaccgtgacagttatgcgttttgggatcctttccatccaacagaaagggctaataggataatcgttcaacagattttgtcaggcacctcagagtatatgtacccaatgaatctcagcaccattatggctttggattcgtctaagaactag

SEQ ID NO: 24487 - DNA, 285 bp, Glycine max
  Peptide Sequence Number=SeqID_141265
atgacgaaggaagtgatccatgatcataactttacagcgcctcgactccaatattcctcttctccttcttcttttgcgttttctctctggtatctcctcgcccaggtgagctgtagctcgcccaggcaagttgcttgcttagggctgaagttacatcttagcccaggcgagctggatgctagccagggcgaatttagggtaagaaatcttcatgaaaatatcattttgcccttccttgtggctttgtttttggatctaacaaacaaccatcaaaaccctgagtga

SEQ ID NO: 24488 - DNA, 135 bp, Glycine max
  Peptide Sequence Number=SeqID_141266
atggtatttcttaatcatgcacgagttgtattgagtttactcggagtgcagctggaggaggggtggtacggagagttaagggaggtcgtagctggaggaggaggaggggagagagaggagattgagaggccatag

SEQ ID NO: 24489 - DNA, 1782 bp, Glycine max
  Peptide Sequence Number=SeqID_141267
atggatagaagagaaaaaggtgagaaaagggtagaagggttaatggtggaaaagttgaaaggaggggttgttgtagggaaaagaggaggaccttctactcccccacccacatggagacttgagtttccatctcagcagaatgagaataacaaaaacaaaaacagaaaccaggttcaagagttccttaactttcccacctcaacaacactctctaccagaacactctgtgccaaactctggcaaattcagccccaccaattggccccacttcccaaaatgaacaagccttcaaccctccgccgccaccgtagggacacacttcttaagcttccaaatcttaaacagttgtctgaacctcctcatactcaccagccagcatctgcaatcggactgagaaggcatgttcaaacatcacctttccagcaccatagatcagctaaaagaaatggtcgccttaaacagcatgtctcccctccttgttacagttgctcaatgcaagtggcacctcatgtaacatctaaaagttccttagacttcaagggttggattacagagtcaagtcgcaaccctaaaacattcagagagttactcaaggtactcaaccgtatttggtgtcttgaagaacagcatgcatcaaatatattaatagtgaaagccctgaaaatggaactagatctttctcgggcccaggttaaagagttacaacaagaaaagcaattgaataagcgtgatatggagaacttaatgaagcaaatagccgaggagaagcttgttaggaagaacatagaacatgataaaattaaagctgcaattcaatctgccatgcaagagatagaagaagaaaggaggttaagaaagcattcagaaagccagcaccggaggctggctcgggagttttctgaagtgaagtcttcattcagtggttctctgagagatcttgaaaaagagagaaaaacacgggtccttttagagaatctgtgtgacgattttgccaaaggaataagagattatgaatatgaggtaggttctcttatggataataatgctgagaaggatcaagttaaaggggatagccttgataggctaatacttcatctttcagaagcttggcttgacgagcgcaagcaaatgaagttagctctagctggccatgatgatctcccagagatagattcatcaattgttgacaggctaggtgttggtactgaaacatttcttcatgcaaaaagatgtgttaacttgataaaatatggtaactcctccacaaaggagcccaaggaaatttacccttgcctactacattcattggacgagaacaacaacaatactgcagaggtccataaagaaaagaagggaaggaacaattcagtgaggaaacaagcacgtgtgaatgtgatgaagagcatgttgtcatgtgatgaaaatgagagttggtttgttgaaatgggaggggagagcacagcactattcaatacccctggagcatcaactgtgggtgagacaacaacacaaggtccaccagaaagtaatacattattatggacaaagagaatgaattcaagtcatgtagttagaaacagttccttgtcttctgaaggcaatgataaggtttatcctgagaccattttcagggaagattcatttgtccattctgcagttactggtaatgctagtccactaaaggacaacaacaacacattgatggcaaaactgcttgaagcaaggttggagaggcagatatctcgctccaaacataggaatgtcaacggtatcacactctga

SEQ ID NO: 24490 - DNA, 1143 bp, Glycine max
  Peptide Sequence Number=SeqID_141268
atgattccaaaggtatctgccgatttctttgtcattgtcacaattgtgttgctttgcttgttcagtttaagtcacagtgaatgtaatttcaaggcaattttcaactttggggattcaaattcagatacaggtggtttttatgctgcttttcctggtgagtctggcccttatggaatgacttactttaagaaaccagcaggcagggcttcagacggaagactcattattgattttcttgctcaagctcttggattgccatttttgagtccatatctgcaatcaattggatctgattataaacatggggccaactatgctacaatggcatccaccgtgcttatgcctaatacttctttgtttgtcactggtatcagtcctttttcccttgctatccaactcaaccaaatgaagcaattcaaaaccaaagttgaggaaaaagttgagcaaggaatcaaacttccttcatcagacatatttggaaattctctttacacattctacattggccaaaatgattttactttcaacttagcagtcattggcgtaggtggagtacaagagtacctccctcaagttgtttcacaaattgttgccaccattaaggagctatataatcttggaggacgtacatttatggttcttaatcttgcaccagttgggtgttaccctgcattcttggtggagtttcctcatgatagttcaaacattgatgattttggatgtttgatttcttacaacaatgcggtactgaactataataacatgttgaaagagacattgaagcaaaccagagaaagtctttctgatgcttctgtcatctatgtggacacccattctgtcttgttggagcttttccaacatcccacttctcatgggcttcaatatggtacaaaagcgtgttgtggatacggagggggtgactacaacttcgatccaaaagtttcttgcggcaataccaaagagataaatggaagcataatgccagctacaacctgtaatgatccctacaactatgtcagttgggatgggatccattccacagaagctgcaaacaagcttattacctttgccattctcaatggatctttttctgatccccctttcatatttcaggaacactgtgatcttcaacctataggttga

SEQ ID NO: 24491 - DNA, 1251 bp, Glycine max
  Peptide Sequence Number=SeqID_141269
atggcaggagaaacatcttggatcagccactatgatgacagacaaagggagactggggcgtttgattcatttttagaacttagtgaggaaggtgaaaaagaagcaactgctgtttctttggatgttttgccggatgacttgttggagcgaattctagcctatctccccattgcaagcatttttagagctggctgtgtgtctaagaggtggcatgaaattgttaactcagagaggtttgtatggaacctttcacatgttctaccgcagaaaccttggtactttatgtttacaagctctgatgaaccaggaggtcatgcttttgatcccctccttcggaaatggtatagcattgaacttccatgcattggaacttctaattggttcattgcttcatcatatggcatggtctgcttcatggacaatgacagcagaagtgaattatgcatctgcaacccaattaccaaaacctacaggaagcttgaggagcctccaggtttgaaattttctgattacagtgcattagcaatctcagtgaacagggaatctcaccgttatactgtggcaattgtaaaatctaaacaagtccccgacaactatgtccagtgggatatctcaattcatctatacaattcagaaaatgcaatctgggtgacgtctttaacagaagttttgatggggtggagaggtggtaatgagagtgtgatatgcaatgagatgctgtactttttagtttattcaactgggggtggtcaatcagaaaaccgtcatgccctagttgcgtataacatgtccaatcattcatctcaaggtagtttaacaaggaacttcattccggtaccttgttctctaacatgtggccgtttgatgaatctgaaggagaagcttgtaatggtgggaggaattggtaaaccagatcgacctgacataataaaaggaattggtatctggcttctaaatgataagaagtgggaagagattgctcgaatgccccacaaattcttccaaggctttggagagttagatgatgtgtttgctagcagcggtgcagatgatctgatatatattcagagttatggagctccggcgcttctcatatttgacgtgaaccataaacaatggaaatgcggtgtcaacactcaagtcattgcttacagcgagaccatcgacattgctgtggagaattgcttgcatcgatttgcaaagctcttgtcactttccaatgatcctagccctggatataacattcattga

SEQ ID NO: 24492 - DNA, 411 bp, Glycine max
  Peptide Sequence Number=SeqID_141270
aacacaatcattgatgagcgtggttcatttgctgtgagcagcccctatccagtaccagcacggattgctttatctggggatgttcttcctcttaaagaagataaggctaagtctcttgcagaaaaacttcaggaagtcatactatctgagaaaaaagcaatcaaagagttcacttgcactgtttctggtgtactaagttctagtgctagtagcagtacatcacaaagtgataatcttcaggatctattgggagacaatgaaagatacacaatatatagatttaaaacgagatcttgcacatttgttgatggcctcggaggcacctttgatgtggatattgaagatttggaaacatccaaagctgatccattagcatcattttcagcaaagattgttgatgggatttgttaa

SEQ ID NO: 24493 - DNA, 300 bp, Glycine max
  Peptide Sequence Number=SeqID_141271
atggttccgtcgcgcattttcgaatcatcgaagaagaaagagaaagccaaaagcacaaatccgtacaaaaaccatggcagaagaacactgatggcaaccctccaaccaccaccggagaatgcatatccttacactacacaacaacaaaagagagagatgaaggcagggaggctcaccgtgagtggtggtggtggttcgccggataatgttggcgcaagtgtttctcctaattcagtcattttcaggataggaatgatatgcacttatgatgtatacagaaatgaaaactttactacttaa

SEQ ID NO: 24494 - DNA, 840 bp, Glycine max
  Peptide Sequence Number=SeqID_141272
atggtcgaaaacaatccagcaagggtttttggttcttctatgtttctatgtttgcttgtgttgatcacttggaacaacattgttgttgttgttccacaagctgaggctcgagcattctttgtttttggtgattcgctagttgacaatggcaacaataactacctattcaccactgctcgtgccgactcatatccttatggaattgactatcccactcacagggccactggccgtttctctaatggcctcaatatcccggacattatcagtgagaaaattgggtcagaacccacactgccgtatctaagtcgcgagctcgatggagagaggctactcgttggtgccaattttgcttctgctgggataggaattctcaatgacactggaattcagttttggatgcagaggctttatgagttgggagcaaggcgagttttggtgactggaacgggacctttaggttgcgtgcctgcagaactggcgcagcgtagcagaaatggggagtgtgcagcagagctgcaagaagcttctgctttgttcaatccacaactcgttcagttggtgaatcaactcaactctgaaattggttcggttgtcttcatttcagccaatgctttcgaatccaatatggattttattagtaacccacaagcgtacgaaggccaaccgccaacctcccacagtaggtacgctattcagtattcacccaatggagatatgggactccaaatacatgcacccaatgaatctcagtaccgtgttgcttttggatgcaacttcaaggacctagctaattattatcttcttcctgttagggtcgtggcatacattctgcactag

SEQ ID NO: 24495 - DNA, 501 bp, Glycine max
  Peptide Sequence Number=SeqID_141273
atggcagagaccattcgcttgggtgttgctgttcttggcaatgcagcctcagttgccctttatgctgcaccaatggttacctttagaagagttataaggaagaaaagcacagaggagttttcatgctttccttacatcattggcctcttgaactgtctccttttcacttggtacggtttgcctattgttagctacaagtgggaaaatttccctcttgtcacagttaatggagttggtattcttctcgagttatcctatgttctcatttacttctggtatgcttcagccaaaggaaaggtgaaggtagccatgactgcaataccagttttgcttgtgttctccataattgctgcagtatcagcttttgcattccatgataatcatcaccgaaagcttctcgtaggtagcatcggtttaggtgtttcagtagcaatgtatggatcccctttgattgtaatgttattactaaaagggtataatattcttggtgtcaaatggtaa

SEQ ID NO: 24496 - DNA, 156 bp, Glycine max
  Peptide Sequence Number=SeqID_141274
atgactagagccagattttcctctcggttttcagccatcgacagagtgacacgtcacaagattagggagttagacgatgccaagatgggggtcaaaatggaggcccctagtttgattggtcacagtgcaggtttaaatatgtgtttagttatttaa

SEQ ID NO: 24497 - DNA, 268 bp, Glycine max
  Peptide Sequence Number=SeqID_141275
atggccgctaggggagggcagtgcttggagaagcttcggaggtttgttcggacggtattcttcgtggcggcattggtggcgtcgctgcttgtgacgtcgctgccggtgctcgtcgccgttgtggacgtgctcgtcccttgcgttttgatttcgagcttctcatgcgtcaagtgctacggcttcaaggagcatttacgacgttacgctttcaagagctccttgacggatattcctctcgtttcggtcataagatccttcatcattatct

SEQ ID NO: 24498 - DNA, 1496 bp, Glycine max
  Peptide Sequence Number=SeqID_141276
gtgtttattccatttgtgatggtcctgctctatcacatggtccttaccttggaactgtgactctgtcttcctttgtttcaattgttctcctttcagtcaaagcttgtgttttcactgtaaattcccagattgaagcagaagctacggtttcccctacaaggcagagacttcatttaaagaagtcatggggaatgcctgtcttgttcctctcgtcagttgcgtttgctctaggccatattgtggttgcctacagaaccagctttagagcaaggaggaaactcatgtttcatcgagttgaccctgaagcggtcctttcatgcaaaaatgtttttactggctatcagaaggtccctcggtctcctgttccctctgaggggagaaccccaaaaagtgacagtgaaatgaaaaggaggccttttggagcagctcatgatgaagaactgccaatcagaatacttgcagacccggagagcttattcatcccctgccaaggtcttactctccattacaagctcagcctacctggttcacctccacttaacatatcctcagcattttgctccacttcatcaatggctggggggttgtcaaaattaaatagacaattgacttttatacctccaaaagtccatcagcaactctacaggagctatagcaatcaattccatggctcatctttgtatgctcctcttttagatggtccagtaacttctccccatcttactgaagatatccctgttttgcatctagatgaaattcatgaagatgaggaaacatataaatcagagttggagcaaaattcagaggacattggccaagtaggtattgttttaatacatgggtttggtggaggtgtcttctcttggcgacatgtaatgggacctctagctcggcagagtaattgcacagttgctgcatttgataggcctggttggggattgacttcaagactgagtcaggaggactgggagaaaaaagaactgcctaatccttataaacttgaaagtcaggttgatctgcttttgtctttctgttccgagattggattttcttcagttgtgctaattggtcatgatgatggagggttgcttgctctgatggctgcaaagagggttcaaacatcaatgaattctttcaacgttacagtgaaaggggttgtattgttaaatgttagcttgtcaagggaagtagttccatcctttgctagaatccttctgcatacttcacttggaaagaaacatttggttcgtccactactaagaacagaaatcacccacgtggtgaatcggcgttcgtggtatgatgctaccaaactgacaacagaagttttgactctatataaggctccactatatgtagaaggatgggatgaagcactgcacgagattggtaaattgtcatcggaaaccttcctttctgcaataaatgcagacttgttgctacaagctgtaaaagacattcccgtgttggtcatagccggtgctgaagattcactt

SEQ ID NO: 24499 - DNA, 216 bp, Glycine max
  Peptide Sequence Number=SeqID_141277
atgggtgcatcttccaagaaaggaaaatgcacggagtcgccaccaacatttattcgaggaaaacgtcgaaaaaatcggaaaagacgtggtctacgaactttaagtgcgaaaggttcgggagttgtatttatgcatggggaagggtgtttctcttgctcctacgtattccttaattgtgataaggaaataagacctacgcagttctttgggaactaa

SEQ ID NO: 24500 - DNA, 642 bp, Glycine max
  Peptide Sequence Number=SeqID_141278
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatcgacaagcatctggtgatcttcgccctgctggattcgccgcgtgccaccggcgcctatcgcctgatcctgcgccctggcaccgacaccgtggtcgacgtcaagtcccagatgttcctgcgcgacaaggtcagcaagctgggcgttgccccgttgacctcgatgttcctgttcggcgcgaaccagcatcaagcttatcgataccgtcgacctcgagggggggcccggtaccagcttttgttccctttagtgagggttaa

SEQ ID NO: 24501 - DNA, 2921 bp, Glycine max
  Peptide Sequence Number=SeqID_141279
tgattctgatatttctttggaccctcaagttccgttcattccatctgttgaggtgttggtaaaggctctgcttattatgtcaccagcagctctgaaacatgctccagaatcatttttcagaataatactttgctcacatcacccgtgtgtagttggtggtgcaaaaattgatgcagtgtggaagaggctctccaagtgtctgcagacacagggttttgttgtcattgatgtcatttcagctaacgtggggaatttcttacaggtcttactgggaccaatgggcttgaagagtgctaatccactagaacaacaggcagcgatattgtcactgtgtaacttgatgtctataatccctggagatacatatatagagtttgaaaagaatttgctaaatcttcccgagcggtttgctcatgatacacttttggagaatgacattcagatcttccttacgcctgaaggaatgctttccactgagcaaggggtttatgttgctgaatctgttactgcaaagaacacaaaacaagcaaagggtcgcttccggatgtatgacgatgaagatggcgaggatcatacacgttctaatcattctgtgaggagagatcaacctagtagagaagctgctggtgcagggaaaaaggatactgggaaggctgcaaagaaggctggcaattcacctaagctgctttttacttatgatgttattgtgattcatttagacaaagggaagacggcaaaggaggaggcaagagaattgctacttaaggaggaggcttctgtacgtgatagagtccgtgaaatacagaaaaatctgtctctgatgctaagaactcttggagatatggccatcgctaattcagtttttgctcatagtaggctgccttcaatggtcaagtttgtcgaaccattaatgcgatcgcctattgtaagtgatgaggcttttgaaaccatggtgaagttagcaagatgcactgctccccctctatgtgattgggcccttgacatttccactgctttgcgcttaattgtgactgatgaagttcatcttctgttggatctagttccatcagttactgaagaggaattcaatgaaaggccacatggcctttttgagcggattttagatggcctatctatttcttgcaaatcaggagcacttcctgtactttaccatgtactcggtgttgttccagcgtatcaagcatcgataggacctgcactaaatgagctgagtcttggtttgcaacctgctgaagttgcttctgcactttatggagtttatgcaaaagatgttcatgtaagaatggcatgcttgaatgcggtcaaatgtatccctgctgttgctaatcgttctctacctgaaaacgttgaggttgcaacaagtatatggatagcattacatgatcctgagaagtcagttgctcaagtggcagaagacatatgggatcattatgggtttgattttggaactgacttttcgggactttacaaagcactttctcacattaactacaatgttcgtgtggcagctgcagaagcattagctgctgccttggatgaacatccagattctatacaagagtccctttccactttattttcgctgtatattctggacatgggtgttggagatgacaatgttgatgctggttggctgggtaggcaaggaatagctttagcattacatgctgccgccgatattttgaggacaaaagacttacctgttgtcatgacatttctaatttcgagagcactggctgatctgaatgctgatgttagaggcagaatgattaatgctggtatattgatcattgataaaaatggaaaagataatgtctccttgttattccccatctttgagaactacttaaacaaaactgctccagacgaagaaaaatatgacttggttcgtgagggtgtggttatcttcactggagctctggcaaaacacttggcaaaggatgatcctaaggttcatgctgttgtggacaaattgttggatgttttaaatactccttctgaagcagttcaaagggcagtctctgcgtgcttatctccattaatgcaatcaaaacaagatgatgcagcagctctttttaatcggctgatggatcaaatgatgaaaagtgaaaaatatggagaacggcgtggggctgcttttggacttgcaggattggttaagggatttggtatctcctgcttgaaaaagtataggattgtgattacacttcaagaaagtcttgctgaaaggaattctgcaaaatctcgtgaaggagctttacttggatttgaatgcctttgtgaaacacttggaagaatatttgaaccgtatgtgattcagatgttaccactacttttggtttcgttctctgatcaagttaatgcagtcagggaagcagctgaatgtgctgcccgtgcaatgatgtctcaacttagtgctcaaggagtgaagcttgtccttccatctctcttgaaggagaatttatgtttgcttcctacttatagaattatcatttactatgcttctatttcaatgaactatttcatagctaatctatttgctcagggtcttgaagataaagcttggaggacaaaacaaagtagtgtacaattacttggtgctatggcatactgtgctcctcaacagttgtctcagtgtctccctaagattgttcccaaattgactgaggttttgactgatacacatcctaaagtccagtcagctgggcaaatggcccttcaacaggttgggagtgtgataaagaatccagaaatatctgctcttgtccctactctacttaagggacttagtgatcctaatgagcatacaaaatactcccttgatattcttcttcaaacaacctttgttaattcaattgatgccccttcacttgcattattggtaccgatagtacatagag

SEQ ID NO: 24502 - DNA, 645 bp, Glycine max
  Peptide Sequence Number=SeqID_141280
atgacccatgaacaagttcagtctcaaagtggaaaggaatttgttttcaaaccctttggagaagatggcaccgatgcagaatacatgaggcaacaggacctgttactgttaggccctccaagattcttgttcaccatagtagaagaatcaaaagaagatttagaatctgatgatggcaaatccaagtgtgacaagagtggaaaaggttcaaggggtagaagcttgggtgatttactagttgtggagacaccatatatgacacctacaacttctccacctttcttcactcctcctttcactactcctatcagtccctataaccaacgtggattcaaccctctatttgaaacagcaactgatgctgagttcaacaaattaaagtcctcacctcctccaaaattcaagttcttacaggaagcagaagagaagcttagaagaaaactacaagaagacgaaaataagggaaatggagatgaggttgatggttctttcatcacaatagtagttgacaagaaaacagaaagagaggttaatcaccagcctcgtccaccacagtatcattcaagcacttcacagttgtgtgcaaaagggacaggaaaaccaagaacaactttgaggaaagttgttaaaaaagatgttatgtaa

SEQ ID NO: 24503 - DNA, 135 bp, Glycine max
  Peptide Sequence Number=SeqID_141281
atggaggtcattttccacaaacagtctcacatgacacagcagtggttagacacgtcatctattgctagtgggtttcattatgagatcaatagtaacaacaataatcatattcctttgggttcaggtgaactctag

SEQ ID NO: 24504 - DNA, 1134 bp, Glycine max
  Peptide Sequence Number=SeqID_141282
atgaaatatttatttcttctccttgtcactttcaagattatgaagaggaagttcacacagctacgggagtctatggggtttcaaacatcgcatagcactaaacggataccacagccaattttcaaagcaaaggaggacttaattgatgcacatgaaaactcattaattcgaaggactacactgaacttgactgatcatacccaaaccaattccatgttcactctctctggctatgattcatgggtggtaaggcacccttctgcattgaactcgtttgataggttgatgaaagccgccagtgggaagaggatcatcgtttttttggactacgatggtaccttatcaccaattgttaatgaccctgatcgtgctttcatgtctgatgagatgcgtgcagctgtatatgaagttgctacttattttccaacagcaataattagtggaagaagcagagataaggtaaaaggtttcgtgaagttaaataatttatattatgctgggagccatggcatggacataatggcaccatcaatggcagttacatcttctgacggcaagcattttgacattgcccgtaacacaaatggcactgaagttccctttcaacctgcgaagaagtttttgccggcaattggagagataataagagtactaaagaatgaagtaaaggaaataaaaggagcaatggtagaggacaacggattctgcctctctgtacatttccgacaggtccaagaaaaggattatgatgttttggaagcgaaagtgaagtctgtgcttgaaaataatccagaattttgcctaacagagggtaaaaaggttatggaaataaggccatctataaagtggaacaaaggaaatgctgtagaatattttcttgacacattaggattaagcagttgcaatgatatccttccagtgtatattggcgatgatagaactgatgaagacgcttttaaggtcatacagagtagagagcaaggttatccaattatagtgtcttcaattccaagagaaactaacgctttatactctttgcgtgacccatctgaaattgtaaaaagggttccaagaaagaataacttctcatcttttgacatcaagaccttcatgataacatttcaaacgcagtaa

SEQ ID NO: 24505 - DNA, 978 bp, Glycine max
  Peptide Sequence Number=SeqID_141283
atgtttggaacttcttctgatgtatttgctgctaaaaccatgaacaataatgcacttgctaatagaggccaaagtcctacatattcatcaaatgaagctcatgacatgcatcactttcctgggttttattctacttcagaattttctcatttgcatagtgaagctccaacccaaaatactacttcaagtggttatcattatgactttcctgttgatgaggcaatgctgatgcatcaagaggagtttggttttcctaattctaatgaatatcagcaagcaccagtgaacgtgaattcaagtgatgtatcttttctaccaccacatgttttagcttcaggatacatgcatgaaaactcatttggggtgcttcatggaaactggattggccaatcaactataggcgctgacttgagtgagaacacaagtactgaatcaatcacttcaagagttcaagctcttcaagtaggtagggaactgccaatgaatgtgcctaattcatcagttcctgattacactcctgttcatgttgctcctcctggttcaagtcagagaggtgttgatgacaaaaaatttccaccagttgaaggtggttcctctggaccatcatttcaagttcctaccatgtccccattctacaatcttcctactgaaactactttcgcagacaccaattatgatatattgaatggtgactttgaaacacattatgcgaatcttcagtatggaaggttttgtaagaatccaaaatcactgccaatgcatttaagggaacaacttccatggcatgggaaacctaaaggtgccatcaacattgtggagcatgctcattccccagttcgagttatgccatctcaacgtgcttctcgcttgcatgggaatactaatgaaagtgctggtttttggcttccaaggtttagtgacgggactgggactttctttccaaagccttcaagttcttatcagcaggttaagatctaa

SEQ ID NO: 24506 - DNA, 1770 bp, Glycine max
  Peptide Sequence Number=SeqID_141284
atggatgatgaggacgatggacggcaacgcatggttcatgtgcaaaacagagagagatggaagaagaataaggttggactcgaagactcatgtggaaggtgtttgaagagtgcacatttcagtgtttgggtttgtgaaaggggcagtgatagtgaaagaatggtgcctcctgggccacccacgccgattggtggtgcccagcctgtgccgccgtctcttttgaggtcgaattcgggaatgttggggggccaagggggccctgtgccttcacaaacttcgttcccttcgctggtggcgcagcgaaaccagtttaacaacatgaatatgctagggaatatgtctaatgtgacttccttgctgaatcagtctttcccgaatggaattccaaattcagggcatggtggccctgggaacagccagcgcagcggaggcattgatgctagggcggaagcggatccactatctggtgttggcagtggaatgaattttggcaatcagttgcaatcaaatttgatgaaccctggttcatctggtcaaggtcagggtcaacagttttcaaatgcttctggtagtcagatgttgccagatcaacagcattcgcagcaacttgaacctcagaatttccaacaacatagtcagccatcaatgcaacagttctctgctcctttgaatgctcagcagcagcagcagcagcattttcagtccattcgaggagggatgggtggtgttgggcaggtgaagttggagtcgcaggtaaacaatgatcagtttgggcaccagcagcagttgccgtcaaggaatcttgctcaggtgaagttggaaccgcaacaacttcaaacattgagaaatatggcaccggtgaaactggagccccagcataatgatcagcagtttttgcatcagcaacaacagcagcagcagcagcatcaacaacaacaacagcaacaactgctccacatgtcaaggcaatcctctcaggctgctgctgctcagatgaatcatcttttgcagcagcagagacttttgcaatatcaacaacatcagcagcaacagcagcaactcctgaagacaatgcctcaacaacggtccccgctatcacagcagtttcaacagcaaaatatgcctatgaggtctcctgtgaaaccagcatatgaacccgggatgtgtgctaggcggctgacacattacatgtatcagcagcaacatagacctgaagataacaatattgaattctggaggaaatttgttgctgagtattttgctccaaatgccaaaaagaagtggtgtgtttccatgtatggaagtggcagacaaactactggagttttccctcaggatgtatggcactgtgaaatatgtaattgcaaacctgggcgtgggtttgaagcaactgctgaggttcttcccaggcttttcaaaataaaatatgaaagtggtactttggaagagctactttatgttgacatgcctcgggaatatcataattcctctggccagattgttctagattatgcaaaagcaatacaagaaagcgtttttgagcaacttcgtgttgttcgtgatggtcaacttcgaatagttttctctccagacctgaagatatgctcttgggaattttgtgctcgacgccatgaagagctcatccccagaagattgttaatacctcaggttagtcaacttggagtagttgctcaaaaataccaggcatttactcaaaatgcaacacccaatttatccgttccagagttacaaaataattgcaatctgtga

SEQ ID NO: 24507 - DNA, 288 bp, Glycine max
  Peptide Sequence Number=SeqID_141285
atggcaaaaatgctctttagctttgcggaagaaagttcttccgcggacgcccgtggaacatttcttccgcgagtgtcaacgaaagaagaactgcggaagaaccatcttccatggaactatgcggaagaacttcttccgccagagtcaacggaagaagaaatgacgaacaaggccaaaggaaaaggcaaggaggtcgccgaaaaaggttctgccgacaagcgcaagggcgccttcgacgatgacaagaccggtggcggccaaaagagaaacaagcaaggccctgtttga

SEQ ID NO: 24508 - DNA, 369 bp, Glycine max
  Peptide Sequence Number=SeqID_141286
atggtggagccagcgattttgagttctgcggagagtatgagagggagctcgtgcttggctttgtgcttagggttgagcgtacgaccaacttcctcagcgccaaacacgaccttgaagaacagaatggcgacgttggccttaggagcttcgacgaggagttatggcttcatagcgacaaacgacaccgtagcagcagctgcgagaacgatgaagagagaaaaccctatcgatatctccctccacaatgccgctggctggaacccgctccaggaggcgctctgcctgcgcgcctctgcatcgtgcaggtcctcatccggctccaccaccgtgccgcctaggccaagtggcgccgccacctgccgcgcctag

SEQ ID NO: 24509 - DNA, 2076 bp, Glycine max
  Peptide Sequence Number=SeqID_141287
atggagtgcaacaaagatgaggcagttagggccaaagaaatagcagagaggaaattttcagaaagggaatatgttggtgcaaagaagtttgctctcaaggctcaaaatctgtatcctgagttggaggatattacccagcttttgacaacaattgatatttatacatccgctgagaataaagtaagcggagaaatggattggtatggtatacttggagtgagcccctttgctgatgaggagactgtcagaaagcaatacaggaagctggctctcacccttcaccctgacaaaaacaagtctttgggtgcagagggtgcatttaagctggtttcagaggcatggagtttgttatcagataagaccaagagactagaatataaccagaagaggagtttgaaaggattccaacataatactcccaaccatgttggatctcaaccagaagcacccagttcaaatggttattataatctaaagaagaatgttaattcaaatgtcaggactggaaataatagtggtcgggcaccttcagctccggttaaaaaggctgaaaccttttggactatctgtaataggtgcaggacacattatgaatatctcagggtttatttgaatcacacccttttatgtccaaactgtaatgaagcttttgtcgctgtagagaggggtccaccaccaaatgtttttaagccaccaaattggtcttctcatcaacggcatcagaattctcaacaccatgctggaagtaataatacaaattttcagtggggttctcactctagaatggctggttttggtagcacagatggatcaacatctgttgcagctcaagctgcaagtgttgtgcagcaggcaagtgagaaagtaaggagggagggttcttttcacaaacctatgaaaaaaaggaagacagatgatattcgcattaatggttatcaaggatacatggcaaatcatatggctacaagagatggagcggctggtttgggcaccttctctgaaccaggaaaggttaacttggaaacagaaaggaattatggtttttcaggtcttcctggcaagcattacagcacaagagaattgtcaatgtttgaaatacgaaacatgttgatggataagtcgcgcattgaaattcgtaagaaacttcaagaatggaaatcaatggctgaagctaagattaacaaggataaagagaataagagacagaaaagcacatttaatggcaaaacaactggttcagagaagctgagagagactgctgttaatggtaacaggcatctggacattgattctttccctgtcagatctgatgatacagttaagaagaaccaagcttacgttacaatcactgttccagaccctgattttcataattttgacttggatagagatgaaaattcctttgcggaggaccaggtctgggctgcttatgatgatgatgatggaatgcctcgttattatgctagaattcacaaggtgatctccatgaagccatttaaaatgcggatcagttggcttaactctcgaagcaacagtgaattgggcccaatagattgggtaggttctggtttttataaaacttgtggggatttcagaactggcaagcatgaaataactgaatcattaaattcattctctcacaaggttaggtggacaaaaggcacaagaggtgttgttcgaatctttcctgggaagggggaggtctgggctctttacagaaactggtctcgtgattggaatgaacataccccagatgaagtgatacacaagtatgatatggtggaggttcttgaagatttcaatgaagaacaaggcatattagttaccccccttgttaaggttgctggttttaggactgtgtttcaaaggcacatggaccgtgatcgggagaggatgattcctaaagaggaaatgtttcaattctctcatcaggttccgaattacttgcttactggccaagaagctgataatgctccaaaggattgtcgagagttggatccagccgctactcctttagacctcctccagataataacagaagctaatgagacatcgaaaaatgctttggaagcctga

SEQ ID NO: 24510 - DNA, 1218 bp, Glycine max
  Peptide Sequence Number=SeqID_141288
atggaacctaatgacaaccaactcacctctttcttccaccaccaccaccaacagcaccaacaccaccagccgccgccaccaccgcagaccacggcgtctccgaccaacgggctcttgccgaacgcggatgggtcccacatactttacccccactctgtggcgtccgctgtttcgtcgcagcttgaaccggcgaagcggaagcgcgggcggccgaggaagtacggaacgccggagcaagctctggccgcgaagaaagccgctacgacgttgtctcattcgttctctgtggacaagaagccccactccccgacgttcccttcctccaagaaatcccattccttcgctctaggcaatgcagggcaagggttcactccgcatgtcatttctgttgctgctggggtcagcatagtcacaccggggatctcttggctgaagttcaccaagttgcaccttcttaagggttcctataatggatccaggcgtgagatgtgtattctgtctgcatctggttccatctctaatgcctctcttcgccagccagcaacctcaggaggcagcattgcatatgagggtcggtttgagattatttcacttactggttcttatgtccgtaatgaacttggaactcgaactggtggtctcagtgtatgcttatctaatactgatggacaaatcataggtggtggagttggtgggccgcttaaagcagctggtccagttcaggaagagggtttgatggtggttgttgatctgtttgtacattgtccaggttgtgaggtggcaaacagatgctccaaggtaaaaggggttggggagaaagttgtagatggagaacagttttctacttatgctcctgattcttctgtcatcgttggaacattctttattgacaacaagaaggatactggtgctggtgttaaaggtgacatctctgccagcaagttgccatctccagttggtgaaccggtatcaagtttaggtttccgccaatcagttgactctcccagtggtaatccaatccggggaaatgatgagcatcaagctatggggggaagtcatttcatgattcaacagcttggtttgcatgggacgcctccccggtccacagactggggtcatccggattcaagaaatactggttttgagttgacaggaaggataggtcatggggcgcaccagtctcctgagaatggaggctatgaacaaattcccgattga

SEQ ID NO: 24511 - DNA, 1549 bp, Glycine max
  Peptide Sequence Number=SeqID_141289
tgccttcaatgcacacgctttaggtgctttagcagaggttgctgggcctggccttgactttcatctttgtactgtgcttcctcctttgctatcagcaatgggtgatgatgataaggaggttcaaactttggctaaggaagcctctgaaacagtggtcttagttattgatgaggaaggtattgagccactcatgtcagagcttgtcaaaggtgttaatgatagtcaggctgctgtcagaagatctagttcatatctgataggatatttcttcaaaaatagcaagttatatctggttgatgaagctccaaacatgatatctactctaatcattttgctaagtgattctgattcatctactgttactgttgcgtgggaagctttgtcaagggtcattatttcagtacccaaggaggtgctgccttcttatataaaacttgtccgtgatgccgtgtcaacatcccgagataaggaacggaggaagaagaagggaggaccaattctcatacctggattttgtcttccaaaagcacttcagcctatattgccaatttttctccaaggtctcataagtgggtctgctgaattgagggagcaggctgctctgggacttggcgaactgatagaagtgaccagtgaacaatcactcaaggagtttgtcatcccaataacaggaactgttcgttctagtgctgccctggcacttgggaagctcagcggactcagtaccagggttgaccctttagttagtgatttgctgtcaagtttgcagggatcagatggcggtgttagtgaagctattctgactgctttgaaaggtgtcttgaagcatgctggaaagaatgtgagctctgctgttcgaactcgtttttacagtgttctcaaggagttaattcatgatgatgatgagatagttcgaacatatgcttctagcatattgggtatcttgacacagtaccttgaagatgttcagctgacagagttgattcaagaactgtcaagtctagctaattcaccaagctggccacctaggcatggttccatccttacaatttcttccttatttcattacaatccagcaacaatttgttcgtcttccttgttctcaactattgttgattgccttagagacaccctgaaggatgagaagttccctcttcgcgaaacttcaaccaaggcattgggaaggctccttctttatagatctcaggtggatccttctgacacacttctttacaaagatgttctttcattgctagtatcatccacacatgatgagtctagtgaagttagaagaagagcattatctgctataaaagctgttgccaaggcaaatccttcagccattatgtcacacagcactattgtcggtcctgcactagcagagtgtatgaaagatggaaatactccagttagacttgctgcagaacgatgcgcgctacatgccttccaactaacaaaggtaattggtgtttttcatgactttgtgcaagttctggaagctcatgacttgtgtttaagtagaagtaaaacggagtatatggattgttag

SEQ ID NO: 24512 - DNA, 1184 bp, Glycine max
  Peptide Sequence Number=SeqID_141290
atggaaagagggttgcttcttttgttgttcttgttgttggttatggtgctttctgtttgtggcaacgatgtggaatattcacagtgcaattgtgacgaggaagggctttggagcatccacaacgtgctggtttgtcagaaagtgagtgactttttcattgccattgcatatttttccataccccttgagcttctttactttgtgagctgctctaatgtcccctttaaattggtcttcctacaattcattgccttcatagttctctgtggattgacccatttgctcaatgcctatacttactatggcccacactccttccagttgtttctttccctcactgttgctaagttcctcactgctcttgtttcttgtgccactgcaatttcctttcccacactcattcctcttctgctgaaaatcaaagtgagggagctatttttgaggcagaatgtgttggaattgggccaggaggttgggatgatgaagaaacagaaggaagctagttggcatgttaggatgctcacttgtgagattaggaaatctctggataagcataccatcttgtatatcacacttgttgagctttccaaggcattggatttgcacaattgtgcagtatggatgcctgatgaggataggagagaaatgcatttgactcatgagttgaaaccaaactcaacaaggatttttcacaattctattcctataagtgatcctgatgtgttggacataaagaagagccaaggggtgtggattttgaggcctgattctgcactaggagctgcaagtagtggtggtggtggatctggagattctggtgctgtggctgccattcgcatgccaatacttcatgtttcgaatttcaaaggaggcacaccagagtttgttgaaacatcttatggtgtactggttttggttcttccaaattcagactccagggcttggacctctcatgaaatggagatagtgaaagttgttgctgaccaggtggctgtggcattgtctcatgcgtctgttcttgaagagtctcagcttatgagccagaaacttgcagagcaaaaccgggcgttgcaacaggctcaaaagaatgcaatgatggccaggaaggcaaggagctcgtttgagaaagttatgagtcatggaatgcggagacctatgcattcaatcctgggcttgctttcaat

SEQ ID NO: 24513 - DNA, 1248 bp, Glycine max
  Peptide Sequence Number=SeqID_141291
atgggtattgttgttggctgttcttgttctgctcctcctcatcctagtcatcatcttctccttcttggtttcttcttgacccttcttctacaaacgtttgaggttgaacccagcaccttcaattacacaaggtataggaaagacagcagcttgagactccaaaggattcagagacacttggacaacattaacaagcctccggtcctcaccatagagagtccagatggtgatctcatagattgtgtccataaaagaaaacaaccagctttagatcacccccttttaaagaatcacaagattcagaaagcaccaacgaagatgccaaggggtatgaagagagtagaagagaaagagatagaaattaggagtgcatggcaaatgtggcataaaaatggaacgcgctgtccaaagggaacggttccgatacggcggagcacggtgcatgacgtgttgagagcaaagtctttgtttgactttggaaagaagcaacgacggtttcgtcttactgggcgcagtgacgcccccgatgtagtcagcggcaatggccatgagcatgcgatcgcatacactggatcatcacaggaggtttacggtgcaaaggcaacaataaatgtgtgggaaccttcgatccaagtagtcaacgagttcagtctctctcaaatttggattctttctggctcctttgatggcacagatctcaacagcattgaagctggatggcagagtgactcatatcaagcaaccggatgctacaaccttctttgtgcgggttttgtgcaaacaaatggcaggatagccattggagctgccatttcccccatctcatcttatgaatccaaccaatatgacatcaccatcctaatttggaaggacccgaaagtagggaattggtggatgagttttggtgatggcacattggtagggtactggccagaagggttattcacacacttggccacacacgccaccatggtggagtggggtggcgaagtggttaacacacgtgccaatggccaacacacctcaacccaaatgggctcgggccactttgctaatgatggttttggaaaatcaagctattttcgtaatcttgagattgtagacaccgacaatagtcttagctcggtgcacaatatcttaacacttgctgagaacaccaattgttatgacatcaagagctcctatagtaatgaatggggcacatacttctattatggtgggccaggcaacaatcctctgtgcccataa

SEQ ID NO: 24514 - DNA, 1005 bp, Glycine max
  Peptide Sequence Number=SeqID_141292
atgtcatctcagaattgggttttcaagcagacccttattatttgctctttgatattgtcaggtccatttggtgtcattgatgagcacttcgattctatacttccaaattgttatgatgctataggcctcatgcttatgattcaaataatacacaagcatcagctcatcatgtctcgaagacggattccatgcttggattcatatttagacaaggtcaatatatccttgtggcctcgatttaaattggtatttgacatgcacctcaacagcttgcgtaatgcaaatgtgaagacattatgggaagacgatgttcatcctcactatgtcatgaggcgttatgctgagtttactgcttcgcttatccatttaaacgctgaatgtggagatggtcagcttgatttgaatttggaacgacttagaatggctgttgatgacttacttatcaagcttgctaagaacttcccaaaaccaaaatcacaaacagtgtttcttataaacaattatgatatgacaattactgttctgaaggaagcaggtcctgaaggtgggaaaattcaaatgcactttgaggaactgctgaagagcaatacaacaatctttgtggaagaactgcttcaagaacattttaataatttaatcaagttcgtaaagtccaaagcctccgaggacccaacatcaaatccggataagcccataactgttgccgaagtcgagccactagtgaaggattttgcgagtaggtggaaggctgcaatagagctgatgcataaagacgttatcacttctttcagcaacttcttgtgtggtatggagatcttaagggctgcgttgactcagttgttgctttattacacaagactctcggattgcatcaagaggatcgttggtggttctgcattgaacaaggatcttgtttccatatcttcaatcatatggaaggaagaaagaaaacgagaaaaactaatgacgcgccaaggcgatgatgatgatataaaagcggtgtag

SEQ ID NO: 24515 - DNA, 342 bp, Glycine max
  Peptide Sequence Number=SeqID_141293
atggagtggttttttcagatttcacacccctttgtgatgccgacggaggacactgctgaacccagacctgcgcctccccttcccactcatgatgatgacttcgtggatccacctgtcgcccaggttccagtcacgtcagatccccctgcgcattttgtggttggttgcacaacatgtgtcaggatgggaaggattgctgagcatttggagcgtgtcatcaacctcaggatggtgactgcatggactgacttatatgatatcatggatctttgcctaaggataggtagagatgacaacccagatgacagtcttaggccgcgacagagatcccgcatagattag

SEQ ID NO: 24516 - DNA, 579 bp, Glycine max
  Peptide Sequence Number=SeqID_141294
atgttcacgctatctcgcgtgttccctctcacttccccttccaggcataggctcttggaagtgctgtcctctaggaaagttgaagtcggagaccgtctgcgccaagaggggcgcgattttacctattcagctgccatttctactgctacaaataactatgctgccaaaggcattgctttatacaacatcatatttgtcaattccacttgtcagtctgggactgttgtagttgatcgacgcggttcaatcatgatgtctttcatgcattctattggagagcgcaaatatgactgggataaaagacagaaatttgctctctcggcaactgaagttggttctttgataaccatggacgctcaagattcctgtgatttctttcatgacccctcaatgttatcaagtaatgctggtcaagtaaggaagagcttatcaattaagcctcatgcaaatggctactttgtgtctttgactgttgtcaacaacctgttaaacaccaaagactacttcagtgttcccgtcacaactgctgagtttgctgtaatgaagacagcttgcactgtatgccttttatctgcttag

SEQ ID NO: 24517 - DNA, 186 bp, Glycine max
  Peptide Sequence Number=SeqID_141295
atgccatctttaattgcttacaatgatcctcagtatgctatgaaggtcaatacagagttccatggaaaacaatcatattgtaaactcaaatttaaaaaggaaagaacaaacattgaacaaataaactctaaaaagtggacaatgtaccgaaaatcagcaatgcaaaaagttgcaactgaagaatga

SEQ ID NO: 24518 - DNA, 465 bp, Glycine max
  Peptide Sequence Number=SeqID_141296
atgagccaccataatgaaattgaagcacacattgtttcacgtttgggtcaaatgctggatgaaaacaatgtccatgcaaagagtttcaggatgacaagagaaagattgacagatagtcaagtgcataatgtcaggctgaaattgatcgctggtcgagaaaaagatggacgtacatataatgtaccaactgtttcagaagttgttgcacttattgcaggtgatattgatgcaaattcaaaaagagatattattgttgaaactcagaatgggcaattacaaaggatacacaaatttcattgtagctatcaaggtctacagtatcctctattgtttccttatggagaagatggatataggcctgacatactacatcgtgatacattaagtggcaaaaagaggaaaagaaattgtcttacaatgagagagtccattacaaacgagtccattataatatgtatacaatag

SEQ ID NO: 24519 - DNA, 197 bp, Glycine max
  Peptide Sequence Number=SeqID_141297
gctttggtcttgaagttgatgttgacaagtctttgcctgatctggtcattggtgatgaggcaaggactttccaaataaatggtataagttcccagtcagatgaatcagtttcaacaagaaattatactggtagaaggcactacaacaatgaacctaaggaaggcctgagcttcagcatgtgcaaaacgctggtgcag

SEQ ID NO: 24520 - DNA, 654 bp, Glycine max
  Peptide Sequence Number=SeqID_141298
atgctccacgattcccgaattgcttcgtatgccgccagttacacgttttcaccaaccactaccccactccaccacttcttctgcaaacagcgtttgttcttcaaacatccactcctcttgcatttcggaaaagccaatactcaaacgggtgctgccatgagttcaaactcatctgtcgcttcaagcaaggacaccatagaagtgccttctttttaccacaagcaatgggtgcccgaatatctaaactttgtccagttcagatatgatagagcaacataccaaatcagactaagacaacatcggcaaaaagtcttctttgttgaaggactaaaacacctcagaaaagatttagaaatttttgaatctgtcaccattaacttctttgcatgtgatgacaaatccacatttgaccttcatttcactccctcactagataaccagacctgcggaagaccacgactgagctcaagagaacatgtttggatgcttgaaatcacccagtcaatgcttggtgcacccaaaccattgaaacttctgcctgttgctataacgcatcttaatgcctacggtcaacacatgaccatccttagaagatttggacctccattacaatggcatgttgtcgtgcttgatattggatttggggagtgttag

SEQ ID NO: 24521 - DNA, 1164 bp, Glycine max
  Peptide Sequence Number=SeqID_141299
atggaggacggcgcaggaagaggtttggaatgccagaagactatggatgggaaggtgagtaacagtaatgggccagagaaggaaattccttcttgttgtctgaaggccaaggcttcaatccccgagtcagaggcaaaattccattccactgttgtttctgggtggttctcagcttctcaaacttgctctgggaaatctgggaaagctgtttatttcaacaacccaatgtggccaggagaagcccattcaatcaaagtagaaaagatcttatacaaggaaaagtcggagtaccaggaggtcttggtttttgaggtttggcctcttcatcttataatgtactataactttaacgtgaaagggatagatgctaatcctttcattttgcagtcatcaacttatgggaaagtgcttgtacttgatggaatagttcaattgactgagaaggatgaatgtgcttaccaggagatgatagctcatcttcccctctgttcaattcagtcccccaaaactgttttagttgttggtggtggagatggtggtgttctcagggaagtagcccgccacagctctgttgaacatattgatatttgtgagatagataagatggttattgatgtttctaggaaattttttccacagttagctattgggtttgaagattctcgagtacatctgcatgttggtgatgctgttgaatttcttaaatctgcttgtgaagggaagtatgatgccataattgttgattcctcagatcccgtgggtcctgcccaggaacttgttgagaaacctttttttgatacaatagctagggcactaaggcctggcggagttctttgtaatatggcagaaagtatgtggcttcatacacaccttattcaagatatgatctctatttgccgagaaacattcaaaggttctgtatgttatgcttgggccagtgtaccaacatatcctagtggtgtgataggctttcttctctgtgcaacagaagggccgcctgttgattttgtgaatcctatcaatcccattgaaaagttggaaggtgctaatgagcacaaaagagaacttcgattctacaattcagagatgcactcagctgcttttgcgttgcctgcgttcttgaagagagaagtgagtgtgctccgtgatctctcccttcagtag

SEQ ID NO: 24522 - DNA, 2052 bp, Glycine max
  Peptide Sequence Number=SeqID_141300
atggggaagaaaagaaagcacagtgagacaactcatgatgaggcacaaccccaaaaggaagacgtcacttcaaagagaccatctaggacccttttggggtggaaggataagaatgaagtcactgatgaagttgaggataattcacctatgtttaggagcaaagagaaggtattggtcacttgctctaggcagattaattacagtgatttcccgataaaaacattattttggttttaccattttcgttgcttctgttggtcgttttcattaggtagtatttgcaagggtttgttgtggccatttagattgttgctgtgcttttatttatgtcggggtgctcctaatagagcgaaaatattgaaagttatcctggcaaaagaggaattgtctcctgatgttgatttagatgcaatagcaagtatgactgatggatattccggaagtgatcttaagaatttgtgtgtaactgcagcagatcgacctattaaaaagatattaggaaaggaaaaaaagagtatatttgctaattttctctacaggagctggcttattgacattggaggatttgcaaagaaagtaaaaatcactactctatctttagctgatcaaatcaaggattgtggggcatatcgtgaatgtccaaactgttcttatcatattgataacagtgatgtttctactgagtggcctggctttcctcttggtgtaaagtttgatccttctgatgtagaactcttagaacatttagcagcaaaatgtggcattggaaacactcagcaacacatgtttatcaatgagttcattctaacactggaaggagaccaaggaatttgctacacacatccggaaaatcttccaggaagactgatcaatgataccaagacaatccctagagaatcacatgctccacaatcagatattcaggatcaagactttcctggcaatgctgcatggttagctggcgaattgcgggctgaggaaagcaccaaatatgatggctgtgacaacatcttattgtgcaaggagatcttagattcttctgctatattaaatgaccttggattggactccaccaatcttgaagacattgcaagctatgctacccaaagggctagaaatgataatgaatcttgcggaatttctgtcctggattcactggaattggatactcctgattttgatcttttttgtagcaatattacaatcagaggcaaaggtgccattgatggtcaaggatttgtttggtggaataatgactctcccacttacaatcccacaaaagtgatgctggaaagcaatggaagacttcctagcacaaaaccaacagcactcatgttctatggaagtgatggtgtagcaatcacaaacataacaattccgaatagtcaacaaacccatctcaagtttgactcttgcacaaatgttcaagtctcgggcattagtgtttcatcacctggtgataaccccaacactgatggaattcacttacaaaattctcaaaacatggttatctatagcagcacacttgcttgtgcagttaaaggaacctggatagatggtgaaagtctcaatgatgttagagggtatatagcaagggcattaatgtacatggcagtctgttatgggttccaacaaccaaggggaattccaggccttcgcctctcggatgccccaaatgttggtagatataaggaacatgctgctgctctagcagaagggcaaccagctccagcattatgcaacagtggggacgttaaagatttaaacatggaagactttaaatatgctcatcagcagggtgttgcctacgatatttccgtgattcaaatttgtcaccatgagcaggtcagggcaaccacgggatttgaagaacttagagcaaatgccatattggcaatgtctcttgcagtctgcaaagctggtgctgttgtcctgaaaattcctctttacaagcctgttgagaaactttccactgctgagatacaattggagaagaggggagcagaacgatctatgggagcattatgttttggttactattcttggcaatag

SEQ ID NO: 24523 - DNA, 204 bp, Glycine max
  Peptide Sequence Number=SeqID_141301
atggcttcttctccagcgttttctgggtgtctatggctcagtggtatttcgggtttaatcgcttacaattggtctcgactcaacatgaaaactggtgttaagatcattcacccaagttcctgttacgggaaagttcctgttactcgcaaaggaaagagattcgtgaagccattcaaggttacaaaggatatggatattgatcgt

SEQ ID NO: 24524 - DNA, 381 bp, Glycine max
  Peptide Sequence Number=SeqID_141302
atgaagtgcaaaactttggagtcttacttgcagattgttagattgcaaacactgaaccaaacatttatgagcagagggaaacaccagccttgtgaggaaaaattaaaggttgaaggtgtaacaagcaaaagcaagagaaaaactgaagaaaaaaagaaaattggaagtaggcccaatccagtaggcgcgtttagcgcgcgtcatgcgctaagcgggcaaggaagcacaggcgctaagcgaggcgttaagcacaaaggcgcaggatccgttactcgcattaagcgcggagcacacgccaagcgagcgatccaacagaagcatacgctaagcctgcaacacgcgctaagcgcacgatctgaacacgctaagcgcacgatctga

SEQ ID NO: 24525 - DNA, 1143 bp, Glycine max
  Peptide Sequence Number=SeqID_141303
atgagtcagtctacacagcagcgcctctatgatttcgccaaaatggctctcatcaacatcttcgctcacccctacgccacggtgtgcgacttgtactgtggggatgccgacgctgataaatgggtcgacgctcaaattggccactacattggaattgatgcgccttcgtctggcatagagcaaatgcgagaagcttgggagattcacaggaaatcctacactgccgagttctttgagcttgatccttgcacgaagaatacagaaacgcatttggaggagaagactaacgtggctgatgttgtctgctgtttgcagcatttgcagctgtgttttgagactgaagagaaagcacggaaactgctgcataatgtgtcatctctgctgaaacctgggggttattttcttggtattactcctgactcatctaccatatgggccaagtaccagaggaatgttgaagcctatcacaacaaaagcagcagcatgaagccaaacattgttcccaactgcatccggacagagaattacatgattacttttgaagttgaagaagaaaagtttccgttatttggaaagaaataccagctaaaatttgctaatgatgtctctgctgaaacccattgcttggttcattttccaagtttcatcaggttggccagggaagctggtcttgagtacgtggagattcaaaatttgaccgagttttatgatgacaacagagcacaattagcaggcctgctaacgcactatgttccaaacctcttggatcctagggggagacttcttcctcgttcatatgatgcactaggtctctacaccacatttatatttcaaaagcctgacccggaaattgcacccccaattgcgactccattattgccagatgttagttataatctcgacgaggtgcttttgtttctttttaattctatcaccacgattcctctaacttgctgggttaacattctcttaaaagatagtgtcgtccaccatgcagaccgcagaaaggtaaccattcggccagatgatgaaataataaatgggcatgcagtagaacctgctattgggctgggcaagataagcgaacaaaaagggatattgggcccaggccctgcagatttacgttttccagaagcactttga

SEQ ID NO: 24526 - DNA, 537 bp, Glycine max
  Peptide Sequence Number=SeqID_141304
atgaagatgaaggaggtagcatgtcaagccaaagtgattggaacaataaccataacattgagaaaatacccaacagagaagtcccttgccactagggtttgctttgttggtgcacttcaaagctctattgtagcagccatcgctgaacgccaccaccctcatgcctgggcccttggttgggatacacgactctttgctcctgcttatgcgggaatagttacatctggagttcagtattacatacaaggcatggtcataaaatccatgggcccagttattgtgactgcttttaatcccctgcgtatgatcattattacaaccttggcctgcatagtcctatctgagcaactctaccttggaagtattattggagcgatagttgtggttcttgggctctatctagttgtgtggggaaaatataaagaatgccacggaagatcaatgccaccgtctccggaaaaggataactttcttgaggatcaacgacagctatcggtcacagttcctaagaatgataccaatgataataagggttaa

SEQ ID NO: 24527 - DNA, 192 bp, Glycine max
  Peptide Sequence Number=SeqID_141305
atgggtgccaagtacctcgaagtggtcaaacgagggttgcatcccaacaacggatggtccccggacgaaattagggatcatgagcaactaggtgagtgctactatgacttgagaaacaaaggtgatcaaataacaagcagagatttaaaaggtactaggttgcctcctagtagcgcttctttaacgtcttga

SEQ ID NO: 24528 - DNA, 276 bp, Glycine max
  Peptide Sequence Number=SeqID_141306
atgggtgatgtggacaacccgccaatgccaatggtaggacatgcaacgtggatcagtcctgccattggttcttgcgagaccaacgtggacctcttctccctcttttgccttcacgtgttcacagcagcaatgttgtttcccttcacgctttacacagctacagttaaggcactgtttgccttcatgcttgacatagctacaagccaggttccttcacgccttcacacagctagggcactgtttgcagagatgatcagatgctcgtgttgcctttaa

SEQ ID NO: 24529 - DNA, 1824 bp, Glycine max
  Peptide Sequence Number=SeqID_141307
atggttgcagaatcatggtttcgcagtctgtggaaagctcctcggaagcatgatgccaattccgagaaggtggtcattgaagtattagcatttgaaatagcaagcttgatgtccaagctagttaatttatggcagtctttgagtgataaacagattgttagatttagggaggaaatcacaaattcggtgggcataaaaaagcttgtctcagatgatgataatttcattgaacgtttgatctgtttggagatacttgagaacatggcacacgtggccgagtctgtggctaggcttgctaagaaatgcagtgatccaattttgaaaggttttgggaatgccttttatgagtttatcactacaggcagtgatccatatgggtgggaattcactggcaagaagatggaaaaaaagattaaaaggatggaaaagtttatatcaactaatgcaagtttgtatcaagagatggaagtgcttgctgatcttgagcaaacttttacaagagtgaaggctaatggtgagtcagatggtgtaactttaatggagtatcagaagaaggttgcatggaagaggcaggaggtgaagcacttacaggatatttctttgtggaacaggacatatgattacacaatacttcttttagccagatccttattcacaacattctgtaagatcaaccatgtatttggacttacagagatggtggatgttggcaggaccactaattcaagtgtcttaaattcagatttcgtttacagaagtcaatcggtttctacgatattgcaatcttcattccacccatcacataataatgttgccaggttttcttcaggacccctcaatgctattactgctagatcaggtccaattggtcgaacaacaaataaaacaagcatttctcattcaggtcctcttggtgactcatccacaaagtcaggccccattttaggaaagcaaacaacaaatgccaatttttactcaggtcctcttggaaggaaattcaatcaatcagtcccagttaccggaagaaataaaaagagcaagatttggaggttttatggacactctgttgccataagtgggaaggaaactaccacaagacccagtcgactgactcaagtaggacctttcaaaggatgtatggcttgggacagttccatattcactgactgccagtcaagtgctagtggtgttcattatggaatgcagaatcccaaagatgttaattcaaaccctcttggtcctggaaaagtagttaatcatactgaatcagtcttcaaacctcttcgcaagctattaaatcctccatctgaaaccctgggtgctgctgctctagcactgcactatgcaaatgttatcattgtgattgagaagctagcagcttcttcacacttgattggtctggatgcaagagatgacctgtacaacatgttaccaagacgtgtgagagcttccctaaaggccaagctaaagccatataccaagaccatggcagcattgtcatcatcaatctatgacccaagtctagcagaagaatggaatgaagcaatgtcaagcatacttgaatggctggcaccacttgctcataacatgataagatggcagtctgagagaagttatgagcagcagagctttgtttcccggacaaatgtgctgctggtacagaccctttactttgcaaaccaagaaaagacagaagaagtaatcactgagcttcttgtgggactgaattatgtctggaaatatggtagggagctcaatgcaaaagctctggcagagtgtggcagttttagggtagacaatgaatatcctaatctgaatggataa

SEQ ID NO: 24530 - DNA, 8449 bp, Glycine max
  Peptide Sequence Number=SeqID_141308
gcttccgccaccaggaaaatatgcagttggcatgcttttcttgcctacatccaatagtcgcagggaagagagcaaaaatgtatttcaaaaggttgccgaatctctggggcattctgttcttggttggcgttctgtgcccacagataacacaggattgggcaaatcggccgtgctaactgaaccagtgattgaacaagtgtttcttactccaagtactcagtcaaaagttgatttggaaagacagatgtatatattaaggaagctgtccatggttgctatatcatctgcattaaacctcgataatgatggcattatagatttctatatctgttcgctttcatcaaggactgttgtttacaaaggtcagttaacaccagctcagttgaaggattactattttgcagaccttggcaatgaaaggtttacgagctacatggccctggtaaatatattatccattaacttctcttccttctccactaactctatatactccaacaaacagcatggggaacaaccagtaacagaagagatgcaaggttggggaatgacttctgaggcattgaggatttctggaatttctactggcacagtggcacttcagtatattttcattgatgtgcttgaaaaaaaaatcattaatgctcttgattttccgcaacagtttattgtctgtaataagaattgggatcgtgctcaacctatgcgtgtattgggccacaatggagaaatcaacacacttagagggaatgtaaactggatgaaggcacgcgagggcctactgaagtgcaaggagcttggtctatccgagaatgagttaaagaagcttttgcctattgtggatgcaaattcatctgattcaggagcttttgatggtgtgcttgagtttttgattcagtctggaaaaagtctccctgaagctgttatgttgatgattcctgaagcatggcaaaatgacaacaacatggatcctcagcgtaaagcattttatgaatacttctcagctctcatggagccatgggatgggccagctcttatagcatttactgatgggcactatcttggagcaaccttggacaggaatgggctgcgaccaggccgcttttatgtcacccacagtggacgagttgtaatggcgagtgaagttggggttgtagacattcctcttgaagacgtgagtcagaaaggaagactaaatcctggcatgatgcttctagtggattttgagaagcatattgttgtgaatgatgatgccttaaaggaacagtattcattggcaaggccatatggggaatggctcaaaaagcagaagttagaactcaaagacatagttgattctgttcatgaatctgaaagagttcctccatcaataacaggagtgatgccagcatctggtgatgatgtggatatggaaaatatgggaattcatggtttactggctccattgaaagcttttggatataccgtcgaatccttggaaatgttgttacttcccatggcaaaagatggtacggaagcccttgggtcaatgggaaatgatactccattagccatcatgtctaatagagaaaaactcacttttgagtactttaagcaaatgtttgcccaagtgacaaacccaccgattgatcctattcgagagaaaatagtcacgtccacagaatgtatggttggtccagaaggtgacttaacagaaatcactgaggaacagtgccaccgtctttccctaaaaggtccccttttatccattgaggaaatggaagccattaaaaaaatgaattacaggggatggcggagcaaagttatagatataacatactcaaagggccgtggtaagaaagggttggaggaagccttggacaggatatgtgcagaagcacatgatgcaattagtgatggctacactacccttgtgctgtctgatagagctttctcaaggaaacgtgttgctgtgagctccctgctggctgttggtgctgtccatcaacatctagtgaaaacacttgagcgtactagagttgccttagtaatagaatctgccgagccacgtgaagtgcaccatttctgcacacttgttggcttcggtgctgatgctatatgtccatatttggctgtagaggcaatttggcgactacaggttgatggaaagatcccaccaaaagcaaatggtgaattctactcaaaagatgagctggttaagaagtacttcaaagcaagcaactatggaatgatgaaggtgcttgcgaagatgggaatatccactttggcctcttacaaaggtgctcagatttttgaagctctgggtctttcatcagaagtgattgaaaggtgctttgctggaaccccaagtcgagttgagggtgcaacatttaagatgcttgctcgtgatgctcttcaattgcatggattagcatttccttctcgggttttctctcctggaagtgctgaagcaaaggcattaccaaatcctggggattatcattggagaaaaggtggggaaattcacttgaatgatccacttgcaatatcaaagcttcaagaggctgccagaactaacagcatagatgcatataaacagtactctaagctcattcacgagttaaataaagcttgcaatttgcggggacttctgaaatttaaagaggcagctgtgaaagttccccttgatgaagtagaacctgctagtgagattgttaaacggttttgcactggtgccatgagttatgggtctatatcattggaggcacacacagcattggcaactgctatgaataagattggagggaaatcgaacacaggtgagggaggtgagcagccatctcgtatggagcctctttctgatggctcaaagaacccgaaaaggagtgctattaagcaggttgctagtgggagatttggagttacaagttactatcttacaaatgctgatgaattgcagataaagatggcccagggagcaaaacctggtgagggtggcgaacttcccggccacaaggttgtaggagacattgctgtcacaaggaattcaacccctggtgtaggacttatcagcccacctcctcatcatgatatttactccattgaagatcttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcgtccagatggactggcataaagaatgctggtctcccttgggaacttggcttggctgagacccatcaaactttggttgctaatgacctccggggtcgcactgttctccaaactgatgggcaaattaaaacaggaagagatgtggccatagccactcttcttggtgccgaagagtttggtttcagtacagctccactcattactcttggttgcatcatgatgcgcaagtgtcacaagaatacctgccctgttggcattgctacccaagatccagtactaagagaaaagtttgctggagaacctgagcatgtcattaacttttttttcatgatagcagaagaaatgagagaaattatgtcccagcttgggtttcgtactgtcaatgagatggttggccgttcagatatgctcgaagttgataaggaagtaattaaaagtaatgagaaactagagaacattgacctctctttattgcttagacctgcagctgaactgcgaccagaagctgctcaatactgtgttcaaaaacaagatcatggtttggacatggcattggataataagcttataggtctgtccaatgctgctttggtaaagggtctcccggtatacattgaaagtccaatccataatgtaaaccgtgcagtgggaactatgctaagccatgaggtgacaaaaaagtaccacttaaatggtcttcctactgacactattcatatcagatttaatggcagtgcaggccagagctttggcgcattcctttgtcctggcatcactttggaacttgaaggtgatggcaatgactatgttggtaaaggactgtcaggtggaaagattgtagtatttcctccaaaggggagtacctttgaccctaagcagaatattgtaattggtaatgtggctctatatggggccacatctggtgaggcatatttcaatgggatggcagctgaaaggttttgtgtgcgtaattctggagccaaggcagtagtggaaggtgttggcgatcatggatgtgagtacatgactggtgggatagtagttgtgcttggaaacacaggcagaaattttgctgcaggtatgagtggtgggattgcttacgttcttgatatggatggcaaattcctatctcggtgcaaccatgagcttgtagatctggataaggttgaagaggaagaggatattactactcttagaatgttgatacaacaacatcagcgccacacaaatagtgtgcttgccaaagaagtgctcgctgactttgagaatcttgttccaaaatttatcaaggtgttccccaaggagtataaacgagttttggcaagtattaaatcgaaggaagcttccaaagatgcagcggagtctgcttctaaacatggagaggagcaagatgaaattgaattggtggagaaagatgcttttgaagagcttaagaaactggctactgcatcggtgaatgggaagcctattgaggctgaatcattcaagaggcctagtcaagtcattgatcctgttaaacacagaggttttgttgcttatgagcgggaaggtgttcagtacagggatcccaatgctcgaataaatgactggaatgaagtgatgaaggaaacaaagcctggtccacttttgaaaacccaatcagcccgttgcatggactgtggtactcctttctgtcatcaggaaaactctgggtgccctcttggaaataaaataccagaatttaatgagttagtataccaaaataggtggcgtgaagcattagagaggcttcttgagacaaataacttcccagagtttactggtagggtatgcccagcaccttgtgaaggttcttgtgtccttggtattattgagaatccagtatctattaaaagcatagaatgtgctatcatagacaaagcttttgaggaggggtggatggtgccacgacctccagctaggagaactgggaaaagagtggccgttgttggaagtggaccgtctggcctggcagctgctgaccaactgaataaaatgggccatacagtaactgtgtatgaaagagctgataggattggagggcttatgatgtatggtgttcccaacatgaaagctgacaaagtggatatagttcaacggcgggtcaaccttatggcagaggagggaattaactttgtggtgaatgctaatatcgggcatgatcctttacattctctcgataggcttcgggaggaaaataatgctattgtcttggctgtaggagccacaaaaccaagggatctcccagtacctgggcgggagctgtcaggagttcattttgctatggagtttcttcatgcaaacactaaaagcttgcttgatagcaatctccaggatggtaacttcatttctgctaagggaaagaaagttgtggttattggtgggggtgacacgggcacagattgcatagggacatccattcggcatgggtgtagtagcattgtaaatctggaacttctccctcagccaccacaaactagggccccaggcaacccttggccacagtggcctcgcatataccgagtagattatgggcaccaagaaggtgcggcgaaatttgggaaagatccaagatcttatgaggtattgactaagcggtttgtgggagatgaaaatggagttgtgaagggacttgaagtaatacgtgttcgctgggagaaggatgaaactgggaggtttcaatttaaggaaattgagggctccgaggagattattgaggctgacctagttttactggccatgggattccttggccctgagtctgtaagtattcataatagcttcatctctttatgtttacagaatgtgacaattgcagagaagttgggtatagagcgagacaataggtcaaacttcaaggcagagtatggtcgcttctcaaccagtcttaaaggggtgtttgcagctggagattgtcgacgtggtcagtccttggtggtatgggcaatttcagagggacgacaagctgcagcacaagttgacagtttcctcacaaatgaagatttagagcacaatgttgccgggagtccagacgaacttatcaagaagaagcagcaaccaagggacactgtggcagtggcaaacaaacaggggaaaataataaagaagcgatctaagggtgcaaggttagtgcacagtagaaaattaggaatgttcataggcttcgtgatggaaagtattgaggttcttgaatatcccaaactcacactcttcatcctcttgaacccacacctgatagcactagcaagcatagaaacatgtttagacagcgtttgcgacactcacgagccagtaatccgattcccgttccgcatagagggagagcaagagaattcatgcggccacccagggttcagcgtatcctgcagccagaacggccaaacactacttaacctattttactgcggcgaactcagaatccaaagaataaactacgcagcacagcaaccaccgccaataattcaccttcttcaacttggagtacctcagtcggtccagtcgccgtttaacgatcgagtgacgtcgttggaactcagcggattcaagagcaacgacacttttgagctcgactgttcccgtgtcccttcaaaagtggctggtggtgatcgcatttggaattgcacaacagcgatgggcgaggttgttagttcagctcccgggaaagtgttaatgaccggtggttacctgattttggagcgacccaatgcaggacttgtcctcagcacaaacgctcgtttttacgccatcgtcaaaccaattcatcacgaaatcaaacctgattcctgggcatgggcatggacagatgtcagattaacctctcctcaactctccagagaagccctctacaaactcgctctcaaaaatctcaccatccaaaccgtttccccaaggctcgtcaataattactcctctatttcacttgatacgagaaatccttttgtggaatatgcggtgcagtattccgtggctgctgcttacgcaacgtttgaccataataaaaaggagctgttgcacaaactacttttacatggtcttgacattacaattttgggtggcaatgatttttattcgtataggaatgagattgagagacgtggactccctttgactccggaatcattggccacccttcctcccttttcctccattactttcaataccgatgatgccgatggagggaattgcaagcctgaagtggctaaaactggtttgggctcttctgcagcgatgacaatggctgtagttgctgctctacttcattacctggatgttgtaaagctttcctcttcgaaagatcatcgggaaaggaaggatgttgcagatcttgatatggtgcataaaatagctcaaactgcacactgtattgcacaggggaaagttggcagtgggtttgatgtcagctcagctgtgtatggcagtcagcgctatgtgcggttttcaccggaagtgatttcttccactaaggttgcagatatagcagtgcctttatcagatggtatcactgaaattataaaaggaaattgggaccatgacacgactgagttctctctaccacctttgatgtctcttttactaggagaacctggaactggtggatcatccacgccatcgatggttggtgctgttaaaaaatggcaaaagtctgaccctcagaaatccctggacacatggacaagattgtcagaggcaaattcagcattggaaatgcaactaaacttgttaagcaaattagcaaaggaacaatggaatgcatataaatctgtgattgacagctgcagcatgctcagaccagacaagtggatagaacaagcttctgaacctaacaaggaagcagttattaaagcactgcttggagcaaaagaagccatgctggggattagatatcatatgcgcctaatgggcgaggctgcaggtgttccaattgaaccagaaccacaaacacaacttttagatgctacaatgaacttggaaggagtattgttggctggagttccaggggcaggaggatttgatgcagtctttgctgttactttgggagattcgagcagcaatgtgacaaaagtatggagttcactcaatgtccttgccttgttggttaaagaagatccttgtggcgtttgtttagaaaaggctgatccacgaaccaatggaatcacatcagctgtgtcttcaattcatattgaataa

SEQ ID NO: 24531 - DNA, 177 bp, Glycine max
  Peptide Sequence Number=SeqID_141309
atgacgttggatcaagtgagggtccttttcctcggatacggttcaagttacgtgatcgtcctcggcggaaaacataaaaataaatcaagcctagatctaaactcagaacggacaggatcctacccttttccttcgtgtttggctgggctgaaacggctttgggctggtgactggtga

SEQ ID NO: 24532 - DNA, 1188 bp, Glycine max
  Peptide Sequence Number=SeqID_141310
atgctcgattcagctcttgaattcaagaaccagttgctgaaagaaaactgcaagcccaccgtcgttacttacactattttaatagaagcaactcttttgcagggtgggattgatgaagcaatgaagctcttggatgagatgttggaaattaatcttcaacctgatatgttcacttacaactccatcataaggggtatgtgcagagaaggttacgtggatcgtgcgtttcagattattagcagcataagtagcaagggctatgccccggatgtcataacttataacattctcttgcgaggtcttttgaatcagggcaaatgggaggctggttacgaattgatgtctgatatggttgcaagaggttgtgaggctaacgttgtgacgtacagtgttttgattagttcggtctgtcgcgatgggaaggttgaggaaggggtgggtttgttaaaggatatgaagaaaaaagggttaaaacctgatggttattgctatgaccctttgattgctgctttgtgcaaagagggtagagtggatttggctattgaggtattggatgtcatgatctccgacgggtgcgtgccggatattgtgaactataacaccatattggcttgtttatgtaagcaaaaaagagctgatgaggctttgagcatttttgaaaagttgggtgaagtggggtgttcaccgaatgctagttcctacaactcaatgttcagtgctctatggagtactgggcataaagttagagcattaggaatgattttggagatgttggacaagggtgttgatcctgatgggattacgtataattcgcttatatcttgtttgtgcagagatgggatggtggatgaggccattgagttgttggtggacatggagatggagagtagtgagtgtaagccaagtgttgttagttacaacattgttcttcttgggttgtgcaaagtgagtagagttagtgatgccattgaggtgttggctgcgatggtggacaaagggtgtcggccaaatgaaactacttacacttttttgattgaagggattggttttggggggtgtctaaatgatgctagggacttggctaccacccttgttaatatggatgctatttctgaacattcatttgaacgattgtacaaaacattttgcaagcttgatgtgtacagacagcttaatttgtctgattaa

SEQ ID NO: 24533 - DNA, 603 bp, Glycine max
  Peptide Sequence Number=SeqID_141311
atggaggtcattagcgatacggcgtcgttggaggtcgatttgttgcagctccctgaggtgtcctctctcgcactcaaatctaacctaactttcgtcgagacgctcttcgagcagtggctttcgcttcccgaaagcaaccgattggtgacatcattggtaaatgaagcaaagtcgggtgctcccttgaatgtccccgggaattgctctagtccaaatgctgcaagcaattctttgccttccatgtttcctgctggcactgcaccacctctttctccaagaagtacatctggttcccctcgcatagtgaaacagagagttggcccatctaacttgggttctcctttgaaggttgtcagtgagccggttaaagaagtgatacctcagttctactttcaatttgggcgtcctcctccaaatgatctgaaagaaaaatgcctgattagaattgaccatttattccatgatcacatggatgggctgcagatacatgaattcaagtcagttactaaggaagtatgcaagctgccatcttttttttccacatctcttttcagaaagatcgataatggaactggagttgtgacaagctgtttggatatctaa

SEQ ID NO: 24534 - DNA, 357 bp, Glycine max
  Peptide Sequence Number=SeqID_141312
atgtcgggtgaaaagcctttgtttttcattctgtcgagcacttgtgaagagcccgtggatgagtttggtgcacaaaacgacgtcgggtttgtggcccttgttgacgaggtggcggaggaagtagagggactcgttgaagttgccggctttgcaggatcgggagagggatttgaggagatgggtgtctttgaaatcgagggtatgggtttggggcttggaaacggaagagagagtgcggttgatgttggtggtttcattgagaattgggagtgtacgggaattagaatgggaattggtgcggttggggtgggggttgaacagggggaggaaatcggtggaaactgttgttgtcattga

SEQ ID NO: 24535 - DNA, 219 bp, Glycine max
  Peptide Sequence Number=SeqID_141313
atggatgaaaggttaagctgctatgctcttattgcaagagcttctattgatgttacaattcctttgctcataagagtattttcagagcgggttggacaccttaatcagattgcaaaaattgagatgtgggccaggggggctggagagccaagaattggggggattttttttctcattaaggagaatgtaaatttgcaccagtttacaggaggtgaataa

SEQ ID NO: 24536 - DNA, 1185 bp, Glycine max
  Peptide Sequence Number=SeqID_141314
atggcattccatttggaaattatcatgctcattctcatcttcatcgctcttgcgcagccgagtgagcgagtcaacgcggagccgactcaggacaaacaagccctcctcgcattcctctcccagaccccgcacgcgaaccgggtccagtggaacacctccagttcggcctgcgactcctggttcggcgtccaatgcgactcgaaccgctccttcgtgacttccctccacctccccgccgccggcctcgtgggccccatccctcccaacaccatctcccgcctcacgcgcctccgcgtcctcagcctccgctccaacgcgctcgtgggccccatccccttcgacttcgccaacctcacctccctccgcaacctctacctccagaacaaccacctctcgggcgagttccccacaaccctaactcgcctgactcgcttgactcgcctcgaactctcctccaacaatttcacaggaccaatccctttctccctcaacaacctcactcgcttaaccggcctcttcctagaaaacaattccttctcgggtagcctccccagcattacgttaaagttagttaacttcaatgtctccaataaccgcctcaacggctccatccccaaaaccttatcgaatttccccgcgacctcgttttcaggaaacaacgatctctgcgggaagccattacaaccatgcacacccttctttccagccccagccccagccccttctcctgtggaacaacaacagcataactccaaaaggctttctatcgctgccattgttggaattgccgtcgggtctgctttgtttatactgttattgctattaattatgtttctatgctgccggcggaggaggaggaggaggagagcggctaagccgccacaggctgtggcggcggtagcgcgtggggggcccacagagggcggaacgtcgtcgtcgaaggacgatattacggggtcagtggaggctgctgagaggaacaagctggtgtttatggagggtggagtgtacggatttgggttggaggatttgttgagggcttcggcggaggtattgggaaaagggagcatggggacttcttacaaggcgattctggaggacgggaccacggtggttgtgaagaggttgaaggacgtggcggctgcgaagagagagttcgaggcgcgaatggaggttgttgggaac

SEQ ID NO: 24537 - DNA, 1185 bp, Glycine max
  Peptide Sequence Number=SeqID_141315
gctattgtgggcattcatggtttagatgtgcagtttgctggaatcaaattcctcgattcattggtatcagaattttctccatctacttcaagtgctatgggccttccaagggaatttcatgagcagtgtaggaggtcacttgagcaggactacctaaagacattctaccgctggacacaagaagctgcttcaagtgtcacaaacaggattattgaatctgactctgctgtaccagaggttaaagtttgcactgctgcactggatcacatgcttcaaattttaaattgggattttcgtagcaatactagtgaaacaaaaataaatgtaaatgtcttctctgctggagttagacaagatggggattctctcaaaaggtctgaatgtcacctagtgcagcctggttctgattggcatgatgtgttaatactaagcagtcatgttggatggcttttgagtttatatgcagcattgaggctgaaattttcatgcgaaggatactggcttgactgccctattgcagtctctgctcgaaagctagttgtacaattttgttctctaacaggagctgtatttctttctgatgatggaaaaatgcatgagcagcatcttctgcagctcttatccgggataatagagtgggtagatcctccagatgccgtttcaaaagctattgaaaatgggaaaagtgacagtgagatgcttgatggttgtcgtgcattattggccattgcaaatgtaacaaccccctatgtgtttgagggtttgctaaaatctatgaggcccatcggtactcttacttttttgtcaatgttgatgtctgaagtaattaaagtcctcatgactagtaacacagaagaggagacttggagctgggaagcacgtgatgtcttattggatacttggactgccattctaacgccaataaatactatcaatgtgaatgctttgcttccatccgaagggataaaagctgctgccaatctctttggtttcattgtagaatgcgagctacgattggcctctgcaacagcatttaatgatgagggcgattcagactatcttcatgcgtcggtatctgttgaggaagtgttggagaacaagccctacatcggtatttggtgggttagaaataagttagagtataagcaaaggggtcatgagttcaaagtgcccaggcatttttag

SEQ ID NO: 24538 - DNA, 3546 bp, Glycine max
  Peptide Sequence Number=SeqID_141316
atgccgcgcagttcgaagcacaaatcgagcaagcacagttcgcgtgacgcgagggagcactccgactccgagcgagattccggcgccaaggatcggaggagcaaggaggagagcggcggcggcggcgcgaagaaggattcgagttccgcggagaagcggaggccggattcgaaggacgcgcacgggaacggggagtattccgacgagtacgcgtcgtcgtcgaagcggcgcaaggacggcggaggcgggggagaccggtggaatggcggcgaagagggatcgaagaagtcgaagacggtgggggattcgaagagcaggaggagggacgggagcgtgggagtgtacggtgagggcgaggaggtgaagaggagtagcgggaaaggggatgggaagcatagggattcggcatcggggcgaatcagggagggtgcggcggagaaggagaaagagaggaaatttaaagaaggtggtaggagtgaggaatcggttgatgagcaagagcagcgtgtatccaagcaggtctttgaaattaatggtaagaagacatttgttgattttgatctatgtggatctatgtggctatgcttttttgcagattcaaagaaaattgatgagttgcaaggccctgaacctgataatcagcttgagaggcgaacaaggaagaagagggacgactatagtgatggtgacaagcatcaagataatgctggagatggttatgataggcatttgtcttctagggatgacattgccaaggatggaaaaaagaaggatgataggcgaaaagaggagaaacatagagacaaatatagggaagaaatagacagggataacaaacatcgacatgacaagcaacatgatgagcgccctgctaaagatcatactaccattaggtctgatgataaacatgctagggaagaaaagaatagtctagaatcacgccaaaagagaaccaggcttccagagagtgacagggaccataaccgtgatcgcgacggggatcgtgatttggaatctgttcgggatcgagaacgccacggtgaacgtgatcgtgattatgatattgacagggatcatgattatgacagagatcgagattgggactgggatcgagatcatgatcgtgaccgagacagggatcgtgaccgtcgccgtgattgtgatgggtcacatgtggatgatagaagtggtagaggcaaagagagtggaacaaagaaaagaactttggatgatcgtgatgattatagtgactctaaatctagagctgttaagagctactatcctgatgcagagaagaggagtttgagcaccagcagagctgaatctgatgttgatagaggaagatctcaacctcgacaagctcatgcagattcatctggaactagcaataaacacagatcatctcctgcctcaaatacacatattggcaaagatgactatagaaatgctaaagcggaagattcaaagtacagagacccatcagtagaacagagaaccaaaggctcaagagagggttactctgggacatcagatagaggtcctaaatacaaattaatggaaaaacccattaaaatagatgaatgtcctgctggagacttgtcaactgaaagatcttccagtgccaaggcttctcctgggggcctgatggaaagatctccttcatcaacaagcattgagcgcaggtatgtgaatagaagtagtgttaagcggaatcttgaaattgatgaaagtggaaggaggaacagtactgatgtaagagatttctctacttctgatgatagacttggctgggagtctactctagagaaaccactcttggatgagccctctcaagcagattcatctttatatggtaggactaatcagagcaatgcatcattgattccacccccacctggtttcagggctaccttagatagaccttatatgggttctttagaggatgatgttagagataactctaattcacgatacagaagaagtagtgaacctggatttggaagaggacatggtggcaattcctggagggcagttccaaactggaattcaccagtaccaaatggatttgttcccttcccccctgggccagctcatggaggttttcaaacaatggtgccgcagtttacatctcaatctctctttggtgttaggcctcctatggaagttaaccacgctggcattccttatcatattgctgatgctgacagatttccaggtcatttgcgcccacttgggtggcaaaatttgatggatggtacaggaactgctcatttgcatggatgggataacaataatggtgtcttcagagatgatcctcacatgtatggtggttctgattgggataggaacaggcattccactaatagtcatggatgggaatctggttcagagacttggaaagagcagaattgtgattcaaagaaggaattgccttcccctgcctgcaaagatgaaccagatcctgccctggttgataatggtttgactgatcagacaagtcagatgtctcaggatgaacataaccgggaagaacttgttgagaaatctcctgaaagaaagttgtccggtctcagttctccagcagaagtaccattgaactcttcatcctcaactgttcttaaaaaggtgcctgacacttcgatgccaattgacaatacttccctcttcagccgtttctacctttccaaacttgacatttcggtggacttagtactgccagaattgtatgaccagtgcatgtgtgctctgaatattgacaagaatgctacaggtgatgcagttgccaatacagaactattattaaagaatggttcaagaacacgacagaaatatgctgccaccttttcaaggcattcaccttttccagaaattgataattctatcttccagagagccatagacctttacaagaagcatagcatgaacctacttaacaagggggaggtagatgatattgcggtatccaaccagatgcaagtggatgagtcatttcctattcctagtttggagaatgggcatgtttttgtctcagcatccaatgggataaaagatgtgccaatgcctacattagaatcaggcaaagtggaaactacatctcctgcaaaggagcaattggaagagatcaatcaaacctacggccaaatggaggaagatcataacaagactggcctgtctagaccatcttctggttgtgcgaaccaagaagcagctgtagcaggtttgcaagagaaagagcccaaaatcacttctgataaggtgaattcaggggatgcaaaggaggattacactttggcagctaaaaatgaagctcagttggcccctactttgcacggagagggagataacatagatagcgaagccaaaactactggttttgcccgttgtgcagatgaaaagctgggttttggtgacacaaaggttaatcctaatcccttaattgttgaggatgggtctcccaaagcttgtgatgctttgatgcctggttcaaatgagtctgagtcactaattttaagccggatacatcattctcctgaaagtacacattga

SEQ ID NO: 24539 - DNA, 1647 bp, Glycine max
  Peptide Sequence Number=SeqID_141317
atgtcgtcgacggtgctggaagtgacgcgggcggcacacgaggaggtggagcggttggagcggctgatagtgaaggagctccagaatgacccggcctccaacaaagagcgtttgtatcagagtcaccgtgtgcgaaacatgatcgacaccattacttccacaactgaaaagcttattggaatatatgaagatagcgacaatgcaaggaaggatgagattgccgcactcggaggtcaaactgccactggaattaacgttttcagtgccttttatgatagactcaaagaggtttatgattgtatttgtgtgtgcaaatggaaggaaaatttgggatttaatatacgagagtatcataggaagcacccagttgctcgtgttgttgacgccaacgacgattatgaaacacttctcaatgaggaacttcaaattgagttcagtggagagccttttctgatcactgattctgtggaattctttcaggaagcacttggtcgatacttagacttgcatgaattatattatcagtatgtcaattctaagtttggagagccaattgagtattctgcatatcttgatgttttctcagacacagataagattccccgcaaaatgaaaatgaccaggcagtaccgagaatatttggcgaatcttttggagtatctgttatactttttccagcgtacagagcccctgcaagatcttgatcgaattttgtcaaaggtaacaactgaatttgaagaaagttgggctgttggaaaggtacagggatgggaaaatgacaatcaggaaaatggacatgtacttgctgagcatgctaccattgatcttgattattatagtacagttgaagagctgatggaagtcggtcctgaaaggttaaaggaggcactggctgcgttggggctgaagactggtggtactgttcagcaacgtgcagagaggctcttcctcacaaagcacacacctcttgaaaagttggacaagaagcattttgctaagggtgcacgtggtgtagaaaagaatggggttgctgcagtttcacaagaagatggaaattctaaagaaattgcattgatggaagccaaaatgacaaaactttgtgatttgttagaggagacaattgctcgaacaaaagacaatgttgtaaagaagcaagccctaacatatgaggaaatggaagcagagcgcgaggaggaagagacacaagaggacactgaaagcgaagatgaggaggagcagatatataatcccctaaaattaccaatgggatgggatgggaagcctataccttattggctgtataagctacatggtctgggtcaggaatttaagtgtgagatatgcgggaactacagttattgggggcgtcgggctttcgaacgacattttaaagaatggcgccatcaacatgggatgcggtgtcttggtataccaaatactaagaatttcaacgaaatcacatcaattgagagtgtgttaaccagtgtcttgagagcacaggaagcaaaggaactttggaagaagatacagcaaagacaaggagtgaacaagtggcgcccggatctagaggaagagtatgaagacaaagaaggcaacatctataataagaagacatacactgacttacagcgccagggactgatatga

SEQ ID NO: 24540 - DNA, 318 bp, Glycine max
  Peptide Sequence Number=SeqID_141318
atggaggggagtggggataatgggaaactgtgtgctttaacggaaatgccctcgtttgtttggccttatgtcggtggtgtccctgtgcggcgcgagtttcgtgtttggttcacggtgctgttaattaggttacgaagctctccaataggaaatagacacggcgtttcgtggtggtgctcgcgtggggcactgactcaaaccctcatctttggctccttcatagctatagagcaagatcattgcaagaaggacctctttcaattacactgtagcctcttacgatcaggccacctctaccacaaagtaagaccatcataa

SEQ ID NO: 24541 - DNA, 685 bp, Glycine max
  Peptide Sequence Number=SeqID_141319
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccagcggcataatcgcatgctgacctccattcattgtgacgttaatcgccagggcatcgtggaggagacgtatctgggaccgatacgcgccgcagagcaccctgaggctatgggtctgtttaaagtcagtgatatggcactcctgagtcagtggcataagcaatgcctgcggaggatcacggttaatgatacgagctattacgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 24542 - DNA, 426 bp, Glycine max
  Peptide Sequence Number=SeqID_141320
atgacgtatgaccctaccattgaggactcgtatagaaagcaagttgtaattgatgatcagccatgcattcttgaaattcttgatacggctggtcaggaagagtatacagctttgcgcgatcaatggattcgtgatggtgaaggctttctcttgtgtttttccatcacgtctcgcagtacttttgagcgccttgaaagattcaaagatcaaattgaacgtgtaaaggatgtggatagtactagacagcttgttcctatgattgttgttggaaataaggccgaccgtactcacgaccgcgaagtctcgattacagagggtaataatttggcgaggcatttgcggtgcgagtacattgaaaccagtgcaaaaactactctcaatgtcgaaaagtatgcatttgtttgcaaattggacttttattattag

SEQ ID NO: 24543 - DNA, 210 bp, Glycine max
  Peptide Sequence Number=SeqID_141321
atgtttgtgatgaggattctaaaggatggaggaacagaagtggctgaaaatggaatgattcatgtgggagaaaaaaagcttaaaattgatcagggagagagtgaagcagaagggttaaatgatgacgagaaaagaagagggcactgtgcccccaaaacaggacaaagtttggcagtgaggatagtgatgatgctgagcatagctgaatag

SEQ ID NO: 24544 - DNA, 110 bp, Glycine max
  Peptide Sequence Number=SeqID_141322
atgagtgctgttgttcctgatttcgacaacctggacaacactcaccacagtgatgctggctctccaccatctcaacagattcaagttattaatgaccgcaaagagtttac

SEQ ID NO: 24545 - DNA, 285 bp, Glycine max
  Peptide Sequence Number=SeqID_141323
attccaagcttaaagaatagcgtgaaagcagacacgactgaaacagacaatggtaatataaactcttcaactaacccagattctccaccactgacaggaaacacacttcacattccagttagatatgcttctcgtacactgacattggactcgacagagtttgaaaacagcagggaacaacatcaaagagtggatatcgagacagtcagaagaaaacatgccaatcgcgaaagagggtatggcccagttggtggattcaagtcgtttccatcaccaccgcagtaa

SEQ ID NO: 24546 - DNA, 633 bp, Glycine max
  Peptide Sequence Number=SeqID_141324
atgcagttgcattgtttggagaaaaatggcaagcagacaacaaaaatggtctcttattgtgcttaccacagggctcccaatccagatacagttttgattatgcaaacccctcttggggtcatttcaactaaaagccttctccaaactaagaaaaaaactggttcgaggttaatctcatctagcagaaaaaagcaagatgactctcctgttgataacactgagcatgagccattttctgctgctaggtgccgtatctttcaaagaacaaaccataccaaaaagagagcagcagatgaagccgtttctcatcgagtgaggggtccctatcatcatcctttagatgcaatagagagtttaaatacacacagagtagtacatgaacctcaggcattttcttctttcagagaacgcctataccacttgcagagaaccgaaaatgaacgggtttgctttggtagatcaggcatacatgaatggggcctctttgcacgaagaaatattcaagaaggagacatgaggcagataaaggggaaccctttcaagaatcatcattatgacatctgtcctgcaagggaatacccattttcaaagctgtattcttcaggcttgtcaactagtattaatataatatag

SEQ ID NO: 24547 - DNA, 107 bp, Glycine max
  Peptide Sequence Number=SeqID_141325
tcgtaaggaataagttccaacatttggaatctcaaaacccacgaatggaggcagccatgggacttcacaacggattggtggctgtggatgtgccaggaagccggtag

SEQ ID NO: 24548 - DNA, 1389 bp, Glycine max
  Peptide Sequence Number=SeqID_141326
atgagaggagaagtttttggaggtggaagaggtgatatagtgtgggccaaagctgggagaaaggaacctttttggccagccattgttattgatcctatgactcaggcacccgagttagttctcaggtcttgtatagccgatgcagcttgtgtaatgtttttagggtatgcggggaatgagaatcaaagggactatgcatgggtgaagcatgggatgatttttccatttatggattatgtggacaggtttcaggggcagtctgagttgagttactataatccttctgacttccaaatggcaatagaggaggcatttttggccgagaggggtttcacagagaagttgatagcagatataaatacagcagctactaacaatggttatgatgattctattctgaaagcctttcaggaggtcagtggtacaaaccaatatgcaggatatcattttctgaaccaggatttatttgataagaaagaaacacggccctgtgaagcctgtgggttgagccttccttacaagatgttaaagaaaacaaaagattcaagtcctggtggccaattcctatgtaaaacatgtgctaggttaacaaaatcaaaacattattgtggcatatgcaagaaggtttggaatcattcagatagtggaagttgggtgcgctgcgatggatgcaaagtgtgggtgcatgcagaatgtgacaaaatttgtagcaaccttttcaagaatcttgaaggcactgattattactgccctacttgcaaagccaagtttgattttgagttatctgattcagaaaaaccacagccaaaagtcaagtggagcaaaaacaatgggcagctagtgcttccaaatagggtcactgttctctgcaatggtgttgaaggcatatattttccaagccttcatttgacagaaaagcaagcacttagtgaatgggaacgacacacaggttccaaattaagaaattggagaacaagtattagggtgaaagattctatgctacctctggaacaatgggaaccatctatacctatgtactcagtacctctgatgctgcagttggcagaatttcatgctactgctcaggttcccaccaaacctaagaaaccttctctgaaagaaagaaagcataagttgcttaccttcttgcaagagaagtatgaacctgttcatgctaagtggactacagaacgctgtgctgtttgtagatgggttgaagactgggactacaacaaaattatcatttgcaacagatgtcaaatagcagttcatcaagaatgctatggagcaagaaatgtccgagattttacatcttgggtttgtaaagcttgcgaaagacctgacatcaagcgggagtgttgtctttgtcctgtaaaaggtatgatgtag

SEQ ID NO: 24549 - DNA, 231 bp, Glycine max
  Peptide Sequence Number=SeqID_141327
atgaacttgctcacaaatgatgacgtgatcatgtgtcgagtgttcccaacaacgttgaagggtgttgaggttctcgttagtcttagtccaaatctgagacttgagctcaaaggacgtgcttactacaatgattatggctctaaagtcaggatgcttctcgaacaacctatcatgtatgtagaacaacaagaaattggcgtcattgtcgggtacttgcgtctcaatatttag

SEQ ID NO: 24550 - DNA, 207 bp, Glycine max
  Peptide Sequence Number=SeqID_141328
atgctggtggtggggtcacctgtcggaaaggttgccggagctccggtgaaggacggaagctgcggccggaaaaggggcagcaagcagaaaggtcaactggaatgcggaaaaaggccgttggaagaagggcggcaagtggagagctccaccgaaatccggaaaaaggctgtcggaaaagtgacagcagccagaaaagtcactggataa

SEQ ID NO: 24551 - DNA, 457 bp, Glycine max
  Peptide Sequence Number=SeqID_141329
gcttactaaatcaagtcaaaatgacatgcgcatcaacttggcaatatctgctgtttttacagcttggatccttgtcaagcgcagtgctgaatataaacctttgcagtttttagcctttgcctttgtttataggctttttgagaagttaaaagcctctgaatctcctgtaacccccaaatataatgaagagggtgaagacacaggagaaggactccgcatgggaaaacgactgctccgatcactagccttggtttttggatgtgtagctatttcatctttggcatacactttcattttgaacataattgagtttgcaggtggttttattcctactcttttgtacaacagtcagttcatgtggtgtgaaggagttgagaaccagctgaagtacatattagtgtaccagagtccagtaactaataatacagctgagaaccacccaacaacaaaaaattag

SEQ ID NO: 24552 - DNA, 1077 bp, Glycine max
  Peptide Sequence Number=SeqID_141330
atggtacctaggatagtggatcttcggtcagatacagtaaccaagccaagtgaagcaatgcgagctgctatggcgagtgctgaggttgatgatgatgttcttggccgtgacccctcttgttttcggttagagacagagatggcaaagatattgggaaaggaaggtgcactttttgttccatcaggcactatggccaaccttatatcagtgcttgtgcattgtgacataaggggaagtgaagttattctgggagacaattcccacatacacatttatgagaatggcggcattgcaacccttggaggggtgcatccaacaacagttagaaacaatgaagatggaaccatggacattcatttgattgaggctgccatcagagatccaaagggggagctagtatatccaaccacaaggcttatttgcttggaaaatactcatggaaactctggtggtagatgtctttcagttgaatatacagacagagtaggagaggttgctaaaaaacatggattgaagcttcacattgatggagcccgaatatttaatgcatcagttgcactaggtgtccctgtggataggcttgttcaagcagctgattcagtatcggtatgtctatcaaaaggcctcggtgctccagttggatctgttattgttggttccaataactttatcaccaaggctagacggctaagaaaaacattaggtggtggaatgaggcaggttggcatcctttgtgctgcggcactcgttgctttgcaggaaaatgttggaaagctacaaagtgatcacaataaagctaaacttttggctgatggattaaatgaaattaaaggactgagagtggatatctcttctgtggaaaccaatatcatatatgttgaagttgaagagggctcacgagctacagcagcaaagctatgcaaggacttggaagactatggtatccttcttatgccaatgggctcatcaagattgagaattgtcttccaccaccaaatatcggctagtgacgtgcagtacgccttgtcgtgctttcagcaagctgtcaatggagttcgaaatgaaaatggcaactag

SEQ ID NO: 24553 - DNA, 177 bp, Glycine max
  Peptide Sequence Number=SeqID_141331
atgtcactttgtcgcacctcaggcagggatgtcaatctttctaggaggggcttgcacttgaggggcactggttatatggatttggggagctctctcatgaaaggagggattcttggcaagctgaattgcagactcgctatcaaaaaagtgcaaaaaggatcaggaataggaagatga

SEQ ID NO: 24554 - DNA, 345 bp, Glycine max
  Peptide Sequence Number=SeqID_141332
atggagaaggtgatgaacattctgaagccgaagccaaatccgcagcaactattgagggattggcagcgcaggcttcgccaagagtgtcgcaacattgagcgccaaattcgcgatatacagagagaagaaaaaaatgtgcagaaggctattagagaagctgcaaagaggaatgacatgggctctgcaaaggcggtgatttgttatctgttaagatttaaaggttcaaaggataaggcacttgccaaggaacttgtgagatctaggcaaactgtgaaccgcctttatgaaaacaaagcacaaatgaattcaatatcaatgcaccttggagagagtgttggttcttga

SEQ ID NO: 24555 - DNA, 1029 bp, Glycine max
  Peptide Sequence Number=SeqID_141333
atgcagaaacctttaaagaacaaacaaggtggctctagatgccatattgaagagactagaggtctaaaagaactgttaaatcagttaatactgttagaggcagttaattcagttagggaaattcgtttggaaaataaagttgcggttcacaatggtattgtttgcttaaatcctaaagtattgactgtattaggaggtgttgttcaatcgctctatgaagaatgggagatgaaccaaaaatattcaggattctcccgatcatctttaagaaagctagagaatcgagatacaggtggtcctccacagtttgtgaagctgcaggttggatcttcttcaggtattgcagattataactctagcagaagtcgtaagccaattgctgtggttggtgaagctgagatgagaccaacaagtactgcagattataactctagtagaagtcgtaagccaattgctgtggttggtgaagctgggttgagaccacctgatttccagcaagaccctaatcagaaagcagatgcaaatctacaatccaaaccacctcaagaaagagctgaagacaaggctagtagtagttcaggcacaaggccaaaagaagttgtggaatctgttcctgttcaaaatcaagcagctgcccaaaagttacttcagaagttaaatcacccaagtcagaatgatcgacatcataggggttggaaacataggggcaaggggaaacaagaagatccagttgtattcactctggaagaatatgaaaacagaaaggcccagacaaagccttctattaaagactgggatctagatatcagtcgtgatgagcatcttgctagacagcttcaaaatcaactagaccttgaagattctcgggtaggaaggggtacttatgaagacaaggcacaagatattaggatgagtatgttcgcatatgaaagggattctgacagcagccatcaaatggggcaaggaggaaggggaaggggaaggggaagaggaaagggtagaggaagggggagaggaagacatggttaa

SEQ ID NO: 24556 - DNA, 552 bp, Glycine max
  Peptide Sequence Number=SeqID_141334
atggctctgggaatctctaacatactgcactgccccaaattgagtttctcccacaataattttctccccaaagttccaacctctatcagcctcaggtttccccagacagcagcatggagtgatagaaagattatctgtgctgctgcatctgcggcaggaagctctaatcccgatggtgaatttaatccttatgaggtgctaggtgtaagccctattgagaaatttgacatggtcaaggcagcatatgctaaaaaaaagaaggaggctgagatgaatggcgatgaagcaactgcttcaagagtagtctgtgatgtcattgctgacatgaaaactagttttccaagtttcaaatgggtgaggttgattgtttgcaatcatgtttggaaattgaaactggaaaaggcatatgacaaactcatgatggctcaattgtctaatcggaaaaagggtgtgacttttggatcatttaaggtttcaaaggagatcaagtatgctgacaagcttccagttataccttgggggccaaggtttaatgttgctttttatgattaa

SEQ ID NO: 24557 - DNA, 168 bp, Glycine max
  Peptide Sequence Number=SeqID_141335
atggttcaaggcaaatttgttccaaatttgggggaggcactgggtatgaaatctaagtgcctacgaaaagagggcaagtatggggaaggaatgaataaaaaaatgaaggttattcaatggatgaatgctctcctagaacctaagcttttgaatcctagaaaaccatga

SEQ ID NO: 24558 - DNA, 237 bp, Glycine max
  Peptide Sequence Number=SeqID_141336
atggctgagtatgatgtcaaatcaaaggaaaaagaaatttcagcagcttcttcctcccttccacgttgctttttctcttcttcttctccaccattgttgcctccattgaagctccaaattcctcttcctttctaccccaaattgcaaggaaaagccattttcggagtcttggagcatacctctacttcgtggggctttaaatttcagaaaactggtagagaggatggggagagttaa

SEQ ID NO: 24559 - DNA, 207 bp, Glycine max
  Peptide Sequence Number=SeqID_141337
atggaaatttgttccacaggaaacagggtaatagcagagcaagagaaacagagtggtttgagtagaggggacaaagcaataaagtatttatatgaagagaaatgggaagtaactacggcaataattatgaggaaggtgagttgcaccaagccaatggcagtgaagtgtgaacataatggtgatggtggaggagatggtgggggatga

SEQ ID NO: 24560 - DNA, 843 bp, Glycine max
  Peptide Sequence Number=SeqID_141338
atggctgtcaagaagaatattgaagatgtacaaggaaaagataattacccatgtggacagcaattgctgattcacaatggtaaggttttgaaagatgaaactacattagtagagaacaaagtctctgaagatggttttcttgttgttatgcttagtaagagtaaaacatcgggttctgctgcagcttcatctgttcagcctgccagcaatcctgctacgactgtatcaatgtcaaattccacccctccttctgatcctccagtgcaaactcaagctgcaaacaacagtacatctagcacagatgccccaactacaaagtatgatacctatggtctggctgcttcgaatttagttgctggtagtaatcttgagcagactattcaacaaattatggacatgggtggtggcaattgggacagagacacagttagtcgtgctcttcgggcagcttataataacccagagcgtgctatagattatttgtattctggaatccctgaagcagccgaagttgctgtgccagttcctcaaacagctggtatgtcttctggagcagttcctgtaggacctaattcatctcccttaaatatgtttccacaggtaaaaactcatgatactgaatggatcatcaaaagtaattccatcttgctatttgcatctttttctgttactttctgtgctttacatcaagctgaaactctctcccaggagacaatttctagtactggtgctggacttggatcgctggacttccttagaaataacccccagtatgttagaagtgtatgtggttcatgcatcacatgcaaaatgcatttaatattcatggggattggtgtctaa

SEQ ID NO: 24561 - DNA, 1374 bp, Glycine max
  Peptide Sequence Number=SeqID_141339
atgaggtgctgctttctaccttgctttcctacttctaaacggaggaaccaattgcgttccgccgatgcaacaccctccacagatgaaccccaaacccatgggagagaaggagcttttgaacctctcgcacgccaaaagaccgatgttgaagaactcattgattgcatagcagaatcaaaaataaaaaatgtagagcaatcaattaagagtgttgaaaccaaggaggagcggtcaagggaagaggaagcacctcagatatgtaagaaggaagaagaagatgatgagattagtaaaagatcgcatcaagaagagtcttctgagtcactgttctccctctccatttcttctagaaataaagtttcagatgccgaggccgaagttaacagtccaatacaactcgtatgcacatttgggtcatccccaagtgttaaagaaggaaaaccatccgagaacaatgaacagcaacctgccaccaaggaattaatcaagaaggaaggtgaaaaaggaagagcgaatgaccctgtcactcagtatagatatagagattgccctgatgatgacgggtacgatgataataatttaaatgttagtttggatgctacacttgaagatgatccttccaatgagaagaaagattgggtagaaggcgctgatgttaaccaaacatgggttcaagaagagtcctcagaatctttcttttctatgtccgctaattctagaatacgaatttcatcagctgaagcagagaacgaagttaatagtcaaatgtcagctcatgctacaagcacaaacagcatcacacaaggaaagattccagatgtttcgtcagtgctgaatccaagtcagaggacagtagtcaaagcaacactgaagaacgataaagaaaacatcaacttggtagtgaaagatgtcaacatacccattagtccagagcctagtttgaagctgtcaaaccgcaaggcaaggcagaggttcgatgacaaaattggggtggacaccagcctctcgagctggttggttgaatcatcggaaaccaccctgaattccgtcaacaataccagttctgtgggagaacaaacaccaaaaggaagaagaggttcaccgtggagtcatgaggataggccaattttaggagcattaacccttgaagagatcaggatgttgtctttatctgcatcttcaagaaggtctagaagccggagtcccgacgagacacccatcataggtactgttgggagctattggagtcacacagagcagagcatggatttggaattcaacaaaagtggaaaggatgtgaaaccaaagaggagttcaacggcattgcagaccagactagaaagagcgtttgaagccagtgctgcaggagtttga

SEQ ID NO: 24562 - DNA, 1863 bp, Glycine max
  Peptide Sequence Number=SeqID_141340
atggaggcattgaatgaaagatctcttgcgagagtgatttcgcatagagtccttcaaatgggaatctcattcccatgtcagatttgtgttgtggggtttctttgtgaagtctgtcttgcctctttcatcttggctgctctcacttcctttggcactttacagcttgatcgattttcattctcaaccatgtcaatgcttaatttgtcttggaactctgatctcaataacaacatcacttggagttgtgtgttgactaaatctgaaagtgagtgcttgctgaaacttggaattagtaagtccagtttgcctaaatcccctcatttggaaaactgcaaggtgaaaacgcagctatatgattgtcttgataagcgcacaggaaatcatagcttccccccatggacaagttggaaaggattgttggacacacaccctgctgctgcaaccactgagcagattaagatattaaggcgtcaagctgtacttgagagtgcttatccaccttggattgcaggatctgatgaagagaactatcctttaactagaaaagttcaacgtgacatatggatccatcagcatccattaaactgtaacaacccgaatgtcaagtttcttctagctgattgggagagattacctggctttggcattggtgctcagattgctggaatgtgtgggcttcttgctattgcaatcaatgaaagaagagtccttgtcactaacttctacaatagagctgaccatgatggatgcaaaggcatgataaattattgtgatcaatactctggcactgtaccattttgcggatcttcccggtctagttggaattgttacttctttctagaaacttcactagaatgtcgtcaacgagcgttggaactcatgagaagtgaagatgcatggagtaaaggaattgaagcgatgcaagagaccaaggtcgctttggagaaaatcgtgaacgttaggttaagcgctgcagcaatccgcggagttcaattcgggatcaagactagcctcagccatgatctcctcgcaacaggtctcggaagcccacggtggtggcggagtgggggcccaccgaggatcggcgtcagcggagacgcagaggacgcagaagtggttgaaggcaactgggcggaggaggaagtgccatggaactatttgcaaccaacaaccgatataaatggaagtctggtggcttctcatagaaaactggatagacgatggtggagagcacaggctgtacgttacttaatgaggtttccaactgagtacacatgcaatttattgaatgaagcccggcatgctgcctttggaaaaatagctgcggaaatggttcttgaaagtccggctgaagaatggcctgaggaaaataggaacaagtcagggtctggcattgaagaatatgtgtggtccaatcacaagccatggatccctaggcctcttctaagcatccatgtaaggatgggagacaaagcgtgtgaaatgaaagtggttgagttcgaagaatacatgcaacttgcagaccggatcaggaggcatttcccaaaccttaatagcatatggctgtccacagagatgcaggaagtcatagacaaaatcaaagaatattctggttggaactttcactatactaaggtaagacgccaaggtaggactaatgtgtcaatggcgaagtatgaagctagcttggggagggagagcagcactaattacccactggttaatttcatgatggctgctgactctgattttttcgttggagcgttgggatctacttggtgcttcctcatagatggaatgagaaatactgggggaaaggttatggctggctatttaagcgttaacaaggacagattttggtag

SEQ ID NO: 24563 - DNA, 2319 bp, Glycine max
  Peptide Sequence Number=SeqID_141341
atggaagccaatggaatcactcatgacagtagcctaggagcggggagaagggataagagagaggtgggagacaaaacgatggaagatttaagtaaatacgtacacagccctgctcacttggcagttgccaggcgtgaccatgctgccctaaggcacattgtttctgccttgcctaggcttgctaaggctggtgaggtcaccacagaagtagaatctattgcttctgaacttcaagctgatgaggtctctactgttattgattgccgtgacgttcctggtagggagactcctcttcaccttgctgtgcgtctccgggatccagtctctgctgagattttgatggctgctggtgcggattggagtctgcagaatgaacatggttggagtgctctccaagaagcagtgtgcaccagagaggaagcgattgccatgattattgcacggcactatcaacctctggcttgggctaaatggtgtcgtagacttccccgcatcgtcgcttcagcatctcgaattcgtgatttttatatggagataagttttcattttgaaagctctgtcattccttttattgggcgaatagctccttcagatacttatcggatttggaagcgtgggtctaatctccgtgctgatatgacccttgctggttttgatggcttacgcatccagcgatcggaccagacttttttgttcctcggtgagggctatgttgcagaggagggtaattttactctgccacctggttctttgattgctctttctcataaggagaaggaaatcacgaatgctttggaaggagctggtacacagccaacagagtctgaagttgctcatgaagtttccttgatgtctcagacaaatatgtatagaccaggtattgatgttactcaggctgaacttgttccccatttaaattggaggcgtcaggagaagactgagatggttgggaattggaaggcaaaagtttatgacatgcttcatgtgatggttagtgtgaagtcaagacgggttccaggtgctatgacagatgaagagctttttgccgtggaggatggagaaagcatgatgaatggggaaaacaatgatgagtatgatgatgtattgactgcagaggaaagaatgcaattagattctgcactgcatatggggaactctgatggtacttatgaggatgaggaacatggagcctttgatggtcaagaaaatggttctgcagcttcccgtgagaattctgaagccaatggtgtggttaaagaaaagaagagctggtttggttggaacaagaaaagtttgaagagtagcagtgatgatcctgaggattccaaagctgtgaagaaaaattccaggtttggctcagaaggtagcaatcagagatcagctgatcagccgaagttagcatctgactttctgagggaggatagtgtagactctaggaagggaaaagataaaaacattaaaaagaagaagaaaaaaggagcaaacaacaatgagtcaaagaatgagagtgagtataaaaagggtttaagacctgtgttgtggttgacgccagactttcctctgaaaactgatgagctgctgcctctgcttgacatcttagcaaataaggttaaggctattagaagactcagagagcttttgacaacaaagcttcctcatggaacttttcctgtcaagtacagcatgctcatattacctgtagctgttttttttagggattgcagatgggtgaaatcagcagatagacaaggcagagacacagatggccgaagtaaacacccaaggctaagaccagaaacacaggtggctgaagtcagaatggagaaggccaaacactggggaacactagattttagctctgtttcagcacagagagcccctccaaaacaccttctggttttaatgctaataacatctggtactcaggtcgctatcccaatagttcctactattcgggtgcttgtcacttttacgaaatttgaggagcttcagccagtagaggagttttcaactccactttccagcccagctcatttctatgatgccaaatccaaggaatcagagggttctggttcatggatttcatggatgaaaggaagtcgtggggggcagtccagtgactcagatagtcacagatataaggatgaagttgatcctttcagcatacctgcggactacaaatgggtggatgccaatgagaagaaacgcagaatgaaggcgaagaaagccaaaagcaagaaacataagaagcagacagcggcaaaaggtggagatggagtgcagcatcagaggaccgaggacgtagaagaagaacagtaa

SEQ ID NO: 24564 - DNA, 1989 bp, Glycine max
  Peptide Sequence Number=SeqID_141342
atggccaagaacatagaaaagtcaattgttccaaaagaagaagaagaagaagaatcaggggaggagtggtgttttgaatgcaaggatggtggacaaatggtcgtttgtgatcacaacgattgtggaaaagtttatcacccggtctgtgttaacaaggacgattctttttttgacattgcaaaatattgggtttgtggtcggcatttttgcttcgactgtaatgaacgttctaagtttcattgtattagctgtccaaatggtgtgtgcagaaagtgctttgctgcctctgattttacggttgttcgaggggtaaaaggcttatgcattgactgttcggagcttgcggtgattatagaacgaaatttggaccatgactccgaggggaacaaaataaccttagatgacacagaaacatatgaatatctattcaaggagtattgggacattattaaggtaaaagaaggattgactagtggtgatatccttgctgcactgcccaactacaaaaagggtaaacaaattccgcatcataaacaaatttgtaaaggtgaagaagaaaagcaaactgatttgatgtcacaggttattgatgaagattataagccagatgaagattataagccagccaaacgtaagaggtacaattcagaggtaaaagacggattgacttgtgatgatatctttgctgcactgcccaactacaaaaagggtaaaaaaattgtgcatcataaaagaatttgtaaaggtgaagaagaaaagaaaaatgatttgatgtcatgggaatgggatgttgttgaagattataagccagccaaacaaaagggctacaattcagaggtaaaagaaggattgactggtgatgatatctttgctgcacagcccaactacaaaaagggtaaaaaaattctgcatcataattttttttgtaaaggtgaagaaaagaaaaatgatttgatgtcatgggaatcaaatattaatgaagattataagccatccaaaaggaaggggtactattcagagacaaaagaaggattgactagtgatgatatctttgctgcacagcccaactacaaaaagggtaaagattttctgcataataaaaaatattgtaaaggtgaagaagaaaaacaaaatgattcgatgttaaggcatagtgatgaagattataagccagccaaacagaatttagaggagtttgagggatggggatcaaaacttctcattagcttccttgcatccattgggaaatgtgaaagtgaaccattaacgcaatgtgatgtaaattctctcatacatgaatacattaaggagaaaaatcttcatcaccctgaagataaggggaagttcctcgctgatgaaaggttgtttcctatatttagaaagaaagttatgccaaaaagtcagatatatcctctactggagtttcacattgccaagaagttggatgattcatctgtggagaaaaaagatgagaaaatagaaaacagttctacagacaagcatgtcaatgatcagaaaacaagcatgggaagcagactatcaagtttaattggaaaacctccattgaaaaagggatctttttttatcaaacatagccgctttgtgtccattactgccaataatataaacctcatttacctaaaacgaagtttggtgctagagttatcaaaacagcctgaaagttttgtggttaaggctgttggaacttttgtcagagccaaagtggattccaatgattctaggcaaaggaagtcttaccatctcttgagagttctaggtgttttctttgatgaaatatcaaatggaactctcttgcaagtttccttcatggataaggctgttcccatttctgagctgtcagatgaagacttcacagagcaagaatgtgaggatttgcagcaaaaagtgaaagccggcttgctcccaaaattaagtgttgtggaggttcaagaaaaggctgaaattcttcacgaggatataacaaaacac

SEQ ID NO: 24565 - DNA, 180 bp, Glycine max
  Peptide Sequence Number=SeqID_141343
atggatacctcttctaggatttcaaagatgcgtaaccgtgaacgtgagaggcttcgtgggcctcaatggttgaagatgatggaatggtggtaccagtctgccgaggagagaatgtcagctcctacagtatatcctccaccccctcctcctccaccaccaaaggtgaagaagcaaatttaa

SEQ ID NO: 24566 - DNA, 744 bp, Glycine max
  Peptide Sequence Number=SeqID_141344
atggcggcggctcaacaactgccggcgagcctccgcgccgctttgacatactccatcggcgtcttggccttacggagacccttccttcacaaactcctcgacttcgaagacgaatccttcgccttactcatgctcgtcctcgaatcccacaccttacgaaccacagatgcttccttttcggaatctctctacggcctccgaagaaggcccgccaatatcgccctcaagaatgacgacgccactaccaccaccaccagcagcagcgcattacggaggcgccagagagttctttccgttgtttttttggttgtgttgccgtatttgaaatccaagttgcattcaatctacaacagagaaagggaagccaggcttcaagccactctatggggagatgaaacccaaggctttgatgatggccgaggagattattctccggtgtcaacgctaacttctgatgccgcagcctccatttcaatgcgcatcgcaaacagagttcagagaattgttgggttttgctacccgtggttacatgctagtactgagggcttgcaatttgcttaccaactcttatacctgttggatgctactggatactactcgctagcactgcacgcacttgggattcatgtttgccgagctacagggcaagagctgtgttttttcttttactttttcacacgagcaatatctcaactctcaagcttgccatacattggcggcagcctccttgttcccaaagtgtaa

SEQ ID NO: 24567 - DNA, 264 bp, Glycine max
  Peptide Sequence Number=SeqID_141345
atgttaaatcaatctgtcgccaatagtggtggaagttctgtgtgcatagatcactacgtagagacagttcttaggacggctagattactcgttgacggtgattgtgaaggatgttcacggcataacaacatcgagacgagagaggaagacacagaggggaagtttcaattatggtcattgacaaaggactgggtcacgaagatgaagaagagccactcggtgtcagtagtgacagagggaaggtcattgatgtggttgtggtga

SEQ ID NO: 24568 - DNA, 1488 bp, Glycine max
  Peptide Sequence Number=SeqID_141346
atggcccctaatccaagagttaataaggcctttagctttatgaaggccttaggaatttctgataaggatgtgaagccagtgttgataaagctgttccgagtttatgaaggaaactgggaacttattgaagatgacaattaccacacacttgtagatgcatactttgattttgagaaacacaagggagtcgaaggtgagagaaaagctaatgacagttgtcatggtggagaaaaaccaaaacggggaccgcttttggtagatgatgatgatgacgacaaggatttgcaaacaatggacagttcaagtcaaatgttaagtgcagaagacaataaaatatcaccaaagacatttgaacagaaaatcattgagccatctcaaacattcatgaaagatattaagcccaaaaccagttcacaagcatcacatacaatgttgagtgaggtagaaaagatctcaaatttacctcgtgtggcagctaaagatagaaaatcataccctgagaatgcatcatctgcagttgagaaagtgctagtgaagccaagaactaagaaactcaagatgcaacttgcttcaacgaatcatattggtttacctgatgcgtcggatgaaaaactgtgtctcaaacctctgtcaactcaggatcaggatatggaaagtaaagatgatgttatatccgcctgcgaccgtaataccccagcttataatggaaatattacgattgctagttcttcacgtctgggagaagtaaaaatatctttgaattgtgactctgcgttgggacaaccaaacttcagtattcctaatttggatattgttatgaagttcatggacaagaagtacattcgctcttgcaacactgttgagcctcaattttctatggcaaagctattggatgacctttgcaggatttatctcaagttgggatatcgaaagggatcaaattccaagcgtgccaatttacagcaatatgttaatcaaggtgaaaggaatccctttcgttttatcagtgacataacaaaaggttcagaaaaggtgaaaatatcattaatagatgaaactggcagtgaagacttgccaaagtttaattacataccatgtaatataacttatcaaagtgctaatgtaaatatttctttggctcggatttcggatgagggttgctgttctgattgttcaggcaactgtctttcctcaccattgccttgtgcatgtgctcaggaaactggtggagagtttgcttacactcctcatggtttgttgaaagaagaatttttaacagcttgtgtatctatgaagaatgaacctcaagaccatcattatgtgtactgtcaagagtgccctttggagaagtccaagaatgagtacatgcccgaacgatgcaagggccatatggttagaaaatttataaaggaatgttggagaaaatgtggatgtgacatgcaatgtgggaatcggatagtgcaacggggcatagcatgcaaattgcag

SEQ ID NO: 24569 - DNA, 548 bp, Glycine max
  Peptide Sequence Number=SeqID_141347
ctaattctgatgacactgatgagaaatcaaaggtgccagttgtacagcagagaggacgttttaaggttacatctgagaatgttgacccagaaaaggtggcccctcctcctgtattgcaaaagagccatagtgtgcaggtttttagccagcataatgctgcttctacacatccaactttgccattattaccagcatctgatgccacaccatcaaatctttctggctgctctgtgtttcctgtgttgcactctgtactgcagataaatattcttcaaagggagagcattttaagtttaatgaagcaaattactgccggcgactcttcagctgatggcacatgtaacccagcacagatagcaataactgagaaatctttgcttgaagcagctcacgagagggaaaaggagttacttcatgagataacagagttgcagtggaggtgtgattgccttgtggaatggatgctttcaagtggatggcttggatactcaattttaagttcttcacggacacttgaaaaattgaagtgcagaaagaaactagaataa

SEQ ID NO: 24570 - DNA, 450 bp, Glycine max
  Peptide Sequence Number=SeqID_141348
atgtggtgtcgtgctcttgcatacgtgtcatttcgtggagtggtgcatactggagacgttgtggcatgctcttgcatacatgtttcttcgtggagtgacatgtactggggacattgtggcatgctcttgcattcgtgtcatccgtggagtggcatgtactggagacgtagtgtcgtgctcttgcatatgtggcactccatgagtggcatagtgcgctctggcaatgtaatcaccttgagagtgtttgaaatgagcctccagttgatcatggtcagccttagctttctcagctcctcctcatggcatcactccatcttcgcaatgcaatttttgagttgttggagagtaccaatgtctggcatggctgttgaaggaggattaaagctttcgaaagggatctcgtgtttgaggccagatcatatgctaaacatgggtgaaagagacagatag

SEQ ID NO: 24571 - DNA, 945 bp, Glycine max
  Peptide Sequence Number=SeqID_141349
atgtcgcgagaaatgaagtatgtgcaacaatgtatgggtgtcaatgggcttgaaaaaatcattcttagagaagttcgcggcttctctgctgaggtttatttatatggggcccaagttacatcatggaaaaatgaccttggggaagaattgctttttgtcagtagtaaggctagttttaagcctccaaaatccatacgtggaggtattccaatatgctttcctcaattttcaaatcacggatctcttgagcatcatggatttgcaaggaacaagttttggaccttagatcctaatcccccaccatttccaacaaatagcacaaacaaagctttcattgatttgattcttaagcactctgaagatgataaaaaaaattggcctcatagatacgagtttcgtttgaggatagctttgggacctgcaggagatctgatgttgacatctcgcattcgaaacacaaatacagatggaaaatcctttaccttcacatttgcctataatacatacttctatgttactgacatcagtgaagtgcgaattgaaggattagagacattagattatctggacaacttgaagaataaagaacgatttactgaacaaggggatgctataacatttgagtctgaagtggacaaagtatacttaagcacccccacgaaaattgctatcatagaccatgaaaggaagagaacttttgtactgcgaaaagatggacttccagatgccgtggtatggaatccatgggacaaaaaagcaaaatccatatctgatttaggggataatgaatacaaacatatgctttgtgttcaagctgcttgtgtagaaaaaccaattactcttaaaccaggtgaagagtggaaaggaaggcaagaaatatctccagttccttcaagttattgtagtggtcaacttgacccacggaaagtgctttttagttattag

SEQ ID NO: 24572 - DNA, 723 bp, Glycine max
  Peptide Sequence Number=SeqID_141350
atgactgaagcaactcgacccaaaaccagaatggaacacattgaagaagccatagccaagctagcctctaaccaacttcatgtcatcaccaaactagatgaactcattcaccgcatcattgtgttggaagcccgtcgaccccactcacccacacattcatcttcttcctctgtgaagacattcctcacacacactctaataccgtttctgtcgctgactccgtcgctgccttcgccgctcaagccgactctgtcacccatgctttcttcgctgcctatgccaactccgccaccacatcctgcagtcatgccgaaacaccccacacgcttaccgactctgtttcctatgcctgttcctcaccttgccaccaacagcaagcaccaagtggcccacgcgtcgtccttcatcttcaataaacttggccatgcccgtgtcgttgcttccctagacaacctctcatgtattgttgttcattatggtcgtgaagcggctccgcatgacaagcttttagaacatagcgacatgacactgtttaagaggggagttgtgccctatgggtctgccatggttgcacgcgagtgccaaccagctgcttttgcattagggatggctgttgacccaaaggagcctcgtcggtacagaccttgggatcctggaggacctcgacgaactcgtaacaccttgaggacaaggtgttttcggatgggcatagaaatgttatga

SEQ ID NO: 24573 - DNA, 1122 bp, Glycine max
  Peptide Sequence Number=SeqID_141351
atgtcggtggttgcacccccataccagctccttgagatcaacgtgatctcggcccaagacctggcccaagtgtcgaaatccgttcggggctacgcggtggcgtggctccaccctgagcgcaaattggccacccaagtggaccaagaaggccacaccaatcccacctggaacgagaagttcgtcttccgcgtcgacgacagcttcctcaattccgacaactccgtcatcatgatcgagatctattcccacgcctggctccgccacgtcctcatcggcaccgtcgccgtccaactcaccaacctcctccctcccaaccgaaaacccaagctccgcttcgtcgccctccaaattcgccgaccctccggccgcccgcaagggattctcaacatcggcgtcaacctcctcgacagcaccatgcggagcatgccgctttattctgaactcagctcctccactgtcggctattgggacatcatggaatcatctaagaaaaaaaagaaatccgaggaggacgacgacaatactcaccatcatcactcgcccttggattctagtcttttgacgctacaacgttgtcagagtgagaaaaacgactccaccgttaacgattacgcctaccatggcaatgcaaaacattacggttacgacgggcaggattccgatgtgggtatgcggaaaggtgccgtttttaacgaaggctcgcttatttccgacgtgggcccctctccgtcggtggtggcggctgcgattgcgaaggggctgtaccccatgccgccgccagcgccgcgcacggtggagagctccacgatggatgggtggtcggagaatagcggcacggaggggatgaagacgaagattgagaggtggaggaacgagcttactccggcgtatgaggactacgttgatgagcggaaggtgttgaggcagacgtcgaagcgcgtgggtcggacgccgaggcggcgcgggcagggcggtgggccgtgttcgtgtttcgggtcggtgtttggggttgagatttcgattacttgcggcggcgggaaccggcggaaagggcggggaggtgacaagggtcgtgtaactagtgcgtcgtctgaactcacttacgatgattcctatatttga

SEQ ID NO: 24574 - DNA, 2634 bp, Glycine max
  Peptide Sequence Number=SeqID_141352
atggttgttactgcaaaaggaagtattcgggtacaaatcaatggcatttctcacgtaatatcagatgtatactatgctcctgagcttaagaccaatctattaagtctagggcaactccaagaaaaaggtttagccattctaattcaaaatggcacgtgcaagatattttacccagacagaggcttaattattcacactaccatgaaaggaaacaggatgttctacttgtcagcatctataggtcctaaacaccccctgtgcctccaagctgaagacgtctcggaaaaggaaactcaactatggcatagtcgttttgaacacctcaactacaaaggacttagcacactcgcaagcaaacaaatggtacttgggctaccctctctgaaatctcccaaaacaatctgcactacctgcctcgttggaaaacaacatagagactccataccaaagcaaagctcatggaaggcgtcaacgaagcttcagctaatccatgccgacatctgtggtcccatctcgcctccctcacacagcaacaaaagaaaagatagaggtggtgaattcacctctaaggagtttacagaattatgcactaatcaaggtatctctaggcaattgacggctgcctacaccccacaacagaaaggagtcgccgaacgcaaaaaccgaactatcatgaatgttgtacgagcagtattacacgagaagcaagttccaaaatcgttctggcccgaggcggttcggtggtgtgtacacgtatcgttctggcccgaggcggttcggtggtgtgtacacgtccaaaacagaagtccaacctccggggtagatcaacaaactccagaagaaatatggagtggagtcaagccacgagtggattactttcggatatttgggtgtgttgcacacactcatgttccagaccaaaagagacacaagttagatgacaaaagcctaaaatgtgttctcttgggagtgagtgatgagtctaaagcctacaaactatttgatcctatttcaaagaaagtcattgggagcagagacgtagtgttcgaagaagataaaagctggaactggcacggacatgcagaagagaataaagccaatgttcttgattgggaagacaaggaaactgaagaagatgcagaacttgtacaacatgaattaatagacggatatgacagcaatcaagacgtacttgaacctccctcaaacttagaaagcaatgctaaccaagattccccagttgacgcattaccagttgaagggagggtaacaaggactagaagacaaccagcgtggatgactgattacgaaaccaatctctcaacagaggaagagagcttaatggcaatgatgattgctaactctgacgatccacactccttcgaagaagcacgatatgcccaaagatatggagtagactatatgaaggtgcttgcaccagttgctagacttgacactgtgagggtacttttagctttggcagctcaaggtgcatgggaagtatttcaacttgatgtaaaaagcgccattttactcggtgaactccaagaagaagtgtttgtccagcagcccgcaggatttatcaagaaaggaaaagaagatcaaatataccggttaaagaaagcactatatggacttaaacaagcaccaagagcttggtatagcaaaattgagacttactttgcaaaggaacagtttgaaagatgccacaatgaacacaccttgttcaccaaaaaggatcacgacaatattctaatagttagcctctacgttgacgatttgattattactggaaatagcagaaacatgtgtgaagaattcaaaagttcaatgaagctggagtttgatatgaccgacttaggtaaaatgagacgctttcttggaatagaagtcatacaaagtgatgctggaattttcatttgtcaaaggagatatgcttgtgaaattctagccagattcaatatgacagatattaatcctgtgcgaaatcctattgttccaggaaccatactatcaaaggatgatgaaggtgctgcagtagacgctataaaatttaaacaagcaattggaagtctcatgtatctaacagtaactcgaccagacttgatgtttggagtaagtctgatcagcaggtacatggcaaatccaaaggagtcacattgggctgcaacaaaaagactcttaaggtatctaaaaggaaccactgagtacggcctattctataaaaggggaagaaaaactggtctcatagcttacagcgatagcaattatgcaggagatttagatgatagaagaaacacctctggctcagtatttataatagggattggagctgtttcatgggcttcgaaaaaacagcctgtgcatcttggatcggaggaaaaggaagaaactgagattttatgtgacaacagctctactatccaactatccaagaatcctgtccttcacggaagatgtaagcacattgcaataagatttcactttctcagagatttggtacacgaccaagtagtgcgcctgagatactgcagttctgatgagcaactagctgacataatgatcaaaccattgaagcttgatcaatttgaaaggactcgatgcatgcttggagtagtaaaagccactaagtaa

SEQ ID NO: 24575 - DNA, 930 bp, Glycine max
  Peptide Sequence Number=SeqID_141353
atgtctggcgcaggtgttggttttgctagtggaataataagccttggaagactagaagttttaaaagtaagaaagtttgagagagtttggagctgcccaagttcgcatggtaaatcatcgggtcatgtattttacaaacctttagagattccagatgatttttcctgcctaggtcactattgccagtccagtgatcagccattaagaggacatgctctcgtggctcgtgaaacttgttctgaacctgaagccgaatctccagctcttaaaaaaccaattaactactctttgatatggagtgctgattcaccacatgatggatgtggttatttttggttgccaaatcctccactcggacacaaagcaatgggcttagtagttactaacaaaccagatgaacctgaagttgaagaagtttggaacacaagggcatgcaaaagagggacgcggggtagaggtgtatcagtcgggacattcttctgcagcacctattctaataactctggaaaaatagcagatattgcttgcttgaagaatcttgactccaccttacatgccatgccaaacataaaccaagttcatgcactcatcaatcattatggccccactgcatacttccaccctgatgagtatacttgccatcatcagtgcaatggtttttcaagaaaggagcacttgcatattcaacagacagtgagaaggctctgggaggagcaaagtttccctcatcctgggagctaccttcagggatcatccacacttggaataggagcaaagaatgaagcagctagaagtaaactaacagtggattccagcaccagatacaaggttgttgcggctgagtatcttggtgagggagctattgctgaaacatgttggttacatgagagtggggtcctacagttgtgtatgactcacgttctgaaatag

SEQ ID NO: 24576 - DNA, 390 bp, Glycine max
  Peptide Sequence Number=SeqID_141354
atgcatcggcttcagcgcgcgccgcagcatgaacgcaagcgagaacggaaacgcgaacgccaacaaactctgcagcgaaacctcagcgatgggttcggatttggtgaggtaggttatccacgcgcccagagtgagctggagcaggcccagcgccgccacgacgcggctcagcgagtacatgttcttcatcatggtttccagaaccacgcgcgtctcgttcgcgagtggggagaggtcgcgctccactgttgggccttctatctcctggtgcttgaagtttgggttttggctcggaaacctgatgggtggaaggaattgggagggtttgaagattgggggtttagggttgttggagatgaaattggttatagaataagaagagggttttag

SEQ ID NO: 24577 - DNA, 414 bp, Glycine max
  Peptide Sequence Number=SeqID_141355
atggattgggcttttgtgcataaaacctgggataagtgggcttctacgaacattggttattctgaaatattggatttatcaattgagttatttgatgctggcagtgctgagcaagaagggatgagagccaatcccattgaattgagtcactttgtggacttcatcaaacaaaataaactccagacagagctcttcattattgggtccaatcagtacttgatcacgtcaattcatgagaactggtttagtgcaaggtgtataaacacatcaaagcctgctggtgaaggtgctattgttatacaaacagcagcttatatcttggttgctatgtacgaaggttccattggtccagcatctagggctatggcagctgctgatcagttaacttggcaattagggcgaaaaaatctttaa

SEQ ID NO: 24578 - DNA, 672 bp, Glycine max
  Peptide Sequence Number=SeqID_141356
atggtgttcacgtgtaagggtcttgttggttcctttttgccacgccattgtgcggattcagtcctgtcccccttgtcgcggcgtttccctgaccctgtcaacacgtttctggagtacgattttgtaccgtacttcccatcgatttggctaatcggccgtagtggaagttgggcgtcgcttcagctactcggttgtaagaaccagtaccctcaggttgtttaccttgatgcggacactattgtggttagaaatattgatgatcttttcaagtgtgggaaattctgtgctaacttaaagcattctgagaggttgaattcgggagtcatggtggtggagccatctgctactctttttaatgacatgatgagcaaaataaaaactactgcatcttacactggaggcgatcaaggatttctcaattcatattactctggatttcccaatgcacatgtttttgagccaaatttgagctcagaggtgttgagttccagacccattcctgaaatggagcgactatcaacactgtataacgctgatgttggtctttacatgcttgctaacaagtggatggtagatgagaatgaactccgtgtgattcactatacactgggcccccttaagccttgggactggtggacgtcttggcttttgaaacctgttgatgtttggcag

SEQ ID NO: 24579 - DNA, 249 bp, Glycine max
  Peptide Sequence Number=SeqID_141357
atgactcgatcccctcgtttcagctataattcgcggaatcttaacccaattggtgtttttgaagaaaaacgtgatgagactctcaaggttgaaaacaacatcagtttggtgcaagatcaagtatttgtttgtggggatgtcgctgcggttattggagccatggccaaatataataccacaagaaaagaggtagcaagaaagaaacctgaagaaatgtgcactctaggcaagtctgatgcttggctttaa

SEQ ID NO: 24580 - DNA, 975 bp, Glycine max
  Peptide Sequence Number=SeqID_141358
atggctggcaccggcatccacccataccaccagcaatgggctccggcggctgccgctcctcctcctcctccggcagccgcgggcggtcctcctcctcaccctggggaggaggttcgaacgatattcataactggtcttccggaagacgtgaaagagagagagctgcagaatctgctgagatggctgcccggtttcgaagcatctcaactgaatttcaaagctgagaaagccaatgggttttgctctcttctccgcaccacaccaagcactcgccgcccaaagacattcttcaggacatgctcttcgatccagacaccaagaatcggagctgctgatgcgggcggtgcttttgatcaaagtaagcgcttaaggacagccggagattatacacacagtggctatacaagtccatctccttttcatcctcccccgcctcccgtgtggggaccacatggatacatggctccgcctcctcctcctcctccatatgatccatatgctggctatcccgttgcgcctgtaccaatgcccactcctgctcccataccagcacctagcacttatgttcctgttcagaacacaaaagataaccctccttgcaacaccctgtttattgggaacttgggagagaacataaacgaggaagaagtcaggggccttttcagtgtacaacctggttttaagcaaatgaagattttaagacaggagaggcatacagtttgcttcatcgagtttgaagatgtgaatagtgctacgaatgtgcaccataatctgcagggtgctgttatcccaagttctgagttatttaaaggaaatcccgggagttatatgttgtctgatttatacaggatttcaaaacatgacaaagcttcctttcataatgggagatccattactgctgctgccatatcattgcaggttggaacttctgtcgattatcaagtgaagcagcctttcaattatatgatgccctga

SEQ ID NO: 24581 - DNA, 2768 bp, Glycine max
  Peptide Sequence Number=SeqID_141359
ctggcctttttcctccacttccagaagagacatcgaagtcttccaagttttcttcaattggttctagatttaagctgcaactacagcaattaatggaaatactaagctctacagagcctcattacattagatgtgtgaaaccaaacaacctcctcaagccagcaatttttgagaatgccaatattatacaacaacttcgctgtggtggtgttttggaagcaatcagaatcagttgtgctggctaccctactcgccgtgctttctttgaatttgtaaaccgattttcccttcttgctccagatgtcacagaagcacaccatgatgagaagattgtttgccaaaagatactggaaaaagcggggcttaaaggatatcagattggaaaaacaaaggtattcctaagagcaggtcagatggctgaactagatgcacagagagctaaaaaactcagtaatgcagcaaaaactatccaacggcgtatacgaacccatcaagctcgcaaacattatcttgaactacgaaacaagactatatatatgcagtctgtgtgcagaggaagacttgcattcaaactttatcaacacaagagaagggaggcggctgctgtgaaaattcagaagaacatacgcagatatgaagctaggaatacctatattaaactccaagcatcagtacttactttgcaaacagctttaagggcaattgcttccctcaaagagttcagatttaggaaacagactaaagcttccatcattattcaggctcggtggcggtgccacaaagctgcttcatattataagaagctcaagaaaggttcaattgtcacacaatgccgatggagggggcgcatgggcagaaaagaacttaggaaaatgaaaatggctgcaagagaaactggcgcgcttaaagacgcaaaggacaagcttgaaaaaagagtggaggatatcacttggcgtcttcaactagagaaaagtttaaggaccaacctagaagaatccaaatcacaagagatagcaaaactgaagaatgcactgcaggagatgcagaacaaagttgatgaatccaatgcattgcttataaaggagagagagaatgcaaagaaggccattgaagaagcacctcctgttgttaaagaaattcaggttattgttgaagacactcagaagattgaatcactaacattggaagttgagagtctaaagacatcccttgagtcggagaaacagaaagctgacgagaaatataatgaagcccaagcttgtagtgaagaaagggggaaaaaattagaagacacagagaagaaggttcgtcaactccaagaatccttagccaggctagaagagaaaattactaacttagaatcagagaatcaagttctgcgtcaacaagccctgtccatggcacctaataagttcctctcaggacgctctagatcaatcattcggagaacggacagtggacatcttggagttgaagcaaagacaactttggatatgcatagcacatcaatgaaccacagggaatcttcggaagtggaggataaaccacagaagtcactaaatgagaaacaactagagaaccaagacttactcattaaattcattcctaaacagataggttttgctgggaatagaccaattgctgcttgtatcatatacaaatgcctcttgcattggagatcatttgaagttgaccgtactagcgtttttgatcgtataattcaaactattgggcattcaattgagacccaggataacaatgatgttttggcttattggttatccaacacctctacacttgtcttgttactccagcgcacacttaaggcaagtggtgctgctggaatggctcctcaacgacgtcgttcttcgtcagggacagtgtttgggaggatgactcatagtttccgtggaactccagcaggagtcaatctttccctaatcaatggtagcatgagcggaggcatagatgcgtcgagacaagttgaagccaagtaccctgctcttcttttcaaacagcagctcacagcttatgtggaaaagatatacggaatgattcgagataacttgaagaaagaaatttctcccttgcttgggttatgcatccaggcgcctagaacatccagagcgagctttgttaagggatcatcacgttcagctgcaaccactgaagcccagaaagctttgattggtcactggcaggagatagttaagagccttgggaactttttaaatactttgaaagcaaatcatgttcccccatttttggttcgtaaggtgttcactcaaattttttccttcatcaatgtccaacttttcaatagtcttcttctaagacgggagtgctgctcatttagcaatggagaatatgtgaaatctggtttggctgaattggagaattggtgtaataatgccactgatgaggtcatacatcagaaaccaaggaaaacgctgaatgaaataactcatgaactgtgtccagtcctgagtatacagcagctatatcggataagcaccatgtactgggatgacaagtatggcacacatagcgtatcccctgatgtcatatccaatatgagagtgttgatgactgaagattcaaataatgcagttagtaattctttcctgttggatgatgattcaagcattccgttttcagttgatgacatatcgaagtcgaaggaacccatagatatctctgatatagagcccccaccagtaatacgtgataacactggctttagtttcttgctgccacacccagactga

SEQ ID NO: 24582 - DNA, 1029 bp, Glycine max
  Peptide Sequence Number=SeqID_141360
atggcgatgatggcggcgacgacactcacactgacaccaccgagatggtcgtggcgtccaactcgtcgttccttttgccggcaaatgcatccagggctgagaggtttgggaatgtacagaaatggtgggagcaatgaattgaatgtttctgcctgggatgataagccctttgaaatgcttccgagcggtaacaaggcttacttggatgagcaggatgtggtgacgtttcttgatcctcctaaggacttaatccctttcgacccatcttcctataatcccgctgcatacctatggaaaaaaattgaagatattcctcaggaaaggcgacatcgacttctccgattgttgaaacctagacttgtatcaattgcttggcagattgctggtacacgattcgatgatcccaagttagtaaagaaaagtgcatctaccttgctgtctagctccaccaacgatggtatcatgcttgaatgttataactgcacatcaagtggaggaccaatgtcaatttcctggatcaattcctttagaaaggctatatttactggcaaggatgggcaagcatatggacgaatcattagtggatcagttttgactgcatttgctgactcctttgctcccttgtactttacggtgagagaacttaaggaagtgatgtcaactgagcagccatgtgatttagcatatgaatttggggatggactacatgatatcaaagagctcccattaggctttccaagaccaggggataatcttaatacttacaactttaaacatccttatcctttcaacgatcaaattgttgtgtatgttcgctatctaggacctggggtttcagtagggcaagcatggcaagaggggacaaagttggagcaagtcccacgattgtcggtggaaagtgagtgcatttcagtcataatgggatacttggagttagagggagagggacactgcttttggcaatacgggccaagcgcggtgtcagctttaaagaagggtcccaagattgcacgattatggcagcattag

SEQ ID NO: 24583 - DNA, 2133 bp, Glycine max
  Peptide Sequence Number=SeqID_141361
atggatttttcaacttcctcagtaatggccatggggtgtgacttcaaccaaatgggtccaattccaagcatagatttttcaaagtggtgggttaaggagagttcgagttcaaggaaaggaaacccggttgtagtgactatggagaaccccaattactcagtgcttgaaatagatgccccagactcagcatttcagccagttgacaaagacagaggtaaaaatgcaaagcagtttacatggcttctacttctcaaggcgcatagagttgtcggttgccttgcttggctcggaaattctctttgttcattgctccacgccgttaagaaaagattgctttttgggcacgtggaggctgagatgtctgccaaggcaaagtttctgtttcgagtaattcttactttcttggtgatggccttggcattcctgtcatttgaactggttgctcacttcaaagggtggcgctactttcacaaccataacttgcaccttcctcaaactttggagatcactggatgctttcacactgcctatgttcggtggttagagttccgggcagactatattgctcccccaattcaatctctatcaaccttctgcattcttctcttcttaattcagtccgtggatcgaatggtgctttgcttaggttgcttctggatcaaattgaagaagattaagcccgtcattgctggggattccctcaactctcatgatttggaaggatccaacgacggatatcctatggtactcgttcaaattcccatgtgcaatgagaaagaggtatatgatcaatctatttccgcagtcagtcaacttgattggccaaaagagcgcttgcttattcaagttttggatgactctgatgatgagggcatacagtggttaatcaagggagaagtctccaagtggagccaaagaggtgttaatataatctaccgtcataggaagtttagaactggttacaaagcgggtaatctcaagtctgcaatgagttgtgattacgtcaaagattatgagttcgttgcgatttttgatgctgatttccaaccaaatccagatttcctcaagcaaactgttccacattttaagggcaatcctgagcttgcattggttcaggctaggtgggcttttgtaaacaaggctgagaacttactgacaagactccaaaatattaatctgtgcttccactttgaggttgagcagcaggttaatggggtcttcctcaatttctttggttttaatggaactgctggtgtttggagaataaaagcacttgaagaatccggtggctggctcgagcggacaactgtagaagacatggatatagcagtccgagcccatctgaatggatggaaatttatctttctcaatgatgtaaaggtgctttgtgagcttccggaatcatatgaagcttataggaaacaacaacatcgatggcattctggtcctatgcaactctttcgtttgtgccttccagcgattataacctctaaggtgattgctttctggaagaaaaccaacctaatatttctattctttctgcttagaaagctaatcctcccattctattctttcacattattctgcattattcttcctttgacaatgtttgtcccagaagccgagcttcctatctgggttatttgttatattcctgtattcatgtcgttcttgaacattcttcctgccccgaaatcctttccctttattgttccttacctcctttttgagaacacaatgtcagtaaccaaattcaatgccatggtgtccggtttgttccagttgggaagttcatatgaatggattgttaccaaaaaagcaggtcggtcatcagaacctgacctattagctgctgaagaacgcgattcaaaggcaatgagtctccaacttcatagagggacttctgatagtggactttctgagcttaacaaaataaaggaatgccaagaaacagttcctgtaaagaaaatgaaccagatatataagaaagagcttgcccttgcattcttactgctgactgctgcagttaggagcctgttatcagcacaaggcatgcacttctattatttactatttcaaggtgtatcattcctccttgtaggtctggatttaattggcgaacagatgaactag

SEQ ID NO: 24584 - DNA, 342 bp, Glycine max
  Peptide Sequence Number=SeqID_141362
atgttgacgggaacggggacaaggggtagcagggggacgacaaattggggggggggggataagggaggagagagcgaacaacttctcaataatgttgccgaagagactgtggattttgttgaagaaggagacctacgcggtgagacccactctgagttgccaagtcaactcgtcaagcgagcgatccaattcagagcactgagtctggagctccacaatgaaggtgggagcctcgacaagggcgcattgcgtgtggagcctgtcgtcgaggagggagagtgcaaagggatagaggtgaaagggtggaggcaacatttggagacactccatcgtgaaaattga

SEQ ID NO: 24585 - DNA, 981 bp, Glycine max
  Peptide Sequence Number=SeqID_141363
atgtttacttccattgtcggtaatgtatttgggttcaaggccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgtgaattcccaaccatttatgcgttggagagaccgtttcttattttgtgccgaagccatttttaaatcacaggctgaaacaggtgaaatcaaagggcattacttgaatgcaactgcgggtacatgcgaagaaatgatgaaaagagctgtatttgccagagaattaggcgttcctatcgtaatgcatgattatttaacggggggattcactgcaaatactagcttggctcattattgccgagataatggtctacttcttcatatacaccgtgcaatgcatgcagttatcgacagacaaaagaatcatggtatgcactttcgtgtactagctaaagcattacgtttgtctggtggagatcatgttcacgccggtaccgtagtaggattgggttctctaccaggtgttttgcctgtagcttcgggaggtattcacgtttggcatatgcctgctctgaccgagatctttggggatgattctgtactccaatttggcggaggaactttaggacacccttggggaaatgcaccaggtgctgtagctaatcgagtagctcttgaagcatgtgtgcaggctcgaaatgaaggacgcgatcttgctcgtgaaggtaatgaaattatccgtgaggctagcaaatggagtcctgaattagctgctgcttgtgaagtatggaaggagatcaaatttgaattcgaagcaatggatactttgtaa

SEQ ID NO: 24586 - DNA, 888 bp, Glycine max
  Peptide Sequence Number=SeqID_141364
atggaagaaagcaaaggaagagtgtgtgttacaggaggtacaggttttattggttcatggataatcaagaggctccttgaagatggttactctgttaacaccactgtgagacccgatccagaacacaggaaagatgttagctttcttactagcttacctagagcatcccaaaggctacaaattctcagtgctgatctcagcaatccagaaagttttattgcttccattgaagggtgtatgggagttttccatgttgctacaccagtcgactttgaattaagagaaccagaagaagtagtgaccaaaagatccattgaaggtgcacttggcattttgaaggcatgcctcaattccaagacagtgaagcgagttgtttacacctctagtgcctctgctgtcgataacaataaagaagaaattatggatgaaagctcatggaacgacgtggattatcttagatcttcaaagccatttggttggtcatattctgtttcaaagacattgacagaaaaggcagtgcttgaatttggagaacaaaatggattggatgttgtcacactaattccaactcttgtttttggacccttcatttgtccaaagcttccaagctcagttcgtaattcattggattttatacttggagaaaagggtacatttggtgtcgttctacagacagatatggtgcatgtggatgacgtggctagggcacatatatttctgcttgaacatcctaatccaaaagggaggtctctgaatcatattgaaggtacaaaaggatcatatttgtcatcaaagaagctgatagatgcaggatttgtgtacaagtatggacttgaggaaatggttgatgatgccatccaatgctgcaaagaaaagggttacctgtga

SEQ ID NO: 24587 - DNA, 573 bp, Glycine max
  Peptide Sequence Number=SeqID_141365
atgcattggacttttccatgtagctacccagttgactttcaagtaaaggaacctgaggaactagtgaccaaaagatgcattgacggtgcactaagcattttgaagacatggctcaattccaagactgtgaagcgagttgtttacactactagcgttggtgctgtgatttgcaacggcaaagaagaccaagtgatggatgaaagcttttggagtgatgagatttatgcaggtgacaaagatccattagcttttaatgctcggatacctatggtgcacgtggaagatgtggttagagcgcatatatttctgcttgaacatcctgacccaaaagggagtgctttaaaacaaaataaaggtatcagggtaccagatttatcggcaaagaagctgatagacgatggattcatgttcaagtatggacttgaggaaatgctagatgatgcagttcaatgctgcaaagaaaaagactaccacaactgtgattgtgctgtggttgcagagactcaaaaaaccttgatgttactgccgaaactacggccacaaaccgtttttcataaccttgaatatggatag

SEQ ID NO: 24588 - DNA, 1074 bp, Glycine max
  Peptide Sequence Number=SeqID_141366
atgacagatcctcagtccaatttgttccatgaatggttcaacttcatgctcctccatcctcactactcctcctcttctcaatccaattaccctcttgctaataattactcaaacaacaacaggtttggaattcaattacaacaaggagcaccctcatcttcatcttcatcttcatctttctatgcagctcctccttcttcccctcctcttagagtggcccttcctctgatcaacaagataagcctcaaaagtagtgagcagcaccaacaaaatgaaacctcctcaaatgttttagaggagaaagaagaggatgagaagaaagtggacaacaacaacaaacatcatgagagtggtgaagatgctgatgaagaaactgtgactgttgccctacacatagggcttcctagaatggatacttcctcttcttctgatctggggccaccaaaggtggtctcgacaacttgtatggaaattggtgaaaaaggggaagtgaacatgatttctgaacaccctttggatcatagattgaacaagggtcagtattggattcccaccccttctcagattctcattggtcctacacagttcccatgtcctgtgtgctctaaaactttcaacagatacaataatcttcagatgcatatgtggggacatggatctcaatacagaaagggacctgattctctaaaaggaacacaaccaacagctatgctaaggcttccatgcttttgttgtgcaccaggttgcaagcacaacattgaccacccaagagcaaggcctctcaaggatttcagaactcttcaaacacattacaagagaaagcatggcataaagccctacatgtgcagaaaatgtggcaaagcatttgcagtgaaaggtgattggagaactcatgagaagaactgtggcaaaatatggtactgtttatgtggatctgatttcaaacacaaaaggtccctaaaagaccacatcaaggcctttggctttggccatggatcttttggcattgattgcttacaagaagaagatgaagcagcctctgatattgaacatgatggagagagttcaatgtga

SEQ ID NO: 24589 - DNA, 2358 bp, Glycine max
  Peptide Sequence Number=SeqID_141367
atggacgccaccgtcaccgacctcagtccctcctgcaatgccgccgccgaaccgccgcgccgcagtgtccgccggcgactggtccagtcgacgctcttccctcacaagccaccggagcctgatcaaaagaacgacaaagaggacgaacgcgacgaggattactccgactctgagaatcacaagaagaggaagaaacccaaggctaaaacaactcctcgaaaaaaagcttccaagaatgccacgccaaagaaaaatgtgtcggctaatgggactaacaaggggtccacttcgcggcaggtgttagctgattccgatcgggttattgcaccggtgcatgatttgtttttagaagcgaaattggctgctgaggaagattcgaggatattcacaggacggcagatacatccatttttttcactgtggaaggcggggaagaaagttcaggacgtggctgattcaggaagtaatttatcaacaacaaagagtgaggatgaaaggactacctgtggtcctattcatgtatttgaaaatactcaggatgacacctcatcccttgactggagaaactggacgtttttggagaatactacctctatgaactatggttcagaaagtttaaattcatctgttttggaggcttctgttgaatccttgaattttgataagcttcgtagttccttgtatccctcaggcacttcaatttctcagaattccttatcttcagatagactttgtatacatccagaaaatctggaagaactatcaccatcaaactcagcttcactagcaaagcaaacatgtcctccgacatgtgaagatgccaaactggacttggaggtggatgaatctgctactacaacagtgcaagctggcatttttagaaagtcggatactgaaccaccaattagatttcttcaagaaagtatgagatcttattactgtagttgtgtagataaggcagagaacagcttatggacatacaaatacaagccaacaaaggctgttgaggtgtgtggtaatgatgaatcagtgaacttcttgcgtgactggctacatctatggcatgaaagacgttataaaagcaggaaggatatctctgacatggataaaagtgacatgcgagatgttggtgatgacgatgatgattataaatgctcctatagtgattacgattcagaagatataaatgaggaggattccctgcagaatgttcttttaattacgggaccaattgggagtggaaagtctgcagcagtctatgcttgtgccgaagagcaagggtttgagattttagagcttaatgcatcagattgtagaaatggaactgctgtcaggaattattttggagatgctcttggttcacttgggttcaaaaggtcatcagaaaacactgcaagtccacagaagaaaactacgaagttccccttggctttggctttgttcagtggtaaagctgctgatgaggtgaatgatggggtggatgaactgataaccatacctgatgatgaagctcatatccccagtggatcattacagaagttacttggcaaaaacaatgtagttgcatcatgtgataaagtgcaaactttaattctaattgaggatgtggacatcctttctcctgaagatcgtggatgtattgctgccatccaacagattgctgagactgcaaaggggccaattatattgaccagtaatagtgataatcctggcctgccagataattttgatgtgcttcatgtttcattcgtgttgccatcaccaaaggagttgctttgccatttgtatactgtttgtctcactgagggagtcaacatccatcctcttttactggagaagtttatacattcttgtgatggagatatccgaaaatccattatgcatcttcagttctggtttcagggtaaaagatttcaaaaagatggaaaggcacaaacacattatggctcgcttccatttgatcttgagcttggccatcagatactaccgaagattatgccctgggatttcccctcagagatatccaaactaattgagaatgaaatcaccaaatcaacaaataaaatggaagaaacttctagagggttggttacagagcttcttcacacagatgaacagaaaaatgatttaaatgtgcagtgtatggaagctgattatatagaggccaagaaggtggagatgattaagagaaatagttctttgacagattacagcgagcttgaaattcaatataatgctatttctgagtttgccaattcttctgattccccgcttacatcctgtcggcaaaatggtcgaaggaaacttgtagtcatgtcctctgattctgaggatgaggattcaaataatggatatcct

SEQ ID NO: 24590 - DNA, 918 bp, Glycine max
  Peptide Sequence Number=SeqID_141368
atgccttctgctccttccaaactctacgcagatgacgtgagcctcctcgttgtgacgctagacaccaaccctttcttctggagcacttttcccttccccttcgccgagttcctctctcaagtactcgcttttctcaacacgatcttgctcctaggccagctcaaccaggtcatcgtcatcgccaccggatgcaactcttgcggctacgtttacgattccacttccgacaagaaccatggctccaccactggtacaatgcccgcgctttattccaatttacttcacaatctcgacgagtttctcgctagggaccggcaattagacgccgacgcctctcacgcaccgggaatcgttccttcttcgctgttatcgggctccttgtccatggcgctttgttgtatccttcttcgccaatatatacagagagcttttcgttcgggaccaatgcctcctcagcctcggattttatgtttgcaaggggctgctgatggaccagaacagtatgtggcaatcatgaatgcaatattctctgcacagcactctacagttcctatagattcttgttatattggttcaaacaattctgcattcctccagcaggcttcatacataactggtggaatatattacaagcctccccaattggacgggctttatcaatatctttcaacagtgtttgcaactgatttgcattctcgtgcatttttacggcttcctaaatctgtgggtgtggattttcgtgcctcaaattttgagacccgcaccttgataaactgtatgtattgtgcaggtgtttctgccataaacaaacaattgacatgggctatgtgtgttctgtatgcttatccatattctgtgagcaccatgataagtgttcaacctgtggaaaattcctttttcaattgtatgcttttgtaa

SEQ ID NO: 24591 - DNA, 456 bp, Glycine max
  Peptide Sequence Number=SeqID_141369
atggcctgcaccaagaaaactgaccaaatgacgtctgaggcaacaaaggaaattgatgacaagattgcctcacagggttcctttgttgcccatagacgtcaggatgtacttactgctgccattgagcgactagaacaccctggttgtgtgcgtgctgttggagccagtggatcacagggacttgcactgcctcctgagtccgaggttagtccttcagctgctcgtgtcagcacaaaggagagttctgttgatcctttagggaatgacccagacacaggtgacttagaaaaatgtgggttatacgtcgaagaaaatcctccccgcctggttgccctaggaagactttgtgaggggttgaaaaccgttcacaacatccctttttgcaatgatcaaatcaaggttggtgttgaggaagttagagatgcagatgctcccattcctgtacccactcaagag

SEQ ID NO: 24592 - DNA, 351 bp, Glycine max
  Peptide Sequence Number=SeqID_141370
atggggactccagtgaacattattgcgggttctcatgtctgggttcaagatccacaagttgtcgcaaagttatcaaatatatatcccaaagatacagaagctcctccgggtggagtggatgacatgactaagctttcctatttgcatgagcctggagtcctccagaacttaaaaactagatatgaactgaatgaaatatacacttatacgggaaatattctgattgcaataaatccatttcaaagactacctcatatttatgatttgcacatgatgcaacaatacaagggagcaccatttggagagttgagtcctcatgtatttgcagttcctgatgttgcatataggtaa

SEQ ID NO: 24593 - DNA, 1041 bp, Glycine max
  Peptide Sequence Number=SeqID_141371
atggagtacggaaggttaggaccctctgatcctggtggctcctcgcgcctcaaccctccgagatcttccgggaggaaaaacattgtgtttctgtcactctttgctgtcttattaatagccgcgtccgctgttactgcagttgccgtccgctctcgcaccaaaaataccggaggggacggaactagtctcggcaagttcacacaggccatttcacgcacgtgcagcaagacacgctttaagatgttgtgcatgaaatcattactggacttcccgggatctcaaggagcatccgagaaggacctcgtccacatttccttcaacgtcacgctgcagcacttctccaaggcgctctactcttccgccaccatctcctacaccgccatggatccccgcgtccgcgccgcctaccacgactgcctcgagctcctcgacgactccgtcgacgcgctcgcccgctccctcaacacagtctccgtcggcgccgtcggctccgccaacgacgacgtgctgacgtggctcagcgctgcgctcaccaaccaggacacctgcgcggagggcttcgccgacgccgccggcacagtcaaggaccagatggccaacaacctcaaggacttgtccgagctcgtgagcaattgtctcgcgatattctccggcgcaggcgccggcgacgacttcgccggcgtccctattcagaataggaggcggttgatggcaatgcgagaggataattttccgacatggctgaatgggcgagataggagattgctgagcttgcctctgtcgcagatacaagcagatattgtggtttccaaagacggtaacggaaccgttaagaccatcgccgaggccattaagaaggtgccggaatatagctcacgccgcatcattatctacatcagggcaggaagaggacaatttaaagttggggaggaagaaaacaaatgtgatgttcataggggacgggaagggcaaaaccgtcatcacgggcggaagaaattattaccagaacctgaccacatttcacaccgcttccttcggtaa

SEQ ID NO: 24594 - DNA, 183 bp, Glycine max
  Peptide Sequence Number=SeqID_141372
atgggtgcaaaagatatgcttcaaaatcttacgggcaaagactcttcttctggtgccaatgctaccacaaatcgtgtagaaggaaaggttcagcatcaggttcctagccatccacaatatgctactgctattgaggacacaattaatgtcctcgtacttttccaagaaacaaacttgttttag

SEQ ID NO: 24595 - DNA, 267 bp, Glycine max
  Peptide Sequence Number=SeqID_141373
atggaattgggtatgggcagaacagaaggtgccaaaagaatggtgggggcatttttcaccctaccaagtcacatggtgaagttcagaaggctagctggaggccctatactaattattacattgcattctaggcatcaagaaaatcctcacgagtcaattcagaaagcctatctagctaaagaggaagaaaggatgaggacctacaatgcaggggcagcatgggactgtggaaaaagcaaagcaaaggaaggatggaaggaaaaataa

SEQ ID NO: 24596 - DNA, 627 bp, Glycine max
  Peptide Sequence Number=SeqID_141374
atgaaactcttcaaatcccagggtttgctattaattggttcctgcaaagataacaagattccagcttctacccaattaaaccttcttgtaatggatgcagccaataaacttagtgtgcatattcctcgagtcaaacttggaactcaaggccttgaggtttcaaagttggggtttggctctatgagctttagtggagtctataatggtccacttcctaatgaggatggcatatctctagccaacgctaaccaagctttaaagcacttgcctagagaaaaggtccagttagcaacgaaatttggccttggaggattgaattttcccattatacaagtcaaagttacaccagagtacgtgcgatcgtgttgtgaagctagcttgaaacgccttgacgtagaatacatcgatctctattatcagcacagagtggaccaaacagtacctatagaggaaacagtaggtgaacttaagaaacttgtggaagagggtaaagtgaagtatattgggttatctgaggcgagtccagatacaataagaagagcacatgcagtttatcccatcactgctttacaaatagagtggtccctatggactcgtgacattgaggaccagataattcctctctga

SEQ ID NO: 24597 - DNA, 456 bp, Glycine max
  Peptide Sequence Number=SeqID_141375
atggtgcagttcccgcgacaacgtcagcgaatcttctcccgaaaaagcccgaaccattttcttaggagagagagagagagaagcattttgttttctgaatcgtataacaatgtggagattcctcgagcgaaacttggaacacaaggccttgagggtgtttcattatctgatcctattgaccaggctttaaagcagctacctagagcaaaggtccagttagcaaccaaatttggcatttcaaggatggattttcctaatgtacaagtcaaaggcacaccagagtacgtaggtgaacttaagaaacttgtggaagagggtaaagtgaggtatattgggttatctgaagccagtccagatacaataaggagagcacatgcagttcatcccatcactgctgtacaaatggagtggtccttatggagtcgtgacattgaggacgaaataattcctctgcag

SEQ ID NO: 24598 - DNA, 1926 bp, Glycine max
  Peptide Sequence Number=SeqID_141376
gtttatggggctcttagtcaattggagtgtggtagtgaagtgtgggaacgcattctgtttcagtcatttgagcttttgacagactcaaatgatgaacccctaactgcaacaataaattttatattcaaagcggcatctcaatgtcaacacctccctgaagcagttagatctgttcgtgtcaggctgaaaaatctaggtcttgaggtgtcaccttgcgtccttgactttttgagtaagactataaatagttggggggatgttgctgaaaccatacttagggacattgattgtgacgatgattgtggtgacagttgctcggctttgccatgtgggattttcttatttggtgaacatggcactgctcccagtggattgcatgtgattgatgagcaggcttatcatgctagtcgtcacttttctgatatttatatactgtttgaaatgttatctattccttgccttgttgctgaagcttctcaaacatttgagagagctgtagctcgaggtgcaataagtgcccagtctgtaaccctagtattacaaagccgtctttcccaaagattgaacaataatggcagctatgcttctgaaaatttccagcattcagatggtgctacagagggagatgcctgtgagcaattgggagttcaaagggatgattacacttctgttcttggtcttgctgaaaatttggccctctctaaagacccatgcgtgaaagaatttgtgaaacttctctacatgataatgtttagatggtttgccaatgaatctcatcgggggaggatgctgaagaggcttgttgaccgtgccactagcaatacggacaatggtcgtgaagtagattttgatttggatatcttggttactttggtctgtgaggagcaggagtttatcaggcctgttttgagtatgatgcgtgaagtagctgaacttgcaaatgttgatcgggctgctctatggcaccagttatgtgccagtgaagatgaaattgtgcgtgttcgtgaagaaagcaaaaatgagatttctaatatggctaaggaaaaagttatgatatcgcaaaagctgagtgaatctgaggccacaaacaatcgcttgaagtctgaaatgaggactgagatggatcggttttctcgggaaaagaaggaactagcagaacaaattcaagaagttgagagtcagcttgaatggatccgctcagaacgggatgatgaaatcgcaaagctctctgcagagaagaaagctcttcatgaccgtttacatgatgcagagacacaactttctcaattgaagtctcggaaacgtgatgaattaaagaaagtagtcaaggagaaaaatgctcttgctgaaagattgaagaatgctgaagctgcacgcaagagatttgacgaagaactgaaaagatttgcaacagagaatgtgacccgggaagaaatccggcaatcactcgaagatgaagttcgtagattgactcaaacagttgggcaaactgaaggggaaaagcgggagaaggaagaacaggttgctaggtgtgaagcatatattgatggcatggaatcaaagttgcaagcttgccagcaatatattcacacacttgaggcctcactccaggaggaaatgtcaagacatgcccctctatatggtgctggtctggaggctttatcattgaaagagttggaaacactatcacgtattcatgaagatgggcttaggcagatccatgcccttcaacagcgtaaagggagtcctgccgggagccctcttgtgagtccccatgctctccctcacacccatggattatatccaactgcggcccccccaatggccgtgggtctgcctccctcaataatcccaaatggtgtagggatccacagcaacggccatgtgaatggtggtgcagttggaccctggtttaatcactcttga

SEQ ID NO: 24599 - DNA, 306 bp, Glycine max
  Peptide Sequence Number=SeqID_141377
atgaaggcgttcaggcttctgaacttcttggcttcgctgaaggaccttgaacctggtaaagtcaaggacgtgtggcttaagctggttaaggatttggaggtccatagagataacgaaatgttaattcttgaagtctacgatcatgatacgtttggcaaggaaaaaattggaagagtgatcttgacactgaccaaggtcatcttagaaggggaatacaatgaaacttatcctctagatggcgctaaatcgggaaatatttctttgcatttgaagtggactccacagcacaattttcgggatccttag

SEQ ID NO: 24600 - DNA, 1752 bp, Glycine max
  Peptide Sequence Number=SeqID_141378
atgttggatttcattgacgcggattcggggttcttggtggatgacactgcggttttcagcacctcgtttcatgtgatcaaggagtttagcagcttctccaagaatggggctgtgattgccgggaggagtgggagtggtgcaaggaagtctgatggacatgttggaaagttcacttggaggattgagaattttactaggttgaaggatttgctgaagaagaggaaaattacgggtctgtgcatcaagagcaggaggtttcagattggtaatcgggattgtcgacttattgtttaccctagagggcagtctcagccaccatgccacctttcagtgtttcttgaagttactgattcaagaaatacttccagtgattggagttgttttgtaagtcatcgtttgtcagttgtgaaccaaaggatggaggataaatctgtcaccaaggaatctcagaaccggtactctaaagctgcgaaggattggggttggcgtgaatttgtgacacttaccagtctctttgatcaagattcaggttttcttgtccaggacactgtcatattctccgctgaagttcttatattgaaagagacatcaataatgcaggatattactgagaacgattccgagttaagcagcagtggttccccagttgataaaagaagttcatttacatggaaagtggagaatttcctttcttttaaggaaataatggagactcgaaaaatcttcagtaaattctttcaggctggtggctgtgaacttcggattgagagtgaccaggctgttggtagtgacccggataaaaatttctgggtcagatacaggatggcagttgtgaatcaaaaaaacccagccaagacagtgtggaaagaatcttctatctgcacaaagacatggaataattcagttttgcaattcatgaaggtgtctgatatgttagaagcagatgcaggatttcttgtacgtgacactgttgtttttgtatgtgaaatattggattgctgcccttggtttgagttttcagatttagaggttttagcatcagaggatgatcaggatgcattgactactgatcctgatgagctcatagactctgaagacagtgaagggataagtggagacgaggaagatattttcagaaatcttctttccagagctggatttcatttaacatatggagataatccttcacagccacaggttactttaagggagaaacttctaatggatgctggtgcgattgcggggtttctgactggacttcgggtttatcttgatgatcctgcaaaagttaagcgtctgcttctacctaccaagctctctggcagttgtgatgggaagaaggccaccaaagctgatgaatcttccccaagtttgatgaatttgctgatgggagttaaagtcttgcagcaagcaatcattgatttactattggatataatggttgagtgttgccaaccttccgaagtgggtcctgttgctgattctgttgatgcatgctctaaaccttctccaaatggaagtggagctgcaagtcctcttgagtgtgaaagagaaaatggagcaatggagtctgcacgagtccccgtatgtgagaggttggattctgttgttcaagaaagcagtaatgcatctgctgtgcagagctctgatttaaaaggcaatggtattcaggaaaaagcacttcctggacagcccatttgtccaccagaaacatctgccactgcgtcagaaaatgcatcccttcgttcaaag

SEQ ID NO: 24601 - DNA, 1122 bp, Glycine max
  Peptide Sequence Number=SeqID_141379
atggactcgtcaggaacggtggtggaggaatgtctgagaacacatgccaatgatggcggcagcagtggacccgccgctattggtggtgaaggcgaggcgtataatgagcctctcccggaacaggatggcatatctattatcaagtatgcattcagtaaaggaatcacattttttgataccgctgatgtttatggagccggtgctaatgaaattttgcttggaaaggctctgaagcagctacctagagaaaagatccagctagccacaaaatttggtattgcgagattagatttttctaacatgctgatcaagggttcgcctgaatatgtgcgctcatgctgcgaaactagcttgaaacgtcttgatgttgaatacattgatctctattatcagcatagggtggacacatctgtacctatagaggaaacagttaaggatttcttcctctcaatgattttgatcatagtgggtgaacttaagaaactggtggaggagggcaaagtgaggtatatagggttatctgaagccagctcagatacaataaggagagcgcacgcagttcatcccatcacagctgtgcaaatagagtggtctatatggactcgtgacattgaggaccagatagttactatctgcagggaacttggtattggaattgtatcatatagtcctcttggtcgtggtttctttggcggcaaaggaattctggaaaatgtgtctgcaagtagctccctgaatgtgtggttgttttgtgatgattatttcacttatcagaaagtacatccacgctttcaagccgagaacatggacaagaacaagaatatatatgaacgaattgaaagccttgcaaagatgcatcggatcactcctgctcagttggcattagcgtggctactccagcaaggcgaggatgttgtacctatccctggaacaactaagattaagaacctggatcagaatataggtgccttagcagtgaaactgtcagagaaggacctgagagaaatttctgaggcggttcccattggtgatgtagcaggcggaatacactactatggactggaacacattacctggaagtatgctaacacacctccaaaagattcgagcatctcaacctga

SEQ ID NO: 24602 - DNA, 153 bp, Glycine max
  Peptide Sequence Number=SeqID_141380
atgagggagaagggaatgaatgaggaattggtggatagcgacagtgtttgtgatggtggtgggttggacggagcggatgttagaaacaataggactataggagttttgaagggaggaagctatggcaatgcgggagaagagatacagcgctga

SEQ ID NO: 24603 - DNA, 225 bp, Glycine max
  Peptide Sequence Number=SeqID_141381
atggatcggctaaaatatgagagggagaaagaaaagttgaggaaatgtttctcaactggggcaaagaaaaatgaagaaaagagctctctatatatagggagtgaaacactattcaagtgtttatccagagcgattcctcttggtcgaggctttttcggtggcaaaggagttctggaaaatatgcctgcatatacaaccctgaattttttggacgtgaaaaattaa

SEQ ID NO: 24604 - DNA, 2277 bp, Glycine max
  Peptide Sequence Number=SeqID_141382
atggctaaccatgatttgatacttggccaaagtcacaatttagcacttggccatgaccagcaattgatgctgagccacaatcatagtttgggcctcggcgagaaccatgatttggaattgggacaaactgatgatcaacatttgggtctgggacgaactcatgatcatgaactggggttaggaattgccaatgaccatgaattggatttaggattgaaccatgatgatgaaggagatggtgttcacacatatgggcatgagaatgagttatcaatggatcaaaaacctgagcatgatgaccatgtgatgcccattcccacacaaaatcatgacttggacttaccagagaacaatgacttggctgtttcagaaaatcaggaatttgatgagaacatggccctgactgtggtccacaacccggaaatgagtattgaatctgctgaagaaatgggtctccatgaatcccatcttatggtttccacaacacctgtaattcaggctcgtacattagctattagtcccaattatgaattagcagtgggacaagaattccccgatgttaagagttgccggagggcattgagggatacagcaattgctctgcactttgagatgcagactatcaaatctgacaagacccgcttcactgctaaatgccgaagtgaaggatgtccctggcgcattcatgcagcgaagctccctggggttccaacttttactatcaggacagtccatgagtctcatacatgtggaggaatttcacatcttggccatcaacaagcctcagttcaatgggttgctacctctgtggagcaaaggctaaaggagaaccctgattgcaagccaaaggagatattggaagagattcatagggttcatggcatcactttatcgtacaagcaagcatggagaggtaaggagcgtatcatggctgcaatgcgtggatcttttgaagagggctaccgcttgcttccacagtactgtgaacaggtgaagcgcacaaacccaggcagtattgcatctgtttatgcaaaccctactgataattgcttccgacgcctcttcatatcctttcaagcatcaatatatggttttttaaatgcttgtcgaccacttttggagcttgatagaatatatttgaagagcaagtatcttggtacattacttcttgctactggatttgatggtgatggggctctctttcctttggcatttggtgttgttgatgaggagaatgatgataattggatgtggtttctgtctgaacttcataacctgctggagattaacactgaaaacatgccaaggcttacaattttgtctgacagacagaagggaattgtagatggtgtggaagcaaattttcctactgctttccatggattttgtatgcgtcacttgattgacagctttcgcaaggagtttaataacactatgcttgttaatcttctttggaatgcagctcaagttcttaccatacttgaatttgaatcaaaagttttagagattgaagagatatcacaagatgctgcttattggatacgaagagttccacctcatttgtgggctactgcttattttgaggggcaaagtttttttcatttgacagcaaacatagttgaatctttaaacacatggatattagatgcatctgggcttccgataattcaaatgatggaatgcattagaaggcagctaatgatttggtttaacgagcggcgagagaccagtatgcagtggccatcaattcttgtaccttctgcagagagacatgttgcagaggctcttgatcgagcacggacacaccaggtacttcgtgccactgacgctgaatttgaagttatatctcatgaagggacaaatactgttgatattaggacccgttgctgtcaatgtcgtgggtggcagctgtatggcttgccttgtgcacatgctgtggctgcacttctgtctattaggcagaatgtgcatagattcacagaaagctgttttactgttgcaacctataggaagacatactcacagaccatacatccaattcctgataagtctctgtggaaggagttgtctgaggctgagggggacgtcaatgcttccaatgctaatcaacttcaacttcaaattgctattaatcctcctaaatcactcaggccaccgggtcgacctagaaagaagcgggttcgtgcagaagaccgtggccgtgtaaaacgggttgtgcattgtagtcgttgcaatcaaacaggtcactttagaaccacctgtgcagctcccatctaa

SEQ ID NO: 24605 - DNA, 458 bp, Glycine max
  Peptide Sequence Number=SeqID_141383
gagtccaggagtttgtcaagggggagttgaggaaagaagggagagaagaggagttgaccaaactgatggaggagaaagaaaggctgaaagctgaagctaaggcgaaggaaatcgaggcagctgaagctgccaaaagaagtgcaagagcagcagtagcttctttgcttccatccaagttgtttgggaacaaggaaacggatttagaatctaaacgcgagggtgaaattcaagctctcaatgaagagaacactaatgccactgcttccgaggcggagttggtggaggaaacgactgaaactgagggtgatagagcaagtgaacagttaacagccccatcagatctggagaccaaagaagtgttggggttgacaaccgatttgcctctctacatgttgagggaggaaatgatagtgacgacgaaggaggctgatgtgggggcatggttgaggaggtcgtga

SEQ ID NO: 24606 - DNA, 2258 bp, Glycine max
  Peptide Sequence Number=SeqID_141384
ttactattgggaaatcagagtcttcaagtaaggccacaattggtgatatggacaatcccaaccctacaaatgatgaggaagtaaataaacagatattgcagcatgaaaaatctgctgctggtattttgtgccagcttaagattcgtcatggagctcaggcttctcatcttacattgacaaaggatgttgtgggtattgttgctactctgggcaaagttgaggatgacaatcttagcagacttttctcggagtatctaggtgtggagactatgctggcaattgtttgcaaaacttatgaaggggttaaagctcttgaaatgccttatgctggtaattacgtggttaatgatgcacaacggaagttggattttttaatcccaagattgcccaatggggagcttccatctggatttcttggttttgcagtgaatatgattaatttagatagctcaaacctattttgtgtaactcccagcggttatggcctcagagaaactctgttttataatctcttttctcgtctacaagtatataagacaagggctgaaatgatacaagcacttccttgcataagtgaaggagctctttctttagatggaggaatggttaggagttgtggtgtattttctttgggcaatagggaagatgttgatgtgagattccccagaccagaaagatcaatgagacttgataaccaccacattgaaattgagagacaattgaaggatgtcaaatggaagaaagaaaagattatggaggaattaaaaagggaacaaatattgttggacacgacgaggttcaattacaataaaaagaaggctgattatcttaagtttttggcacaaagttcatcagatgcaactcagcctggcagttacaaggaaacagcgaccctcgcactttcccacttcaggcacttggtcttcaacttcacacgcgccggtgactctgggtgcccgccacgcgctggcttcggggttcggagaggctacaacgtcgtttcctcgttgggggacccacccgaagtctggtccggcggcgggattgtcgttcgccccgggaattcgaatttcgatgtcgccggcggcggcgccgccccgaattccggcgattcgaaagagggatgttggggtggctccaacttggggaacagtttccctacgccaaaggagatttgcaaggggctagacaaattcgttattggacaagagagggcaaagaaggtgctttctgtggcggtttataatcactacaagaggatatttaatgaaacctcttcgtccaagtggcctgcaggagattcagataataataatgtgaagactgatgctgttgatgatgatagagttgaacttgagaaaagcaatatccttctaatggggccaacaggatcagattataatgttgcagctgcacagcaaggcattgtttacattgatgaagttgacaagattactaaaaaggctgagagccttaatatcagtagagatgtttctggtgaaggtgttcagcaggcattactaaagatgcttgaggggacggttgtcaatgttcctgagaagggagcccgaaagcatcctaggggtgacaatattcagtctgtggtgtttctgtatgtaactagtaacttttggttccctttcagccgtcatgattcttctattggatttggggcgcctatacgtgcaaacatgaggactggtaaagtcacagaagctgctgtggcatcatctttattacaaactgttgaaagtagtgatcttgttgcatatggtttaatacctgaatttgttgggaggtttcctatccttgtcagtttgtcagctttaactgaaaatcaactcattcaggtcctcacagaaccaaagaatgctcttgggaagcaatacaagaagatgttccaaatgaatggggtaaagctacattttacagaaaacgctctaagatcaattgccagaaaggcaatatctaaaaatactggtgctcggggattacgatcaatattagaaaatgtgttggtagatgccatgtatgagattcctgatattagaacaggcgatgatgttatagatgctgttgttgttgatgaagaggctgttggaggtgaggggcgtgggagaggggctaaaatcctttatggtaaggatgcattggatcgatatctttcggagcagaaaaatgattcagagaccatggaggcatcagccgcagataatgaagcagatacggaacttccttccattgttgccagcatgtaa

SEQ ID NO: 24607 - DNA, 891 bp, Glycine max
  Peptide Sequence Number=SeqID_141385
atggccacacactgtgttccacatgtaaaactagggtgcacaaccgatgtcccacttgtagacaagagcttggagatattaggtgtctggcactggagaaggtggctgaatcacttgagttaccttgcaagtactactcccttggatgtccagaaatctttccatactacagcaagcttaagcatgagacaggacgatcataaagtggacatgcacacaggatgcacattcaaccatcgttatgtgaaatcaaatccacgagaagtagagaatgccacttggatgctcacagtatttcattgttttggccaatatttctgccttcattttgaagctttccagcttggcatggcccctgtatacatggcattccttcgttttatgggtgatgaaaatgaggctcggaattatagctatagcctagaggttggggccaatggtaggaaactcatttgggagggtacaccacgaagtgttcgtgatagtcaccgtaaggttagggatagccatgatgggctcattattcaaagaaatatggccctatttttctctggtggggatagaaaggagctgaagctcagagtcacaggaagaatatggaaagaacagaattcagatgctgggatctgtgctcatcaccattgccaaaagcaagataaggagagggaagcacatggcttttgtgagtctcttgtcgtcgaagatgctgagctaacccatcacgtactcttccaccaccctcgcttgcagacattacgatgcccattgtcacgacctcctcaaccatgcccccacatcagcctccttcgtcgtcactatcatttcctccctcaacatgtagagaggcaaatcggttgtcaaccccaacacttctttggtctccagatctga

SEQ ID NO: 24608 - DNA, 1392 bp, Glycine max
  Peptide Sequence Number=SeqID_141386
atggggaagaaaggagggagctggttctcgtcggtgaagaaagttttcaagtcctcttcttctaaggactcgccgctgccggagaagaagaaagagaacaacaaggaagaacagtggcagcatgtggcgccagaggaggtttctgtggagcattttcctgcagagagttctccagatcttaccaatgaagggagtgtcacgtcgtcaacaccagtgactgaagatacaaaccctgccgttgcctttgcagcagcaactgccgccgccgccgaagcggccgtggcggcagctcaagcagccgctagagttgtgaggttggcgggttatggacgccagtccaaagaagaaagagctgcaatactcattcaatcatactacagaggctaccttgctcgacgtgcattgcgtgctttgaagggattggtgaggctgcaagcgctggtgaggggacataatgtgcgaaagcaagcgcaaatgacaatgagatgcatgcatgcattggtccgagtgcagacaagagtaagagctcgcagactggagttgactgaggagaagcttcagagaagagtttatgaggagaaggtccaaagagaagtagatgaacctaaacagtttttgagccccatcaaaatgttagatatggatggttgggacagtaggcgccaaactagccagcaaattaaggataatgatttgaggaaacatgaagctgtaatgaaaagggagagagctcttgcttacgctttcaactgccagcagcagctgaagcaacacatgcacatagacccaaatggtgatgatataggaagctatagcactgagcgtgaaagagcccaattggattggaactggttggaacgttggatgtcatcacaatcacccaacttaagaccacgtgagaccctttataggactcttgctactgctacttccaccactgatgacatgtctgaagaaaagacagttgaaatggacatgggtgcaactctggactcaactcatgctaatatgggcttcattaatggagaatcttttgacacaagcccaatttctaataggtaccaccagcgccaccacagtgctggtgtccctagctacatggccccaacccagtctgcaaaggccaaggttcgaagtcaaggcccgtttaagcaacgtggttcacctgggcctcactggaactcatccacaaggagaggttcttctgttggtttgggctgtgactcatctagctctggtgggcccactgcagcccatgtcttcccaagaagcccaaacccaaaaattaacgagattcgcctccaatctagacggatttcaggtggcagcccagataatgttcacattgaggattgggcccttccccttggagccaccaacggttgggcttga

SEQ ID NO: 24609 - DNA, 417 bp, Glycine max
  Peptide Sequence Number=SeqID_141387
atgcccaccacggttgctgtctccgtacctcaaaatcaaaacactaaccatggagtcgaatcccccaagaagaacaaaattcaggtttctaacaccaagaaaccccttttcttttacgtcaatcttgccaagaggtacatacaacagcgcaatgaggttgtgctttctgctcttggaatgggtataaccacagttgttacaattgcggagattttgaagaacaatggacttgctattgagaagaaagtttcgacatcttcagttacaatgaaggatgagaccaaaggtcgcctggttcaaaaggctaagattgaaattgttctggagaaaactgagaagtttgacagtctgacggctgttgcaaacactgaatcaaaagtagttgcagctgacgatgacaatcatgagaagaaatga

SEQ ID NO: 24610 - DNA, 1947 bp, Glycine max
  Peptide Sequence Number=SeqID_141388
atggagtctctggaacttgttcctctccttcttcttctgcatccaccaccatctcaatctttcaacaattcacgatcaataaggcaacttcgtttcccttctcttctcaatagtaaaactagaaacgccaacttgcgatcattttccggtaaccttcaaggtggcggcggtgctacttcacaagacggacccttcgctttcgaagaccaagtctctcaccacaaagacgatagagctcttgtattagccagagaaacagacgattttggctatctcgttggctttcgcttgcttcctaattctggtcttgaagagtttatgaatgtgtcacactctataactgaggaagattctagtagcgatgaggttgaaaaacccaaggttgaggatacagaagaagaggaagctaagactagagtgtcacataacattgttgttgtgacttctgaagcggcaccgtattcgaagaccggtggccttgccgatgtttgtggctctttgccaatagcactggcaagccgtggacaccgtgtcatggttgtcacgccgagatacattcatggtacttctgaggatctcaagtttgctggggcagttgatcttgatcaaagcaccaaagtgttttgctttggaggtgctcaagaaattggcttttaccatgagtatagggaaggggttgactgggtatttgtggatcatccctcattccatagaccagggaatccgtatggagacaagtttgggacttttggggataatcagtttcggttcactttactttgccatgcagcatgtgaagccccattggtgcttccattgggagggttcagttatggagaaaaatgtttattccttgctaatgattggcatgccagcctagttcctatacttttggcagcgaagtatcgtccacatggggtatataaggatgcacgtagtatattagtgatacataatatagcacatcaaggagtggagcctgcaattacatatagaaatttggggctaccttcagaatggtatggagcactggaatgggtgttccctacttgggcaaggacgcatgctcttgacacgggtgaagctgtcaactttctaaaaggtgctgttgttacagctgaccggattgttacaggctattcctgggagataacaactagtgaaggtggatgtggtctacatgatttattaagcagtcgaaaaagtattctcagtgggatcacaaatggaattgatgtcactgaatgggacccgtcatgtgataaacatattgcttgcaactattctgctgatgacctttccgggaaggccgaatgcaagatttctttgcagaaggaattgggtcttccaatgaggcctgattgtccaatgattggattcattggaagactggactaccagaaaggtattgacctgattcgcttggcaatgccagagctcatggaagctgatgttcagtttgttatgcttggttcaggaaaccctatttatgaagactggatgagagcaacagaatcaatttataaagataaatttcggggttgggtgggatttaatgttccaatatctcataaaataactgcaggctgtgatatactgttaatgccatctgcattcgagccctgtggactgaatcagttgtatgcaatgagatatggaactatacccgtagttcatgaaactggggggctaagagatactgttcataattttaatccctatgctgaagaaagcagagctgaaagcactgggtggacattttctccactaacaaaggagagcatgctagcggctctaagatatgccattcaaacatacaatgaatacaagtcttcttgggagggattgatgataagaggcatgacaagagattacacgtgggtaaatgctgccactcaatacgagcaagtcattgagtgggcattcaccgaccctccctattgctga

SEQ ID NO: 24611 - DNA, 1580 bp, Glycine max
  Peptide Sequence Number=SeqID_141389
ctcaagctgatgtgataggatggacaggagttaagggggtgccaacttataaggactatgtgatatatgtccaagatggggaggccgatgacatgctttggctttctcttcacccttcacctgactcaaagcctgagttctatgacgccatactcaatggagtggaaatattcaagctcaatgacacagacttgtctggtcccaatcctcagctttcggagatgctcctcaagcagcagaaagaggatgaggaagcaggcttcattagccacaaagcatatcataagcatgttgttattggtggagctgctggaggtgctgctggtttagcttttatggctgcattgttccttgccgtgtacaacaagaagaagagagttccggggtcagagggtcacacaagctggcttcccatctatttgaactcacacagcaaatcctcttcgtctgggaagagtgttactagcagtgccaacttatctgccatggctcaaggtctttgccgctacttctccttgcaggagataacgcaagcaaccaagaatttcgacgaggccaacgtcattggggttggtggatttggaaaggtgtacaagggtgtcattgataatggaatgaaggtggcaatcaagaggtcgaacccgcagtcagaacaaggagttaatgagttccaaacggaaatagagatgctttccaagctgagacacaagcatttggtgtccttgattgggttctgcgaggaaaatgatgagatgtgcctggtttatgacttcatggctcttggcaccatgagggaacatctttacaagggcaacaagcctatgtctactctatcatggaagcaaaggttggagatttgcattggagctgcaagagggcttcactaccttcacactggggctaagtacaccatcattcatagagatgtcaaaaccacaaacattctcttggatgaaaactggagtgccaaggtttcagattttggcttgtcaaaaactggtccaaacatgaacaccggtcatgttagtactgtggtgaagggtagttttggctacttggatcctgaatacttcaggaggcaacaattgactgaaaaatctgatgtatactcatttggggttgttctgtttgaagccctgtgtgccaggccagttctcaatcctagccttccaaaggaacaggttagtcttgctgattgggcattgctttgcaagcagaaaggaactctagaggatctcattgacccgtgtctcaggggaaagatcaatccagaaagcttgaataagtttgtagacacagctgaaaagtgcttgtctgatcatggtactgatcgtccctccatgaatgatctcttgtggaatctcgaattcgctctcaacctgcaagaaaacgttgaaggtggttcaactcattctgctcgtgctcaggaaagtgattttgaagatgtaagcttgggagacaacgacatggcacgccactataaaaacttaagccttggaagtgacctggaccttagcgacgattctaatgagaacccgaatgccatcttctcagaacttgcgagtccaaaaggacgatga

SEQ ID NO: 24612 - DNA, 468 bp, Glycine max
  Peptide Sequence Number=SeqID_141390
atggtgacgatggaaactcaaatacaagaactctctccctccaaaacccgcaggaaatcctcctacggaacttctaaaaggtccattctgaagaaatccttcagccaagagcaagtcaccttcaccgctcctctctccgatgaccccctcgtcgccctcatcggtaaaggcaggaatgctagaggctttgaccaagttaggggtacagagttttttcttgtctatgctaggggtgcagtttttccaactaatacacatggagttccatgtatctttgatccctttggaagggctgggatatgtggtgattggctactaggttctaatatagaggcagccgtcttaagtggaattgctctagcgaaccatattgcagactattcccaaagccccggaactgaccctggagagtttgctgttggtttaaatcatgagtttcaaccactggaaggccatgatattggataa

SEQ ID NO: 24613 - DNA, 1457 bp, Glycine max
  Peptide Sequence Number=SeqID_141391
atggctgaaatggaccagaacacgggcggtgagcatgaggcggaggaaacgattgagattgaggcggaagtgcacggtggtgaagaggcggttgttgcggagaagaagtggccggggtggcccggggagagtgtgtttcggatgttagttcctgcgcagaaggttgggggtatcattggacgcaaaggagagttcatcaagaaaattgtcgaggagacacgagctcgagttaaaattcttgatggtcctccgggaactgtgcaaagggctgtaatgatatcagctaaagaggaacctggttcctctgttcctcctgctgtggatggcttattaaggattcataaacggattattgatggtttagagagtgattttacccatgctccttcaggtgtggccgggaaggtttctacaaaacttctagtgccagcctcacaagcaggaagtttgattgggaagcaaggaggaactgtaaaatctatccaagaagcatccaattgtattgttagagttcttggagcaggtaaggatgagctttatgcactgtctactacagctgtaatagagcatcatcttggacatgcttttaagccattcactagtgtcataactttcttgccattgctaaccatctgtgtggctttctcttctgcagaagacctccctatttttgcccttcaagatgacagggtggttgaagtagttggggatcccgctggagtgcataaggcattagagttaattgcctcccacctaaggaagtttttagttgatcgcggtgtaattccaatttttgaaatgaatatgcaaacagccaatccccaccatgcagagcacatgccaccccaccaatcttggggaccatctcagggtcttcctccaaatgttggtggaggtcctggttttggacctccttctcaatacatgccacctccacgacaacttgatagttattatccatcagctgaaatgcctcctccagtggacagacagccccatcaaggtatatctgcttatggaagagatgcttcaataggtgttcatgcatcttcaaatactcaatctgcaccttccatagtcacacagatcacgcagcaaatgcaaattcctctatcttatgctgatgctgttattggaacagctggagcaagtataagctacatcagacgagctagtggggctactgttaccatacaagaagcaagaggtgttcctggggagatgacagttgaaatcagtggaactgcttctcaagtccaaacagcacagcaactaatacagaattttatggctgaagctgcagctgcagctgcagcaccagcacagccgcaaacaactgtgcctgctgcagaccaaggatacaattcttaccctgcccatggttctgtctatgcctctcctccttccaatcctggacatgctggaggctatggctcagtttatggtgcaaactatgg

SEQ ID NO: 24614 - DNA, 651 bp, Glycine max
  Peptide Sequence Number=SeqID_141392
atgccgcatcgcataataaatcaagttacgatagtaataacaatgtttagcaagcagagaagaaaagaaagccatgcacttgaagccgctgcagacccacaaccagatgacaaagaggacagcgcagacgaacaaatcgaggaggaggaggacccacacgtgtttcttccaaacgtgcttggccttgttgctgtggttgtggagctggggcttgagcgaaacggcgtcgtcggagacgtcgagcgtggcgggcgcgtcattgggccttttctttttcttcaagccctgagctggagggttgagaggaggagagggttgttgttgttgctgcgatctgttgttgtcgtgaagcgcgttttggaagatggtgtggaattgggattggaaggagagaggggcaaagtggaggatctgatgcggtggaggaaggggagggtttgggatttgaggagggagtggtgggagatggagaagaagacgaagggagggtcgatgaggaaggtgtatgtgcggtggttgacggtgtgggagaatagggagtggttgggaggtgtttgggccacgcattgggccgccaaggcctccatgttgggctccttctcgctctggtgctgccccaggatagtctccgatcgagcgatgcaggcgtag

SEQ ID NO: 24615 - DNA, 3722 bp, Glycine max
  Peptide Sequence Number=SeqID_141393
atggatgacatgccgttgccggcgctctttgagcaagcccgcaagatccacgccgcagccaccgattccggcgccgaccaggaggttgtgaagaaggggtgcgaggctctgcatagatgcgaggacatggtcaataatctaggtttgttctctcccaacgagaccaaagaagatatcagcaccacgaatctcaaatacattctggtgccattttatcttgcggagttgacagaaaaaatagcacaggatgacaggatacagattctaaagtcttcccaggcaaaacttaaggagtttatctcattttgtgaagcaatggagctggtcccaaaagaggagttagaatcttacattgatggggcaccaaaaactgttgctgatcagagggccaggaagatcgctaggttcaaacgtcagagagctgcagaatcaaagttgttggaaataaaagagcgaaaggaacgacgtgggcgttctactaaagcagctgccctgtccacccctgttgaggcaggagaggaagaagtattggatgatgatggggaagaagaaagagaggcttggatcactaccatatctttggcaatctgtaaggcactagatatgctggatatgttgaagaaagaggaagagatgctttctgctgtaaaggatagacaatccaaggatggggataaggagttctctaaggatgttcttgatgaacgtgccaagaaagcagaagcttggcatcgtgattctgcagttcgtgcacagtacactaggccatcaccaccaatcacatgtgccactttcgcccaagatgttctagaaggaagagcaaaggcttcacaagaacacgatcacaagcatcaacccctaatatttggaccagctagccttgtaaatggaaacataacaactgagagagaaagaatggcagctcaggtcttccaacctagtcatagaccatgtgcccaaaaagagatgaagttttatttccttgtagttttcagtgttatattgcctaggactccccattggttgcctatgattgagagagtagagttgatgccaactatgagcattgaggaggccgggctaaaagaaatggaaataatgaacaaatggcaagagagaaatgtcaaactcatggaagaagtcaattcatcttggcacaatgataggaagtcaaagctaggagaagacgatgatgatgaagatgatgatgctgcacaggagaaagcaagggcttgggatgactggaaggatgataatccacgtggtgctggaaataagaaacttaccccttgtggaggtgccagggaatccgatctcacaggaatgggtgagaaggaagtttctgttttggatagagatgggtgtgacaacaagagtgacactgaaagcatgtatcccatgtattttggtgtttcttgtgcattctttgcactccaagtcctcacagaagaaccacaagttgaggttgagaaatggtctaaaatccgtgacacaatgcttcaagggagtgctcgactcttggggttggttgtgtggaagcttcagaagggaatgcgaaatgggggagaatgcaaactcaaaattgctgagggagaaattgagaatctgaaaaaaatgaggcatgaggatgccaaggccaatgagaaagttgtgggaatctttgcagcacaagagcaaagctggttgagtgaaaggaggagacttcggcagcagattggggctctactgagcgagctgagagtttttgagagaaacaaggatgctgctatttctgaattaaatcagaaattgaaggacatggaatctttggtggagtcaagagacaaggagattgaacaagaggagcagaagaggaaggagctagaggaaaagctgaacaatgtcgagaaggatgctgaagaaacgagagaatctgctaggcgcgaagctcaagagcattcttctgatcttaggaagcacaaaactgctttcattgagcttgtgtcaaaccaaaggcagcttgaggctgaactcggtcgcgcggttaagcaagtggaagctactagacaagagcttgcttctgtggaggagaagaaggaggagtcggatttgatggcgcagaaattgtctttggagatcacaaaatttcacaaggatttggaacagaaggataaaattttgtcagcaatgttgaggaagtctaagctggacactgcagagaagcaaatgctgttgaaggaggttaagttatcaaaggctaggaggaagcaagctgagcaggagacacaaaggtggaaggctgtttcagaaggaaaacatgaaagacaatccttaaaaagcatgttggttaacttgagttcaaggatggatgttttccctggtaatagaggtgtgcagcatagttccacagggtcctcacacattgcaaatgaaccagaccaactttcaccctttcctgatcactatttgcagcaaagaaatggagacttatccattcctgctaatgctaagcgtttggaagattgggtgagagctgaggcagaaaggtatgcaaccttgattgaacagaggcatcacttagagctagatgcttttgctgaacaaatgcgactcaaagatgaaaaattagaggcatttcggtggcagttgttgagaacagaattagaaatgaaacagatgcaggcacatgtggaggggctggtcaaggatgtgacacagctaaggcatgacaagatgagattggagaccttacttttggagagagaagatgaactgacttccctgaaagagcaatttgtatcaaaattgaggcccttaaaaaataactcaaatttgcctccacaatctttagaaatagcccaagaggctgtctggtcaagagtgaaggttgtcaagagaaaaccaggtgaaaaagtgctagaaacgatggaaactttggttgaggaagattgtgagaaggaagtacagtgtcagccccatgaccaggttaacggtgctaatttactagttcaatctccagaaactgagattgaagaagaaaagagtatttctagggaggatagtcctactactcctatgcaaaatcaaagtccaagtaaagtagaagctgatgcttctgaaaagatagcatctaccagccagaccttaagtacaacaaaaaagtccctagggaagatggaccttcatgctcttggaatatcctacaagatcaagaggctgaagcagcaacttgttcttgttgaaaggttaacaggaaggcaagccaatgacgagcatgcagaaattactgatgatagcaaagttggtatgaaggcttatctgtccttgacaacgttgctgaataaacaagttggaagatatcaatccctccaagagaagactgacgatctttgcaaacggatgcacgagaatgacctctatgcaaaccgtggagatgtgagtgctgcaagagcaaaggagaaaacatcaacactggagcacttcctagaagaaacatttcagttacaaagatacatagttgcaacaggacaaaaactgatggaaattcagtccaagatactttctggctttgttggagtggcagaagagatggggaaaagttcaggcattgacatgaaccggtttgccgacagcattagaaatctgttccatgaagttcaaagaggtctagaagttaggacggctagaattataggagaccttgagggaactctagctcgtgaaggaatgacatgtttgagaag

SEQ ID NO: 24616 - DNA, 309 bp, Glycine max
  Peptide Sequence Number=SeqID_141394
atggatgttgatgaagtcgtgagcacaggagtaaataaagtggaattgatgggttcagaggataccaatgcttctatagatttagaggaattaggttctggttcaaaaagaaggggacaatcttcaagctcaacaagcatacaatcccaaaggaggaagattggagaaaaagatggaatatctacttcaatgaaacaagtgccggagtcttttgatcgattgacacaagcatatgatgaaaaggttgatgaaaatgatattttagaagtgctagatgaggtggttatgatgctaaaccttaataaataa

SEQ ID NO: 24617 - DNA, 720 bp, Glycine max
  Peptide Sequence Number=SeqID_141395
atgtttttgcagtccaatccattaacagagacagaaaaaatacaaaaattgtggaaagatcttcgtgagcgtcgcatggatttaaaacagcatgctacctcggaacagctgggtgcttttcaagttgttaaacttgctagtgggctgaacaatctaatttcagaagctgacttatttcataaacgtgatattatggaaccttcaacgttcctttctggtgaagccacatctagctggtatcatgaacaaataatgacgtccactgttgctgaacatgggttttgcttttacgctaagcttatagcagatgaagcatcaaagttgggttgtgcaaattgtgttgatattacttctgagatgttggcttccgccattaaattatccggacaggatctcacaaaaagcaaagttatctatactggaaaggaagtagagtggaaaagcccaataaatagtacgcagaagagtgaaaacaaaacatctcagttcaaagccatccaatccattgttcctgcaagaatatccttggcattgaaaggtggtgcattcaatgaatatctatcttcattacgcgaaattacgaggtcagaagcttcccgcatttcacaagaagttgaaaagaatagaagaggaagatgtaccacgttgtctcctgaagatatatctttggtgagtgagggtaatctgtacagaaaggattcttcacaacatacaacatag

SEQ ID NO: 24618 - DNA, 519 bp, Glycine max
  Peptide Sequence Number=SeqID_141396
atgggagaagtagagcgacaagtgcagttccagcaggtagaaacagagttgcaacatttggcattgaagaaaaggaagcgttgtttgtcgaagcagcaatcgatgtttgaggcgccgcgagacattgcatgggagagaaagaggcgacaagaggggaagacgaggacgaggacgaggactaggaggaacagttttcacgataatgtcacggacgatgatcttcacgagcttaaagggtgcatagaattagggttcggattcaacgaggaaaacggccagaaactgtgcaacaccttgccggctctcgacctctatttcgccgtgaaccgccagctgtcatcggtctccacccctcatagccgcccctcttcttcctttgggagccccgtcagtagtgcaccgccgcctgattctgattcttggaagatttgtagcccgggtatgaacatatatatacacattcatgattcacgtttaatagatgattttgaattggaagaaagatttcgttacttataa

SEQ ID NO: 24619 - DNA, 255 bp, Glycine max
  Peptide Sequence Number=SeqID_141397
atggctgctactcaccgttgttctgctttgaaagccctcacttgcggtcctccatcctccatcgccgtcactgcctcgcggtcctccgtcgctgtcgctccaagcttcgcttcaagtcacaacaataaggggaacatagggaaggttgaaatcccttttgatgatacgaggcttgctttcactgtttcttgcattttgcattcctttgccgcagcgattaagatggtaatggaatcaaaaaatgaaagatggtag

SEQ ID NO: 24620 - DNA, 198 bp, Glycine max
  Peptide Sequence Number=SeqID_141398
atgtctctccgaggtattttcatgtatacaattttgaaccacaggggggaatacaaaagaagaaaggaagaagaagaagagtacagcacggccatgcaagtctacgcggagaggatgagtatagcagtgagggatggagtgcgtccaattcgcagattaataattaatgtaaccttgctgccaagccataacgaatga

SEQ ID NO: 24621 - DNA, 1185 bp, Glycine max
  Peptide Sequence Number=SeqID_141399
atgaaagaagttgttgacaatttgaaggatgatgctcctcgtctagattcaatacttatgcatatgggaagtatgtatgcaacattgagcaagtttgaaaaatcattggatgtgtatcagagggctgtctacattatggagaggacctatggtatggatagcacttttcttgtcacaccctgtttaggtatggcaaaagttcttggttctattggaaaagcaacaaaagcaatagagacataccagcgtgtgatcactcttttggaatcaagtagaggtaccaaaagtaaagatttggttgtacctttactaagtctagccaatctgttactcaaagaagggagagccaatgacgctgaaactcattttactagagttctcaacatatacaccgaattatatggacaaaatgatggaaaaattggaatggctatgagttccctagcccgagttaagtgtgctcaagggaaatcagatgaagcaattcaactgtttaaacgtgctattcaggtcatgaaggattcaaattacttgtcgccagatgacaatataatggaaaagatgagggtagatctagccgaattacttcatactgttgggagaggacaagaaggcagagagctattagaggagtgcttgtggatcactgagaggtacaagggaaaggagcaccccagcctagtgacacacatgataaatcttgcaacttcatattcacggtcaaagaactatgcggatgccgagcacttgttgagaagaagtttgcaaatcatgataaaacaaaagggaactgatgaccagtccatcagctttccaatgctacaccttgcagttacactctaccatttgaaaaaagatgaagaagcagagaaacttgccctggaggttttgcgcatccgtgagaaggcctttggaaaaaattctcttcccgttggggaggctttggattgtttggtgtctattcaaaccagacttggtagggatgaaagtgagttactcgagctgcttagaaggatcctgaatattcaagagagagaatttggacgtgagagtgaggaggttttggttaccttgaaaaaaattgtatactacttggataaactagggaaaaaagatgaaaagcttacccttcagagaaggttgtcagtgcttagtaaaaagtataagcagatggttaattactga

SEQ ID NO: 24622 - DNA, 1443 bp, Glycine max
  Peptide Sequence Number=SeqID_141400
atggcatcagcagaagggaaggctccttatacagctaattgttttactcaagatttccggattcccccgagttctcctgatcatccgtcatcagtttcaaaaacaatagtatctgattgggttcctagtaattctattaatgatcaaattcatgccaatgcagtctgtatcccccacaatctgaattctgataagctacctgaaatgaaatggtggctacatgtgaaaagtgacttgggggatgaagcaaattatacatgtcaacagctgaattcctacgagtctgaacttggtaccttctattctgaatttcttaatggcagcgtcaagagtgggggagatcaattggtcaaagactttgatgctctttctaatattcaaagtgccaatttatctatagagcagccgtggcatgttgtctctcctacatgtatgaaaaacaacaataccagaatgccaaaatttgaggcttcactgaatactgatttacattttactcctaagaagaaagatcaggaggaattctattttcaagatagtcattttatggattgcgatatttccaatttcttggtctctgaacaaggcaaaatggcatcatctgatctagaatcacatttgatgggagcagagaaaactggggcttggtggcgcaccactggaaaagatgagttggcttccttggttgctcggaagtcgcttgagcatattgagaattgtgatctccctcaaccccagactaagcatgtcagtcagagaccctcctacccaaagggtgttgaccatgataatactccaccatcttctttgaaccgtaaaactgagactggttcttcctatgcagatagttatacaactgggatatccacttctgactgttcatttcaggattcaaacaagcattccagatgttactgtatccattattcctttttaaacccaaatggaatagcggtcttcaattccagtcagagcaaagattttagctcaagcaccgaaggttgccaaataaattctgagaacggtagcgtgtctgagctgttgaaagctttgtgtcactctcaaacaagagcaagagaggctgagaaagcagcgcagcgagcttacagcgagaaggagcacatcctgagtctcttttttcgacaggcttcacaactctttgcttacaagcagtggctccacatgttgcagctcgagaacctgtgtctgcaactcagaaacaaaaaccagtcatttccaaatctctttccagcatccttaccctgggacccatgcaggggaaggctgcttaagaaaagtcatagcaaagctaggaagaggaagaatagtaacagaagatgtgtgattacaaagtgtgctgttgcttttgctgtgggattaggcctcgctggtgctggtttgcttcttggttggacaatgggatggatgtttcctcccttataa

SEQ ID NO: 24623 - DNA, 723 bp, Glycine max
  Peptide Sequence Number=SeqID_141401
atgggaaaggtcgcaacttctgcaaccctgcctgtatctcaagaagcttccaattatgatgaggtttttatgcagcagagcttgctctttgatgatagtctgaaggatttgaagaatctgagagcacaattatattcagcagctgaatattttgaactctcatactccaatgatgaccaaaaacaaatagtggtagaaacattgaaggattatgccatcaaagctcttgtaaatacagtggaccatttaggttccgtgacctacaaagtaaatgatttgttggatgagaaagttgttgaagtttctgtagcagagctacgagtgtcttgtattgaacagaccatgcatggtgccaaccgcacaaagtcaaaatatgtggggtacaacctagatgacgaaggtgaatggcctcactttaggaatgctgttcgagctactatcagagaaacaccaccatctacagcgaggcctccaacacctaagataagtagaccaaccactccaaatccaagcagacccaccacaccaaatccttctaatgcaagacaaaggtacccttcggagccgcgcaaatcatcttcaatgcgattatctgcagaaagagaccatggcaaagacatagaacaataccctagtaagagtaaacgtctcctgaaggccttactaagccgacgcaagtctaagaaggatgacatgctatacacatacttggacgagtactga

SEQ ID NO: 24624 - DNA, 1038 bp, Glycine max
  Peptide Sequence Number=SeqID_141402
atggctcccgatgcttccgacgcacttgcagcgaggcagaaagttcaattgtttctgaacgctgctcgaactggatcaattgatctcttaaagaaattggcgttgcagctggacgagggtaaggatttggcgaaatcggtggaagcaataaaggacgccaacaagagaggtgcactgcattttgccgcgcgcgaaggccaaaccgctgtttgcgactacctcttaaccgatttgaagctctctgtcgattctcaagatgatgatggggagactgcactcattcatgctactcgtcagggacataccgccactgctaaatatctaattgaccacggtgccgatcctaccgtggctagcaatttaggggctacggtattacaccattctgcagggataggggatactgaactgctcaagtacttgctgtccaggggagttaatcctgatctagagagtgactcgggaacacctttggtttgggctgctggccatgcccaaccagcttctgtcagtgtactattggaacatggtgcaaatccaaatgctgaaactgatgatggtattactccactcctttcagctgtggcagccagttctctggcatgcttagagctgttaattcaggtattggtgtttacaagatgctgctttcttcctgcaggtgctaaagcaaatataagtgctggtggagcaactcctttgcacatcgcagctgataatggaagtcttgaactattaaattgcttattgaaagcgggagctgatcctaatgtctctgatgaggatggtgtcaagccaatacaagttggtgctgcaaggggctatctaaaagctgttgagatattgttccccttgacatccaaagtagatactattcctacttggactgttgatgggatactcgagtatatgcaatctgaaactagaaagcagctgggcaatatgcaggatgaatcgataaatgacaaagaaactaatcagcccaaggaagctgattttccaaagcaaaatgtccccgagctgtattattcaatgtag

SEQ ID NO: 24625 - DNA, 447 bp, Glycine max
  Peptide Sequence Number=SeqID_141403
atgactatcgatgggtgcagaaagaaaaagcctcaagtcagcttcgaagtaaatgcccaaaaggacataactagcccacaaaaaaaaaacgcgcgttatcttcacttgctaaggtttgatcctaagatgaagacgaagacgaagacgaggtttatgtgtagaatgaaaggttcatgtcttcttctcacgtcctctttcaccggaatcaggacaagcaaagagcttcggcatatgctgtcactgtgtgagttgaaaagcataacatgcttctcagtttgtaatcaaaagcaaaaatacaatcaaaagctttacattattcccgttagaactgtttgtgttcggttctgcatctcaagatcctcagttgggtcagtggaattgagtgggacaggcacacacagtgatgcttattcaggattttcggctccaaatgactatcagaggtag

SEQ ID NO: 24626 - DNA, 4701 bp, Glycine max
  Peptide Sequence Number=SeqID_141404
atgactgccgagttagggcaacagacggtggagctctccaccctcgttacacgcgcagctaatgattcctatgcctctctcaaagaactcgtcgataaatgcaagtcctctgaattatccgacacggacaagaagattagcatcctcaaattcctcagcaagactcagcagcgcatgatccgcctcaatgttcctttaatacaccactgtcagcaactggcttcgactgtttcaaatcacgacatgtgtttcacgcaagctgctgattcgttattctttatgcacgaggggcttcaacaggcgcgtgcccccgtttacgatgtaccttccgccattgatattcttctcaccggaagttaccagcgtttgcccaaatgtatagaggatgtggggactcagtatgctttgaccgaggaacagcagaaacctgctttgaagaagctggacacgcttgttcggtccaaattgcttcaggtttctattcccaaagagttttccaatattatggtttctgatggtaccgcaatgcttaggttagatggggagtttaaggttttgataacgcttgggtatagagggcacttgtctttgtggaggattttgcatttggagctgcttgttggtgagaaggataagcctgtgaaattggaggcaacacgacgtcacttgcttggggatgatttggagaggcgaatggcagcggcagaaaatccattttcggtgttgtactctgttctccatgagctgtgtgttgcacttgtcatggacacggtcataaggcaagtgcaggttcttcgacagggaaggtggaaggatgcaattcggtttgagctcatatctgaggggcatggagcgagttctagctctgcgctgaaccctgatggggaatctgattcgtctgccatgcgaactccagggttgaaaattgtgtactggttggattttgataagaatgctggtgcgtctgaatcgggcacatgcccatttctcaaaattgaaccagggtcagatcttcagataaagtgtctccacagcagctttgtcatagatcccttgatgggcaaggaggcagagtttgttttggaccagagttgtatcgatgtctgtagaaccgcagatgatgttgtgctccagtctcaaatgggtgaacttgatattgaatataaacaggttaagatagataattttgaagttctggtcaaaattatagtcatcttatttctgcgttatctgccaaagatttggggtttactattgttgagataccacatcgaccaaagacatgacaaatctagtccttacaaggcttcaacagtcctcaaccccacaaaatcgaaggatgataagtgctgcagcaaggactctgagggccatgaggttttgtgtgtgcgtgcctatggctcttcttttttcactcttggaattaatataaggaatggccgttttcttcttcaatcttctcaaaacatagtggtttcttccgctttattagaatgtgaagaagctttgaatcagggatctatgactgcagctgaggtcttcataagcctgagaagcaaaagtctattgcacttatttgcatctattggaagggttttaggccttgaggtatatgagcatgaattcaatacagttaaaatacccaagaatgtttcaaatggttcagctatgctattgatgggatttcccgactgtggaagttcttacttcctgctgatgcaacttgataaggatttcaaacccttgtttaagttgttagagactcagcccaacccatctgtaaaagataatttatctggtgagcttaatcaggtgctgcggatcaaggaaattgatataggacaaatgcaagttcatgaagatgaaatgaatttaagcctggttgactggggaaaattacgctctgttttgcccaatgctgtttgtccaaatcaaacatctggacatgagtttttttctgatattcgccttgagaattccatacagattgcaagaggtcatccttcaggtttttcatcacttgttgatgaagtgtttggacttgagaaagggtcttcaacgcctccattctctgttaaaaatctttcttcatctgtgaatacatcccttccttcccaatatggctctgtccctatgactctccatagtttaaaggctggaagcccttcgccaaagtgggaagtaggaatgcagatgccactggttagtaatgtaacaaaagcttctagtgctactaaccactatagtggttccttgttctcatcaggcagtgtgaagggcccagttcagtccagttctgttggctcaataccaactggacaaggaaggaactctgctggaacaaagctatctgcttccaagtctgaacaggatttggcttctcttaaatctctgcattcagttgactctagttcctctgctgcaatggatgaagaacagctaagagtgttcagtgataattccaacgatgctttagctggaagtcggtcatctcgacttttatctcctccacggccaactggctctcgaatgtccatacctaattccagacctaatggacctcaagttgaatcgtttaaggctgctggatctggttcatgtgctacaactcccgtatcccaaacactggaatcaacggttagctataacacaggtgaagatgttacctccaaaaatgataggaaatctggaaaacgaacagcttcggatatgttgaccttgattccatctcttcaaggtgttgaaagcaactcgggaatctgcaagaaaagaaaaatttctgattcagctggctgtcaactgtctttgccacaaggtgtcatgtccgctgaaataatacccagaacagaaggatacagttatggaagtttaatcgcagaagcaaataaagggaatgttccatctagcatttatgttgcggctcttcttcatgtggtcaggcattgttcactttgcattaagcatgctagactaaccagccagatggatgcattagacatctcatatgttgaagaagtgggtttgagaagtggatcatctaacatttggtttcgacttccacttgctagaggtgactcatggcaacatatatgtttgcgactgggcagacctggttgcatgtactgggatgttaaaataaatgatcagcacttcagggatttatgggagcttcagaaagggatcaataatacaccatggggttcaggtgtacgaattgctaatacatctgacatagattcacatatacattatgatccagatggtgttgttttgagttatcaatctgttgaagtagatagtataaagaaattggtggctgatatccaaaggcttgccaatgcaagaacatttgcccttggcatgaggaaattgcttggcgtaagagcagaggagaagtcagaagagctagttacaagttctgacaccaaaacacccagtaccaaggttgctctggatactgcagacaaactaactgaacagatgagaagggcgtttagaattgaggcagttggactgatgagcttgtggtttagctttggttcaggtgtccttgctcgttttgttgttgaatgggagtctggtaaagagggttgcactatgcatgtatctcctgatcaactttggcctcataccaagtttctggaagatttcataaatggaggtgaagtttcaccgctgttggattgcattcggctgactgcagggcccttgcatgctctggcagctgcaacccggccagcaagagctggtcctgttccaggggttgcagctgccttatcttctattcctaaacagaatggtagttatatatcctcacacggtcttctgcttagtaattcaactactaatgttggtctgccaacatctggacctggggcaaacactgtcatgcctactgctagtggtctcactagccaaacactttcaatgttagctgcttctggacgtggtggcccaggcattgttccaagttcacttttgcccattgatgtttctgttgtgctccgcggtccatattggatacggatcatgtacaggaaacaatttgctgttgacatgcgttgctttgcaggagatcaggtgtggttgcagcctgcaacaccgcctaaagagggccgtctttctggaggttcactgccttgcccccagtttcggccttttatcatggaacatgttgcccaggaattgaatggattggatcctagttttactggacaacaggcaggtgggatggcaaattcaaataatccaaaccctggttcaggatcccagatgatggctgcaaatggaaatagaataaatttgccaatttctgctgcaatgcctaggacaggaaaccaagtagctagtttaaaccgtgttggaaatgctttagcaggctcttcaaacttagctttgatgacatcagctgtctctctacggaggccacctggaacggttgtccctgcacatgtcagaggcgagctgaacacagccattattggtcttggtgatgatggaggatatggaggtggttgggttcctcttgttgctcttaagaaggttttgagaggtattctcaagtatcttggagtgttatggctttttgcccagttacctgaacttttgaaagagatcctaggatctattttgaaggaaaatgaaggcgcacttttgaatttggaccctgagcagcctgccttacgtttttttgttgggtaa

SEQ ID NO: 24627 - DNA, 1158 bp, Glycine max
  Peptide Sequence Number=SeqID_141405
atggaggttgtaggcaatgtaaatgctgtaaagaatgctctagtaattatttcatcacggttgagggagagtcagcaccgtgaccgcagtcatttccatggacgtgtacattcaccagagcgttttttctctcctgacgatgattatgttcctcatgtgactagtggatctcgcagatcttctgttgatggggcctcttttggatcacgaggatctaacacaaatagtagaaataataaccacccctcattgaattatgcaatggagcctggggctgctcctgttgttgatgatgcgcagggcttttatggggaggaacttgttttccgtatactctgtccaattgagaaagttgatcgtattattggggaatcagaaggaattgtagagttccttcagaatgaagttggcgtagatgttaaggtcactgatcctgttggtggttcagatgaacagataattatcattacttcagaggagggtcctgacgatgagctgttcccagctcaggaagctttgttacatgtacaaactcgcattgttgatcttgttctagataaggacaatactataaccaccaggcttgttgtcccatctagcgaaatcgaatgcttagatggaaaagatgtttctctatcggaaataaggaggttgactggtgctaatattcaaattttgcctagagacgagctacctctctgtgttgcaaaaactgatgaactggtacagatatttccaataaatggtatagagaggatccagatgagagtgagcttggacacaatgataaggttattgtcccgtgacctagaggtcatagatttaaatctagcaaatagctcttcacttgtggggatcgtaggagagattaaagcagcccgagatgctgttgttgaggtgacttcaagattaaggagttacttgtacagggatttctttcaaagggacacagtaccactaccagctcccttacctggtgcggcggcatcttcttccaataatatagttccggttactgaaactcccacaacctatcaaaatctgcaaactgttgcagcagcccttccatcaaaggaaactggaggatctagcactgagacgggaaagcagaaagaaagtgaccgccgggatgatttgcttagtggtttaaataggtaa

SEQ ID NO: 24628 - DNA, 2565 bp, Glycine max
  Peptide Sequence Number=SeqID_141406
atgtacggaagcatgctgaggacagtctccgacaatttcaggagcaaaaaccttcctggattcttggtctctctctctggagagttagcaagtgaagataaaccggttgatagccgaaagttggcgggtttgatactgaaaaatgctttggatgccaaggatgaaaacagaaagcaggaattggtccaaagatggttgtcgctggaccctgtggcaaagactcaagttaagtcatgcttgctgcaaacactctcttctcttgtacctgatgctcggtctacagcaactcaagttattgctaaagttgctggaattgagcttcctcagaaacagtggcctgagctgataggatcacttttatcaaatattcatcaagttcctactcatgtcaagcaagcgactttggagaccctggggtatttgtgtgaggaggtatctcctcaggttgttgatcaagaccaagtaaataaaatacttactgccgtagttcaaggtatgaatgcgtctgaagggaacaatgatgttaggcttgctgctacaagggcattatataacgctcttgggtttgctcaagctaattttagcaatgatatggagcgtgattatatcatgagagttgtttgtgagacaactgtgtgccctgaactgaaaatacgtcaagcagcctttgaatgtttggtctcaattgcagccatgtattatgagaaattggctccttacatccaggatatatataacatcacagcaaaggctgttagggttgatgaggaacctgttgctcttcaagccattgaattttggagtacaatttgtgatgaggagactgatatcttagaagaatatatgggtgattccaatggagactccgatataccttgtttttatttcatcaagcaagctcttcctgcacttatccctctgctgttggaaacattactcaaacaagaagaggatcaggatctggacgaaggtgcatggaatattgcaatggcaggtggtacatgccttggtttagttgcccgtactgttggagatgatattgtgccgctggtaatgcccttcattgaggagaatatcacaaaaccagattggaggcaaagggaggcagcctcttatgcttttggatctatcttggaggggccttcacctgacaaattagctcctcttgttaaccatgccttaccatttatgcttagtgctttagtgaaggacccaaacaaccatgtgaaagacaccactgcttggactttgggacgaatgttcgaatttcttcacagttcaattgttggtacaccaatcattaatgagggaaattgccaacagattattacagttctccttcaaagcatgaaggatgttcccaatgttgctgagaaggcctgtggtgctctgtattttcttgcccagggttatgaggatgttggaccaacatctccgctaactcccttgtttcaggaaattgttcaatcccttctaactgttacccacagagaggatgctacagaatctcgattgagaactgcggcatatgaaacattgaatgaagtagtaaggtgttcaacagatgaaacagctactttggtggtacaactagtttctgtcatcatgatggagctgcacaaatgtcttgaagcacaaaatctttcatcggatgagagagaaaagcggagtgaattgataggccttctttgtgggtgcatgcaagtaattattcagaaactagggtctttggattctaccaaatatgtgttggtgcagtattctgatcagataatgagactattcttcagggtctttgcttgtagaaatgccactgcacacgaggaggcaatgctagccattggagcccttgcctactcaataggccaggagttttccaattacatgccagaattttacaagtttctcgagatggaccttcagaactttgaggagtaccaagtttgtgctgtcactgttggtgtcataggggacatatgcagggcattggagttaaaaatactgccttattgtgatgggattatgacacaactcctcaagaatttgtcaagtgataatttgcaccgttctgtgaagccccctttattctcatgcattggtgatattgcacttgcaataggagataacttcaataaatacttaatgtatgcaatgaacacactacaacttgctgcagagatgtatgcccacacgtcaggttttgatgatgaaatgacagagtatatcaattctttgagaaatgggatattagaggcatattctgcgatttttcaagggtttaagaattcatcaaaaacccagctcttgattccttatgcacctcacatcctccagtttttggatagcatatacatggaaaaagacatggacgatgtagttatgaaaacagcaattggagtccttggagatctagctgatacacttggaagcaatgctggttctttaatacagcagtctttgtcaagcagagactttttgaatgaatgtttgacctctgaagatcatttgattaaggaatctgctgagtgggccaggttggctattaaccgtgctatatctgtttga

SEQ ID NO: 24629 - DNA, 165 bp, Glycine max
  Peptide Sequence Number=SeqID_141407
atggcacatcatcacaaaaatgaagaatatataatggaactgaattggaaagtgatggaagaattacctcgtcggacgatggtgggtccttgttttgtacctgggcatgctcccttccctgatgggatgtacaggtggagtgtgacaactggtgttaaagactaa

SEQ ID NO: 24630 - DNA, 399 bp, Glycine max
  Peptide Sequence Number=SeqID_141408
atgaatgcagacagtgagggccggacaccattacactgggctgtggatcgtggccaccttaatgtcacagagttgcttgttggcaagaatgctgatgtgaatgccaaggataatgatggacaaactcccttgcattatgctgttacatgtgagagagaagccatagccgagtatttattgaagcataatgcagacatatattcaaaagataatgatgggagttcaccacgtgacatctgtgagtcaaactggccctgtatgcagcatgtggggggagaatctagtgtacgctgtacgcctatgcaccgcttaggagaaatagtgacagggaaagggtatcttcaacgatatcctttcctcggaaaaccttctacccttctattgaaggtcttcaaatag

SEQ ID NO: 24631 - DNA, 762 bp, Glycine max
  Peptide Sequence Number=SeqID_141409
atgaatggagaggaggatgaatcaggtgctacagcaactaccgtgttcattggagatgatgagctgctaatttcacatattggtgactcaactgtggttctatgcagatctggaaaagcagaagttctgactagtcctcaccgtccaattgggagcaacaagacttctcttgatgaaattagaagagtcagagaagcaggtggatggattagcaatggtagaatttgtggagacattgctgtatctcgtgcatttggggactgtttcctaaagggtatctaccttttgcatgtggaaaggatgctgcaaaaaggagttcaggaaggaagatggtcggcaaagttcatttctcgtgtacagctcaacaatgacttggttgttgcataccctgatatttatcaagtagctcttggctcagatgcagaatttgtggtattagcatccgatggcttatgggattacatgggcagagaattaccttcacactcttcttactattgcagctccgaagcagtttctatagtgagggatcaactgcgaaaacacggaaacattcagcaagcatgtgaagcacttgcagaagccgctttggatcgacgtacacaggataatgtcagcattataattgctgatttagggaggacagactggaagaatgcgcctctggagcgacaaaatactatacttgagctggtccaagctcttgcaaccattggaattgtgtccattggaatctggttttcatcacagctttctttatag

SEQ ID NO: 24632 - DNA, 528 bp, Glycine max
  Peptide Sequence Number=SeqID_141410
atggtgctaattctaattaaagaactaagaagatggagattatggggaatgcagtaccatgctagatggagggttcttaggtggcaaaattactatggtaatgatgacggatttaatagacatgtggtggcggcacttttggtttggatggaaaacagctatggatcagtgtgttatattctgttgctgctgataaaaaaggatgaatatatgcaccccaaaatggagcgcattcctttcatggaggagcaggtaaggatggtaagggaacagggaaagctcttgacgatggacatagagaggttaatgttgtcagaagataatcggtttgattttgtgaatgagatagcagctgaggccaattcttatgttgagaacaacagggatgagtatggaggtgagaagaaggccattcttcatgttttgagcaatcgaatgaatgatactggaatttacaggccagaggcatattatgagtctgatcccttcaagcccggacctcattatttgagagaagaatttacataa

SEQ ID NO: 24633 - DNA, 219 bp, Glycine max
  Peptide Sequence Number=SeqID_141411
atgggttgctacaactgcagctgcagtggtgcaaccacttttggacagattatgtcagcgtgtgaccagctgaaaaggtattgtgccatgttagttggagcaaccctttattcaaattacctaagtacaacgtattgcaccattactaccagcgcaatacatgcctatataaactctcgttctccttccatccagacacactttctggttttattataa

SEQ ID NO: 24634 - DNA, 348 bp, Glycine max
  Peptide Sequence Number=SeqID_141412
atggcaggcaacatcgcatcagcattctgtgcccatgttcatgaatcactctccatgaacagcaacaggcagctaaaaggcacctattcaaacagagatgaccgccacacgcatcctcaccacactttgcaagtattaaccccaggcacaagaggccctaccatgagatggacgggaagattggcagacaaagagattcatttagggccagcagattcttgtgtagctaaaggcaatttagactgggtgccaagacaagctaaaccttggccactggctaatttccagcagggttgcattagaaccacgatagtgccaccacttgtcattaaccaattagcaatataa

SEQ ID NO: 24635 - DNA, 975 bp, Glycine max
  Peptide Sequence Number=SeqID_141413
atgacaccaagttcttcaacattggatgccatggaaccatattctggtaatcacaaagttcttgttggaaatggtaatgttctgcctatctctcatattggttctcattgcttgaattctaccctgcaacttctagatattttggttgttcctggtttgcagaagaacctcatctctattagtaaactcactcgtgactttccagttgattctattttcactaacaactcctttctacttcagaaaagggacacaaaggaaatcttggcccaagggaggcgtgaacacaacctgtacattctggagcatggtcaagctgcttttatgactattttaaattccaataaattacgaggatcctttgaatattggcattctcgtctagggcatgttaattatgatgcaatatttgatttgagaaaaactagtcatttgtcattatcttctatttttctaaatccttctctttatgcttcttgtgaacaagctaaaagatgcaagaacttttacagcaaaatggaattctttatactatgtcatgcccccatacacctgctcaaaatggcagggccgaacgcaagcattgccatattactgagacaggtttatccctacttgcatgattatgctcctcataaattatcaccacgaagtattccatgtatctttcttggatatagcagcatgcacaaaggtttttggtgcatggacgtctcaacatctcagatctactttacttgtcatgccaaatttgatgaattttactttcccttctccaacacaggacttatttcttcgatcttacacttgggattctctctctttgatgaaccttctaagcttgtcattgtctctccgcctgctccttccaaaccatcttcgcaatcgtctatgccactgttgtctcgcccttgtggcttatgtccttcaaaagacacttcccctgttgttcttgtgcctccagctgagccttaa

SEQ ID NO: 24636 - DNA, 459 bp, Glycine max
  Peptide Sequence Number=SeqID_141414
atggcggagtggtctggaagagaagagagaaagaatgggcaaagagtagctgagttagatggatctcatgagaataagggaggtttgtttaatttcaatggaatcaagggcgtggcttgtggtattcttgcagcttgtacggttacttctgctgcatttcccgttactgctgctacccagagacttcccccattgtcaactgagccccatcgctgtgagcgtgcatttattggcaacacaattggtcaggcaaatggtgtatatgataaaccattagatctccggcaatgtgatttcacagatgaaaaaaccaacctgaaggggaagtccctgtctgctgcactcatgtcagatgccaagtttgatggagctgatatgacagaagttgtaatgtcaaaggcttatgctgttggtgccagcttcaagggtaacaatatttacttgtgcaaaatcaactaa

SEQ ID NO: 24637 - DNA, 327 bp, Glycine max
  Peptide Sequence Number=SeqID_141415
atggttcagaggctaagggacctatgggcccagtattcagtacttttgtttatgaagaggaatatggcagtgactcatattggtgactttcctaggaggtacacattgatagcattgaaaaatctcataggactaaaacatacgagtaattttatctcctatagacaaatggaagccattcatggatttgccagggaaggagatatggctaatctgctcaagtgtattgaaaatggtgtttccatgaatttaaagggtgagttatttgtagctactactcttccatatgtatacattattctcgactgtgctgtgagttgtcaataa

SEQ ID NO: 24638 - DNA, 1287 bp, Glycine max
  Peptide Sequence Number=SeqID_141416
atggcgtaccataaccacaacctttcacagcaagaccttccactccaccatttcccgaaccaatccatattaccagaccaacaacaacaacttccttcctcacccgaaccaaactccaaacctccctccgatctccaaaccgcgcccaattggctcaacgacgcgcttctccgcactcactacaccgagaccaccaccaacgacgccacaaccaacaccgccaccgtcgccgccgctgccgccaacagtaatgttaacggttccaatttcctgaacctcaaccccggtgcctccgacgcgcagtggccggcgctccaccgccaccctggcgaggtcatcgacgccggcgcaggggactccatggtggagcacgccgatttgaagggcggcggcggagacggtggtggcgacgccgtgaattggcagattggacggtggaaggcggagattctgcagcacccgctgtacgagcagctgctgtcggcgcacgtgtcgtgcctccggatcgccacgccggtggaccagctgccgaggatcgacgcgcagctggcgcagtcgcagaatgtggtcgcgaaatacgcagctttcggacacaacaacatcgtcgccgatgacaaagaactcgatcagttcatgtcgcactatgttttgttgctctgttccttcaaagaacaattgcagcagcatgtccgggtccatgcaatggaagcagtaatggcttgttgggatatagagcaatcattgcagagtctaacaggagtttcacctggagaaggtacaggggcaacaatgtctgatgatgaagatgaccaagtagatagtgatgccaatctctttgatagtagtttcgatggggcagatggcatggggtttggccctcttgttcctacagagagcgagaggtccctcatggagcgagtaagacaagaattaaagcatgaactgaaacagggttataaggagaaaattgtagatataagagaggaaatcttgcgcaagagaagagctgggaaacttcctggtgacacaacttctgttcttaaagcttggtggcaatcacattccaagtggccttaccctaccgaggaggataaggcaaggttggtgcaggaaactggattgcaattaaagcagattaataattggtttatcaatcaaaggaagaggaattggcacagcaatccttcaacttcaactgtcttgaagagcaaacgcaaaagggttaaagcgggtcaaggagctaatattggtgaaccagtttacttgtgcttaaaggcctgcaaatag

SEQ ID NO: 24639 - DNA, 414 bp, Glycine max
  Peptide Sequence Number=SeqID_141417
atgaggatgttgcggtggatgtgtggtaagactcgacaggataaaattagaaacgaagctattagagagagagttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaacttaatgatttggatagaagtatgtttgaatacgaggtagcaagctatgaattttatgagtacagtggaaaaattgagtttggtattcgtagagaatgtggaaatgaaagtaaaacaaatggaattttgacttcaagaagattctcatgcttcaaatag

SEQ ID NO: 24640 - DNA, 3516 bp, Glycine max
  Peptide Sequence Number=SeqID_141418
atgttgttgccagaggtttgcctaatagcgaagagttcaaacgatgatccctcttacctccacaatgattctaacatcgtcagtgaccaagtctctagcgttcgtgctagcgatatcgtcgctagtggcttcctggatgaggccgagtcccctcagttgaatcctcctcagaatgtcatagacttagacacaaaggctacgaccatccaagtgatttcgcgtcagccattcattcttcctcttcctccccttaaaaagcctaatgtgtctaaaaagtaccttcctattgctcttttgggttactccttggttcatgaggaagttgggtcttacacaagtagtttcttaacctatgagtccgtcatcaagtttctcaagtcgattaaatttagtaacattgatcactcatatgtaatgtttgttgagtgttgccgagaaagtgaacatgttttcatgcgtgcttttccatataaggaggacatggttgttcttcacaagcttcctagaagccttcactacaaaacttttgtggaccttcccttttccaagactctgaacgcagacttggattttcctcctcctcctgttattgtcgacactaccatccgagaagatcatgaaccttcaggtgaaggtccttcaaagaggcaaaggggaaagattttaatcttaaggctctccttcaagcatttatgctcagttagtctaattgcacatgcaaagggagagtttaaggggaaaaatgtcgagtgtcaaaaagcacagactaattatgccaaggctttggttgaagctgcctatgctaatgagacactgttgaggtcgctcgaggaatctcgggagtcttttgtgcatgcagagaataagttaaaagagattgaatcccgagaggagactttgaagacccagctttctattgttgagcacttgactaaggctctccatgaagagatcgagcgtctcaaagagaagctaaagattgatcttgacgaagtcgaagccgagatcctaaagacccatgaagctaggtgtaacaaggctttccttcaggttatgtactttttcaaagatgctaacactttcctctttggtgttgacaaggacgttactcatcaaggggagttagtcaacgaagttgatatgcttgacattaaagctcaaggaccgacacaaggactaaaaggacctataaccaaagttagagccagaaaggtagaggagactctaccacaagtggtagcaacaattcttgaagcttcacctatgactgaatctgttcggacttatcaggaattatccatcacccttgtggcatcttcctttggcttatcttccattactggaagtggtgccttccacctgtcatcaaacggagcaaatggtgatggccttcctcatttggatggagctcagaggattgaaggaataacaaatcaattgaatcatgatgtcagaggtcctaatgctaataggaggtggcatgccaagagagggagaggcgatgaagaaggagggccgagacggaatagagttgaaggagtcaaactaactattccgccatttaaaggtaggagtgatctagatgcatatctgaagtgggaactaaaaattgaacatgtgttttcttgccatgactatactgaggagcaaaaggccaaactggcaacaactgaattctcagactatgccttcatctgtgttgaagagtactataaggagatggaaatggcactgattagagccaatatagatgaagataacaaggcaataatggctcattttctaagtggactgaactatgatatcagagatgttgtggagttgctcaagaaggaaggaagatcttcaactagtccaacagtgacttctacatataggaaatcaccaatgaagcctaatacatcatcttcaagaattggaactagagacatcaaatgtttcaaatgcttggagatagaagaggaagcattagagggtgatttgttgatggtcaaaagttgcactaatgtggccagttccagattgttgtccaaattaaacttggagactaagccacatcctaggccatacaaacttcaatggcttagtgaagatggagatatgacggaatataaggatgtgtttccaaagggggttccaaatggattgccacctttaaggggaattgagcatcacattgatctcattcttagagcttcattgcccaaccagcctgcatatagacataatccccaagagatcaaagagattcaaaggcaagttgaagaattgatgagcaaaggatgggtgcaagagagcatgagcctgtgcattgttccggtgcatttggtacctaaaaaggatggaacttggaggatgtgcactgactgcaaggctatcaataacatcacgatcaagtatagaaaccgtatccctaggttagatgagttgcatggtgcttgcatattttctaagattgacttgaaaagtgggtaccatcaaattaggatgagggaaggggatgaatggaaaactgcctttaaaacttggtgtggtttatatgagtggctggtgatgccctttgggctaactaatgccccaggcacttttatgagtgccaaggaggtacatatggatgaggaaaaggttagggccatcaaagagtggcctacgcctaagactgtgagtgaagtgaggagctttcatgggttagccaaaaaacaagaaaaggcatttgctgaacttaagtataaattaattgatgccctcattcttgcattaccaaattttgcaaaatcttttgaaattgaatgtgatgcatctaatgtgggtattggggctgttttgatgcaagaaggccatccgattgcttattttagtgagaagttaaatggggttgccctaaactatcttacttatgataaggaattgtatgccttggcaaaatcaaaagtgaagcctcatggtttatatcattctctgcctattcttgattttccttggattgacatatctatggactttgttttgggatttcctagaacaaagactggcaaggattatgtttttgtggttattgacaggttttcaaaaatggcacattttataccttacaaaaaggttgatgatgcttgtcatgtagcttacttattcttcaaggaagtgggataccaagttcctaagtcatttttggagaacattgtgggggatgcacaagctaaagctgattatatgaggaagaaagagaggtttcctgaacaaaggaagctcaagctccaacctaaaggagacgggcctttccaagtcttggagatggtcaatgacaatgcttacaaaattgatttaccagggaatgatgagaacattgaagctcaaggatcagcacaaggactaggaggacttatgaccagagccagagctagaaaggcaaaggagaccctacaacaagtggtagcaacaattcttgaagatgcacctatggtgaaggacattaaaccaaaattatttcagtgcatgattattactgaagacccgtga

SEQ ID NO: 24641 - DNA, 1137 bp, Glycine max
  Peptide Sequence Number=SeqID_141419
atgacgaactcacagccttacactccaacaagacttgggaacttgttcctcaaccacctaacactaacattgttggcttcaaatgagtattgcactaagtatctttttgatggctctattgatcgcttcaaagcacgattggttgcacagggatttactcagactcccgatcttgattatgatcatacatttagtcctttgaggttcaactccttcttacttcatcttggttttattggcagcaaggcagatccatctctctccatctatcatcataacaccgcaactctctaccttcttgtctacgtcgatgacattattttgaccggcagtaatcattttgccatccaaaccatccttgctaaaattcgagccgagtttgccatcaaggatctaggccgtctaagttattttcttggtcttgaggtacattatggtgctaacgatatttttctaagccaatcaaaatacgcccatgacattctggacagggcaaaagtgttggatgccaagcccattgccatgcctcttgcttctggtattcaattgacaagcactggagacccatttcctgatccaaccctttattgttctcttgtgggagcattacagtacctcacaatcactcgtccggatctctcatatgttgttaactctgctcgttgtgttgagactcgtcgctccacctatgactactcgatattcttgggaggtaatcttgtgtcccggagtgctaaaaagcagcctactattgctcgttccaattgtgaatctaaatatcgggctatggcaaatgtagcaactgagctaatgtggttcactcatttgctgcgcgatctacatgtttactctgctccccctactcttctttgtgataacaaaagtgctatatttctttcccagaatccagttgctcacaagcgtgccaagcatattgatattgactaccactttgtttgcgagttagttctctccaaaaagctcattactcagttcgttccttcccatcttcaactcgccgacatcttcaccaaaagcctgtctcgaccactttttcagctttttcattccaagctttgcattggcccaaatcccacactttgcttgaggggggatgataggaaagaaaatatttga

SEQ ID NO: 24642 - DNA, 153 bp, Glycine max
  Peptide Sequence Number=SeqID_141420
atggaatgtgttgatttgcgtcacgagttttctgctgaggctgagcagcaagggcggcgacagtgggcaagaagaaatcctgatcgtgaagcccgaaggtgggatcgaccatgtggcacaggctcacgccatcacggacaccataatgactga

SEQ ID NO: 24643 - DNA, 1008 bp, Glycine max
  Peptide Sequence Number=SeqID_141421
atgctggcgctggatacgcagggacggctgcttgtcagcctcaccgataccggccgcattctacgcctcaaccaacaaggcgaagcagaggtcattgcacaaggcctcaatgcaccgcacgggctggcattgctgggagacgatttgctggtggctgagcaaaccggtgtggtcaagctgccaaagcaaggcgatggctggggagcgccacaaccactgatccgcaatttacccagtggtggacatagtcttaaaacagttaaagtctccccagatggttatatttttatcaatgtgggctccagttgcaacgtttgcctggaggataaccctctccgcgccaccctgttacgttatacgacagagggccgtcctgccggcgcggtactcaccgtcggccgacacgctcaaagtgctatctggagcaccgggttgcgtaatacacaagggtttacctggcatccggaaaccggagacatgttcgccaccaacaatggtgcagataaccgcagcgccattaaaaatggcaaaacagatgatgacctaccacctgaacatctcaataaaatcgaagcgggaaaacactatggctggccctattgctggggtgaccccggccagccagggcaattattccaggaccccaactttactggcgagcctgatatctgcaaacaggcacaagcacctgctttgaccatgcctgcgcacagcacgcctatcggcatgacattcctgcagcacagtcgtttgccaacgcaaatacaacaagatgcaattatcgccctgcacggctcctggaaccgcaaacaacccagcggctacgccttgctgcgtgtacaattcaggaaccaactgcctgttgcagccgtcccatttatcagtggctggctacaaggtcaaaaagcctggggaaggccagtggacgtgattgtcggtgcagatggctggctctatgtttcagatgacctgaccggctggatttaccgaatacgcagtacgcaataa

SEQ ID NO: 24644 - DNA, 567 bp, Glycine max
  Peptide Sequence Number=SeqID_141422
atgtttgaagtgaccgaggctgaaaaaatcaccgaccacgcccatttgaaaaatatttttgcggaatacaaaaaacaccagtttctgaccgcgattgacgattttggtgcaggctattccggtctgaatctattggcggaatggcaacctgacattatcaagttggacatgaacttgattcgagatatcaaccagaacaaaaccaagcagctgattgtgaaaagtattctggatgtctgccagggactcgggattcaggtgatttcggaaggggtagaaacccgggacgagttgcacgtgctggtagatttcggcgtgaatcttttccaaggttattactttgccaaacccttgtttgaaggcctgccaacgcgcttgccagccttgctgctagtaacgccagcactggccctggtcttccgaccacaagtgcaaccagccatgtttgaccagatgactgacaaccgcatgtttttcaatgatgcgcgctattttggtccggctggccacaatcactaccgtcagcctgagcggttcatgtatccagcgatcaccattatggagtga

SEQ ID NO: 24645 - DNA, 399 bp, Glycine max
  Peptide Sequence Number=SeqID_141423
atgaaagatggcagaaatacaagtagtggggatgtctcctccccctctaggacctcacaaactcatctcaagctctcaggacgacttcctcttcaatctctggtctctgcagatcttcacacaacaaaatctctcaaactctatagaacttggacctttctctctgtagaactctctagacatgtagaagcttcaagaaaaggccaaactcgcttccaaaatctgatttcaggcttaaattgtgaatggactgaagcggtgcgcttagcgggatggcccttcgctcagcaaacatgcacaactcatccttcttccagattcttcctcgcgcttagccgaggaatgttacgctcagcggatggctcgctaagccaacagattgacttagtgagagggtga

SEQ ID NO: 24646 - DNA, 171 bp, Glycine max
  Peptide Sequence Number=SeqID_141424
atgaaatttggcggagctgttccatttctcattcctatgacgaggggtgggggtcacaacccactctttgaggattcacctagtgagtctggtagtggggccgcctctgtgagatatgggctaatctccaatgacactcacgaagcaagatgcaagtgcaaggtcgtgtaa

SEQ ID NO: 24647 - DNA, 381 bp, Glycine max
  Peptide Sequence Number=SeqID_141425
atgaattggcatgtgcatgttgtgtatgttcatggggggtgcattaaccttgtcggacggtccattcatgggggactagagtggttaaagaatctaagcatttctgaggggatgcttaggcgctttaatttgtccatggtcattgcacttgatggtgcccatgttcgatacattggatgttgtgtatgttcgtggggggcgaagtgcactgaccttgtcgggtggcccattcgtgggggacaagcgtggttaaagaatctaagcatttctgaggggatgcttaggcgctttaattggtccatggtctttggcactttcttatggccacgttcatacgtcggaactcctttgggccccaggctgatcacctatggggggtag

SEQ ID NO: 24648 - DNA, 771 bp, Glycine max
  Peptide Sequence Number=SeqID_141426
atgaagcatcattttgctggaacaaatcaaaatgtggttcctttttcaaagattccacatgatgttaaggagatatttgtcaagctattgaagacaaaagaaaaagaggggacatctaaagttgtcatactaaagacaagtaatcaaacttgcgaagatagggatgttgtgattcaagatatttgcaagtgcgtacatggaaatgctttaccatttaattctttgttggacagcattgttgaaggaattggggagaagaatgttgtccaagttgtgacggatggggcttcaaatcttgtagcagccgggaagaagttattggagaagataacctctcattgcattgatctaatccttgaggacattggagagcttcctgtactctataataccattgacaatgcaaagaaaagcactacttacaaatataggcatacatgggcgcttaatttgaatagaaagtattcaaaggggagggaattggcaaggctggctttgacaaggtttgcaacttattaccttacattgaattgcattcagcaacaacagaatgcaattagatctatgtttgcatcggaggaatgggctactagtccacatgctagtaaaagtgaggctaagcaagtgacaagcctagtgttgagcgatgctagattttggaaatcaatcacatattgcctaaagtgtgtgactccacttgtaaaagtgctaaggcttgtagatggtgattctggaaaaatcgccattgatgcaaatacctccaggacttga

SEQ ID NO: 24649 - DNA, 1969 bp, Glycine max
  Peptide Sequence Number=SeqID_141427
gccattgctttctgttgaggaaggtagtgccgatgatgaaggtgcaggcctaggtgagattgtgaggccaaagaagcgtggtcgaccaaagggacccaagaagcttggtcgaccagaaggttcagaaggaagaaagaagagtgtagtgttggttggtaataaggttgttggtgagattgcaggacctaataagtgcggcaagacgaagggttcaaaaaataaaataaagaatgttgttgaggttggtaatgaagttgctggtgctggtgagattgcaggacctaagaaacatggtcgaccaagaggttccacaaagataaagaagaatgctttggaggttaataatgaagtttctggtgctggtgagatcacaggatttaagaaacgtggtcgaccaaaaggttcaacaaagaaacggtatactgttgtgtacgcttctagtaatgaagtggcatgtgaggttgcaagacaagatctggaaaacaaaatgctgagcaatctgtgtcaaaaagtttctgatgaacttgtaagcataaataataaatatggtccagcaatgagtacaagaagtaactcgaggagttttgtatttgagggtcagaagtttccagggatgtctaatgatattaatttagaaggtgatggtggaagcacaagtgtttggtcaagtggtttggaaaaagaaaaagggaggtctcctaaaccagtcaaagaaattgaaaacagtaagattacttggccaattgttaagcgtggtcgcccaaagggctcaaggaacaagaagataaaactaataggtcaggtcaggacaaagcatggacgaccaaagggatataaaagtaaggctgaagaagctggaaacaattttgacaagggagggaaaaagcgtggcaggccaaagggttctcatagaaaggaaaaggagtctgcttaccattttgattcactgattgagaggcatggtcttgtagctgagaaagaaggaggaacttctgctgaatctgcctccaaaaatgatactggtcaagagaaaaaaatttatagctgtcaaagaagttctagaattacaagacaagctattaagcaaagccaatcaaggggtctaaaagagaagacaccagctgctgttactatagcagatgagaatgagccaaatggtgttactgacagatccatgacaaatgctagaggacaatccttacaaaaacataaaagcactcgtttcagcaaagttttgagtaggattatgccacagaatgatttacaggaggaatgcattacactgctagaagatcaagtacatgaggtaaagaagtcacattttcttcttgaatgctcagagaatcccagaaatgaaaatacaaaaagaacaggattgacttgtgcaaccagcaatgatcagagaagatctagtgaaagactgaaagctttgctaattgatggcaagaattttcagggtgttggaagggaagaaactgtataccatggattggaatcttcagctttgatgtgtgataacggaaagaaaaaggaggcaaggactttaaggtgccaccagtgttggcaaaaaagtaggagtggtattgtcatttgcaccgagtgcaagagaaaacgatattgttatgagtgcattacaaaatggtatccagataaaactagagaggagatagaggtttcttgtcccttttgtcttggtaattgcaactgtcgattgtgcttgaaggaggaggatatatctgtgttgactgggactggtgaagcagatacagatgtcaaattacaaaagttgttttacttgcttgacaaagttctgcctttactccaaagtatccaattggagcagatatcggaattgaaagtagaagctaggatgcaaggttcacaactgctggaagaggaagttgtgcattcactaattgatgatgatgaccgtgtttattggtactacatcatgaacccttatggttga

SEQ ID NO: 24650 - DNA, 1620 bp, Glycine max
  Peptide Sequence Number=SeqID_141428
atgctgtgcattgatcaggtcaatattttgatacacacagctgaagtaaagacaccaccatggcagccaagaatcataaaaaaaattcagaaaaagtatgaagtggaagatatgcatgagctctatggcaaggacagtaaggcaattggttcttgtagaagaaaacgtcaaaagtgtcatgtaggtattaccaggaatcctaaaacccctgaaaaggcagacacttctgggagagactctaccttgcccggaagtcaattaaaagagaaacttaatgaacaacaaagtagactcctaaatatgggggagtcaagatcagataaggaagcttgtattcaaggactttcagaatctgccaaaagtaaattaagtttaaatgttggtgagcaggaagttctcaatttgaattcaaggcttcaggattttgatctcaataatcatgattccagttgcataattctggagaaagatagtgaaggaatttctttaccagaacatatgcagtttaagacatgcacaaatgatgattatgaaaaaggaagaatttctgctatgcacctaatgaaagataagttttgctctatctatgaccaatctgatacacgttctgtatttgatgatttgaacctccccactccacaagccagggtaaatcaggaacatcagaaaaattacattgaacaatccaggttcaaaagcaggtgcatacattttgaggagttaccctactactctgggaagaatgtttctgatttactcttcccgcaggagcagttttctcaacactatttttctgtttgtgggaatggggttgacaacactgttttgcaagatgtgacagatacaggtggtgacttccctcttgatgaatcatatggacaagatcctgataatgatattggaggatatccaaacaccagtgaaagccatctgccttgtacttcaacagaagatactaaatttgtcaatggattgaattctttagacacaccatgttcagacatcaatgttgaaaaaatagagtctgttaaaaatgacacatcaagcaacaatttctgtcaaaatgatgatcatttggagactcaatatgggagtgctgtgtgggacatattccggaggcaggatgtacccaagctaacagagtacctaaagaaacaccacagagagtttcgccacataaataatcttccagtgattcatcccattcatgatcagatcctttatttaaatgagaagcataaaaagcaattaaagcaggagtttgccatcaatttttgtctaccaggtgttgaaccttggacatttgagcaacaccttggggatgctgttttcgtacctgctggatgcccacatcaagtgagaaatagaaagtcttgcatcaaagtggctctggacttcgtttcacctgagaatgttcaagaatgcattcgattgacagaagaatttcggttacttcccaaaggccatagatccaaggaagataaattggagtgcggatgcattatatctgcacctgtaacactacttgtgtctggagttccttacacaagacattctttgttcttagataaagaagatggcactatatgctgcggatgttgcaataaccgaagccactaa

SEQ ID NO: 24651 - DNA, 582 bp, Glycine max
  Peptide Sequence Number=SeqID_141429
atgagttatatgcatacttatttatcgagtgcaatagcaacacaacacaaagtgagcaagaagcaaaaatcagattcatccacaaaggtaatttcttctccttccttgcccaaaattgatcaagaggcatgtcgaaatgcgctgattaaaatgtttgcggcaatggggctctcctttcgaatggttgagcatgaagcctttcagaaatttttgagcattatagctctctttcttgttgtcatctcacgcactatcttggcacgtgatgttcataaactatggagtagtgaaaaagtaaagttgaagaactttttttcccgacacaaccataggatttgcttcactatggacacatggacttcatcacaaaatctggattatatgagtttgacaacatatttcattgacaatgattggaagttgcaaaagaaggtgataaatttttgtcaagtctcaagtcacacatggaagaatttggctaagacggttgaacattgcttcagtagttgggggctcactcgtgttcttacattgacaattgataaggcgttatcaaatgataaaacaatcgaatatctgtag

SEQ ID NO: 24652 - DNA, 231 bp, Glycine max
  Peptide Sequence Number=SeqID_141430
atgtccattggagaggaatattctggcatgatgggaaagatagtggaggacatgttgtcggacagaggtactagatgccatagactgatgcacggggggagtcctcttccaacggcaaaaaaccatgatagaagagaggatggtaaagcttatctcattgctaaacacggcaaaattagtacaccggtaaaaattgcaaccatgaaggctagaaactcagcactggcctaa

SEQ ID NO: 24653 - DNA, 363 bp, Glycine max
  Peptide Sequence Number=SeqID_141431
atgaggtacgaaacatgggcaccatcaagtgcaatgaccatggataaactaaagatcctaattcatccccctcaagagatgcttagactctttaaccgcactatttcccctactaaggacatccgacaaggtcaaagcacaccccatgaacatacacaatatccaacggacatccgacaaggtcaatgcacccccatgtacatgcgcaacttgcatcatcacaatgtaatttcaacatcatcagcatctcgtctcggcatcactctcaacatgaacgttatttcattctcagtggcattattaataacaacaacatcttctcatattaacatgatcatcaataacatcatcaactcatattga

SEQ ID NO: 24654 - DNA, 1789 bp, Glycine max
  Peptide Sequence Number=SeqID_141432
gtcttatgggtctctgattgtggaagaagcatggcttgtttttcattaccttgcaatactgggtcatttgttaccccaactttggctcaaagaagatattttgggtagaattccctcattgagggttcctcattgttgcaagactccacatggtgtttcaagtaacaacaaaattgagccacttgtaagtagaagcaagggtgagaaaaagactcactatggtaaggatggaactgataggttgaagaagagattttcgttgagattgaggccgaggttacggttattggctatgagaatgaaaagggcttccattaagtccattttgaatgaattggggatccttattcgtaagaacattagagcagtggcgttttctgcttcaatttctactgtgttctgcctttgtttcttgtttctgaaattgactgcactcccccctccgaaatctgttccgtattctgacttgatcatcagccttcagaatggacatgttgaaaaggttttagttgaagaggggtctcgacgcatatattacaatatgaagtcccagaatattgaaaatgatccggtttctggggaagaatctgaagtggcagatgcttcaattgataaggatgttgataagattgggagtgagggtacttctaaagctggccaaactccagtggggaatgtactaaaaaaattctctaagactcgagcttcaatccctgagtggcagtattccacaagaaaaatagatcatgatggaaagttccttgttggtttgatgagagaaaaaggggttacgtatagctctgctcctcagtctgtattaatgtcaatgaggagtactttgatcactgtgataacactgtggatacctttaattccattgatgtggcttctgtatcgccaactttcggctgctaatagtcccgcaaggaagcagagaccaaatggtcagacagttggatttgatgatgtggaaggtgttgattctgcaaaagtagagctcgtggagctaggggcaaagttacctagaggtgtgttgctggtgggtcctcctggaactgggaagacactacttgcgcgtgcagtggcaggggaagcaggtgtaccctttttcactgtatctgccagtgagtttgtggagttgtttgttggaagaggggcagctagaatcagagaccttttcaatgcagcaagaaaatttgcaccatcaatcatattcattgatgaacttgatgcagttggaggcaagcgtggaagaagtttcaatgatgaacgtgaccagacgttaaatcaggcaaaaatggatggatttgaatccgagatgagagtggttgtcattgcagcaactaatcggcccgaagccttggatccagccctatgtcgccctggtcgtttctcgagaaaagtatatgtaggtgaacctgatgaagaaggaaggagaaagatattggctgtgcatctaagaggagttcctttggaggaggacagtagcatcatttgccatttaattgcttctcttactactggtttagtaggtgctgatctggcaaatgttgtcaatgaagccgcgttgcttgctgctcgtagaggtagtgaaactgtggcaagggaagatataatggaagctatggaaagagcaaaattcggaatcagtgataaacaattgaggtcaagtaaaataagcaaggagctaagcaagctattcccatggatgccatcattgatgggaaaaagtgagaggagacaggatgacctgcaaggaccattaggttatcaatcactgagttcatga

SEQ ID NO: 24655 - DNA, 1815 bp, Glycine max
  Peptide Sequence Number=SeqID_141433
atgcctactcccttccttgacaacaaagctccttatgagaaactctatggacatccctatgacattaccattctaagagtctttggttgtctttgtttccctagcacactttctgcaaataggaagaagcttgatcctagggctacaacttctatttttctaggcttcaagtcatatacaaaaggttatgtcacttttgatcttaaaacaagggccatcaatgtatccatgaatgttatcttttatgaagattgttttcctttcaatgttcaggattctcatgatcccattactgttttgcctaaaccaatttcttcttttcacgatgacattgaatttcccgcctccacttcttccatattaccatttgtcccatctgattcttctcctacagccttcatacccacaaaaatacaacaaactcttagaagatcagaaagacaaattaaaagaccatgcaaatataaagattttcatgttagctatttaccattaattgttgccagtcactctataggtagtctttatcccttaaactctatactttcttatagcagattatctccatcttatcgtagtgtaattgtatttgtcactcaacaagttgaacctaagtcatacacagaggcatccaaagatcctaattggattcaagccatgaatgttgagattcgggcattagaagctaatcatacatggacatttactgatcttcctccacataagactgccattggttatttaaatgaagaagtttacatggtgattcctcaaggtatgaatccaaaaaagccaggtttagtgtgcaaacttcaaaggtctttgtatgagttgaaacaggctagtaggcaatggtatgccagattatcctcttttctgatatctcatggttacaaacaatgtgcttttgactattctttatttctaaaacatcaaaacaattatatcactactttgctggtttatgtggatgatatagtcttatctggaaacaattttactgagattcagaatattacacacctattgaataatgctttcaaaattaaggatttgggtgatctaaggttctttcaaggctttgaagtggctcgtacttctactggtatcaatctttgccaaagaaagtatgcattatatattcttactgatattggcatgtttggttttaaaccaatatccactccctctgattacactaccaaattgcatcaacattctggttctcctatctcaactgaagatgcctcttcttacatgagattgataggaaaattaatctacttaacaaacacaaggcctgatatcatatttgttgttcaacatttaagtcagtttgtggctcatccaacttcggctcatcaacaagctgcttcccaaattcttagatacatcaaagggtctccaagtgcaggcattttcttttcagcagatggttctatccaattgaaaggctttagtgattcagactgggatagctgcattgacactagaagatctattacaggattcactatttatcttggttcttctttaatttcatggaaatataagaagcaagctactgtttctagaagctcttcagaagttgaatacaaagctctagccagtgccactttcaagcttcattggctaacctttccattagaagaattcaaagttgttttccatcaacttgttgttttgtactgtgataacaagtcaattttacatattgctgcaaatcctatgtttcatgaaaggactaagcatatcaaaattgattgtcatatcgttcgagagaagatccttgtagggcttgtcaaattgctttaa

SEQ ID NO: 24656 - DNA, 768 bp, Glycine max
  Peptide Sequence Number=SeqID_141434
atggagtgcaaaggtgatcatatatctcatctttctttacattccaagatgcgtcctatctgcaaagaatcaatgcctagagatgtaaaaggcatacatggcagaaccgggttcaaccaagataaaataaattctttcattgagccaaaagcttatcaagagatggaaaggatgtcaccaaatccaacaattaatactgcagatatggaggacatgcagggtacaaccgggttcaaccaggattggataaatgctacagagaaggtcattgaaccaaatgctgatcaagagatgaaatggatgtccttaaatgcaacagttactgaagatatggaggacatacaagccagaatcgggttcaaccaggatgggataaatgttgccattgagccaaaagctgatccagagaaggaaaggatgttcccaaatccaacaactaatacggcagatatggagtacatacaaggcaaaatcgggttgaaccaaaataagataattgtatgcttgccaataaccattgatgttggcacaaataatgagatgttgttgaatgatgagttttacattggagttaaacaaaagcgggcaactggccaggaatatgcagagtttctaaaggagtacatgcacgcagttaagcagaactatggggaaaaagttttcatacaggttactgattatgcccttctttggtttaatgtagggtacatcatttgtggtattcgtaggatttcttgcatccctaaaattagttgggggggaccttag

SEQ ID NO: 24657 - DNA, 684 bp, Glycine max
  Peptide Sequence Number=SeqID_141435
atgtttcggataagcaagatgcatgctagaggttctaatttcgggaatagctacaaacaaacaccaggaagttcttcatcatttgtcccaaaccatcctctgcagagagattttgatttaagacatcaaaattatataagaaatcaagcaagttctacaattttgcgttcccgacatcttaatgagcaaggacatgcttctgttttggaaaaatttatgaaaaaccgactactatttgttgaggctgctacaaaggagtatatcaatcgacagacaattatgcagcgaatggatacacaactcaagaagttgcatgccccaaaatgcagccaagtaaatagctctattgcttgcacatcccggatgctgcctttttcttggttattgcaagctaggtctaatggaagagtaccagaacctgcttttcagaatgtggctggtcctatcaccattgcaactgattattgtgcaatggctgtagacagtaaaaatggcttcccaaatggagggttgtcttattcttctattgttccccaaccagttttttcacccgataaccatccatcaatcgctacatgcactgatttggatgtgcttcctaactcttttgtttctggttggagaagcaatccgaaagctagctccaaggaagacgtttctggtgaagtatggagattgttctag

SEQ ID NO: 24658 - DNA, 453 bp, Glycine max
  Peptide Sequence Number=SeqID_141436
atgcataacacttttgtaggagaagtttgtgctgcaggctcccgcgtacttgttcaggaagggatctatgatgaatttgagaagaggttggcagagaaggcaaaagcttgggttgttggggatccctttgatcctaatgttcagcaagggcctcaggatcctcctctagtgacttacattacaacttgctatggtaggttgacaaaaagcaatttgaaaaaaattctttcctacatcgagcatggaaaaagagaagaggccacccttttgacagggggcaaaagagtgggtaacaagggttactacattgagccaacaattttctccaatgttaaggaggacatgcttatagcacaagatgaaatattcggtcctatgatagcactgatgaagtttaagttaaaagtcaaagatgtcctatacctcaagctgctcatgcagtcttctttgtag

SEQ ID NO: 24659 - DNA, 300 bp, Glycine max
  Peptide Sequence Number=SeqID_141437
atggttgatgctggtgttgggctgacccgacccaaccctaacccgattttcgcatgcaaaaggggtgagcagcacgagcaggaacggcaccacgcaaacgagacgcaacaccccgcatcagcacctgcaccacgacggcgacgacggcaaactcggcaccccgcacgcgacgtggcaccagcgcaccacgcacgcgagcacggacggcgacggacgcgagcatggacggcggcggcagcaacagcactacagtctgcgaccgagggcaattggatgatggagaaattgaaggagatgtga

SEQ ID NO: 24660 - DNA, 387 bp, Glycine max
  Peptide Sequence Number=SeqID_141438
atggggaaagaggaagttaaccaccatgtgcaagaggaagtaaatgggggaaagaggaacaaggatattttactcacgcatgttggagctttgagaagacatgatgtatcttatgctacgatggaaacttggggtagtagaatggtgtggttgaggtgctatgggttaccattacatttttggaatgtggcatgcttctcaaaagtggtgtcaacgtttggtttgaaagtggatgcagacaatgcaattttaacaagactggcatatgctaggattctagtgaaagcgtataagcaaatatatatccttttagagaggattagtatcaatggacacatcattccaattagaacaataaaagcatctttagtgccaggtcttgagtaa

SEQ ID NO: 24661 - DNA, 633 bp, Glycine max
  Peptide Sequence Number=SeqID_141439
atgaaggtgctcgatagaagcaccatcatcaagcacaagatggtcgaccagatcaagagggagatttcgatcatgaagctagttaggcaccctgatgttgttcgcctgcacgaggcatgtggtaattgctttccattttcctgttgccactcacaagcacttctttctgttgtaaaacgcttttttcttcaggttcttgcaagccgtactaagctttatattatattggagttcatcacgggtggtgagttgtttgataaaattatacaccatggacgccttagtgaagctgactctagaagatatttccaacagcttattgacggtgtagattattgccacagtaagggagtttatcacagagatttaaagcctgaaaatcttttacttgattcactaggaaatataaagattttcgattttggtttgagtgcatttcctgagcagggggtgagtatccttcggacaacttgtgggactccgaactatgtggctcctaaggtactcagtcataagagttacaatggtgctgtggcagatgtttggtcctgtggggttatcctctttctcctactggctggatatcttccttttgatgagcttgatctaaccaccttatatagtaaggcatga

SEQ ID NO: 24662 - DNA, 351 bp, Glycine max
  Peptide Sequence Number=SeqID_141440
atgaagaatgaagtttacaccatagttacatgtgttgagtaccatgatgatagctataaacaaaccatgttgggattatacactcatttctctttgaaagctggagttgctgcacatgatgtccaacgttatgtcaaggaaccagatcgggctgcacaatgcacaaggcaagataaaagtcaaatgaaagaattgaagctgcaggatccacgatgtcggatacaatgtccaggacatcctgcccgaaaatactggacacataaatctgttatatctttaacagattgtgcaggatccacgatgtcggatacaatgtccaggacatcctgcccgaaaatactggacacataa

SEQ ID NO: 24663 - DNA, 156 bp, Glycine max
  Peptide Sequence Number=SeqID_141441
tattttcgggcaggatgtcctggacattgtatccgacatcgtggatcctgcacaatctgttaaagatataacagatttatgtgtccacccgatctggttccttgacataacgttggacatcatgtgcagcaactccagctttccttcattgtctaa

SEQ ID NO: 24664 - DNA, 726 bp, Glycine max
  Peptide Sequence Number=SeqID_141442
atgcactgccatgaagtgatagcaaatgggaagcgatggttttgcactgaatgcaagaaatttcaggagtgtgaaagatgccatactgttcactcacacatttcagccaaaggcgagaggcatagacttcatcaggtcctcatggatgacgtccttggtgataccaaggagaatgatatcattcttgataatgggttatttgattccagacacaactttctgagcttttgccaaaggaacaggtttcagtttgactcactgcgcagagccaagtattcctcaatgatgatcctctaccttgtgaagaatcctactcttctgactgttggaacaacatgccgcgtttgctctaaaaacaatgtgtcccagcgctactggaaatgtgagaattgccctgaattcactgtctgttctgaatgctacaacgagagaggtgctaattgccatgcacacacgttgaatgaagcttattcaccagcacaatctccttcagggaatcaagaattgcagcagaactcagcaatgttgcagcaacttctggatgttattgaacatgcatctctgtgtcactcaatcaaaactcaaccatgcacttacccacattgccgtcaaattaaaaagctgttcgctcatgccagtaggtgcgaaattcgattttctggggggtgccaattttgtaagaagggatctgaagaaacaagtagaatggatagcaacgcaatctga

SEQ ID NO: 24665 - DNA, 900 bp, Glycine max
  Peptide Sequence Number=SeqID_141443
catcaaatatgtgcactctacaacgataaaagagatttggactacagagctgagtatacatgtcctatatgccgcttaaaggaaattggaaatggaatgcatgtacccttaccgaagacagcggctatgtttagtgctaatgacttgccgagaaccatgcttagcgaccacatagagagcagactttttaagcgtctctggcaagagaatgaagattgggcaaaagcagggtataagaatcttgatgaggttattcttctgtttcagaagattgaaggagtggatgtatgccttttcgcaatgtatgttcaggagtttggctcagaatgtggctatcctaatcagcgttctgtgtacatttcatatctcgattctgtcaagtattttaggcctaaaagagtgactaaaagtggagaagctcttcgtaccatcgtttaccatgagatattgattggatatcttgatttttgcaagaaacgaggtttcgcaacttgctatatatgggcctgtccacctatgaagggagaagattatttactatattgtcatcctgacacccaaaaaactcccaagaaagataaactacggcactggtatcattcgatgctaagaaaggctgccgaagaaaatatcgttgttggttcaactaacttacatgatcatttctttgttactactggaagttgtgactccaaggtaacaactgctcgtttgccttactttgatgggggcttctggtctggtgctgctatggataaagccagggacagtgaacaagagtgtggaggagattataaaatgatcttcgataaagtagtatccaaaagatgtttaaagtccatgggacatgtaaatcctccttctgaaggaactgccaaagacattctagtgatgcataaa

SEQ ID NO: 24666 - DNA, 630 bp, Glycine max
  Peptide Sequence Number=SeqID_141444
gaggtgcaagagcagatgaaggccgacatagaggccatgaaggagcaaatgaccataatgatggaagccatgatgagtataagaaaaatgatggaggttagcacgactacaatcattgctgcaagtactctcactgaggtggactcgactcacccatttagcctcaaccaagcaaatcgcctagcctcggataaggtaagtcaaggaggcgaagcgttgggaagtgcgggtggctcccattttgtgcagagtgccgataactccgctcccatactcattgagagccaacaaccccagtctggtcaggcacagtcgtttggtggcatacccctgccaaacactttggggggccctcagtatcgcccagaaccacaacccttgcactttacgatgggaagagtgcctcttgccatggtggaaagggaaaattttgatcatatagaagaaaggctaagggctattgaaggaggcagagattatgcttttgctgacatggtagagttgtgcctagtgcctggcatcgtcatccttccaaagttcaaggtgccagattttgataagtacaaggggactacttgccccaagaatcacctgaagatgtactgcaagaaaatgggggcatacgcctaa

SEQ ID NO: 24667 - DNA, 255 bp, Glycine max
  Peptide Sequence Number=SeqID_141445
atgagggaaagaaatgttctcattgccaaactagcaaccttaagggagaaagaattggaaaaggagtattatgacattctaatgaaggacacatctacaataagtacactccagctgtcataccctattttcatctggggactatcgttcgttgatcttttgatccttgctagtcgacttatggtgttgaacacaagttacagtgcaaagcaaggaaccattcagtattttgatcaggaatgccaaagatactag

SEQ ID NO: 24668 - DNA, 1056 bp, Glycine max
  Peptide Sequence Number=SeqID_141446
atgttttggataaacaagatgcatgccaaaggttctaatctcgagaatagctgcaaacaaacgccaggaagttcttcatcatttgtcccaaaccatcctctgcagagagattttgatttaagacatcaaaattatataaggaatcaagcaaggttcttctttgactggcgaaaagatcctggaattagtcgatataggaacttgataaaaattgatatttctacaatattgcattctcgacatcctaataagcaaggacaggcctatgttttggcaaactttctggaaaatcggctatttgtggaggctgcttcacaggatgagtatatcaatcggcagacaattatgcagcgattggatgcacaactcaagaagttgaatgccccgaaatgcagccaagtaaatagctctattgcttgcacatcccagatggtgccctcttctgggttattgcaagctaggtctaatggaagcgtactggaaccttcttttcagaatgtggctggtcctatcaacaatgcaaccgattattgtgcagtggctgtagataataaaaatggcttcctaaatggagggttgtcttattcttcttttgttccccaaccgattttttcacctgataaccttccatcaatcgctacatgcactgatttggatgtgcttcctaactcttttgtttctggtgggagaagcaatccgaaagcttgctccaagtcagtcagttcctattttcctcagcgacaggcagacgattggaagacacttctgctgaagtatggagattgttttaggactacaatgggaaaatttgtccaatctgaatctccaaatttgatgacccctcaagatgccttgaggggattgtcaaaagtttccgatcttcctcctgtcccgagaagccttggagatattaggcagcatcaacaccggaagcgagattttcagcagaatttaaaactttgtatgcagccatatggacttcctggtaaaacttatatggcccagcctaatgcactctccaatcaaggggtcaaatgttggggcagaaagcattga

SEQ ID NO: 24669 - DNA, 495 bp, Glycine max
  Peptide Sequence Number=SeqID_141447
gaccctcagcctcagatttcactccaagccctaaacaagttaaatttgctcctactgctgctcctatgtatccttatttatttgatgaatctgaccaactgatcttaacccctctaagtgaccttatgcatttcaatagtgtagaggcagaagaagcatcctttattccatcatgggaggagactaagacaattagggatatgggtaatgatgattgtatgaggcaccttcaagttctatgggaagaacttcaaccctttggatttgacttgacatggctagagccccatgttcaatcagcaatgagtgcaaaagcttattttgaaagagtagactacttgaaaagtataaaggtcaatatagcttctttagagatagaattgaagaagctgaagactaaactggttgttgcacaagttgatcttgaggttgcaaggagagacttgccagaggtagaaaatgatttccgagagagggacatggatgctgaacttg

SEQ ID NO: 24670 - DNA, 861 bp, Glycine max
  Peptide Sequence Number=SeqID_141448
atggaaggtgacgagcacatgaacgaggttccatcagagaacagcaacttgggaagtgattctttggaaaaggagaacattttggaagatgaaaaggaggatttgcaagatgggttgaagttgaaggtggtcactgaggaagtgagtggaggattgctcgctgagaatggttgcatttctcttgaggatgggagtctcaaaagaagccttgagactccactggctgctactgggatggctgtgacggagtgtttcagttttgtggctgatttcatggccagaaaggatgctagcgaagtgttggaatccggtgaggagacattttttcctgctttgcatgttggacttgaaaagacttctgccgtgtcattctggatggagaaccaaacaagaaatgataagaacaaagatttcattcctttagctgataatactgtgcctctatatgatcgtggatatgctttgggattgacttcagctgatggctcaagtaatgtggatgggaagtttagttcagatgacattttgatatgtaagaaatccttacttggccaattgatgttgccatctgcagcagattgtgtagtggtgggaatgttgtgtatgtatggtttagggattattgatgctgctgctaggtgtttcaattgtggttcttacaaccactctttgagagagtgtccaaggccccgtgacaacattgctgtcaataatgctcgcgataaactcaagtcccgacggaatcagaattcttcttcccggcatccaactcgttattatcagaattctccagctggaaagtatgatggtttgaggccaggatctctggatgatgcaacacgtaaacttttgggcttgagg

SEQ ID NO: 24671 - DNA, 711 bp, Glycine max
  Peptide Sequence Number=SeqID_141449
atgggttgtattgtggagcttgatccacctccgtggcttaacagaatgcgagaactaggatacccacctggatatcttgatgtggacaatgaggatcagccttctggcattacaatattcactgatagtgagattgctgaccaagaggatggggaaattatggaagctaatgcttccaaaccaaagcgtaaaaagactgtcaaatttcctggaataaatgctcctattccagaaaaagcggatgaaagattgtggggcactagggctggaccctcgagttcagatatatcaagaaacttgtcattgccacagcacaggtcgaattatagtactgattatggcagtcgaggatatcatcgcgaacatagattaggggatcttagggatgaaggtccaccaggggacccaggacatagttcatttatgttcagttttcatcctaggtttggtggccatgattctgcactaagaagtccttcaatggcaaggtctcaatctgacaggagtagaagtcctatgcatgatgaagaatcctcaatgcctttttctttccattctcttcattattcatcttcagagaggcatttttcgcccttggaccgagattctggtagactagggagctggacctctgaaagttcgacgatcgtcactaccgcagttggaggtgaggatggcacaaacaggatcaatcatattggtaggttctga

SEQ ID NO: 24672 - DNA, 237 bp, Glycine max
  Peptide Sequence Number=SeqID_141450
atggaggaaccccctgatgcaattttggccaaaacaaagttgaagttacaagattggaccttagcccaaagtgcaacaaagatttcaagtttaggcattgtactactcaaatttggcataccttcatacgcagtgctcgaccgtgtagtctactttgattggcaaaatctgatggatctaattgaggtacacccaaccactgttaatggaggagctcacagaggagcgacatcgtga

SEQ ID NO: 24673 - DNA, 138 bp, Glycine max
  Peptide Sequence Number=SeqID_141451
atggagcatgatcttgctttcattgacgccatggcagagaacacgcatttgaaagatttgcaagctgaagttcgtggtcaagctgacgatatcaagaaattaatggagctcttggatcttcacgatcagaaacaatga

SEQ ID NO: 24674 - DNA, 1854 bp, Glycine max
  Peptide Sequence Number=SeqID_141452
atggcgaagcttttcaaattgcaacaaaccggtatagtctcagattattatttgaaattcatgtcacttgcaaatagatcttcgggtctatcggatgatgctttgttgaatttctttttgagtggtcttcatgctgaaatacgtagagatgtagttgccttgttaccaacttccttgttgaaagtggttgtgttggccaaattgtatgaggagagatatttgcttgttactaagccaggcacttgtcctaaccggcagtttttgttttttcaacttgatgagacttctatggacgatgtgaactcaccccttgacactggacagcagttcattgaggaggaaactgttgtggataatcatcatttgtcacttaatgcattaaaaggaggtaaaagtgtgggtacaattcgatttttggaatttattggcaaattatcagtcacagtgctgatagatggtggtagttctgacaattttatgcaacctcgcattgctaagtttttgaagcttcttgttgagccagctctctcttttaaggtgatggtagggaatggtaattacgtggcagctgaaggtatggtgcagaattggattattcaggcgcaaggcaatatgtttcaattaccagtatatcttctctctatttctggagttgatcttattttgggtgctagttggttgaagaccattgggcctcatgtggctgattatgcctcattgaatatgatatttttacatgagaataaatttattacgttacaaggtgaagtggatcatgttccaatacaagctcatttacatcatattcgtcgtatggttaacacccattctattgctgaagtatatacaattaagatggtggatcctactgctcaagctattccattaccagagctgtcagatgacatggaacccgaattggctcttctattgtgtaactatgcttcggtgttcgctaccccaacttcattgccgccccactgcactcaagatcactatattccattaattgaaggctcaggccctatcaaagtgaagccatatcgttatccccacagccaagaagaggaaatagagaagttagtgggtgatatgcttaaagaggggattattcaaccaagcaagagtcttttttcctctcccataatccttgtaaagaagaaggatggttcttggcatgtatgtactaattatcgagctattaacgccattacgataaaggatagctttccaatgcccaccgtggatgaattgcttgatgagttatttggtgcttcctttttctcgaagctggatttgcgttccggttatcatcaagttctattagcacctgaggacagacataaaaccgctttttgcatgcatcatggccatttcgagtggttggtcatgccctttagattgactaacgcaccggttacgtttcaagaaattgagtatttaggccatacgctgtcaggtcagggagtggctatggatacaacaaagctggacgttattcgaaaacatagagacttgcaatttgagcaatatatacctttgcccctgacgactacggagtttggcccttccgtacaaccatttcaagtcctaagtttccgcactgtcatgcatcattccaaatcagtgcctcaagtcctaatccaatgggattccttgggtccttctacagccacttgggaggatgttcaagagattcaagagtcattttcagagttcaaccttgagaacaaggttgctcttgatggagggagtattgtaacgtgcacgggaagaaatgttgagtttgataaggagggaaaattagttaatcagaaaagccatgtggagcatgatccgcaagtgggggactga

SEQ ID NO: 24675 - DNA, 267 bp, Glycine max
  Peptide Sequence Number=SeqID_141453
atgagtataaaggtagaagaatacatttctcaagtgctaacaaagaacactgacctcttcgcatggcaaacatccaatatgcttggaatcgacctcgagtttcattgtcaccggttggccatctgccctgaagctagactggatgaggcgaagactgcgttcacaactgatacgactaactattggtactcggttatgccgtttggtcttaagaatgtcggagcaatgtcaaaggctaatggacaagatattcatgaaccaatttag

SEQ ID NO: 24676 - DNA, 390 bp, Glycine max
  Peptide Sequence Number=SeqID_141454
atgagggttcatatcaccttttataaagtagaagatgaagttttccctcttatcttaattagatccaccagattttgtggaattgaagtagactacttggttggccatcgagtacggaggttcacccaatcgggggggagttccaacgacgatccctctcatcatcatggtggcttcgacgctgccaatggtgatgtttctagcgtccttgctaatgatgtcgccactgttgacggtgtggttttccctaacgtgggtgtcaccgcccctgttggtggctccatcattgttgagggagggcttcgccctaactctagcgttcatcttaaccccagggaggatgaggctgaatcccatctagccaataggccaccgttgttcaagtcatag

SEQ ID NO: 24677 - DNA, 201 bp, Glycine max
  Peptide Sequence Number=SeqID_141455
atgtcattttcaggcaaggtcttgggggatatcgaatattggaccaatgaattcaagaaaattgatgctaagttcaacaaggcacgggttgaactcacaaaggcttatgaagctttggttgaatccaccaagatttgttttaattgcgagctaagagtcgttaaggcgttggaccttgaaacgatttcaagtgatatttga

SEQ ID NO: 24678 - DNA, 438 bp, Glycine max
  Peptide Sequence Number=SeqID_141456
atgcataccaacaattggaaactaacttatgattgtcaggatactaaaaacttctatctcaccaaacgtcctctaaatacaggcatctttttcagcatctttcttaacaaactcatgttgttacccgagatagcgaagaagcgtgaaggcgagacgagaaaccaagtaggtttccgcggcgacgtgttcgatatttctgcgcaaagattcttgccgaacgaggcgatgccggaggccgttatttccggcatcgcgccgatgagtggtgcggtggttgttagagacggagtccgaagttattggctgcgcgtcaacgttctccggcgggagcatgcggcggcgatgatcggagagggtggccatcgccggcggcggatacggaatcagagggattgtgttgtattggatcggaagagaataaatgaaattattgcatga

SEQ ID NO: 24679 - DNA, 483 bp, Glycine max
  Peptide Sequence Number=SeqID_141457
atgtcctcccaatcgtcatccatatgctgcatcagaccacgaaagcctaggaagcttattggcagtgttgggcccaaggagcatgatgatgcacttcatgttgatcgcttcttcagctacctctgttgttgtcttgcgctagtagatgcaccagagtttaggtcatgcatagttgattttcctgtttggtggactgaagccatgccattctatcaccattttttcatgtttgtgatagagatcatcattctattcgagtctccttcactacctatggacaatgagaagtcttttgttagatatgaatcttcatctgatgactctgaggctactctctctgttttggtttctccacagtcggtgttaccaagccctgatggagaagagggttttaaggaggacatatctatcaaggaggattcatcaatggatgaggaggaccctgtcatggagtcgaagtcgatgggggaagactcttcatag

SEQ ID NO: 24680 - DNA, 186 bp, Glycine max
  Peptide Sequence Number=SeqID_141458
atggctgaaggaattagctcacccaggcaagctagttgcataggcttgaaggcatttcaaggcccagtgtgtgtgcaagatgaagacacttacagtcaggagtttcatgaggatcgacacacattacaaggaaaaaagggaaaggaatggatgaacatgatggcaagattgtgtagacttagatag

SEQ ID NO: 24681 - DNA, 150 bp, Glycine max
  Peptide Sequence Number=SeqID_141459
atggctgtgatgacccccataatttcagcaaaaagagaagccgcaaatcaatcaagaaaatccgccatgtggtttctaaaaatcccaccgcaacttgctctttctgagcatcctttgacagctatgtggttcaaatttacaaatggttga

SEQ ID NO: 24682 - DNA, 294 bp, Glycine max
  Peptide Sequence Number=SeqID_141460
atggagcacagtgcaaaatggccgaaggctcagacacaagagctggattggctcccaaagccaaaggtttcaggcaaggaaaaggttgaaacccccaaggagagtgaggaggtgcaagccttaaaggcggaacttgaaagagcacaagcagtcaaggaaaagttcaagaggatggccatcaaagtccgaaaagaatgcgaaaaactgagagacgtcaatgtggccaccaccgaagctttggagcgggaaacaaagagagcccgaaaggaaaaatggggccaaaacaagttctga

SEQ ID NO: 24683 - DNA, 429 bp, Glycine max
  Peptide Sequence Number=SeqID_141461
atgaccatcgtgcgccgcgaagtcgcccgcatcatgcgcatctggggccagaccctggtgccgccggcgatcaccatgaccctgtacttcctgatcttcggcaacctgatcgggtcgcgcgtggttcatcgtgccgggcctggtgatgatgagcgtgatccagaacagctacggcaacatcagctcctcgttcttcggcgccaagttcggtcgtcacgtggaagaactgctggtcagcccgatgccgaactgggtgatcctgtggggctacgtggccggcgcggtgctgcgcggcctgatggtgggcgtgatcgtgctgatcatcgcgatgttcttcaccccggtgcgcatcccgcacccgctggtgatgctgaccacggtgatcctgggcgcgacgatcttctcgctggccggcttcatcaacgcggt

SEQ ID NO: 24684 - DNA, 137 bp, Glycine max
  Peptide Sequence Number=SeqID_141462
ttgagcacgagtcgtatatagattaccgtggtaagagattagatgttagtggaggtcccctaaatctcgacctccaaaggggtaacgaggttagcttggaaatcaacctcagatggtatgtgacccctcagctttga

SEQ ID NO: 24685 - DNA, 261 bp, Glycine max
  Peptide Sequence Number=SeqID_141463
atgatttcctcatcgcaattgaggatacataggagcaaaagccccgcttttgttgaccaccccaagagatcgttaatggtcttcgacttgcttgataacagtgaaccatcatctagagtttttctctttgataacatgttgctggtagtccctactgtcgcaatatgtttgtcgaaggggatgatacctctagaaaccatcaagaaaggtatgatcaccttgggaattatcactaaaagccttttagttcctcccgtttag

SEQ ID NO: 24686 - DNA, 432 bp, Glycine max
  Peptide Sequence Number=SeqID_141464
ggccctcagtatcacccacaaccacacccctcacattccacagcgattaaaaaccctcatgctatggcggaaatgggaaagttggatcatctaaaggaaaggctcagggccattgaaggaggtgaagattatgcctttgctaacctagaagagttgttcctagtacccaatatcatcacccctcccaagttcaaggtgctgaactttgacaagtacaaggggactacttgccccaaaaaccatctaaagatgtattgtcggaagatgggggcatacgcaaaagatgaggaattgctgatacattccttccaagaaagtcttactggggtagctgttacctggtacactaacttggaaccttcccgagtctattcttggaagtacctaatggtcgccttcgttaggcagtgtcagtataatggctttggatag

SEQ ID NO: 24687 - DNA, 99 bp, Glycine max
  Peptide Sequence Number=SeqID_141465
atgactaatgcaaactatctgcaagagtcattgcattcagtctcaaacgggaatctaaggtttggcactgcacaaactcttgtgtcaaggttcctttag

SEQ ID NO: 24688 - DNA, 750 bp, Glycine max
  Peptide Sequence Number=SeqID_141466
atgcagtggccggtggtgatttcgcctgaaggcaccgcgccgcggcgcattgcccagcacatgctggatgaacaaggctgctcgctgccgggcaactgtgtcgaaacctcgtccacctcgctggcccgccagctggcgctgcgttatgactatgtgtggtttgtgccatccggcgcgcggccactcgctctcgctcagcgcggaagtgctgatggccaccatccgcaaatttcacagttaacggctgcgtttggcgtggcgttcgcgattgtcgaggcgcgcgcgatcggttttgcgcagcccgacatagactgcaccgctgccgccgtgctgcggttgcgcgctgcagaaggtctgaacatcgtcaaattgccgcagccagcgtgccacgtagctgcggacaatattggcgtgcgcttcatcatcccgccctttgccatgaataatcagcagattgcgcaggccctgtttgcgcgcttccagcataaagctgaacagcgattgccggcaggtctccaccggctggcgcaacagattaagactggcgtccagcgtatatttgcccagccgcagcttatcgagcacgccctgctgaatgccatcggctttatattccagcggcgtgtcgcgcgggataatctcaaggaagccgcgcgtcaggaagttttccggtgcgtcatcatgcggctgctggcgcggcgctttggtagacggcgcgcgcagccactgggtgttggcgcaatcttttaa

SEQ ID NO: 24689 - DNA, 324 bp, Glycine max
  Peptide Sequence Number=SeqID_141467
atggcatctcagaaaagagaatccattgcttcttcatcttctcagctcaaatatgatagatacaaattttcttcccctaaagcatgggatcgctacaccaacaacatgttcggcagaaagatcattcctgaaagaaaggtgcagctgtcatttaatgactttgaggaatttcaaggggagttaaacaggaggaactggcataagaaaatcgctaatttggaagagggaagcatagatgtggcacttgtaaagaagttttacacaaatgtttatgatcacgaagacaagtcaccaaaacaggtcaagaaacaccagtggtcatag

SEQ ID NO: 24690 - DNA, 261 bp, Glycine max
  Peptide Sequence Number=SeqID_141468
atgaaagaagtagccgagtcattgaaagaatttgttgaagtgactaagaagaagatggagaacaaaaaaaagatggagataaaagaagctcaagaagtggtacatgaagtggtgagtgagctagataatatacctaattttaatggtgcacttcgacatagagcaatcgattggttgacagaaaatcccattaagtttacgattataaaagctctttcattggatgataaggaggattacatctcgtcttttatgccttga

SEQ ID NO: 24691 - DNA, 398 bp, Glycine max
  Peptide Sequence Number=SeqID_141469
gtagccaagatgaggctactacttcactttcctctagtgaaagtgaaaaagcaaaaggggaagaatctagtgaagaaatctacccccaagaagaaggacacccattagtgattaaagagaagtgtaaggaggcacttgctagcattgccacacctcttgggcttgagtttattcctcaagtaaagaagttgttggatgagggtttggttcgcaagagcttaaatccttgtgctttgttggtgcccaaagtaggtattattaggcaccaagtccctaaaataggtggtatgatgaatgttttgagtggtgcaaccctcttttgtaaaatcactcgtacacctaacatcttcatggggttgagggaaggagcccagagtatgaagaacctcgggatttga

SEQ ID NO: 24692 - DNA, 372 bp, Glycine max
  Peptide Sequence Number=SeqID_141470
atggaaagggagatgatcaccatgatagtggacacactcccaatgttctactatgagaagttagtaggctacatgccctctagctttgtggatctagtattcacgagtgagaggatcgaggtaggcataacaagggggaagttcgactatgtcgcccctgccagcacaagcaatagaagatccaggtcgactggggcaaagaggaaagaaggggacgcgcatgccatgaccacgactcctacttggccaaaacctcaatcaacccctcacaatactcatcaatatgccgagcaccattcgagcttttcggcccgcgccggaaacccctccaactcaacacccgtccgacaagggacatttgccccactataa

SEQ ID NO: 24693 - DNA, 219 bp, Glycine max
  Peptide Sequence Number=SeqID_141471
atggcgagatctggaatgggagagagagggatctcgtccagagctcagaaaaaaataaaaatggaaaatatgaatgaggagaagagaacaacagtaagaaggtggaggtgcttgcaaccttgcactttgaagctgtccccgactattgtgggtgtgagtgagtgcccctctctccactgctataaggaatatggggatgataagtttaaggcttcataa

SEQ ID NO: 24694 - DNA, 309 bp, Glycine max
  Peptide Sequence Number=SeqID_141472
atggatgatcaacgatcaaattacccactcctaccaattcctcaaaaagagcattttggataccatagtgagaagcaagccaccaaaaaatcaacattgttattgcgaaagatgcccgcacaagctgagagaccaaaggagcctttagaagcaccatcagtgttacattttgtccatagaggaagaggaggatgccaaccaacttccttgatgataggatgcttgggagtattccatcaactgaaaataacttcaagatgctcagtcgctcatgctagaagacatgcaacttttagagataatccttga

SEQ ID NO: 24695 - DNA, 186 bp, Glycine max
  Peptide Sequence Number=SeqID_141473
atggaggaaggcataattcccatactagacctcactcccaaagaagagaaaaggatagaaggtctcaagagggaaagaaggattcatagggatcctccagtagagcattggaatgatcttaagaattcccttaggaagagacacattctctcctactatgaaagggagcttatggacaagctctaa

SEQ ID NO: 24696 - DNA, 108 bp, Glycine max
  Peptide Sequence Number=SeqID_141474
atgttaggaacatcaaggccacaatttgtgctgtttgggtcttccattgttcaatacagttattatgaaggttggggtgctacactttctcacttgtatgctcgtaag

SEQ ID NO: 24697 - DNA, 333 bp, Glycine max
  Peptide Sequence Number=SeqID_141475
atggggagtgggatggctcagaagaattggctttcctatgacgccaatgaactgattctcatagatgcctttaggcaacacagtgaaatcattgaagacccagaacatcacgactcgcgaatcttctctcatatcgtgatttgtttgaaggtgaaggtaatgtttgcttcacttcaaggcacggcttgcttgcttcactttactcccaattgtgatttgcttccaagtgaaggctcgagcgcgcatctgttggaaccatatactggacggcagacgcattcaagtgagttatgcacacaaagggtagccaccaagtgtggcaacaattcataa

SEQ ID NO: 24698 - DNA, 102 bp, Glycine max
  Peptide Sequence Number=SeqID_141476
atggagaggaagctcttgaagtttcaatgcgaggaagctcgtggtagtccaacaaccctagtcccaatttatggttcaatgaccctgatgactaaagattga

SEQ ID NO: 24699 - DNA, 690 bp, Glycine max
  Peptide Sequence Number=SeqID_141477
atggctgaacaagtgacagctggcaacaatgctcgtgaattacaaagaataagaggaagggggaaaattaccttgggaggtgcacgttttgcttcctcgcactgtcaagaggccgctgttcgtccctccgttcgtgccacaccgccagtgagtgcccttgccgtcgacgtcaacttcgtcatcgtctccaccgtagatgcacctgttgctgaggatgttgagcatgattttccaagtgggtctcacgatacatcaattttgacgaactatgttcatcatgtgacggaacgtcctaagttgaagttgtcctcccatggaaggaaggtagagaaatttggaaggtctgctctagagactgaagacatagtggctgccacaagattaagttttcagatagcattaggagaggtcactatcaccgtcaatgatgtggcatcgttgctacatctgcccattacagttcacaagaagcaagacatgagacatttcaatgccttgaggcatatgttcggctatcctggctgcgagacatatatcgcagcaaatgtgacgcagcacagtgaactgtggcagcttgagcatattcatctactaggttgcacactttttgataacaagagtaccacacgcatgcatgtggtattcttggacgcattttgtcacttgacgcagaatggaagctatgcatag

SEQ ID NO: 24700 - DNA, 387 bp, Glycine max
  Peptide Sequence Number=SeqID_141478
atgttttccaagaaggagggaatgatgagaatcatgaaacaggccaaatacagtctaaaggcccaagtggagaaggacgaaggcccaagtggagaaggacaaagcccccgagtggagaaggatgaaggcccaagtaatccttgtggcgtctacccagacttatcttccttcattggaagtggcgtctacccagacttatcttccttaaccggaagtggcgtctacccagacttatcttccttcactggaagtggcgtctacccagacttatcttccttcaccggaagtggcgtcatccaaaaactctacagcctgtatcaagtgatccgccccggattgaatagacaaaacaacagcccacatcaggcgtcaaacagccgcgactga

SEQ ID NO: 24701 - DNA, 473 bp, Glycine max
  Peptide Sequence Number=SeqID_141479
ctgacaaaatagatagcttcctgaagcaatgtcccgctttcccaactgctttcttaattggcggtccagcagatatatttgttaccgaactcactgatcagcttcaaaagctaaaggttgaaccagtgctgcttcattacctttcagaaattaagatccttcagggtatggaattgagaatgactactagtacgagactgaaaacttgtttgtatagctttacttcacctggtggtccaatgtatcccactagagccgttcgtcatgcagcttgggaagcattagatttactttttccggtgggacgttatcctcggcatcttattagtttgttcttcaggttgctttatccgtggtattggccttcctcttgttggaactttgtgatttcttgcattcaggcagttttttactccgtgctggggtttatattttctacgtgggataagattgccaagccaaaatcacaatag

SEQ ID NO: 24702 - DNA, 498 bp, Glycine max
  Peptide Sequence Number=SeqID_141480
atgtgtctgggccgtgttgccgctgtgtccaagcttaaaaaaaaattggacaccacaaaatttgccacatgtccactgcgcgtcagtgttggaaatgtgttggacaccccgaccccgacacctcctttaaccactgtgtctgagcttcacagaaaacatttgtggcaccttgaaccagagcagatgaataccggagaagcacttctggattatcaagatgaacttcaaataactgcaaaaagttatgaagttattgtgaaacacagtaggaagctacatggaaaatgttttactgacaaactatataccacaattacgatccatggaagatatatgcaaaaagggaaaaacctcggaggttgtggaactgttgatgttaggagtgaagaacctagggctactgcagaggtgttcttgaactggaacactatgtgcaatgttctggaaccttgggctgtcaacatagaaagcattatcggttctggaaccaaaagatga

SEQ ID NO: 24703 - DNA, 471 bp, Glycine max
  Peptide Sequence Number=SeqID_141481
atgaccaacaggccagagttatatccagggagggaggggagtgataacagaaaaaaggcaattctattatgcttacaaaacataacttctaatcaggtcattgttgctgacaactacttcactggatcaaaggacaacctcaaaaaatggattggtcatccaagatttgagcttatccgtcatgatgtcactgaacctttgacgattgaggttgatcagatctaccatcttgcatgccccgcatctcctattttctacaaatataatcctgtgaagacaataaagacaaatgtgattggcacactgaacatgcttgggcttgcaaaacgagttggggcaaggattttactcacatcaacatctgaggtatatggggatcctcttgtgcatccccaacctgaaggctattggggcaatgtgaaccctattggtacatgcttttctctttgtctcagtctgtatctttcttaa

SEQ ID NO: 24704 - DNA, 120 bp, Glycine max
  Peptide Sequence Number=SeqID_141482
atggcaagggaggttgcttcggcgacagtacatcagaagaattcgttgccattgcaaggacctctgaagttcaattcctgcaccaatttcgaagaggttaaccaatttgctctcaccacg

SEQ ID NO: 24705 - DNA, 495 bp, Glycine max
  Peptide Sequence Number=SeqID_141483
atgggttctgtcttgatccctactgtaaacaaaccaacggagggtccgtgtcgccttcttaaaaacgtgcgttggggcatttcgctacccctagacgtcgtatctaagaaggggacaaattccccggacccccgcattcctagattgcatctgtgtcatatgcattccatcatgcattcatccatcccacccatgagatatcggagttttgatttgcaccagcttttgtctcactttagtaagcatgggaacaaatcaaaccgacaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccataaaagccattgcatcacttacccaatactacgaccagcctttgaggtgcttcacattcgcagacttccaattagtaccaaccattga

SEQ ID NO: 24706 - DNA, 131 bp, Glycine max
  Peptide Sequence Number=SeqID_141484
gagaccaaccttcttcctctggagggggtggggcctctacagctcaggagactgtgagtgaggagccactagcaccagcaccatcgccagcagcaacagaggaagagaccactccagctcagaccccatag

SEQ ID NO: 24707 - DNA, 429 bp, Glycine max
  Peptide Sequence Number=SeqID_141485
atgccatctactatttgtggggatcgcgcccacaagacacccagtggacccggaggagcccaacagggccctggggtttccggctctggttacgggcctctgtcagtcctacagggtgcccgtccccccaggaagtttgtgccatccccacatagggatcgcgcccacaagacacccagtggacctggaggagcccaacaaggccctggggtttccagctctggttacgtgcctctggatcgtgcccgcaagacacccagtggacccgaagaagtccaacaaggtcttggagttgccagctctgattacgggcctctgtcggttctacggagtgcttgtcgcccccagcaaggcaggcgtagggctaaacaccatagcagcctggggatggccggcagcgggcaacagatgcaccgccaccacctctag

SEQ ID NO: 24708 - DNA, 786 bp, Glycine max
  Peptide Sequence Number=SeqID_141486
atgggtattagaaagaaacttcatcctatgatgacaaatgatggtaaatgtgtaatgtatgcaaaggcatgtttttctataacttctaatgagaagactattttttgtggtgtcttgaagaaagtaaaaatgccagatggttgtgcttcaaatatttcaagatgtgttcaacttaaggacaagaaagttagtagctacaagagtcacgatgcacatttcatgctgcattacttgcttcaagtagctgcgagaagcactatgtctaaccaggtttcccatctagtaattggtctttgttcattatttcgttgtttatgtcagaaagttgttgacttgacagatttgaatatcttacaattagatattagaaacactttgtcaattagaaaccattttctccctagtttctttgatgtgatggttcatttgcctatacatcttgtaaatgaggtaagatccggagggctagttcagtttcagtggatgtattttcttgaaagatatttaggtaacttgaagagttattttcgtaataaaagttgtgtcgaaggttctattgccgaaggatacttggttgaagaatgtttgacattttgctcccgatacttgcataatggggtggaaacaagactaaatagaatgacaaggaattctgatagatgtgttactaacgaagctgaaagtccaatttttttttctagaattggtcatcttattggaggaaagaaaaatggtgaagcaatgtttttggactacaagtcaagtgaacatgagaaagaaaattaa

SEQ ID NO: 24709 - DNA, 264 bp, Glycine max
  Peptide Sequence Number=SeqID_141487
atgtcctggacatcgtatccgacatcgtggatcctgcagctttgtgcattgtacagcaacttccagtattttcgggcaggatgtcctggacattgtatccgacatcttggatcctgcagctttgtgcattgtacagcaacttccagtattttcgggcaggatgtcccggacattgtatctgacatcttggatcctgcagcttcaattcttcatttgacatttcatcttgccttgtgcattgtgcagcccgatcttattctttga

SEQ ID NO: 24710 - DNA, 297 bp, Glycine max
  Peptide Sequence Number=SeqID_141488
atgactttgcaattagttgaccgctccattaccaggccctatggagtgattgaagacgtgttggtcagggtaaagcattttatcttctcagcagactttgtggtcatggatatctctgaagatattgacatgcctataatcttgggaaggccgttcatgttgactgcaagctgcatagttgacatggggaagagaaagctggagttaggttttgaagaccagaaaattgatttcgacttgtttgtggaagacaagtctactccagaacacaatgtttgcttgcaggaacttgcttaa

SEQ ID NO: 24711 - DNA, 1383 bp, Glycine max
  Peptide Sequence Number=SeqID_141489
atggccgatcgccagcgccgcctgccgctgttgccggcgctgcgcagctacctgtcgctaaaatctgccgcgctgcggacggcggcgcgcttcgccgtgatgctgatgttcggcagcgcgctggcgctgttcttcaatattcccaagccctactggattctgatgaccatcatgtttgtcagccagaacggctacagcgccacgcgcgtgcgcattcagcaccgcgcgctcggcaccttcgccggcttgctgatcgccgcggcgtcgctgcgctttgctgttccggagtcgattgccctgctgaccatgctggtcatcacgctcgccagctatctgatcacgcgtaaatattatggctggtcgatgattggctttaccgtaacggcggtgtattcgctgcagctgctgtcgctgaacggcgcgcagtttctgctgccgcgcatgatggatacgctgatgggctgcctgattgccttcgccggcatgatctggctatggccgcaatggcagagcgggctgctgcgcaataacgcgcacgacgcgctggaagcgtatcaggaggcgctgcgcctgctgctcggtccggagcaggcgccggagaagctggcgtatcagcgcgtcaaggttaaccaggcgcacaacgcgctgtttaactcgctcaaccaggcgtccaccgagccgggctttaacttccagtatctgaaagatatgcgcctgtgggtgactcacagccagtttatcgtcgagcacatcaacgccatgaccattctggcgcgcgagcacaccatgctgacgccaaagctggcggagcgctatttgcagtcctgtgaaatcgcgctgcagcgctgtcagcagcggctggcttacgacgggccgggcaacgacagcaatattctggaagcgccggagaatctgaatgaggggccggtgacgattgtcgaacagcatgtgaagcgcattctgcagcacctcaatgtgatgcacaccatttcttcactggcgtggagccagcgcccgcatcacggccgctggctcagcgtgctgaagccaaaagcgcgccatgccttctgcgatatcggttggctcaatcaccagcgacggcacaaaacgaatcacatcgctgccggcggtcagtaccatcaggccttcagcggcggaagcgttgaggatatcgcgcgctttgctggcgtgctgcgcgttgagtacggcacccagcagcaggcctttgccccgaatttcactgaagatgtcgaactgctgattgatcttctgcagcgccgagacaaactgctcacgacgcgcgtcgacaccattcagcacctcgggcgtattgatgatatccagcgcggtttcggcaatcgcacaggccagcgggttgccgcc

SEQ ID NO: 24712 - DNA, 141 bp, Glycine max
  Peptide Sequence Number=SeqID_141490
atggaggttgaggaaccctggcaggggttatggctatcattgcattatcaagtggtgtttgggcattgggcgtgtggtgagcaggcaggccgtgtggctgatttggggatggattttatggatgattgggtgaaagggact

SEQ ID NO: 24713 - DNA, 405 bp, Glycine max
  Peptide Sequence Number=SeqID_141491
atgagcccaaaatctaccctaaggctcatgagaaccttagggccttctcttgaatctctggcccaatcttcttggagtcttctatccaatgcccttggggggtatgattgcatcatgatgcctacctcacacacatcagatatcactctggatagggccaagttgatttatggaattgtgcagaagatggacatgaatgtgggttacttgatttctcatcagatatcacttatcgcccagcatgactcctctaggcttgggtttccagccttgatcactgctttatgtaaagctagaggagtcacttttgattccaggaccctagagagtctcagccccgctattaacattgcatatgtcacgaagaactgttggaatcttgatgatccaatagtgactttttga

SEQ ID NO: 24714 - DNA, 390 bp, Glycine max
  Peptide Sequence Number=SeqID_141492
atgagttccttgaaggggaatctcctcgatagtcagatgaggtccacgaggatcgtcgggagcatgcccaaggagacatcgattcccactccccatgagccacccctgacagccgaagaaagaaggaagctcgatctcatcgaagagagattgagggctgttgaaggctttagcgactatccgtttgtagacatgactgatctttgcttagtaccagacatcatcatccccccgaaatttaaggtactcgatttcgataggtacaaggggacaacttgccctaagaaccatctcaagatgtattgtcacaagatgggagcacattctagggatgagaagttgttgatgcacttcttccaagatagcttggctggggccgcggtcgtctga

SEQ ID NO: 24715 - DNA, 225 bp, Glycine max
  Peptide Sequence Number=SeqID_141493
atgggggttcaaatagcaaccaggcccacttgggccttccagaatattcctccagaaggcggttgcttctggaggaagcaacctagatcgcctggaaaatccaagccgaggcgcttccgtaatttttccgtgggtgatttcgcgaagattttcaaccgttattcaacgttcttcgttcgttcttcgtcgttcttcggtcttcaaccgatttctaaaaaagcctaa

SEQ ID NO: 24716 - DNA, 454 bp, Glycine max
  Peptide Sequence Number=SeqID_141494
atgttagagttgtgcctagtgcccgacgtggtcattcctctgaagttcaaggtgtcggatttcgataagtacaaggggactacttgccccaagaatcacctgaagatgtactgcaggaaaatgggggcatacacaaaagatgaaaaatttttgatgcatttcttccaggaaagtcttactagggcagccgtcacctggcaatatcagtacaattctaatatgactccggatagaatgaaactacaaaacatgtgtaagagggagcatgaatctttcaaagaatacgaccaaatgtggagggatctagtagctcaagtagcgcccccaatgatggagagggagatgataacaatgatagtagacacgttaccggtgttctactatgagaagatggtgggttacatgccttcaagctttgtggatttagtgtttagtagcgagaggatcgaagtgg

SEQ ID NO: 24717 - DNA, 585 bp, Glycine max
  Peptide Sequence Number=SeqID_141495
atgacgccaggaagcaagaagatcactcttttttctgacgaagaggataggatacttgaggcacatgaagatgctcccccttctcagccacaatttgaacatcaacagtttaatatactacagcgaagtgtggagactcgaggcttagtgcgacgtcgacaaactgctgatgcagcaccatacagtttgcctccgatgccagaacgacaacatggaatgtattacacaccgccggcattcacccaagaaccgtcgcagatggcgctgatgtattcatacccacataattttcaaccagggtacagtatgacatgcatatttgggtcctctcctcctttagggggaactccttcatttacccaaaataatgaactatcgaccccaaatgccccacttggtggtccgtggaatgtacctggaaatatacccgacatggatgacttattaggggtcgatttacgtcatgatttctctgccgaggctgacaaagcggatgaaagggtgaatctagaagaagaaatcctgataaggcagctaggaattgggaccggccatgtgggacttcgtcgcgacatcacagacata

SEQ ID NO: 24718 - DNA, 663 bp, Glycine max
  Peptide Sequence Number=SeqID_141496
atgggagatcgcttagaggatatgattcgtgatcttggacaagagtggcaagcacattcccctatgtatgatacattgcaaactgattcaaagaagcctttgtattcggggtgtaataattccttaatgttgttgtcagtagtgttaagtctggttaatgtgaaggccaaatatgggtggagtgacaaaagctttagttcactgcttcaagtagtgcacaatatgcttcaagaggaaaacacgttgccaaaaagttactatcaggccaagaagatattatgttcgatgggtatggagtatcagaagattcatgcttgccctaatgattgcatactgtacaaacatgagtttgaagaaatgcacaaatgccctaggtgtgggatatcatggtacaaagtgaaggatgatgacgagtgtagtagtgacgaaaactcaaaagaagggccctccccaacaaaaggtgttgtggatctttcccatcattccaaggttttaagcgtctgtttgctaatggagacgacgcaaaagattttacacgacatgcaaatgggagaaactacgatggaatgttctgtcatccggctgattccttgcagtggaagaagattgatcatttgtatccagattttggcaaagagacaagaaatcttagtcttggactag

SEQ ID NO: 24719 - DNA, 300 bp, Glycine max
  Peptide Sequence Number=SeqID_141497
atgctgaccctaggtaaaatcaaggatgctacaggtgtgtctggtgttgagatacacgaatttcgtcaaaggatgatcaatgataaagatggttctcagtcccaatctagccagagtaatgtggtggaaaaatttctgctgaatgctcaagtggtcagtataggtgaaatcaacaatctcagacaggattgttactgcttaactgttggaacagttgacgaaatcattattgatgctccatggagttatgacagtcgtcctaactgtacaacgacatttgatccatcaaaaggtggctga

SEQ ID NO: 24720 - DNA, 933 bp, Glycine max
  Peptide Sequence Number=SeqID_141498
atgccaacaggctgctacttgtacttgggagctgctgtcagtgattatcggcaatctttgcagtttcagaatttaaatgcagagaaacaaaatataaaattggaggtcattagaggtggcagaacaatacaaatatccatatttgatattgttgttggtgatttagtgccccttaaaataggagatcaggttcctgctgatggagttgtaatcactggtcactcgcttgccattgatgaatcgagtatgactggtgaaagcaagattattcacaaggatcaaaaagcaccttttttgatgtctggttgcaaagtagcagatggagttggtgctatgctggtaactggtgttggtataaatactgagtggggattgttgatggcaagtatctcagaggatactggagaagagactccattacaggttcgtttgaatggagtagcaacttttattggcatagttgggcttactgtagctgtttgtgtacttgcagtcctcttgggaagatatttctctggccatacgaaagatttagatggaagagtacaatttgttgctggagagactagtattagcgaagcagtagatggggtcatcaaaatttttaccattgcaagccatgcaggtaacaattgtggtggttgcagtgcccgaaggtctacctttagcagttaccttaacgtgcgaaggctgtcagcatgcgaaactatgggatctgctacaacaatttgcagtgataagactggaactttgaccttaaatcagatgactgtagttgaggcatgtgttggaaggaagaaactaaacccaccagatgacttgacaaaattgcatccggaagttttatctttgataaatgagggcattgcacaaaatacaactggcaatgtttttgtgcctaaggtctgccttttacttgacaacaatgtctaa

SEQ ID NO: 24721 - DNA, 1629 bp, Glycine max
  Peptide Sequence Number=SeqID_141499
atgggagttatgactacgactagtggtgtagatggtggagaggtggaggtttcagggtctcctacggagaaagcaattctttcttgggcagtgaagttggggatgaattttgatcttattagatcaaattcaacaattctacacgtcttccccttcaattctgagaaaaagcgaggaggccttgctctgaaactgccggactctgcagtacatatacattggaaaggagctgcggagatagttttaggaacatgtactcaatatcttgattctgatggtcacttgaaatctattgaagaagagaaggtattcttcaagaactctatcgaagacatggctgctcagagcttgcgttgtgttgccattgcatacagatcgtatgatttagacaaaattccatcaaatgaggaggaattagaccagtggtccttacctgaacacgagcttgtcttgcttgctattgttggaataaaggatccttgtcgccctggagtcaaggatgctgtgaaaatatgcaccgaagccggtgttaaggtacggatggttacgggtgacaatcttcaaacagcaaaagcaatagcttttgagtgtggaatactgatgtcaaatgatgatgctgttgagccaaatataattgaaggaaagacattccgtgaactatctgaaaaggaaagggaacaagttgcaaaaaagataacagttatggggaggtcttctcctactgacaagctgttgctcgtgcaagcactacgtacaggtggtgaagttgttgctgtcacaggagatggcaccaatgatgctcctgcacttcatgaggcagatattggtctttctatgggcatccaaggaacagaagttgcaaaagaaagttcagatattataatcttggatgataactttgcatcagtagtaaaggttgttcgctggggccgttctgtatatgcaaatattcagaaatttattcagttccagctcactgttaatgtagctgctcttgtaataaatgttgtggccgcaatatcttctggtgatgttcctttaaatgctgtacagcttttgtgggtcaacgttatcatggacacacttggggctcttgcactggctacggaaccgccaacagacaaccttatgcacagatcaccagttggccgaagggaacctcttataacaaatgtcatgtggaggaacttgggcgtacaggctctctatcaagtcactgtccttctcgttcttaacttcggtggtgaaagtattctacgtaatgatcaggattctgtagcccataccatacaagtgaagaatactttaattttcaatgcattcgtcttttgccaaatattcaacgagttcaatgctcgaaaaccagaagagatgaatgtcttccggggagtgactaagaacggtctcttcatgggaattgttggaatgaccttcgtgcttcagataatcataatagagttccttggaaaattcacaacgacagtgaagcttgattggaagctgtggcttgcttctctttgtattgggcttttaagctggcctcttgcgataattggaaaattcattccagttcccaaaacaccactgtcccgatatttcaggagattcagcaagtccaagtcgcaatag

SEQ ID NO: 24722 - DNA, 228 bp, Glycine max
  Peptide Sequence Number=SeqID_141500
atgccactgccattgaacttcaagaagcaaaggactccattgatgaagaagattcaaggcctacaagctccacatggagcttcgtcatggttggtctcaacatggatggaccaatcactagagttctggttaagagctgaagaggagcaagagtggtatggcttccacaagtggagatgctactccaccatctccaaaaactgcaaggctcatggcagagatgattaa

SEQ ID NO: 24723 - DNA, 453 bp, Glycine max
  Peptide Sequence Number=SeqID_141501
atgggtgaagtagaggagatacaagagaagatgaagcccgacatggaggccattaaagagaaaatggccacaatgatggaggccgtgatgagcgtgaagaagataatggaagccaatgcggttgcaattgccgctaccagcattgttgctaaggtgaacccgacgtccccatccgggctcaagcaaatgaatcatccaacctcaaatatggtaggcaaagatttaggaaagacccatgaaattccccatcacaatctagccgacttcgagccttggctcggatatgccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 24724 - DNA, 150 bp, Glycine max
  Peptide Sequence Number=SeqID_141502
atgaagcagataccgtttctgggtgttagtgattccgaggaaactgtttctgaagcattggagagtggaaaacaaggctgttttgtggatcattcaatggctctcaacaggataaactcttggaatatcaagcaagtcaacttgatttga

SEQ ID NO: 24725 - DNA, 285 bp, Glycine max
  Peptide Sequence Number=SeqID_141503
atgggggcatactcaaaagatgaggaattgctgatacattgcttccaagaaagtcttactggggtagctgttacctgggcaaatgaagagggtgagaatgagggagaagcccatgttgtgactgccattcctatacagccaagtttcccaccaacccaacaatgtcattactcagccaataaacaaaccttctccttacccaccgcccagttatcgacaaagaccatccctaaatcaaccacaaagtatgtctaccgcacttccaatgacgaacatcacctttag

SEQ ID NO: 24726 - DNA, 390 bp, Glycine max
  Peptide Sequence Number=SeqID_141504
atggctcccgaagaactcgagcagttgactcaacaaatcagggaccaactggaggagtcgatcatagaaaaacctgaggttggtcccttagttgctcgtgtcagcacaaaggggagttgtgttgatccctcaccgaccgatccagacacggggatctacaacagttcacaacatccctttgttgcatggccatgggaagttggtgttgaggaggttaaagatacagaggctcccgttcctgtacccactgacgaggcagttgtgtctgcagcaaaacctccagataggctggatcatgaggtcgatgatcccctatatttgatgatattgaccatcccacaactttttttgaagcctctccaggttttgtgggatgctaccgtgttcggg

SEQ ID NO: 24727 - DNA, 255 bp, Glycine max
  Peptide Sequence Number=SeqID_141505
atggagacagtaggttttcatgttctgaagctgcgtaattcgtgtttggcctctggtaatcgattaccaaggctgtgtaatcgattaccagagatgaaaagccttgagatcgtgatggcggcgcaactaatccatgatcgagtggagatggagtgcctagagggagcttgggagaccctcaaaggcaatgcgaggtgccgattccggggcacgattcgattcacgactacttcattggtgcatccagaggaaccc

SEQ ID NO: 24728 - DNA, 220 bp, Glycine max
  Peptide Sequence Number=SeqID_141506
atggcggagcgtggccatggaatgtattacacgccacatacatttgctcagtatccgacacagatgtatcagtatccttttcggggtcatcacactgatacttctgcaagtgagcattcgttcagtggtgttgcggacacacatcctcatttttcatggccgactatgaccccttcacagcaatatcatggcccaattccaacacctaatgccccattag

SEQ ID NO: 24729 - DNA, 318 bp, Glycine max
  Peptide Sequence Number=SeqID_141507
atgagcactccaaagtgtagaaatccagaggttgaagctcaagagaaaagccctataaaagagcatgagtcaagagaaaaagatgaggaacaagcacaacaacaatgggagaagtactcaatagtagaaaaccaacaagaaaatattctccaaatcaataaccttcctcatcaactgattttcaagaaaggaaggcaaggagagcatgaggaaaccttaagtgccattctttctttaatcactaacacctttcttgaaatgatttggaatgtacttccagactatatgaagttcatggattttctagctaaaaggtga

SEQ ID NO: 24730 - DNA, 267 bp, Glycine max
  Peptide Sequence Number=SeqID_141508
atggggctccgaataaaagttgagaatggagaattggtgaacagcgctaggcgatcaattcgcggggctccagactcgaagcgccagacaatcaattcgcagggctccagactcgaaggtggaggacacatgaccagcgctaggcaattaattcatggggctccgaataaaagtggagaatggagaattggcgaacagcgcgaggcaatcaattctccgggctccagactcgaaggtggaggacacatgaacagcgctaggcaataa

SEQ ID NO: 24731 - DNA, 128 bp, Glycine max
  Peptide Sequence Number=SeqID_141509
atggcattcttgggagaaacaagcagtcagaccattgctaactcgagattagccttcatttttccaaatggaccaatcactcataaccaaactggtgtttattttcaaagtctcactccaacaccaat

SEQ ID NO: 24732 - DNA, 267 bp, Glycine max
  Peptide Sequence Number=SeqID_141510
atgcctttgaccgagttttcggatacattaatagaagaatggaagatgtatgagcagtgcactcaaacactcagatatcctactcaaccaacttacctaaacccccttggatttggtgatcccatcaaaggaggtaatcttgtcatgcacgacatggaggccattgcacacgatggcgatgagggtgaaagggaaatcacaaatttgatgcaggaaggaaaggaagttgatgaagagggattagatgttgaaagttgtggtctttga

SEQ ID NO: 24733 - DNA, 240 bp, Glycine max
  Peptide Sequence Number=SeqID_141511
atgagtattgtgccaggagggttggcgcaacaccctcatgtgcgtacttgcgccactatgcccgtgcaacacctgtgcctgcctatgctgaccaaaagtggttgcgccactgcagctgcagctgtagcaacccattacacaaagcttttggcacaacaactcaatgccacaagtcagctccccgttgaatcgcgtccctgtctttggcgcaatgcaaataaaaacataccccctcagtaa

SEQ ID NO: 24734 - DNA, 582 bp, Glycine max
  Peptide Sequence Number=SeqID_141512
atggaagaagcatattaccttattagggaaaatatgaagcaaaaacaaatggtctacttggacagagttcacgtcatagaatacatagaacacttgtcaaattcgctttacatacagtatggtaattgtccaaatttttacgaccgatttgtcaggagccgaagacgaagcaagcccagaaaggttgaacaaaggagacaacgcatggcagttaatggcagccacagtggtgggtctggtgattctctatggaagcctagagtgaaaaagacatgggccattaactatcgccttcgcggccgttcttctttgcagggtggcgtggggattcagcatgtcattcggcgagaaaatggtgttcttctggggaaagcttttctggggttctttcccaccgcgacgatggtgttttttcagggcttgtttgcggggattactttgatcttgatagctggggcgttacttgggaggatgaactttcgtgcttgcagatgctgtttgtgccgctttgggttactttttcctacactgtcactgccttttgtaataagaattttcatgtataaaccagaatataaataa

SEQ ID NO: 24735 - DNA, 702 bp, Glycine max
  Peptide Sequence Number=SeqID_141513
atgtcagacggaacattgcaggtactggacggaacgcacctgagaggcgtcgatctgtccttaggcgacgacggtccattcaccggagctaaaatactcgacattgcccattcccgcgcctcttcttccctcttcggtctctcattacccgattccctcaaagtctctgctctcacgcgcctccgcacacccgacaccgatgctttccgctccgcctattactccgccgacaaggcctccgagattcttcgagactacatctccgccatcgccgatgaactcaaaggtttattatcttcttcttctgatcatcacgcaaagcactataatcctcttgttgtatcaatcttggatggaagtactctccggttgttatcagaggatgaggatgacttcgccatgttagcagaaaatctattcactgacttagatgccgaagacaaggggaaaatcagcaagagtgaaattcggaatgctcttgtccagatgggagttgagatgggcgttcctcctttctcagaatttcctcagctaaatgacttgttgaaaaaacatggggtggatggagaagaaaagttgggccaggcacagtttgcacagcttctgcagtctgtactgcaagatctagaagaggaactttctaaaaagaatgttgtttccatccagaatattcgaatcattaatggctctaagctaagacgg

SEQ ID NO: 24736 - DNA, 717 bp, Glycine max
  Peptide Sequence Number=SeqID_141514
atggagcagtatgaaatacttgagcaaattggaaaaggtgcttttggttctgctcttcttgtgaagcataagcatgagaagaaaaaatatgtgctgaagaagatccgccttgcccgccaaacagagcgctctcgtaggtctgcacacctggagatggagctcctctccaaattaagaaatccatttattgtggagtataaagattcatgggtagaaaagggttgctatgtgtgcattattataggttattgtaaaggtggagacatggcggaagctataaagaaagctagtggtgttatgtttcctgaggagaaactatgtaaatggcttgttcaacttcttatggcacttgattacttgcatgtgaaccatattcttcatcgcgatgtcaaggttgtgggaactcctagctacatgtgccctgagcttcttgctgatataccttatggctctaaatcggatatttggtccttgggatgttgtatatacgaaatgacctcacttaagcctgcattcaaagcatttgatatacaagccctgattaacaagatcaataagtccatagtggccccattgccaacaaaatattctgggtcatttcgaggtcttgttaaaagcatgctgcggaaaaatccagagcttagacctagtcatctagtaccgtgtatcattttggagatgggttgggttgatgatggattctacattaaacattaa

SEQ ID NO: 24737 - DNA, 1125 bp, Glycine max
  Peptide Sequence Number=SeqID_141515
atggggaaggccagcaaatggatcagaaacttcctactagggaaaaaagaagataaaataaagaagatcgatgcattctgcagcgaggataagagtggcaacacagggagtctgattgtgagtcccaaagtgaagcgcagatggagcttcggaaaactaacaggagcagggcataaattttccagatcatttgactcagctgactctgcaaaacttcaaatacaagccttgttggaaaccaagactccaaggcgtcttccaaaaccattagcaaagccttctaaagataaaaacaaagccgctacaaagattcaggctagctttcgctcttatttggcaaggagagcattgcatgctttaaggggattagtcaagttacaggcactagtgaggggtcaccttgtaaggaaacaaacaactgctacactgcgtggaatgcatgcgttgatggccatacaagttagagcccgaattcacagagttcagatggcagaggaagcaaacctcctccgacaacaatcgcctccgcaacatagacaagttccatactccactgatctcataacagaagaaaataaagattcaaaccatatgagtgtggaagaaatgttggaggttttgaaaagcagaagtggcccactagatggttcatatgttaagggcagagagcgtgattccatgacatactattccaagcatgtgccggttgtttctaaacgagaaaaccaatacaagaaaactctaatcatagaaccaaacagcctagaaaactaccgatccatgtctgaatttaacccaacgacaattgccttgtcaacttctcagcgccattcagtgcctcacggccaatcactgtcaccaaattacatgaacaagacagaatcttcaagggctaaagcaaggtcgcagagtgaaccaagacaacgaccaatacggggaacaaggcacaaaggcaagtctgtggaatcaccattgaatggtccaagacaaaatctgttctcaaactcgttacgcttcgatcatggaagcatggaccattgggttatcaattttcatgggtcaacgaacgacagcaggcgcaattcctttggcagcagctcggttactactgattcctattattga

SEQ ID NO: 24738 - DNA, 927 bp, Glycine max
  Peptide Sequence Number=SeqID_141516
atggagagcgcactgcccagtcatggagacaaatcactacaagaattcttcaaagttttcctgctcaggacaggttctaccaagttgcaaataccaacatctttcaccaagttcttcaatggagtcttaccattgaaggtcactcttgtagatcacgatagaaaatcttgggatgtttacttggagaaaaccgagggttgcttggtttttaaagatgggtggcagcaatttgccaaggagaaagttttagaagatggggatttcttggtttttcagtatgatggcaggtctacgtttaatgtgaagatattttcgaaaactgggtgcaggaaagtagctgcccctgcaagtagtgcaaaaattgaacccactgtgattttggatgaagattctgatcagcgttgtagtaaagaaatccagtgcggtcgtaaacggaaacagtcaccgcctagtctcaaaacaaatgaggaatcagtgttagaaggtccatgtccatccgaaggagctcggttcaaatcaaaaagagtttatgaagaaaaggatgaccacaatgagaagaaacccgatccaacaaagtgtgttccattacagaattctcatcattttcagatatattttaatgctccctggagactgaaaaaagtggaaattcctagaagtgtgctgaggaaaacgaatatcaagctaatgtcgaagataagtctgagagatgagaatggcaaattatggcccgcgtcgatcatatccataaagaaagaatatcgtcattttttgggaggtggatggaatgatttccggcggagttacaatattcaagaaggggaccgatgtgattttgagtttgttgttgataaagcaaacgcagcccaagaactgctagttcgcgtacgttcaaaatgttcatttggttgggtggactgcaaataa

SEQ ID NO: 24739 - DNA, 654 bp, Glycine max
  Peptide Sequence Number=SeqID_141517
atggcaaacaacaatattcaaccatgccatgacgaccttgatcctagagaagccaacaacccttcaaagatgttaaacttggacgtggaaggacagagagagggttttgactatgcaaagagggcacagtggcttagagctgctgttttgggtgccaatgatggtttgctctcaacagcatccctcatgatgggagttggagctgtgaggaaagatgttaagagtatgatgctgactggggttgcagggctggtggctggagcatgcagcatggccattggagagtttgtttctgtatactcacagtatgatattgagttggctcagatgaaaagagagggaaacatggatgagaagaaggataagttgccgaacccctattatgctgcttttgcctctgcccttgcgtttgctattggggcaggggtgccactacttggtgctgcctttgtcaatagctataaggcaaggttaggggtggtggcggctgttgtcacccttgctttgatcgtctttggagatttgggggcctttttagggaaagcacccagggttaagtccactctcagggttttgattggggggtggttggccatggctattacttttggtttaacaaagcttgtagatcatcttggacttggagtagcttga

SEQ ID NO: 24740 - DNA, 309 bp, Glycine max
  Peptide Sequence Number=SeqID_141518
atgtcagcggcagttgctcagaaagtacacatatgtagtatagcattgacgaactctggagggcaagaattttgcgaagcggagtacatactacataggaaggaaaaagcaaagcaaagtgtacctgagacggggaaagaagaagttgaggagatagaagggactcaaaagggagagggaagagacgaatctgagaatgggaggttcgacattggcagagaaagtgaaaaacgacaccgttattggaacagcagcaacagaagaagaagctcttgcgccattgtggttggtttggaagaaagaaaatga

SEQ ID NO: 24741 - DNA, 345 bp, Glycine max
  Peptide Sequence Number=SeqID_141519
atgaaacaaccttcagatactaaaaggaaatcacaaattagatttaggtttctggcagtcagagatattcagtctaattcccggctgcaaattggtagcattgacctctatgcgaaatctatagatttctgggaccgattatgttctgcgtgtactggggatttacccgtatcagaaaatttcaggaacactaattcagtaaattgtgctaaaagtgtatacaagttcaagaacttaacgacttgtacaagtaaaaggaatataaggcaaaagcctctcacccgcatctctctgcagatgctagctatcatctctgtaaccctgttaactaggcaaacgcattag

SEQ ID NO: 24742 - DNA, 2274 bp, Glycine max
  Peptide Sequence Number=SeqID_141520
atggtgggagttgagctgagtagagagaaagaagatggtggcgcgcaggtctttcaattccagctttattccctcacttccgttccacctcatcaacaaaagattttcggagccgaacaagatactcctgtggtcaatgactctgatctcgtcgccatttctgacaaactacgactcgtctcggtcaacgactccgaacccgaaccaagcgctgccgatttgttgaaatccgatgaggaattggcccgactcttgcaggcagaggaggaagcgcttatgttgcagcagtatgtggcgagcgaaaatcctcgagaatttgatagtagagtacggccccacgttagtcaagtccgcatgtatgaggatgcaacgcggcaggaggctgctcggaagtccgttcctatggaagagctcgaggagaaagctttggtctctttggccaaggaggggaacttcaagccatcaaaaatagaacaagatcatgctttcctgctgcagctgcttttctggttcaaacgatccttcagatgggtgaattcaccatcttgtcatgattgtggcaacgaaactgtaggccagggcatggctcctccacttccttccgagactctttatggggcttctagggttgaactctatcgctgtactgtttgctcccaactaactcgcttccctcggtacaatgatccaatgaagcttgtggaaacaagagagggccgctgcggggaatgggccaattgctttacgttctattgtcgagcttttggctatgagtcacgtctgggaaaacgggcactgagtattgatgtccttacagttttgccagtgaattttcaacctaggatcttggactttacagatcatgtttggacagagtgcttctctcaattcttgggaaggtgggggaaaaaattaaattatgtaatagccatagcaaaagatggagtttatgatgtcaccaaacgatacacaaggaagtggcatgaggtcctatctcgacgtactatcattacagagccttctttgtcatctttactctctaatataacaaaagaaagtcgaagaggttttgcatctcaactactttcaattattgaagtccgtgatatggaggaaaacaaagaacttgagaggagtttacatgctgaagatgacgagtcactctcattacctggaagaagaagtgggaatgaggaatggcgcaaatctagattagaaatgggttctgataagctaagttcctctgcttgcccagttcgtttgtgcgtagatgagcacgtgacaaggatttataatgcattccgtcctatcctttatcaatttgttggggaagaattaacaaagtcggaagctgttgaagtactcaggattactaaaggaattcttttggatcttagcaagtccccctataaaacaagaaggacctccattgactcagttctagataacccaaaatttcagaaactattgccatcttttgatgacttacttggtgctctttcactggagaaaaaggtgaatacagatgggagagttgaattttgtttggttggtgaccctgtagtaacttctttagcattgcctgttgcgttagatgctctggatgacatgatttacattcttaacaagtgtgaaaactatgggaaagatatgtttctgttgccatttttaaaattaaatagaatacattctggttcagccattgcaagttcagaggagttgccttttgggattataacatcagcatttgatggcacccgaatttctaaatgggaagaaccaaacggagcaagaggttgttgggtcgtgtatagaacatttggtaacgagatgtttgagcttgtagcatatgagttgatgtcagccaatgatgcaccagaaagggatccaatggactggtatggactttgggatttttttgtcagcacggagattgaggctgtaggagatgtcggattcgggttggtccctgttggtgtggagttcgaaggtgaggggttcggcgtcggcggtggtggggaggtggagattcttcatcttcttgaagggttgccattggttttggattgggggattagggttttgggggtgaaggcgggagcgggtttgggcttagagtgtggggtttcgttgaaaggacggagaaggagagcttcatggtttcggttcttctttcacgaatcaagaagaagaagaaacacaaaagaaattaccttaactactgcaacgccgacgacaacgataacgactctcactctcttttgcagatcttga

SEQ ID NO: 24743 - DNA, 162 bp, Glycine max
  Peptide Sequence Number=SeqID_141521
atgcagtcaagtcttatcaattctaccttggaggataagaatctgtctgagattcgaaactttaagttactgttgaaacagttggtcactatggaggttatccagtgcacaactctttgggattcatacaaggatgagtttgagaatgagagtgttacttag

SEQ ID NO: 24744 - DNA, 342 bp, Glycine max
  Peptide Sequence Number=SeqID_141522
atgggtaaagctaaaaaaggacccaaatttgcggttatgaagaaggctgtcacttccaaagcaatcaaaaactataaagaaaaggttttgaacccagaaaagaaaaaccttctaaaggaaaagttacccagaaacattacttgtgtccctcttataaataaacaaatgaactattatatctggttctacccgctcagctttccatggagtagtttgttcaagttggatttggagaaaggaatgatggactgcttatatgcaaaatgcaccccttgtatcacagactgtgtgatggcagaacttgagaagttaggccaaaaatatcgtgtagctctaaggtag

SEQ ID NO: 24745 - DNA, 258 bp, Glycine max
  Peptide Sequence Number=SeqID_141523
attcctggtgtgccaattatgtacatcaccaaacgcaagtactcaattgagcgattgcctgaagcaacaattggtggaggctcttcgctatgcgaaggtatgggggagggatgttgtacgcagccttacccttgcatatgcaaagaggctgtttccggattcgaacccatgaccaacaagtcaccaaggcacaactttaccgctgcaccagggcttgccctcgcaccagggctcgccctcgattggactaaccattga

SEQ ID NO: 24746 - DNA, 303 bp, Glycine max
  Peptide Sequence Number=SeqID_141524
atgaaagcagtgcgtgactttttggcatacagtagatgcattgagcttgtgttcctacttgatgaagttggcaatgaactcgatctggtccttcttactggaaagcccattgaggagaacgcagggtggcggcctcaacgggcttctcctctagcaatggtttacgatgccagccctcaagactatagtgtgaaagtggagacaaaattccggagaattgtgacttacgttggagatggtcctgctcgtcgtacaatggcacttcagtttgactttcaggtctcagatggagaaggactatga

SEQ ID NO: 24747 - DNA, 693 bp, Glycine max
  Peptide Sequence Number=SeqID_141525
atgaaagattatgtagtaagggcccttgttaatgctgttgatcatctaggaactgtggcttacaagttaagcgacattcttgagaagcaaacatttgatgtctcgaccatggatttgaaggtctctactttgaatcagagacttcttacatggcatatgtacactgataaagaaggtcttcggcaacagcagttgttggctttcattcccagacatcataagcactacattttgccaagtacccctatttcaaaaactctttcatggcatttagcatcagaaactaagtctaccttaaaaaaacagacttcacgcacttcaaaaaacaccaaggactcaaaattttataagaagatctctggagttttccaccttttagatagtgaagggagtacgcggatgaaaacctcagcagcacaacctcacttgacaaatggagttcctacttctggtgctgccacccaaactatgggtgccacaggcagggatcatattgatccagtaaatctttcgatatcacaaattcacaaccaggatgcactgaagcattccaaaccattgacaacatatggttcctttgatgatcgaaatggacgtgaggctgtccaagttcacactcgcagtaaaagtgtgctttctagtttctttgtcaagcaaactgcagctaagttgaaggccggttctgtcttatga

SEQ ID NO: 24748 - DNA, 297 bp, Glycine max
  Peptide Sequence Number=SeqID_141526
atggatgccaagcacctcacaaggaccaaagaaaggtcgcatgtcatcaagcaaaggtccccggacgaaattagggggcaggatcaccttgggctaccttctgaggtagagacaaaacgtgagcggcagaaaccaatcaaggtagggtacttaaggacggatgcaagtagggatggggtcacgaccgaccgatcgttgccccttctctgcgcgagacaagcagaggatgtcgctgcgaggcagccccgtatcctttgtattttgcagctttcttttactatttgtaagaataagtaa

SEQ ID NO: 24749 - DNA, 327 bp, Glycine max
  Peptide Sequence Number=SeqID_141527
atgaatgccgtgccttctgtcacttttgtgctagccgtaattctaagagcgtgtgaatgtaaaagaggtgcggagcctagcaaaggtgattgggacgttggtaactttttcaggtgctttgttaatgacatttacaaaggtcctcaaattaagctatttttctctcctgacacaacccaccaccaagatggaagccactctcctgatgaggctctcagggactgtctttctcctcctcgcgtggtggcaattgtggccactcgtcattctgggcttgttgcatgggccttaggttgggacttcaggctccatggccctctctacacg

SEQ ID NO: 24750 - DNA, 732 bp, Glycine max
  Peptide Sequence Number=SeqID_141528
atgaataatattaggaatggatacagagaagaaaaatcattctgctatttccaccccaaacaggtacttgttggggtgtgtcccctgtgcttgaatgagaggctcctcatactgtttgcaaaacaaggtcgccaccacaaccgttcttcttcttcatccatatcttcacacaggcttcaaagtaattccagacacagaaaaccaccctcttcttctattcacaagatctttgcttttggctctctcttcactcgcccagaatcccaccacaactatgactatgatgatgtctctcccactccagaagatgcaaacgccaagagcattatgacactgcaaaaattattttgcaagattatggtctatggatttgttatggaattaagctacgataggagtgtgacaatgatattctggaatgagtttaactttgcagagtcattcatctcaatcaagtttgaagagaatggggtggcatcgtgggaaaagagcacagtgtcaaagaaggtgtcgtcgtggaaccatcaaaacaaggagaacaagagagtgatagagcatgggaagtcacgtgacacgtttaggtggcgaaagaggatagggcacatgctccagctcattcggtggaagaagagcggtggtgtgtgccacgtgggcaccaaggtggagggggtgaaggtcagaaagggttggatgaggactctgacaaagaggaaaacaaccaccttggaataa

SEQ ID NO: 24751 - DNA, 388 bp, Glycine max
  Peptide Sequence Number=SeqID_141529
acgagcacgaggcccacggccgagaacagcaggacgctgcgggcgtacgcgcgccaagtctgctccgaccgggggtcgaccccgatcacgcggtacagcccgcgctccacgcgcaagtccttggcggacgtgtagacgtgggcgatgtagtcgccgagggggcggtacagcaggacgagcacgaccacgacggccgcgacctgcaggaccccgaacaggatcgtggcgtccatcagaatttctccggggcgaccagggctccgacgaggtagacgacggcggcgacggcgagaacggccgcgatgatctcgaacacgatcatgcgcggtccaccgccttggcgacgaggaacacgagagcgaacagcgcgaaagtcagcgcgaggtag

SEQ ID NO: 24752 - DNA, 356 bp, Glycine max
  Peptide Sequence Number=SeqID_141530
atggtcattgaccagtcccttttccatgacttaaccaaattacccagtgacggtgtaccatttgaaggtacactgaatgacgactggaaatttgatttctctgcccatgatgcccgccagttggtttgcaccaacaatgcggatatgaccggacgtcttcttgccgggtcattggcttttgaaagccgcatccttcactatttaattgtgcgtattttgcttccacggtcttccaaccttgcccagggtgttccacccgctgatgatgaaggcaaccaaccagttgaagataattcctctcttcttcgaaagcttttggaaaagttcgatggtcttcaaacttttgttggtgacaa

SEQ ID NO: 24753 - DNA, 486 bp, Glycine max
  Peptide Sequence Number=SeqID_141531
atggcctctaggaaatgcaagagtatcggttcaagacccacaactgaatatgatacaaggagatttcactccttagatgcatggaaccagtacacggataatgtattggggagaaacatcttgccagagaggaaggtggagctctaccacactgagtttgatgattttaagactgaattggagaggcgtaatctccataaatgcctcaccaatttggttgatgggagcatagatgtggctttggtgaaagagttctatgcaaacctatacaactctaagggtcattcaccaaagcaagccagggtcagaggccatctagtgaagatcgacgctgacagcctcaacacattcctagagacactgtggctgccttcagatcctagggagattgaggctgccctatgcataccaggccaagggttcatcttgaatgctgagggccatcctaggaggatcatgaggaaggacttgacgaatttagcctag

SEQ ID NO: 24754 - DNA, 330 bp, Glycine max
  Peptide Sequence Number=SeqID_141532
gtggatacacccggtggatcgttcggtcctgccgaccaacccctttttcggagccccatgaattgcattttcgttcatgtgtcctccaccttcgagtttggagctatgcgtagtgattgcttagtgcaactctccagtctcaatctgttttggagccccatgaattgcgttttcgttcatacgtcctccaccctcgagtttggagccatgcgtagtgattgcttagtgcaattctccattctcaatcttttttcggagccccatgaattgcgttttcgttcatgtgtcctccaccccacgagtttggagctatgcgtagtgattgcttag

SEQ ID NO: 24755 - DNA, 372 bp, Glycine max
  Peptide Sequence Number=SeqID_141533
atgtggctccgcatgccaccggactcttgggtcacgcatttcgtttctaaacgaccatttagaggaaacactgggtccaacaaaaataggagaaaatcactcaaagtgtatcaatctcacacagtgcgtggcgagaaactcgctagcgcattggattttgtcggcaatcaaagcgagaggaccactttaggtcgtggtttcctttttcttgtttacttggtgacaattctgtattgttcatatattgtctggtccaaaaaccggtcaaaaagaatattccaagttcgggagttgtatttacgtatgaggaaggtattagcacctctcacgtttgtctcaaaggacaacagccttatttttagaattgtgtga

SEQ ID NO: 24756 - DNA, 504 bp, Glycine max
  Peptide Sequence Number=SeqID_141534
atgagaaaaagaaagaagatgagaatattacccaagtggattttattgattatcgaagtaattttgaaagaagtgaaaaataaaattaagggtctcctttctctcgatctcgttataggcgatccacctcaagaggagagaagtctaacaatcgagatagaggaagaattcaagaatattacagaagggccatcaaaacgaagaaagcaatttagggttggagatgatggtaaaatattatttgatgaagaagagcacaaaatgatcctagattttaaaagaggtgaggactatattgaggttctttgtggcactacaaacaaaaaatatggagattatgttgggaggctaaaaattaataacgaaggtcaatatttcatcacttgtgagtgttgccctgagtgtcccttggggatgagttcctatgttgaacgagatgcgggaaggagcacaggttccatctcaagagcagaccagacattaagaactaccacgaagctttaa

SEQ ID NO: 24757 - DNA, 737 bp, Glycine max
  Peptide Sequence Number=SeqID_141535
gtgtcacgctgctgtcggtgaagaccggcggctgcccggaagactgcgcgtactgcccgcaggcgcagcgctacagcaccggggtgaacgcgcagaagctgatggagaccgacgcggtgctggccaaggcacgccaggccaaggccgccggtgcatcgcgcttctgcatgggtgccgcatggcgttcgccgaaggatcgagacattccgaaggtcgcggcgatgatcgccggggtgaaggcactgggtctggagacctgcgccacgctgggcatgctcagcggcgagcaggcgcgtgcgctgaaggacgccggcctggactactacaaccacaacctcgacaccgcgccggactactacgattcgatcatccacacgcgccagtaccaggaccgcctggatacgctggaacacgtgcgcgatgccggcctgaagacctgctgcggcggcatcgtcggcatgggcgagacgcgcgcgcagcgcgtcggcctgctgctggcgctggccacgctgccggcgcatccggattcggtgccgatcaacaagctggtgcaggtggcgggtacgccgctgcatggcagcgccgaactggacccattcgagttcgtgcgcatgatcgcggtggcccgcatcgccatgccgcgctcgatggtgcggctgtcggccgggcgcgaggcgatgagtgacgaactgcaggcgctgtgtttcctggccggcgccaactccatcttttgttag

SEQ ID NO: 24758 - DNA, 432 bp, Glycine max
  Peptide Sequence Number=SeqID_141536
atgagggctggaattgggggaggagcattgaagaagcaaaaactgatttgcttaagtggggaagaagctgaagaaggagtgcagcatgagggggaagaagttgaagaaggagccgagcaggagagggtagaagaaagcacagaagcaggagtaattaacacacaattaagtgctcaggggaggaatcgaagagaaccactttggatgaaagattatgtaacaggagagggattgtcagaagaagaaaatgagcacaatctgattctgtttacttcaaattcagatccaaaaacttgtgaagaagctgttaaaaatcccaaatggagagctgcaatggatttggaaatagaagcaattgaaagaaataagacttgggagctaacagaccttcttaaggaagccaaaaaaattggtgtgaagtgggttttttaa

SEQ ID NO: 24759 - DNA, 1602 bp, Glycine max
  Peptide Sequence Number=SeqID_141537
atgacttctgaaagcactttcgttcaacctgcaattcctaagtttgatggtcattatgatcattgggccatgcttatggaaaatttccttcgttcaaaggaatattggagtcttgtggaggatggaatccctgttgcagtagagggagaagagtttactgaagcccaaagaaagtcaattgccgagcagcaactaaaagacttgaaaaagtatcaaggttcaacaacaagggtcaaaagagcacaactccaagcccttcgaaaaaagtttgaggtcctccacatgaaagaaggagaaagtgttgatgaatattttgctcgtacacttgccatagcaaataagatgaaacttcatggagaaagcatggggcaattgttgattgttgaaaagatcctaagatcaatggcatctaagttcaactatgttgtgtgttcaattgaagagtctaatgacttagacactttaaccattgatgaattgcagagtagtctattagtgcatgagcagaggatgaaaggacatggaggggatgagcaagccccgaaggtgaccactgatgacagatcaactggaggaaaaggtcgtggtactggtcgtggaactagtcgcgaaactgctcgaggaagaggtagagctaactatgcagaacttgaggaggaagaggagatattgttaatgtcatttatggagcctaatcagtctgacgaagaagtggaagatgtatggtttcttgactcagggtgtagcaatcacatgtgtgcaaacaagcagtggttctctaatcttgatgaggagtttcgacaatctgtgaaacttggaaataactcagcgttggatgtgttggggaaagagatagcaatgtcaacaaacaggatgttcaagttgcctgcaagagttttaccaaaggctctgacttgttttcaagcaactcttgaggacaacactcacctttggcatcgtaggtacggacatcttagctacaaaggtttgaaaaccctgcaatataaggagatggtgagagggctacctcacttgaatgcatcatttaaagtatgcactgattgtatggtgggaaaacaacacagggatgcaatctctaagaagagtttgtggagagcatcacaaaggttgcaattagtacattctgacatttgcggacccatcaaaccagtctccaacagtaagaaaaggtatttcataagcttcactgatgattacagtcgtaagatgtggatatacttccttgttgaaaagtctgaagcttttattacctttaagaattataaaaatcttgttgaaaaagagatgggtgcttttattcgttgtctacatacagatagaggtggagaattcatgtctcttgagttcaacaatttttgcagagttaatggtattagcagacaactcactgcggccttcactccccagcaaaatggagtagcggaacgtagaaatagaaccatcatgaatatggtcagaagcatgctatcagagaagcaaataccaaagagattctggcctgaagctgcaaattggacagtgcatgtgcttaacagaagtcctactttggcagtaaaagacatgacccctgaggaagcatga

SEQ ID NO: 24760 - DNA, 519 bp, Glycine max
  misc_feature (502)..(502): n is a, c, g, or t
  Peptide Sequence Number=SeqID_141538
atggcagagccatcaaagaagagaaagggatcatcttccaccgccaccgctgctgcccatcgccgtcacggcccatccggagcacccacaacacctattcctccttctttgtcatctccaagatcatcaacactgttttcatccgatgatcaacgtctacgaattttgcttcctcggtcttcaaatttagcacaagcctctgaggaggatttgattcttatgtgggcttttctaaccggtcatcagatcgactgggcccatttggttcggtaccgaatgcataaggcattacgggccaatgcacctcttccttatccacatttgattactctgtttttgcgtcattttcaaattccgcttgatgatgaaccctttgttcaagtcaagcgttcctttgcaattggtgctggtgcagtgacctcctttgggtatcgtaaagatcggaatggacaatggctgaagaaggatgcactccctcctcaagatgaacgtactccttcanctccccctcaacgttga

SEQ ID NO: 24761 - DNA, 207 bp, Glycine max
  Peptide Sequence Number=SeqID_141539
atgtgcacatcataccaattggataaggctcctctaaagtatgtttgtcatcaaagcaagcaatggttcctatatcaatatccttttgggatgagtaggtggctaccttaccctctggttgacttgatactggaaggacttcttgaactactagagaataaagaatgtgctcactggaaagctaagtatgtatctggctggatctaa

SEQ ID NO: 24762 - DNA, 195 bp, Glycine max
  Peptide Sequence Number=SeqID_141540
atggaggcgttggctttgtatgcgagttgctggtacaagatgttgtgggttagggagtatcgaagtgagcctgatcatgaaatgtggagagattcttacctaattagggttcatgacattgagagaagaatgaggcagcttgagggcaagagactatgtgttttagaaaatttgacaacattaggttttttataa

SEQ ID NO: 24763 - DNA, 129 bp, Glycine max
  Peptide Sequence Number=SeqID_141541
atgaatttccttttgcagggcatgggggacttcttggacgaaatgttaacaatgatgagtcagaccaaatcaaatggaaaatcgaatgagaaaagagatctcaattggttgtgcttgtgcgtgagctga

SEQ ID NO: 24764 - DNA, 246 bp, Glycine max
  Peptide Sequence Number=SeqID_141542
atgaaggctgtaaagcacgaatgcgaatgtcgtatttcattggacttgatgcttcggtgggtggtgatggttctgttctgtttgatacgaggggaaagaatgatgaagtgcaatatggttgcaacacttgcgacaaagaagcttggtttttcggcggaagaaaccccacgagtacttagaaaaatatggggcgaattcaatttcatcaacacgggtgaatctgctgtcatcaacgttgaggaatga

SEQ ID NO: 24765 - DNA, 249 bp, Glycine max
  Peptide Sequence Number=SeqID_141543
atgtctccgattaacataaccttgatgcgaatgaacaacatgaatctccttcacaaggttgtaaaacggatgttcctctctcatttaggccaactcgaggccaaacaaaatttcatgcaattcagcttcaacaaaggccagatgcatagcatgactatggctgttcgaaggtggtggcagcgaggtcatggtggtgtgacaatggttgttcaaaagtggtggcagcaagattgcaactacaagatctaa

SEQ ID NO: 24766 - DNA, 1431 bp, Glycine max
  Peptide Sequence Number=SeqID_141544
atgccagggttcatctcttccagatttcaattattattgctcctaaatgtatggtgttggagtctctcttctgtgtctgttattagtggttacacacttacattctcctctttcatccagggtaaagaagaaaaaattgcttgtgtgattggtgaccgatcaactagtgatgttgatgtgaggctacgcacacaggaaggtcgagatgattggctatactgccactcagagattcttgtgaagaattgcaagtattttgccgatcggttgtctgagaactggccaacatgtcagatccttgattcacgcaactgtgttgatgtctattgccaagagttgaattttgattaccatgtaaatcttatacgccttctctacattgtcgtagatagttcagttgatgatttgtggcatggtgttaggaattcccttggcattctccaggtcgcagttgagcttggatgcccacaaattgtaactgcctgtgtgaattacttagaagcggtgacatgggaagaggctgaggaggatgagatattgaaaattgtacctcgaatgggattacaggcagagcctatcctagctagacttcaaccagttaaccagtctgctattgtaaacatctttgtctctgccctccgctttgctacatcatccccacctccacaaatgaatgatcttaaatcttcagcgcaagagcaacttgagtacatgctaactgaagatgatgatgcccctttgttgacagctgatgacaacataaaacttgaggtaaaagaatgtgtaaacagactattttcccagtttaatgactcattaacagctttgttctgtggttccacagaatcactctctggggctggaaatattcagttgtttaaatcctatttgactgatttgtcatgggcttgtcagatattgagtaagttggaaattatgagggaatttgtcgtgtattggtttgatgcatcggataagattgtcaaggtgcttgaacaaggaagttctacaactgaagtaattgagataaaattaagagctattgaggtgacatccaaggtgttagaggcaattgggtatggcactgttatattgccaactgcaaaacgccttcaggtcttgaaagtgtggcttccatttgtgagggttacaaaaccattgattgattctgtcaccatgaattgtgagaatgccatgctgcttaaattagatggtgaaatgtggcaatccttagaatccacatttgtctccatcattcttgcattgccatcaggggatcaggcagaggttttaactgagtggctggataacgagtacatgcagtatccagacttaactgaggcatttgaagtgtggtgttataggtccaaggttgccaagagaagactatcattgctagaggatgagcatgccatgaccaactcattttga

SEQ ID NO: 24767 - DNA, 873 bp, Glycine max
  Peptide Sequence Number=SeqID_141545
atggaggagcggatagagaagagatgttcttactcccctattaagccgagttggcaaggtgtcagggcccaaaactgtgagaaatcaaactcagcgtgtggaaggaacatgtgccacgtgtgcgaccaaggagtccacgctcgtccacgtggcgcccctcggaaggcgagccgagatcgcgcggaactccaacctcttatcaacaaaatcctcaaaacaaacaacattcccccacgtttctctttctctcttcagacagagactggtttaaaaggaaggtttagagtgtttgctgtatatggagaagagatagataagaagaatgcatggagtgccctctttgatgtggaggatccacgatctaaagtgccgcagtataaagggaagtttttggatgtatatcaagcccttgaagttgcaagatatgatattcaatactgtgattggcgagctaggcaagacttgcttaccatcatgcttcttcatgaaaaggtggtggaggttcttaatcctttagctcgtgattataagtccattggcaccatgaaaaaggagctagcagagttgcaggaagaattggcacaagcacaccaacaggttcatatatctgaggcaagggtgtccagtgctttagataaactagcttacatggaagaattagtaaacgataagttgttgcaagaaagaagcaccacagaagtttcccagacatcctcttctcccagtacttcttttaaacctgtagatatagaaaagagaagatcgccacgaaaaagcttggacatatcaggtccagttcagtcataccatccacacttgaagaatttctggtaccctgtagctttctctactgacttgaaggatgatacaatg

SEQ ID NO: 24768 - DNA, 237 bp, Glycine max
  Peptide Sequence Number=SeqID_141546
atgaaaggaacttactcaccttcaatggcaacaagtaggttgcaggtggatgagaggtgttatcgtcgtgggatggttcaatctgttgcaagaatcactagagggagacgcgccatcacgagtaggaggaggcatgtgacagggttgagggttttattcattaagagtgatttaataatttcaaaggtggttgtgggaggtgtaggatataggtatccccagaaagacacgtcataa

SEQ ID NO: 24769 - DNA, 1452 bp, Glycine max
  Peptide Sequence Number=SeqID_141547
atggatattgagtcaacaacgcaagtaaacaagggtggatttttttctcgtttggggaactgcctcgtggctatgcctaggaacttcaagaccaaggttatcaacttcgcaagaagcataacaaagattggaaaagatgaccccagacgagtaattcactcattaaaagtggcaattgctctcacatttgtgtccttggtttactactcaaggcctctttatgatggcttcggagttgcgggaatgtgggctgttctgacagtggtggtagtgtttgaattcagcgtaggtgcaacccttagcaaaggtttaaatagaggatttgctacattattagctggtgctttaggggttggagggcaacacttggccactgcttttggagaaagagcagaacctattgtccttggaatcctggtcttcagtttagccgcaggggctacttttttcagattttttccaaaaatcaagcaaagatatgactatgggattgtggtatttatattgacattttgtttggtcgctgtctcgggttatagagtggaagaactcttcgagcttgctcatcagagactttcaacaattttaataggagcagcagcttgcatggtcatctccattttcatttgtccagtatgggcaggtgaagaccttcacatgttggtggcttccaatattgaaaagttggcaaattatctagaagtattcgaaaccgaatattttcattgctcggaggatacaaaaaagtgtgagaagtcagttcttgaaggatataaaagtgttcttaattctaaagcaagtgaagaatccttggcaaatttggcaaggtgggaaccaggacatggccgttttcctcttcgtcatccttggaagcagtacttgaagattggagcacttactcgtgaatgtgcttacaagattgaaacccttaacaactacctcaacccggaaatccaagtatctttggaattcaagtgtaaagttcaggcaccatgcacaaagatgacttcagagtccaacaaggcattaaaggcaatatcttcatcaatcaaaaaaatgacacacccatcagctgccaaagttcacatagaaaattcaaaaactgcaattgaaaacctcaaagttgcccttgaaatcgtttcgttgaaaaatactgatctcctcaccataatcccagttgccacagttgcatcaatactcgaagaaatcaccaagtcagtggagaaaatatatgagtctgtttctgagttttctcacttagcccacttcaagagtgttgtagaacccaatgtctcaccagagaagcctccccttcttcatcgaggtatcataaaacctgttgtggatattgataacaccgtcgaccatgttgaaattacgatcccagatataactacagactctctagagaaagaaaaagcaccaataacaaaaccctccgaacatttgtaa

SEQ ID NO: 24770 - DNA, 507 bp, Glycine max
  Peptide Sequence Number=SeqID_141548
atggcggcaaggattttcaaagcaaaatactactcaaatgggaagttcatggacggtgccattaggcataatccatccttttcttggcgtagtatcgacaattcccgtgttttgttgaaagaggggagaagacaaaagaattgggccgaggaaactaaaggggaatacacggtgaaaagcgcatacaagctgtttatggataacatccttgattccacaggcctctatgtggatgggcatttggaatttgaaggttcctccaagtttgttgagatatccttcttactcgttccagacttcaaaggaaaggtattgaatgtccttctacttgcttcttgtgtaatgctggtattgagaacgtctcccacttgtgttgggaggaattgggccttgccaatagtagatgaatttagggatatggtgcttgcccaaactgattggcaggagaagctatggggctcctcaaggctatcagttagttctcggatatgggcatgtccaatgtga

SEQ ID NO: 24771 - DNA, 123 bp, Glycine max
  Peptide Sequence Number=SeqID_141549
atgatgacaggcaggctttcaggtgttaatcacggctgtatatcaagcagtgatgctgaaaatatgactgctgaacagttaatatggctttactctactatgatatttgcaagtgtgtggtga

SEQ ID NO: 24772 - DNA, 2361 bp, Glycine max
  Peptide Sequence Number=SeqID_141550
atggcgacgcatccgcaaactccaacctcgtcgaacgcgttctcgttcatctccaagggctggcgcgaggttcgcgactcggccgacgcggatctccgtctgatgcgggaccgagcgaactcgttcaaggacctagcgacttcgtttgatcgcgagctcgagaacttcttcaattccgccacgccgccgttctccgtgccggcgatgcgctctccgccgcccaaggagatcgagttcgtcaagagtctgcgccccaagctgtcggagattcggcgcgcgtactcgtcccccgacttcagtaagaaggttctggagaagtggcgccctaggacgcagattagaataaacctttccgcgattaagaacgcgattgtgtcggcggaggaggtggggcaggaggaggaggaggggattgtggattttgaaaagaggagaaggaggaggttgagtttctgggaggagtggaaaaacgatggcgagggtgaatctagggattgggaaccgattcgagtcttgaagacgcggttcaaggagtttgagaagcgtggttcgtcttttgaggcgttcaagaacagtgaattcgtcgagaaattcaagtctagcttgaaatcaatgtgcaaggaacctcaggagtcaaaggaagtgccgccattggatgtatctgaacttctggcctacattgtaaaacagtctggtccatttttggaccatcttggagtgaaaagagacatatgtgacaaaatagtagaaagcttgtatagcaaatgcaaaaaccatcatctattgcataccctctctggggaagaatcttctgttctagggaatggaaacataaatgatgaattggatttacgaatagcaagtgtccttcagagcacagggcaccggtatgaaggtggattctggacagaccatgcaaagcatgttccattggacaatgaaagacatgttgcaatagtcacaactgctagtcttccttggatgacaggaacagctgtaaacccactatttcgagctgcatatttatcacaatctgctaagcagaaagtcactctgctggttccatggctttgtaaatcagatcaagaactagtttatcccagcaatgtcacttttacttcgccagaagaacaggaagcttatatacgtagctggcttgaggaaaggattggtttcaaggcagacttcaaaatttctttttatcccgggaagttttcgaaagcaagacggagtataatacctgctggagatacttctcaatttataccatccagggatgctgacattgctatcctggaagaaccagaacatttgaattggtatcatcatggtaagcgttggacggacaaattcaaccatgttgttggtattgtccacacaaattacttagaatacatcaagagggagaaaaatggggcactccaagcattcttcgtgaaacacataaacaactgggttacaagagcatactgccacaaggttcttcgtctctcagctgctactcaggatttaccaaagtctgtaatttgcaatgttcatggtgtgaatcccaaattcttgaaaattggagaaaagattgctgcagagagggagctagggcagaaagcctttacaaaaggggcgtatttcttgggaaagatggtgtgggcaaagggatacaaggagttgatagatttattagcaaagcacaaggctgaccttgatggcttcaagttggatgtatttggaaatggagaggatgctaatgaagtacagagtgcagccagaaggttggatttgaatctcaactttcagaaaggaagagatcatgcagacgattctcttcacaggtacaaagtctttataaatcccagcattagcgatgtgctatgcacagctacagctgaggcacttgccatgggcaaatttgtagtttgtgctgatcatccatcaaatgagttcttcaggtcatttcccaactgtttgacttacaggacatccgaagactttgtgacaaaagtaaaagaagctttagaaaatgagccttatcctctaacacctgagcaaagatatcaactttcttgggaggctgctactcaaagatttatggaatattcggagcttgacggaatcctgaacaaggaaaataatggcgaaaagtcaagggtagataaggggaagctcattgctaagtcagcatcaatgcctaatctgacagaactagtagatggaggcttagcatttgctcactattgtctcactgggaatgaatttctgagattatgtacaggagcaatacctgggacacgtgactacgataagcagcactgtaaagaccttcatctcttgcctccacagttgcttgtgttaggtgcctgctaa

SEQ ID NO: 24773 - DNA, 1032 bp, Glycine max
  Peptide Sequence Number=SeqID_141551
atgggtatgtttctcttcttgcttccatgcttgggagtattcttgctctttcttgtgtcttacgctacacaagctcaagagaaggagaagaagaagaaggagcctaggaaacatcatgctcgagttgaaattggtagagatcttagatataaaattaaaagaaatcatagtcacggagatcccagttacacaagcattgtcactaagcatggcaattacataggcacagtccatgacatcaaggtaacccgtacatctaagtttgcaagaaaaggaataactaaaaggaaaagagttcttccaaggcagagaagacaagaatcaggaatgttaggaatccatgataaagggttaccattactttacattgaagtttgttcatctcccaaagaaatctcaaaattcatccactcaaataccccaattgcatttatctgttctcaatccaccaactgcattggaacacccttttctccttcaatggaaggtgaggaggggaaacagtcttcccaaaaaaacccttacgttgaactagaagaagttgactttgattttattctagcaatgagcatgcaagaacaagagagagagttcacaatgctttcaactattgaaagtgaaagtgatgaatatctaagtgactcctctatagataatgatgatgatggtgatcctgactttatagcgagtcaagagtttgaaaccgaccttcggtttcttgaaggtgaaggaagcgacgatgatgatgaagacatggaaatggaagaagatgagattgatccagacgaattatcttatgaagaattgatggagttggaagagtttataggagaagaaacaagagggttatcagcaaatgaaatctctttgtgcttgtacccttatacctgccaatgtgctgaaagcaaaagtggcattgatcgttgtgtgatttgtcaggttgaatatgaagaaggtgaagcactagtggcacttcaatgtgagcacccttatcattcagattgcataagaaagtggcttcaaattaagaag

SEQ ID NO: 24774 - DNA, 549 bp, Glycine max
  Peptide Sequence Number=SeqID_141552
atggagcaagtgttgttcttggagtttggtgatggttggagaagaggttgcggtgttgtagggtgtgataggttgaagagggtcaagaatggagttggttgtggaagagtagaggggcattgttttgtgcacaacataattgttgatacacccaacaaaatagtaaaattccattttcattcttccataaagctgatatggattgacaaatttgtgtaccagcaattgtattttgtgtgcgtagtaacagccaaagtagagatgttaaagcggatccgtccaaaccattttgtcccgtcacacttctatatatatatatatggcaggctggcggaccaatcggtcccgctccgccccatcattggttcagcagggcgagctaatgggttaagtcacctaatccaatccaccatttttggcaggaaagtccccgggaccaagacccacattgtcacccaaaagaggagagataaggtggaggctgggagagaaggtctgaaagtggaaagggtgaaaaagaaagaaatgatggaaaaagagaaagattaa

SEQ ID NO: 24775 - DNA, 1104 bp, Glycine max
  Peptide Sequence Number=SeqID_141553
atgaagtcagagtttcctgcgtgcttaagaaagaggacagttgcagtaccaagtgatgtgtatgctaattctaatatcatgtctgacacagtctttttgtttccagagggcacatcagttcaaggtgaaacacccttcttgtggcctctttggtttagggctgctgttccaggtgatacatcactttacatgagcatatattatgagatgggagatgcatcaagtgtcatcaagtatcgtactcttcgcttgcattacaatgtgcaggtttctaaaccatgtccagcaatgaaatatagcatcctccatcaatttgttgacattgaaattgtcattcgagaagacaatcatattcctatgatgccaaatgctcctagttatggatatctgccaacgctgcctcctgatccccgacagcctgcaagaggaatgttggaggaaatgggtgacttaaatactgttgattttgtattgatctctcggccattcaagagtaatgacgatccgggttttcccaatcctcctcatgttatgtctcatcatgcgtgtcacttcagtactgctagcacgggccctatttcatggctagtggatggacctcaaaccttgcaccatgacttctctgcatcgttctgtgaaataagtctgaagatgcatatttacaattcttctggtgccactgcttttgtacgcattgacaccttagattctgctggtaatggtggacacatgaacagtgtaaatgtggttcaatcagcaactactgataaccaagcagggtggcatgatattacaccagtgaatgaactgaaagtcacatcaaatgttcttgaaacccaaccaggaaaggcaccatcattggaaagtgtgtcctcatatatttggtctggatcaatctcaaccaatctccacattgatgctatgtcctctgcagaaattcctcttcagatctgtgtgttctctcctgggacatacgacctgtcaaattatgttttgaattggaaacttccatccaatggtaagggagatagtgatgaaacgaggcagcattcaggcaagtgccagggctataaatactatcttaccgtgcttcagtccacttga

SEQ ID NO: 24776 - DNA, 1743 bp, Glycine max
  Peptide Sequence Number=SeqID_141554
atgaggagtacatttggggcaagtgactgttcgttgctttgcattaattcttccctggatactccaatcaaaactcaagataatccttgggcttcatatataactgatgcctcacctactcctagtcaagatcttggttgctttctcaacattgatgatatcaacgaggtttctgcaacacgaaaagggtttaaaaaccaaataaaaaatttatggtggagaaaagggaaagaagacggtgcagattctctcaatggtcccacgtatgactttaattccattgaatcccagattcgagttttgggtgattatgctttcatgttacgagattatgaacttgccttgtcaaattatcgcctaatttccaccgattacaagattgataaagcctggaagcgttatgctggtgtgcaggaaatgatgggacttacgtacttcatgttggatcaatcaagaaaggaagctgagtattgcatggaaaatgcttttaacacatatttagatatcctacattctgctgtgatgcttgaacaagcatcgtattgctacttgttgtctaaaccctctatgttacgcaaatatggatttcatctagtgctttctggtgagcagtataaaaagtgtgatcagatcaaacatgcaattcgaacatacagaagcgctctttctgtttttagaggaactacttggagttatataaatgatcatgttcatttccatataggacagtggtatgcttctcttgggatgtatgacgtggctgtcaagcatatgacggaaatcctggcctgtagtcaccagtccaagacaacacaggaattattcctgggcgactttcttcaaattgtggagaaaactggacggatgtttgaggtaacaaaacttcaattgcctgtaatcaacatctcttcactcaaggtcatcttcgaagattaccgaacttttggaacaccttcagctgctaatactagagaaggcttgtggcgttctttggaggaggaaatgctaccatcattctctgctgccaagacaaattggttggagttgcaatcaaagcttatcccaaagaagcacagtcaatccaatgtttgtgttgtaggcgaagctgtgacggtgaatatcgaatttaaaaatcctctacaaatctcaattcccatatctggtgttacacttgtatgcaagtattctgccagtactgatgatgttagatcagatgagaatgagtcaagtgtggagaaagataatgaggttgaccactttgggaatatgagctctgacagttcctcatttatggtgtctgatgttgatttcttactaggaggtggtgaaacaaccatgcttgagtataatggttctagacttcagtccttgaaaatgaagataattgtttgttctagctgggacttttgggagagacttaactgcccaggacattttctttttccattgaatttcctttttcatcagtcttcaacattctggcactgtatcctcctgatacagattcaactatcagttactcccagggcagagggttctcttgaaattcttggtgttaggtggaaattgtctgcttttcctcttctaaaatcccagagcatacccaagcttcagggttccattcaccctctacctggaaagacatatgctggagatttacgacaacttgttttggaattgaggaatccatcagagtttcctgttaaggtaccatgtctggagtcaacttgctctaaattttaa

SEQ ID NO: 24777 - DNA, 507 bp, Glycine max
  Peptide Sequence Number=SeqID_141555
atgacttatcttcatcttcagattctgccaaagccacaaatggtattaagaaaaaaaagtatgccagaaagaggaggaagaaagcaagatctgaagttcaacccaatacagggtcctgctaataaggacagtgtcccttgtctaccccctgtccgcattccaattggctgtaaatgggtgtttagagtaaaagaaaatcccaaaagcatggtcaacaggcataagccccgccttgttgccaagggctttaaccaatactttggcagtgattataccgagaccttttcaccagttagcaaacctgttactgttcgtctcattctcattttggcaatcattcattgctggaccctaaagcaacttgatgtcaacaacgctttccttaatgggattcttgaggagaaagtctatatgactcagcctcctggctttgaatctcatggcaagtctctcatatgcagacaacacaaggcaatccatgggctgaaacaagccccatgcgcctga

SEQ ID NO: 24778 - DNA, 975 bp, Glycine max
  Peptide Sequence Number=SeqID_141556
atgagactactgttgtctccttatttaatctttgcctggactccgatagacgagacgacgtcgtggagggcaaagagaacctttccttttagattgaactgtgtattgtgttgtgtgggttcccgttggccattgacggcagcagagatccgatctgctctgcatctccctcacaccacagtgtcgccggtgatgatggatccggcgatgacgccgctggggcaaatgctattggaggagatcactcccgtggtcatgctcctctcaactccttccgtcgaagaagcttccctcaagaacggcctctccttcctccagacgctaacgccgttctgctccttcaacaacatcgacgttcctgttaggaccgccagtgaccaaccttatcgccttcacaagttcaaattgcgtttgttctacgcttccgatgtgaggaagcccgatatgaaggtagctaaagagcagctgaagcaagttatcacagaggcaggggagaaagagttttctgagtcttgttcagatgtgtcggaaattaatcatgaattttcgtcgagttctgaataccaaaatacaccttcctggtttcggtttctcaataaagagcttgttcgtgtggcttccttttcagaccatgaagcatttgaccatcctgtgatatgtcttgtagctgtttcatcaaaggatgaacaacctattagcagatttgttgacctttttaataccaacaagcttccttcccttcttaatgatggtgcaatggatccaaaagtttcaaagcgttacttgttagtgcatgataatcaagatggccctgcagacaggaacgacatgatttttaataatcaacagttttctatttcaaagctggtggatatcgctatttttagaacttggtcttggttgaggggatgggaaaagggctttgctgttccgtttcaacaatggtcctcatccatgtctcttgccttcacctag

SEQ ID NO: 24779 - DNA, 225 bp, Glycine max
  Peptide Sequence Number=SeqID_141557
atggctttcatggatgattcaaaccctctctacaactttcaaggcacaggacaccataggatactgtctccgaccccaacatcatttgacacttactactaccagagcattagcagttctagcctccgggtgatgatgtctcgaatcttgacggtggtggtggtgtcggaggtgggtgatggcggtgcagaaggtggcatagaggctgaaatttttcagatttga

SEQ ID NO: 24780 - DNA, 993 bp, Glycine max
  Peptide Sequence Number=SeqID_141558
atggcgatgcaaactgtttatcttaaaaagcatgaaggaaatgcacacaattttgtgggcacgttgtcgtctgcagcttcagcaccctggtggagtgcttttggatcacaatccgttcatcagggagaatcttgtggccaaatgaaaccctttgcattggagctgcctaactgcatagaccaacttgctgccactaagctatcagcaagaggagctgagcaagtgttgggtgaagggcatacaactcagttcaccatttttccagatggttgtaaaatgtcagatgatgcgcaaaagcttcagacaaccatatcactgcagtcttcacttactgatccccactctcgttttgagataggatttagtcagcccatgttatgtgcaaaatatccttacacggatcaattttatggcctcttctcagcttatgcacctcaaatttcgggacgtataatgctgccacttaacatgtcatctgatgatggaccaatttacgtaaatgctaagcagtaccatggaatcattagacgtcggcagtcccgtgccaaagctgtacttgatcacaaattgactaaacgttgcaagccctatatgcacgaatctcgccatctccatgcaatgcggcgaccaagaggatctgggggtcgcttcttgaacactaggagttctattaacggaaatggtaaacttggaaatgaagtgcataaaactgttggtgaacaattgcagtctagtgactctcagagttctgaattccttcaatctgaggttggtactttgaattcatcaaaagagactaatggcagcagtccaaatatttctggttcagaggtgactagcatgtattcgcggggaggtctcgacagcttttctctcaatcatcttggatctgctgtccactcttttgcaaacatgatagatggtgggcgcggtatgatcataccccccaaatgggttgcagcagctggtaactgctacaaccttaaagtttga

SEQ ID NO: 24781 - DNA, 1800 bp, Glycine max
  Peptide Sequence Number=SeqID_141559
atgacacttaaagtgggaaaacaacaacagcagcagcaacaacaacgacatcagcatgtgatcgagataacacaaggtggtggcatggacttggacaagttcttccaagaagtggaatcagtgaaggaggacttgaaggagttagagcgtctccacctaagccttcgtgctacaaaccaacacggaaaagcgcttcacagcccaaagggcgttagggagcttaggtcacgcatggacctggacgtggctctctctctcaccaaagcgaagctcgtgaagggtcgcttggcggctcttcaccgaaccaaccaagcgaccctctccttgcccggttgcgggcccggttcatactccgaccggacccgaaccgcgcttgtgggggccttgacgaagaacctgagacagtccatggagagtttcaataagctgagagagcagatatcgtacgagtacagagacactgtgcaacgtagatactacgctgtcactggagaaaaccctgatcaagaaaccattgacctcctcatctccacgggtgagagtgaaactttcttacagaaagccatccaacagcaagggagagccactatcatggacaccatccaagagattcaggagaggcacgacacgatgaaagagatagagagaaatctacacgagctgcaccaagtgttcatggacatggcagtgctgatccaacaccagggtgaacacttggataacatagagagccacatggaacttgcaaactccttcgtgagcataggggtgcagcatttgcaggttgtgaggagtcatcagaagaacacccgcaactgcacttgtttcgccatacttctcttcattatcgtgttggtctctttgaaagaagaggaaatagaagagaatgaaggcaaagggttacggctagatgatgttgttcatgtaactggtgggtctctagaagaatcaagggaggcacttgccattgcggaaacagatggaagacttttctgcacagttggagtgcatccaacacgttgcaaggaatttgaggagagtggagatccagaaaagcatttccaggctcttttgtctttagctaaagagggaattcagaaaggaaaggtggttgcaattggagaatgtggattggactatgacaggcttcatttttgcccagcagagattcaaaagaagtatttcgagaagcaatttgaattagcatatatcacaaaactgcctatgtttttgcacatgcgagcagctgctgcagatttctgtgaaatagtggagaaaaataaggacaggaatttagagaaagatagatatatggggtttaatatccatcagaacagtgcaacgttgaggttcactgctggagtcacccattcatttactggtagtatggatgattgcattaagcttctctcatttgataaaatgtacataggcataaatgggtgctctctgaagacgactgagaaccttgatgttgttaagggtattccagttgagagaatgatgattgagacggactcaccatactgtgaaatcaagaatactcatgctggaattggttttgttaaatctacatggccttctaagaagaaagagaagtatgatcaagagtgcattgttaaaggccgcaatgaaccttgtttagttaagcaagttcttgaagtggttgctggctgtaaaggcatcaacgatgtgagtaacctcagcagaacattgtaccataacacttgcaggatatttttccctcatgacttggattctgctgctgatgctcttctagctggcggtaattctacataa

SEQ ID NO: 24782 - DNA, 1065 bp, Glycine max
  Peptide Sequence Number=SeqID_141560
atggtgggcattacctgcgtgtttggcaaaaactctattcgtgacctttgcaaaccatacaaatcctttatcagaagatggtttcgtcgtaacaagaaatcatcatcctctagcagacataacccgcaacgccagaaacaaacacaacaggaacacatgaaagaggacagaaccacgaatggaattcacggcttcagatcgaatggcaatggtatgagaagcattaatgatgatgatagtccaatgagtttaagaggatgtggtttatgtaggcatagaagcttagataattcttcgtgttttccttctgaaaattctgggtctagaaataatgcaagcagaaagattaatcacccggcctcaagcaagagctgcgattttattccaaccccttcttcttcatggaacagcagcggcagtttcagaatgcctccacatgatctgaagtcacggaatgccagtcgtaagagagacactccaatcatgtattccaattcatctgggatgctaaaacccccaccaattgagaaaagactagaatgcactctggaagacttgtgctatggatgcaagaaaaaaatcatgatcacaagggatgtcctcacagatacagggggaattgttcaagaggaagaactgctaacaataaatgtgcaacctggatggacgaaaggaacaaagattacatttgaaggaaaaggaaatgagagaccaggagcatacagagaagatataatatttatcatctccgagaaaaggcaccaattatttagaagagaaggggatgatttggaattgggtgtagaaattcccttagtaaaggcacttactgggtgtacaatattagtcccactattgggtcgagagcacatgaatttgacacttgacaatatcatacaccctggctttgagaagatcatccctggccaaggcatgccaatctccagagaacctggcaagagaggagacttgaaaattacatttctagttgagtttccaacaaaactcacaggcaatcaaagatccgaggttgttcgtattttacagaattcaacgccttcttag

SEQ ID NO: 24783 - DNA, 1001 bp, Glycine max
  Peptide Sequence Number=SeqID_141561
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccaagcattcaccatcaaactgaaaaaagacttaccgttagaagaaattgaacaaattttagcgtctcacaacgaatgggtgaaagtgattccaaatgacaaagaaaccacattacgtgaattaacgccagctaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 24784 - DNA, 216 bp, Glycine max
  Peptide Sequence Number=SeqID_141562
atggcgtcggaggacatagaaaagatggcattcgtcaccctgtggggaacgttctgctacaaggtgatttcctttaggctcaagaacgctggggcaacctaccaacgggctatggtagcattattccacgacatgatgcataaggagatcaaagtctacgtggatgatatgattgcgaagtctaaaattgaggaggaacatctcgtcaacttgtga

SEQ ID NO: 24785 - DNA, 393 bp, Glycine max
  Peptide Sequence Number=SeqID_141563
ggtccagcggctggaagagcaccgcacgtcgcgtggtgtccggtgcgcccccggcggccctggaaaatccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 24786 - DNA, 303 bp, Glycine max
  Peptide Sequence Number=SeqID_141564
atgatttctgttaatcctaactcgagaagtcaggtggcaggcggagatactcaagtggttatcggtacaaaacgatttctgttaatcctgacccgagaagtcaggtggcaggcggagataccttatgagactaatgtcgtcacctgcaccctttgtcaaccaagggcaagcgagcccgttgacacacagagactaacatcgccttctgcacctttgtcatctagagacggcgagtccgatgacatgcggagatacccaagtggttatctgtacaaaccaacttctattaatctcaacccgtga

SEQ ID NO: 24787 - DNA, 183 bp, Glycine max
  Peptide Sequence Number=SeqID_141565
atgggagggtacatccattatggatctttggcttgtaaaggattttacaaggttgaaagaaatctcaagaaccgttggttgcttggggactggataacttcatgctaccatgcatttgccttgatcataaagatgtatgtgtcattaggatcattcaacagtggaaactggtctgattcttag

SEQ ID NO: 24788 - DNA, 414 bp, Glycine max
  Peptide Sequence Number=SeqID_141566
atggtagcgtggagggaagcatcaatggagatagagggaaggtgtacagacacaagctttgaaaacaaaagagaaggtgtagtggtttggggtccatcccttaatttcatttcatcactttcacttgccaattttcaacctaattcgtgttcgttcgttcaaattttaggtgctttgagggatacgtcagtgatcgtggtgacgctggacttggacgaggtcttcatcatcgctaggctctacaccagaaccgacactcatagtgaggcctcggatttcatcaccaacggatcgcggtttgcctgcaggagcaggacgctcgtgagtagaagagagagggaggaagagggaatcgcgagcgatcgacagaattggtgctggagggtggagagagaaagtgctgagaagaaataa

SEQ ID NO: 24789 - DNA, 2565 bp, Glycine max
  Peptide Sequence Number=SeqID_141567
atggaagcattgaaaaatattaatgggaggccacctcatggcagaatattgacgtcaaaggtgcatggaccagaagaccagtcagatgattttacataccttcttcttcattatgccacgctgaagcatgctcttctcccatctcggctcactcacatgggctgcggcgggtccaaggtcgaggacttccccgcggtggttctttgccgggagcgaaaggcgttcctcaaagccgcatcggagcaacgctacgctctcgccgctgcacacgtggcgtatttccgttcgctgagagaaatcggcgacgcgcttcacaagttcgccgaacaagacctcaccaccaccaccaccggttcctcctctccggttctcacattaccttccgaaaccaaaagcatcaacaacaaactctcttcctcttccccttccatttctcacgccgattcccccaacggttctcacttacccctctcctctggatccgaattaagttctccttctcattcttcttcgcctcatattcacgattccccagaatccgacccgcctccttatggatactatcaaaattaccattacgcccactacatgaagaggtctgtccctcgtggaaaacccatggtctacgaagagcccgagagacacgtggcaaccaatggacaatggcctgatccttcttacggccacgccaacaccggtttctacgggtttccaggtggggattacccttattaccctcctcctggaccgtcgtattctccgccgcgtcctcctccggcgccgccgtctcctcctcgcgtctccacctgggacttcctcaacttgttcgataatttcgacaatggttacccgagttacccgcctcggttcgggtcgagtgcgagcagccccgattcgaaggaagtgagggagagagaggggattccggagttagaagaagaaacggaacacgaaataatgaaagagaaagagaaagaggttccgttgaagaaggagaagaagaaggtgggagagcagaagggttttggtgttgttggagttagggatttcggggaggggccttcgaataccaaaacggtgccgttgcagcaggtgagtagcagcgaggggagttccaagacggtgaggttccatgacggcagcgataatggctccgtcgagaaagagattaagagcagtcccgacactgttgcttccgaagagcgcggtgcgaagaaaggagtgagttttgagattgacgaagcgaccgttacgacggtggacggtgactcctccgttttgagcagcgtcaccactttgtccgcacatggcaccagggatctcctcgaggttgttgaggagattcagggtgagtttgtgacggcgtcgaattttggaaaagaggttgcgctgttgcttgaggtttgcaaaccaccttatcgatctagggttgctgcccttagagttatcttttccagaatcttgcagatggtagcaccttccaggctaccttcagatcctctatctatacaattttcttctagggaaataaaattggcacaagcatactgtggggaacctgggaaagagttcaagacaaatccagaaaatctttcgtccacattggagaaactttatgcatgggagaagaaattgtataaggaagtcaaggatgaagagaggttacgagctatttatgagaaaaagttcaagagactgaaaacattggataatctaggagctgaatctaagccccgggatccaagaggccaagaattgatggtggcaagattcataagaatgtggaagttcatgctcaaatgtcaccagaaacagttccaagctatcatggagagtaaaagtcagtctctcaagattaacataggtctgcaaggagatgaaggtttgaaggccattgtagaacttgaaaaggagcttttgaattggtgcagtcagttcaacaattgggttaagactcaaaaatcttatgtcaagaatttgaacgagtggctcataaggtgccttcctaatgaacctgaagaaacagctgatggtattgctccattctctccaagtcggtttgatgctccgccagtttttataatttgcaatgattggaatcatgcaatgaatagaatttcagaaactggagtggcagaggccatgcatgaatttgctctaaaactacatgagttatgggaaaggcaagatgaagtgcaacggcagagaatcaaagcagagtatcttagaaaggactttgagaaacagcttagaactttgcgcacagaaatgggaggctcagaacatgagcatgataaagtttcgggaaagattgcattgtcaaagcttgcttctgatagtggtgtttcaccactagatgatctaaaagtggatttagattctatgaagaagaaattgcaggaagagagggtcaggcataaagaagccattaaacttgttcgtgatgcagctaataatagtttacaagctggtttaattcctatttttaagacattggagagtttcacttcagaggtggtgaaagctcatgaacaagtcaggcttcaaagtgctggggactcgtag

SEQ ID NO: 24790 - DNA, 564 bp, Glycine max
  Peptide Sequence Number=SeqID_141568
atgtcaaggggcactgcaattttacttaaacacaataaaacagcaggaaattcacatgtatttctcactctcactctacagaaagatggaccaggagcacccggaggacaatcctggacagtgcaatggttgaaatttgacaactcttacttcaaggacatcaaagaaaaaaaggatgaagatctattggtattgccaactgatgctgctctttttgaagacccatccttcaaggtatatgctgagaaatatgctgaagatcaggaagcattctttaaagattatgctgaagcccatgcaaaacttagcaaccttggagccaaatttgatcctccagagggcattgtgatagatgattctccaaatgcaggggcagagaagtttgtagcagccaagtactccactggaaagagagaactgtctgacggtatgaagcagaagatacgggctgaatatgaggcgattggtggaagcccagataagcctctacagtcaaactattttctaaatatcataattattattgctgttttggcatttttgacatcactgcttggaaactag

SEQ ID NO: 24791 - DNA, 219 bp, Glycine max
  Peptide Sequence Number=SeqID_141569
atggtggtgggtagaattacgatttacctccccttaggattcactctctttcttttcgcatcagttccttctcagatttcggctaacgagtcgtatgttctcacgttagatcactcaaacttctcagacactataagcatctcatcgtcgttgagttctacgcaccatgtgtcaagtgaccttaatggtcattttggtaaaggagaaaccaaggaatag

SEQ ID NO: 24792 - DNA, 600 bp, Glycine max
  Peptide Sequence Number=SeqID_141570
atgaaccgcttggtgtgtacctcctgcgtcctccgcctccacccctccttcttctgcccctcctgcttcgacttcttcgaccaccctctctccaacacctcctccgccttcgcccaccgcttcgtctcctgcaccaagtgctcctccctcacccacctctcctgcctcccttcccctcccccctctcccttcctctgccccccctgctcccaacacaacttctccttcttccccgattccaccgcccccttagataaacgccgcgccctcatcctcctctgcgcctgcaagctcgccgcggcctccgtcgctaaatccctcgccctcgcccggaccagagtcgaacgcaccgtccgcgaggccgccctcgccagaaagagggcccgggacgctctcgaccattgctccaccgtggagaagatcaagcgcctcggcctccaaggcaccttcgatgcttctaactctaagtatttgggaatgggaacgatgaatcataaccataataatgttactgttttgaatggcttcgtgggacctcagggcaaggttaaggctgatgtcaacaacattgatgccaaattgcccaatcgagtagcgtag

SEQ ID NO: 24793 - DNA, 240 bp, Glycine max
  Peptide Sequence Number=SeqID_141571
atggcttctggttcagattttgcgttagcggtttcttctgaactcgagtcagttttgaggctggagactgttaactactttgttacgaggaggccatggcttgatctttatggagttaacgtgagacctgttgcgccagttgggagtgctagtaggaggccttatgtggatcctgcacttatacatcgttccttacctgatgagctgctttttgaggtgtttcatttcatcaagttataa

SEQ ID NO: 24794 - DNA, 318 bp, Glycine max
  Peptide Sequence Number=SeqID_141572
atggtgaaggtgtggtggtgtttttcctttgctttcattttaattagggtgtttattggtgccgtctatggtgacaatgtcacctacgacggaagatccttaatcattgatggccaacataaaatccttttctccggttcaattcattatcctcgtagcactcctcaggtaagaaatatcaaacagtactgctccattattcggaatactactcttgcagcagctatggttggttcacgttgtttttgttttacgcttttttaccttcgttatagaatgttaaataatttgatgggtggaaagagaaaagaggagtaa

SEQ ID NO: 24795 - DNA, 711 bp, Glycine max
  Peptide Sequence Number=SeqID_141573
atgggtgatagggtggagacgcttgccagattagcccagtggaaaatcgacaactttggaccttgttcctacaaaaaatctgaccccttcaagctcggaatctggaactggtgcgtactaagtgtttgtgtttgtgtatttgaaatgaatgatcttcactttgaacctgatcaggttttgaaggataatccacccttttctcgattcgttcttcgagtctccgcagcttcatatttcccctgtggtttggtcattggtgaagattggctattgcatgcaattggggaaatcactttcgttcactgctgtctgctgtgtgattgctattggggaatgcatcccaaaagagacgggcgagtgacaattagtgttcaagaaaagctgcttaggacacatgatgactttgtctggcctgtggatacgacttttgttggtcgcctcatcattgatgttgagtttctagacctgaagatatgccctccgaatggtggagaaactagttctgtatggccttctgatggaaattctcaatccattgcatttcaaaatagcactcttcgttgcctctctcgtatgcttgatgaggctatacacgctgacttaaccatcatgactgctgatggcagcacattgagagctcataaggcagttctctcagctagttctccagtgttccagagcatgtatcatctcaacctgaaggaaaaatag

SEQ ID NO: 24796 - DNA, 675 bp, Glycine max
  Peptide Sequence Number=SeqID_141574
atgactccatatgacttggggagggcatcttgtgtatgtcgaaaatggaagtacacaattcgtaaccctgtattttggcgcaatgcatgcttgaaggcttggcagctatctggaattgttgaaaactataggatacttcaatcaaaatatgatgggtcttggcggaaaatgtggctgtcacgaccaaggttacggactgatggtctctttgtcttacaatgctcccacatctcaggtctttatgtgagtagaaatacctacattcgagctggagttgctgagtggaaaatcactaatcctgtacatgtggtctgctatttccgatacttgagattttttccatctgggcgattcctttacaagaattcatctcagaaggtcaaggatgtggcaaagtgcatgaatttccgttcatctaaagcagactgtgtttttggtggccactacacattgtcagatgacaaggttgaagctgcagtgttgtatccaggcatgcgacctactgttttgaggatacgcttaaggttgggatttgatgtgccattatactcttaccatttcaccaatatccaatggatacctcaaaataattccctcccctcgcccatgccaaataaaaaaaaagaagctagcaacagtaggggtatatccttttcagcatggattatggaataa

SEQ ID NO: 24797 - DNA, 1867 bp, Glycine max
  Peptide Sequence Number=SeqID_141575
tcgttccatgattaccgcattaagcgccaaaaacaagttagaattcgttgacggaagtgcgccggaaccactgaaaaccgacaggacgtacggagcttggcgccggtgcaataacatggtgctatcttggatagtacactccgttgccacttccataaggcaaagcatactctggatggacaaagctgaagacatctggagagacttgaagtcgagatactcgcagggagacctcttgagaatctccgatcttcagcaagaagcgtccacactaaggcaaggaactctctccgtaacagaatatttcactcgactacgcgttatttgggatgaaattgaaaacttcagacccgacccagcttgtacctgcaatatcagatgttcttgctcagccttcgccattattgcacagagaaagcttgaagatagagctatgcaattcttgcgtggcttgaatgaccagtacaccaacattcgatcgcatgtgttgctcatggatcccataccagcaataacgaaaatcttctcatacgtggcgcaacaagaaagaaaattgttaggtaattcctctcctaaccttaactttgatcctaaagacgtttccattaatgttgcgaaaaccatctgcgattactgtgggcgcattggacacactgaaaatatctgttacaagaagcatggtatgcctctgaatcatgagacaaggaacaaaagcacgggtggaagaaaatcgtgtacccattgtggtaagatgggccacactgtcgatgtgtgctaccgaaagcatggatatccaccagggtataaaccctacaatggaagatctactgtgaacaacgtagtgacgatggatagccaacccgtggaagatcaaaatcagcatctagaaccttcctcatatgccgaagcctctcagtatgactgttggattaaggccatggaagctgaactacaagctctgcaatcaaacaacacctggaaactcactcctttacctcctcataagacaacaattggatgcagatgggtatataaaatcaaacatcgagcggatggttccatagaaagatacaaggcgcgtttagtagcaaagggttacacacaaatggaggggctcgactatcttgacacgttttctccagtggcaaaactaaccactgttcgtctactccttgccatggctgcctttaaccagtggcacctaagacagttggatgttaataacgcctttcttcacggcgagctagatgaggaagtttatatgcaagttccacctggattgttggttccaaactcacaaatggtgtgtcgattacagcgttcactttatgggctcaaacaggcaagccgtcaatggttcacgaaattatcgggtctcctaacgtctcttggttttgagaagtctcactcagatcactcactttttctacgattcactggttctattaccacagtcctcttggtgtatgtggacgatattatcttaactggaaacagcgaatctgaaatacaagatgttatcaagctcctcgatcaggcttttaaaatcaaagatcttggaaatttgaaatacttcctcggtctggagattgcgcgctcttcctcaggaatccatttgtgtcaaagaaagtacactttggacatactatctgattcgggaatgctgggatgtcaaccgaatgtaactccaatggattattcgaccaaactacaagctacagcagggataccattatcaacggaagcttcttcttcttaccggaggctcattggtaggctcatatatctcaccaatactcgccctgacatcacgtacgcagtgcagcagcttagccagtatatgtccaaccccacaagtgttcattag

SEQ ID NO: 24798 - DNA, 510 bp, Glycine max
  Peptide Sequence Number=SeqID_141576
atggctgaaaaacgtcatgcaaagtgtcattgcggtgcggtggcattcaccgttgagctctctgatggcctgaacaccgcgcggcgctgcagctgttccttctgtcgaatgcggggcgcggtcgttgtctccgcgccgctgtcggggattacggtgacgaaaggtcaggataagctcaccgagtaccgctttaatacgggaacggcgcgacacttcttctgctcggtatgcgggatttacacgtttcatcagcggcgctccaatcccaatgaatacggcgtgaatgttgcctgtttagaaaacgtttctccctttgatttcccggaggtcacggtgatggacggtgttaaccatcccatggatggggaaagcggggtgtttggctatctctcttttcgtgagaaagggacgggagaaattatgctctgtgttgaaaaagacgatccgcgtgaggccccggaatcaggggataaaaagccacaacctgcaatacggctagctgccatccag

SEQ ID NO: 24799 - DNA, 387 bp, Glycine max
  Peptide Sequence Number=SeqID_141577
atgttgtcagtggtaagaaatctggcaggtcagattcttgttacagacccaagaaaggaagaaggggtgtcaattaatccaacattcaacgtttctgttatatttggcaaacgggatgagccaatgttagtagcatgtgcacgccagatgattgagcacatgagtttgtctggctcctccaggccattggtgctctcacttggtcttaaagaccattctgtggagacattgaaaggcattgtttctgctgtgatggacaataacatgtgtaaattcaacagtgtattactgacgtttgcacttcagattatagaaagtgaagaggatagagaatgtttaaacaaagagctagtaggaaagtggagagaaacaaaaaattcaacttaa

SEQ ID NO: 24800 - DNA, 1044 bp, Glycine max
  Peptide Sequence Number=SeqID_141578
atgcaccaggagattataaaatatctcaatgaattatatgaaaaagaggatagccagagtctaacaaaggagaaaatatccaagagaattgagttgcaagaatccttttggaaggaccctagcaaagtcaagctggagataagaaatttctttttagaaagatttggggagaaggaaagaaatagactttatatagatagggtcaatttatctcaaatatcacttgaagagaagaaaaagttggaggctagatttgaggaggaggaaattaaagaagtggcatgggattgtgaaagctccaaaagtcctgggccaaatggtttctatttcaaattcatcacagctttcaggaacactttgaaaggagacatcattaaatttatacatgaattccacatgaatggtgttcttcctaaaggctgcaactcttcttttattgctttgattcccaagattgatgatccacaaaatcttggggattatagaccgatatctctagtcgattgcatgtataagattcttgctaaacttctagctagaagaatcaaaggtgccttgacaaaggtgattgataaaaggcaaagtgttttcctagaggggagaaacttattccatagtgtactggtggaaaacgagccagtggatgaagctagaagaagaaagaagaagtgtttggtgttcaaagttaactatgagaaagcatatgattcgatatcatgggatttcctgttttacatgttgcgaagattagggttgggtgtgaaatggatagggtggatcaaacaatgtttgactaaaacacacatctcaatcttagttaatggaagtcctatagatgaattttctccacagagagttttgagacaaggagatccattggcaccatttcttttcaccattgtagcggagggcttgtgtgacatgatgaaagaggcttttgcaaaagatttgtttcaaggattccttgttggtagggatggtattgagataaatcttttacaatatgttgatgatatattgttttctttggagtgctacatataa

SEQ ID NO: 24801 - DNA, 432 bp, Glycine max
  Peptide Sequence Number=SeqID_141579
atgggtaataataaccttcttgcaatggtatatggggatctccaggatgccctagaccttttgaatacgtccaagcaacataacacaaatgtcaagaaggctttggagaatgctattgagcaacagatggtggtgaagtggaatgtaggtgttttgcagttgtttgttggtaagaatgataaggtttggaggtgtgtaagccctataggtggtaatcctaagaagtactcaaaagagacatggaatgaaattaaaaagtccttaacaactccttttggaagattagccataatgggtactcagtgcaagtatgaagcaggtattttgattaagaatatgtgcttgaaaaatcatgctttaggtgatgtcctacagattttgaacataggtcatagcatgcctaatactacaaaaggcatgcagtggaaatga

SEQ ID NO: 24802 - DNA, 282 bp, Glycine max
  Peptide Sequence Number=SeqID_141580
atgaacgtatcgacgccaatagcctcaatgaagaccgcaagcccaccagttcacgagaaaggaaagagttgtgagagagaaagaaagaaaaatattttctttagtgtaggaagtactatcataatctcaaaaaaacttgacatcgaagggtccatagttgtttcgtatggtgcagaacctattccactcacgcatactagtcatggtcatatcaatttatccacattaacatcgaaggacatgactttcaaattgtttcgattttcatacgctggatactag

SEQ ID NO: 24803 - DNA, 1026 bp, Glycine max
  Peptide Sequence Number=SeqID_141581
atggcaataaagcttccatcttcggcacaccctactcgattcctcagatgggtttatctctcttcaagctgtattgcagatatttcagaaacccctggaattcttaagcccaaggattcatctgaattcgaccaaaacctcaactttttgaaaaataagcttgccccagataacttaatccgggttctggaccgtacaagcgatttgaactcggcagtgaggatattcaaatgggcttcaaggcagaagagttttcaccacacttccaacacttatttcaggataattttgaaactgggtatggccgggaaagttttggaaatgagggatttttgtgaatacatggttaaggataggtgcccgggtgctgaagaagctcttgtggcattggttcatacatttgtggggcatcgtaggattaaagaagctattgtagtcttagtgaatatgaatttgggtggttataggcccccaattgaagtttttaatgttttattgggcgctcttgtgggaggagagagtagagattttcaaagtgccttgtttgtttataaagagatggtgaaggcatgtgtgttacctacagttgacattttgaattatttgttggaggttttgttcgccaccaatcggaatgagttggctttacatcaatttagaagaatgaacaataaagggtgcgattcaaatagtaagacctttgagattcttgtaaagggtctcattgaaagtggtcgagtggatgaagctgctactgttttagagcaaatgctcaaacacaaatggaaaattaatgaggcaataatgtttttagaagatacacaagttcatgaaactgctcctttcaatagattgctcgaaggttgctgcaatgctagtgaggttctggcagcaaatgttctgcttgagacaatgtctgagagaaacatagctgattgccaatcttggaatattctcattagatggctttgtgaagagatgctcattctgaagatgccattgaagtgtttcactatatgtctgtaa

SEQ ID NO: 24804 - DNA, 162 bp, Glycine max
  Peptide Sequence Number=SeqID_141582
atgagtgaaggctatagacatgacgagaccaattatcatagactagattgtacaacagcaaaggtattggagaagtgtgaggcaagggcaatctggctcatgccttcaacccaaacatgggtccataggcacagaggcgagcgacactacacgagattatag

SEQ ID NO: 24805 - DNA, 528 bp, Glycine max
  Peptide Sequence Number=SeqID_141583
atgaagcacttcactgacaccctcatcagtgccaacatactacttgccgggttccctcccccctttatgccttctgctttcactccagccactagaccgaattggggttttttctcttgcgctccaatgtgtacccccgcttacgttcgacgactacgatcctgtgcttgttgccccgactttcctatactgccatatggactagctgcattacgaagtggagcgaccaactacccatgcgcgatcgggactacgaggttcaacatgcctactacttcatctactgggatgcaacagcccatgagcgtactagctgatgacctctatatacaactagctccagcaacaaggttcgaacccactactgcgccatcaggacggatgaggcactggctgttgttgctagcggcggtagtggatcgtcagacccttttctcttcttccgtagtgaagctagtcaaagtgcaatggggccagggctcggattctatatatatatatataggtagttcgggttgctatgcctaa

SEQ ID NO: 24806 - DNA, 414 bp, Glycine max
  Peptide Sequence Number=SeqID_141584
atgccactcgaagcaccagtgaggagagtagattgtattttttctagtcctatgaaaagggggaaagggaaaccaataaggacattggattggaagttgacacattacttgaggctgtggtttctgccatattattctgttatacaagtttttggttacattggagtgtcacttcttgcagatataagtgagttgaatctgccaaaatcttgtagcatgcagtttcccaatggcaaagatgacctgatgaactttaaagtttcaatccgacctgataaaggatattacaaaggtggcacatttttgtttaccttccaagtgtcccccatctatccacatgaggcgccgaaggttaaagtgcaagacaaaggtctaccatccaaatatagacttggaaggaaatgtttgccttaa

SEQ ID NO: 24807 - DNA, 699 bp, Glycine max
  Peptide Sequence Number=SeqID_141585
atgcactatgcacaacctgttgatgagatcaaagaatattatgactgtagatatgtttcagcatgtgaaggagcttggagaattttcgagtttgaccttcattacaagtggctgccagtgcagagattaatttttcaccttccaaatcagcaagctgtttatttcaatgactatgaagaaattgagtcatttgttgaaagacatgaacaggttcaaacaatgtttcttgcatggtttgaggcaaacaagaattttgttgtgggtagggatctaacatattcagaatttcccactaaatttgtctattgccaaaaagaaaaaatgtggcaaccaaggaagaaaggacaaagtattggcacgcttcagtacattccccctggcattggggaactttattacatgaggattttacttactatgcagaggggttgcacaggctacgattgcctgaagacagttagtggtgaaaagtataatactttccaggaggcatgttatgagttgggtttcctagcaaatgatagggagttcatagatgcaatcaatgaaggaagtgaattggcaactggtaatcaatttcgaaggctatttgttacattgttagccatgaatacaatgacaaaaccatctgatgtttggaacgaaacatgcgagttatattgtgtgatggaatattatatgacaagaggaagaaactaa

SEQ ID NO: 24808 - DNA, 393 bp, Glycine max
  Peptide Sequence Number=SeqID_141586
atggaggtgataaaagtgacgaggtacagtgaccatgactgtactatagcgagggcggcagagatgataattcattacctagcctcatgtttttttaagcttcaagaccttcttagaagcatttatggcagaaccaacaatattgcaagttttgatctagcactcccttggttaatattgcaagttgagtcatctttgataactaatggaatagagaaggttgagtgggcagttcatcctcgaggcagaagcagagaagcaaagccgcttaaggcaacattgaggacaattaacccctttgatcgcatgcctgcagataaagtcttccataaaaatgttttgctagtaccccatattcatataagaaaaaaaatctacctgattcagacatga

SEQ ID NO: 24809 - DNA, 193 bp, Glycine max
  Peptide Sequence Number=SeqID_141587
tctctcaacaccaagtggtctagtggacaatgatcgtagacgtgaggctttgcgtgtccgcatcacggcagacggcgaagctgatgcgtccaaagtaggaggaggaggaggaggaggaggaggaggaggagtggaggcagaaaacaaagaggggaacgagcaacaatttgaaggttgtacattcaggaactaa

SEQ ID NO: 24810 - DNA, 183 bp, Glycine max
  Peptide Sequence Number=SeqID_141588
aatgatgattttgctattaaaaatgaggatgttatgaagtttgcaattgacgagattaagaagaaaatagaaacattttcagaaactatggagagtttaagtgctcatgctgataaatgcagtcgccagatacggagagcgaggactgtggttgtacaaaatataatcaagaaaccagattga

SEQ ID NO: 24811 - DNA, 258 bp, Glycine max
  Peptide Sequence Number=SeqID_141589
atgatggggaggttggggaggggaaagagttggggtagcttaggaaatttcaatgtttttataccgggtgggagtgaacttagcaataaggattgtaggaatggcaaggaccttttaggttatcgggctttgctaaaagaatgttccgcctatcttttcgtttgggctagtgcatgcttctctgacttgaatgttgtacggctatatcagcatcatcatcatatatttgtgaccttaaataaaaagttcaaacaataa

SEQ ID NO: 24812 - DNA, 442 bp, Glycine max
  Peptide Sequence Number=SeqID_141590
gggagcgttccgccttagagggaaggacccgcgcgatcagttctggacgaagcggaagcgagaatgtcggcttgagtaacgcaaacgttgttgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 24813 - DNA, 1317 bp, Glycine max
  Peptide Sequence Number=SeqID_141591
atgagagttccctcatccccacaagctagcaacaaccatgtcctccacacaaacaacaaccctaacaccttcacctacgaacccacctcggtcctcgacctatgccggagcccaagccccgaaaagaagctcactgttcccaagccagaaccacaacacaacaaccagctagacctggatgatcatgttttgcctaattctgattggtgggagtccatcatgaaggacttaaccctacccgaagactctcccactccccttttgaaaaccaatccatcatgcatccctgatttcccaccttcttctcaagacccatcctttgatcaccccactcctgacttcacctctctctccgaaatctacaaccaaaacatccccttcaattacccctccaacactttagaaccttcctttcatgaccttaaccatagcctccacccccacaacaacaactgggacttcatcgaagagtttatccgcgccgccgattgctacgacagcagccacttccagctggctcaagccatacttgagcggctcaacaaccggcttcttcgctcgcccatgggtaagccgctccaccgagccgcgtttcacttcaaagacgcccttcagtccattctatccggttcgaaccggaacggaaacgagattgctgagaaggccggtcccggaaccgcgccgctccttcgcatcaccgccgtcgtgccggaggagtacgccgtcgagagccgcctggtccgccagaatctcaaccagttcgcgcaggatctagggatcagcgcgcaggtggacttcgtgccgcttcggacctttgagacggtgtcgttcaaggccgtgaggttcatcgacggcgagaagatcgccgtgttgttgtcgccaacgattttcagccgcctcggaggcaacggaggcagtgtcggcgcgttcctcgccgacgtgaggaggatggctccaggagtggtggtgttcgtggacggtgaggggtggacggaggcggcggcggcggcttcgttccggcgtggcgtggtgagcagtctggagttttattccatgatgctggagtcgctggacgcgtcagtggcttctgggggaggcggcgagtgggtgaggaggatcgagatgctgctgctgcggccgaagatcttcgccgcggtggaaggcgcacggcggaggactccgccgtggagggaggcgttttacggcgccggaatgaggccggtgcagttgagccagttcgcggattatcaggcagagtgtttgcttgccaaggtgcaaatcagaggcttccacgtggacaaacgacatgctgagctg

SEQ ID NO: 24814 - DNA, 363 bp, Glycine max
  Peptide Sequence Number=SeqID_141592
atggggaccaccacgggggaggagcttgccacccagctcgcccaggcgagctcagctcgcccaagcgagcaaggttgcttcctccagaagcaaccgccttctggaggaagaatctggaaggcccaagttacgaatccttatggatcatgtatttactccttttttatctttcgaagaagttacggaaactcacggattgagcaacaatacttccttttggttgccgttgcattatggaatttcacggatcgcgtaaccctgcttccttttgatttccggcgcgtctcgggacttacatattgtgcaacaaagggtgccgagtatcttgaagcggccaatcaaaggttgcacgtcatcaagtaa

SEQ ID NO: 24815 - DNA, 309 bp, Glycine max
  Peptide Sequence Number=SeqID_141593
atgacaaattccttagaaacaaggattcacgatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagttgcaggatccacgatgtcggatacgatgtccaggacatcttgcccgaaaatactggacatataaatctgttatatctttaacagattattgtgcagttagcaagagattagatgatctatctttaggaacgaattaa

SEQ ID NO: 24816 - DNA, 231 bp, Glycine max
  Peptide Sequence Number=SeqID_141594
atggaagttatggtcacacttgagcagaaccttcaacttcacgccatcaacgaacgcatcgagacaaatgcaacactatgtctcctccatcatgtggttctaccccgacaacaacctcaaggcaatggtggcagagcatttgaatcgccacacaatgctatgaacaatgaaaggatttacgggaacaccaaagtgggtttcatggaggaggaggtaaaaggagaagaataa

SEQ ID NO: 24817 - DNA, 864 bp, Glycine max
  Peptide Sequence Number=SeqID_141595
atgacgtccaaaaacaataccgggatcctaaggtttattccgacgaattgcaccaaaggtggcagaactggtgttggggaagaagacttgaagtggtggcattctcgccctgtaagtccacgaagtgcccgtgatgaaagaacatcacatgtaatggtgttggagcggtctgacatgagaaggtcggcgaggtgcaaagtttccgatgctaaatcacttgataaggagttcaaactaatttgggccaaatgggtcaggttcgagtcgggtgtgagggttgggtccggggtcgggtcaactagatctatattagggcaattgggatcttcgtcttcagcaaccagaaggaaagcttttagaggcgtagcaatgtcctctagggtggcgccagaaatggcagaagtggcgacggtgtcagcggtggagtccgcggcagaggcggtaatggagaaggacatccagttgggagtcgaggcagtgtgtagcggcatcaagtttggccaggacggcctcgaggcagtcctcgctagcaggagaaaagtcatggtgggttggcgattgttgtggatggtagtggttggggctgtaatggcatccatggaaggcagccatagaagctccgtacggcaagtgacagccatggaaggcaaccatgggagctccgtacggcgagtggcagccatggaagctccgtacagcgaggtcagcacctccaaaaacaaagaggaagaaggagaagataagctggtttcgaggttaccagtgcctcaagaggaagaagaaaagcaaagagcagagcaacatcgaatcttccatcctgcacacaacactcctgcacgatcttgctcaaacgaagtcactaag

SEQ ID NO: 24818 - DNA, 462 bp, Glycine max
  Peptide Sequence Number=SeqID_141596
atgaaattagcaaattactctcctctatgcttttcttcttcctctagaggcattggtaacctcaaaaccaacttatcttctccttcttcctctttgtttttggaggtgctaaccctcgaagtcagtaaccaagccagtgcacggagtagtaacctctggaattacgtattatgtgccagggttggtattgcaaagcaaaggaccggtattttcacagcctttaatcccctatgcatgatcattacttctgctttaggatccttcatatttgcagagcagcttcacctgggcagtatcattggagccatcattatcgcagtgggtctgtactctgtggtgtgtggcaaaggcaaaggcaaaggcaaagacaaaggcaaagactattcagaccccacgccaccatcacccactacaaagaaaacggagacacaacacctgccaattacctcatctgatatctaa

SEQ ID NO: 24819 - DNA, 382 bp, Glycine max
  Peptide Sequence Number=SeqID_141597
gccgccgtcccttgggacggacgtgtggggtgctaataccttccccgtgcgtaaatacaactcccgaacctttcacttaaaagttcgtagatcgcgtcttttccagtttttctggcgttttcctcaaataaacgttggtggcgactccgcgtgtattcctttcgtggaacacgcatcccgcgagtcacgcgtcgccctcccgccgaaggcgccagtcttctcgcttggcctaagggttaaatgcggtgcgcttagtgagttcacactcgctcaacgcctctgtgcagcacatccttcttctagattcttctgtgcgcttagccagaggatggtgcgcttagcggatggctggcccagcgagtggcctggctcagcgggttga

SEQ ID NO: 24820 - DNA, 285 bp, Glycine max
  Peptide Sequence Number=SeqID_141598
atggcttacaaggtcatcatgaaggatatgcaggtacaagatatacccaacaaacaaatacaaagaacaagtttaaaggagataattggcaagatatatcacgttagagattctacacaaagctggctactatgcattcttcacaatcaaacctcaactgcaaaaaatgcagatccttatacgaggaaggttctcggggcaaataactttaccagaggccacccaatagacatacatacacaaatttttttgcatctcctcatcaatgcacgcaccatggtttag

SEQ ID NO: 24821 - DNA, 1905 bp, Glycine max
  Peptide Sequence Number=SeqID_141599
atgtcgacccagaatcgtcgctcgtcgttttcctcctcaacgacgtcgtctttggccaaacgccatgcatccgcctcaacgacgtcgtctttggccgccgctcctacaaacatggccaagaagcggcctcctctctccaacctcaccaacaccgttgctcaccgcaactcttcctcttcggttccatgcgcagctaaatttgccaagaccaagaaagacgttgttccggcgtgttcagggaacaaaaggcccacattggcgaatgtgaaacccgctagcgcagttatttttccgaaggctaattctttccctgtaaagaatgaagctccaccaactcctcctcctccagttgccaccgttactgttccggctccggtggtggatgtttcacctagtaaatcagatacaatgtccgtttctacggatgagtcaatgtcctcttgtgactccttcaagagccctgacattgaatatgtggacaatagtgatgttgcagccgttgattcaattgagaggaaaacattcagccatctcaacatctctgattctacagaagggaacatatgtagtagagagatacttgttgagttggagaagggggacaaatttgtcaatgttgataataattacgcggatcctcagctctgtgcaacctttgcttgtgatatctacaagcaccttcgtgcatctgaggcaaagaaaaggccttccacagacttcatggagaaaattcagaaggagataaactccagcatgcgtgctatattgattgactggcttgtcgaggtggctgaagagtatagactagtacctgatacattgtatttgacagtaaactacattgatcggtatctatcagggaatgtgatgaacagacaaaggttacagttacttggtgttgcctccatgatgattgcctctaaatacgaggaaatttgtgcacctcaggtggaggaattttgttacataactgataacacatacttcaaagaagagatggaatctgctgtcctgaattttctcaagttcgaaatgacagccccaacagtaaaatgtttcttaagaagatttgttcgtgcagctcaaggagttgatgaggtcccttcgctacaactagagtgcttgacaaactatattgctgaattgtctctcatggagtacagtatgcttggttatgctccatcacttgtagccgcttcagcaattttcctggccaaattcatacttttcccttcaaagaaaccatggaattccacattacagcattacaccttgtaccagccttctgatctgtgtgtctgcgtaaaggatcttcaccgtctttgttgcaacagccctaattctaatttgcctgcaattagggagaaatacagtcagcacaagggcgttatccgggttggagattggctcagccgaaatacccgcatagtccgtagcaaacgcaatgttcttcccgtcggggctgaaacacgggtggttcgacttcttacccgacccgttttcaatcagtttcctcaacccggttccgttggggtggatcaggtagagctggtagtatgcagtacccggttggaggcaaaaacgatccagtcaccatccggtgaccagttgcacatggtgtcattccacgcaccctccgtcttcctctctccatcaaccgcatccattacgtacaaattctttgaacccgatcgatacgtataccaaatattctccgtcgggggtaacactgggcttgtctttcaagagagggatttggattctggctgggtgctccccaaggatgacgttgttctcaagcacccaagctcgattgtcagcggaatgctgcatttgtcgtccaacgtacttttctttagttacattcaggagctaccagttccacttgctacattcagggaatag

SEQ ID NO: 24822 - DNA, 378 bp, Glycine max
  Peptide Sequence Number=SeqID_141600
atggctgatatgccctttttggggaattgcaaagcaagatatgatggagttagcatcaaggagattgttactgggactcaggtggttatctctccaatgaccaatgttgttgtgtctggatgtgctatggaagattttgaggctagttggagtggaggtttccttgatggagccatcatctggagctactcaactaaaggggctacctttataaatatgagaattgcagaaaaattaccagactatgtggaaaggcacataacgaagaaagtgaagaaagaggtgattgagactcccctgtctaatgctgatcaaaccataggaactcaagctaatcctttggatcttgaatctagagcatcgtctcaaatgaagtag

SEQ ID NO: 24823 - DNA, 315 bp, Glycine max
  Peptide Sequence Number=SeqID_141601
atgatgaatgaaggtgaaagtggagtttggaagctcaacaaagtttctcttccattgacagacgtgcacccgggggatgcatcttcaagcatattctatgccttaggaatcataattggcttgtccactgctgattggaacttgttgtttggaggaagcttgccttgccctgatttcttctttagaatgattgaggcacatacacaactgatcttcaagctagatgtcttttgtgtcaaaggattccccaaacatagcatgattctagggaagcactacattgaaggtagcgatcaaaccaagaagttgatgtag

SEQ ID NO: 24824 - DNA, 342 bp, Glycine max
  Peptide Sequence Number=SeqID_141602
atggccatggaaatctacaatggccctcctccataccaagagtatgtcaaatttcttgagacaactcaactcagaacaagggaggcacttactgaagttcttcaggatatggctcatgttaaaagagaagccaaaacatgcaaaatccttggagagcacctctttaggaagtatgttgatgctttctttggtagctcatttgatgatgaatctagagatgagttctttcgcaagcttgaagaggaagaagaagttatcaaaaaaagggggagaaaaagtaaaaagatgaagaatgcaaccatagcaaaagatgcacaagctaagggggagcacatcatctga

SEQ ID NO: 24825 - DNA, 714 bp, Glycine max
  Peptide Sequence Number=SeqID_141603
gaagtcgaaagagttcttcgtttgcatttttctggaaaacgcgatgatctcgctaagcgcatctgatgcgctaagcgagttcatcaatgttgctcatgctaagcgccgcccccatgggctaagcgctattccttgcggcatgcataaggctaagccagcgctgctcgctaagccattggttgaaataatagtgctctgggctaagcgaatggcatccaggaagagaaagagcactgcttctagacctgcagctcaatatgataccaggcgattccaatctttggaagcttggaataaatacacggacaacattgtcggccaaaatatccttccggagagaaatgttaagatttatcatacgaagtttgatgagttcaaagtggagttggagaggcgtaatctacacgaacgcctcaccaacctctcggatggaagcataaatgtggctgtggttaaggaattctatgctaatttatacaccatagaggaccaagctccaaagcaagctagagtaagaggacacctgatcaaaatagatgcagacagcctgaatgagtttcttcagactacagtggtattagaggaggggaatctttacccacctactctagattttgcaggatctgactacactagcccagacatagagtgtcttctcttacacaacttagctcccacatcccacacctcagatttgaacatggataaagccag

SEQ ID NO: 24826 - DNA, 306 bp, Glycine max
  Peptide Sequence Number=SeqID_141604
atggttgaaacacctacaatgccacaaccaaatgaagatagagttcatagtaatgattccatatgtgacatggttaatgatgcatttaggccttatcctgataacaatgatatggaggaagacaaagatatgtctccaaaagcaagccaaacaatgctagatgatattacagagcttttggagttaatgaaggatggagaacaaagtttgtatgaatggctgctggatccttttaacttcctaaacatggctatttatagaaaagagccaagaggtgctgagaaattcgcccaggcaaatttgtga

SEQ ID NO: 24827 - DNA, 240 bp, Glycine max
  Peptide Sequence Number=SeqID_141605
atggcatcggaggacatggaaaagacaacctttgtcaccctatcgggaacgttctgctacaaagtgatgtcctttggacttaagaatgctgggacaacttaccaacaggctatggtagcattattccacgacaagatgcataaagaaattgaggtctacgtggatgatatgatagccaagtcaaagttgaggaggatcacctcgtcaacttacagaagttgttcaagaggctgctgctag

SEQ ID NO: 24828 - DNA, 318 bp, Glycine max
  Peptide Sequence Number=SeqID_141606
atggtattcgcctcttgtttgtattcatctcctttttctttgaaccacatcccctataatcaacagttgatgcctccattcatcttcgacctcccaaccatcacacaccatcaaattttgcacgatcatcaccatccaaacacatcgcatctgcatgctaccaccattgacaccacaaccatcgaaacactatcgcaaccacgtgccactactgaaatgatgccagatctgtttggcaagcaaaattggaagttaatcctagattctcacaaagatatatttgatgagagaactgaagttgatttgaaggacgagtga

SEQ ID NO: 24829 - DNA, 173 bp, Glycine max
  Peptide Sequence Number=SeqID_141607
caccagtcctctcgcttggcctaagggttaaaggcggtgcgctaagcgagttcacactcgctcagcgcctctgtgcagctcatccttcttctagattcttctgtgcgcttagccagaggatggtgcgcttagcggatggctggcccagcgagtggcctggctcagcgggttga

SEQ ID NO: 24830 - DNA, 207 bp, Glycine max
  Peptide Sequence Number=SeqID_141608
atgggatctaaggttgagaatgtcggttgcttccttatatttctgcgtgtgagagacttcaacatgaacaagaaggcctgtgctatcttaaaagctgtggcaaattttggggctaatttgtgtcttgtggctgcatcggcttgggctgtgcaggttttctttgtggacatgctagacattgtaaatgataatgttgctattccatag

SEQ ID NO: 24831 - DNA, 1428 bp, Glycine max
  Peptide Sequence Number=SeqID_141609
atggacgagttcggcgttttgaccgaaaggttcggtctcaaaccacaaggaaaatccgctccaatggctagggcaaagcgacctccgaatgtcgctgattcccaaacacgccccaattccaaatccccccttaacggatccccgtctcaccaaaactccaccttcgatttcgattacggctttttcagcagcagcaacaacagcaacaccgacaacaaaacgcagcgtttcgacgacatctttggcgtagacgccaaatccaatggcgcttcgttcgactacgattccatattctccggatcgaacaaaccggtttccgcgtcatcttatgtggatgacatattcggtggaatgcatgagaagagtgtcggcgttgatgatctgcttgataagattggcgggttaaacaccaacgctaagagtccaaacacaaaaacacctgcttttgattatttgatccctggctttggtgtttcaaataatggtgttgagatgaacaagcaaagtgttactccaaacaagcctgctgcggcggcgtctcaggatgatccgtttttgatatttgaaactgcttcaagctcggcatcttcagaatcattcctgaacgcgctggagcagattagtaggtcgaataattctaaggggacaaaaggagggtccccatcattgaagtctccacccaagccaatgagtaaagttaataggccgagtgtatcaacaatagatgagcttgaggactttgccatgggtggggcacagactaatgctagtagtagaaaggccaatgttaacgccgctgagactaaacaaaacttggcggctaggatgaacaatggtaaaagagttccagctgcgagagtgaatcaggcaaatggcgtggatgatcttgaatcctttttcagcatgggctctcgatcaagcagcgtgccaaagtcaaggactccaactatggatcatatgtatgataaccaaatgaagaacaaagagagacctgaggtgtcaccaagagtgccatctagatcctcagcaagcgtgaataaatctccagtgatgacatcccttgatgacctgtcattgatgttcggtggttccccatcatctgaattccaggaggttgaaggggaaactgaagaaagacgaaaagcaagattaggacgtcatcagagagcacaagagcgagcgttaaaagcagtgaatgatatgaaccagcgtgaccttcaaactaagatggagcaagaagagaggcggaaaattgctgatactgcagatgttcagataaagcgctgggctgcagggaaagaaggcaatatgcgggcattgctatcaacattacaatatgtattgctcttttacaattattactatcaattgataatacttcatttcactctagggcttttgaatatacctcttttgtcctgtaattga

SEQ ID NO: 24832 - DNA, 486 bp, Glycine max
  Peptide Sequence Number=SeqID_141610
atgggacactggaaattggggggaaacagcttggcaacacggttcactgttggaaaggatgctggagaagtaggtctttgcttagaagcaggggctagggttccacgtcgggggtgcacggatgtgagggaaagcagtcatctgcaacagcaaggtgtgacactatgggattctggggagcagggtcttcccgtgacatgttgtaatggcagtacagtgctgcctgccattgcacacaatcgactaatatggggaaaacagagaaatagtgttctttggccagaatgtggttggcagccagtttctctgacagatatgattacctcttcggcagttaaaaaagtttatagaaaagcaaatttatgtattcacccagataaagtccagcagaaaggggctactcttgaacagaaatacacagcggagaaggtttttgacattcttaaggaagcttacaccaagttcaatgcggaagagctttcttag

SEQ ID NO: 24833 - DNA, 465 bp, Glycine max
  Peptide Sequence Number=SeqID_141611
atgaagccagaagatttttggaagactgagaaaaaccctattttttatcactttgtagtctgtagttattggttaatgttcatatatattgattccctggtcactcatttatatgatccttctaccttgagaaaaacaaagaatcttttgtttaaactagtgctagatggactgagtcttcttttgattatcttttactcatataatacttccaagaattccatcaaagctaaatctttcaagttcattggaaattttcaggaaacaattggtgcaagaactggttggggagctgtcattgttgcagaagctgttgctctgattgctgcaagcactgtccaccgagtttgcatcactacatgtttcctgttctcggctgcattgctgtatgaggttaacaagatctctgggtcagcgctttcaacaagtgactccaggactaaaaagcaaagtggaagagcttaa

SEQ ID NO: 24834 - DNA, 252 bp, Glycine max
  Peptide Sequence Number=SeqID_141612
atgaggggagacattgttggccataacaagattccttccaaaatgaaaacattactcaaagaatcccacctgaagaagacaaatttgatcaagcctcatgaaaaggaggaggaggaagagagtgttgaagcatctgcttatgtgaagaccagagaaaagttatttaagctattaggtagtcttgtggaggaggttggagaaatcgaggttgtgcaagtggttactgacaatggaaataattgtttcagataa

SEQ ID NO: 24835 - DNA, 1095 bp, Glycine max
  Peptide Sequence Number=SeqID_141613
atgttgtccacactcataaacagtattttgaccacattgaatggatacactggtcacgtgatgacatttgaggttggtgcagtgcttgaggatgcaaattggcaggctccagtgaattgttttgatgagaatgacaaggaaaagaatatccctattttgggatctgctgttcgtggtggttctcttgggagttatgacataggctctgccacttgggcagaccttaggaaagcacccctccaaagtgcaatggaagtcacttacatttgtgtccactttgttttaaaagaacttgtgcggaagtcaatttcagaaactgaggtcagcaatgtttcagcaatgtcccagcaatcttcagcattggaatctggaagctttcattctcctgttgatgaaaagttgattttgaagtttgtggttgaagagatgatgattggtcacacagatcacatatcggagtcaagatcattgaaggatcaaatacttggctactctgggtctgaattaagtgatgatgaagaggaagattgtttggaacagatactatactcaacatcctttgaagagctggcaagcaattacgttaaatatgacacggtcatatggcttgctatatcattacttctagttttagcttggagaattggccttcttatgttgctttacctgcccatcaggagatatgtgcttcaaaaggatttgtcttcttgcatattatatgttacatgtatcgaagtagtttacaaggtatcaagaccttcatttataccattttgggggactgtaacaattgagaggcgtgtacctctttctctggtcattgatattatcattgaacaagattttctcaattctttgtccaagttgcctgcagtctatatatggggttcctttaatgttataccctttaatgttatactgctaagtactaacaaagggtatgtcatcatcttaaaagctacaattggtttgcagatgattgtaacagaggcttcaaagatcacacaagatgtgagtacaagtgggaagcatgctgatccaagcacagatgaggaaaacatatgccaggagcaactgagggatcagttgttttga

SEQ ID NO: 24836 - DNA, 741 bp, Glycine max
  Peptide Sequence Number=SeqID_141614
atggacagagcgaggttagtctacgggcttgtgatgaagatggatatggacttgggctcgctcctttcaggccagatatcagagatggcccagtccaactcctctcgactaggcttccctgcaatcattatagctttgtgcatagccagaggagtagtatcttattctctgacttttgagtccttgagccctgccattaatttggcatatattagaaagaattgttggaacctggatgatcccacgatcacatttccggggacccgcaagactcgagctcgaggacctgaggcttcttcttctgcttctccagctccagcttcttctactccagctccatcgccaccagtcccagcaccctccggcacctctgctcaaagctcaaacgtcgtggtgctgatgctacagagccttcaccatggcttatgcatgcatggaggcatttatggcccaagtgacctggccaggagtccagccttctccttcgggggaggtgaggctcctacagcccaggagccgcagccaaagccggaagtgacgcccgaggccactctagaggtcacaccacttatggaggttacagaggatgaggatggcactacagacacagattatgcagctgacatggcagcagcgcagagcacttgggatccctggcccactacagcacaggatacacctcagccagcccaggatgctccttcctcaccttatgacgatcatacaccggcacaggattga

SEQ ID NO: 24837 - DNA, 225 bp, Glycine max
  Peptide Sequence Number=SeqID_141615
atgaaaacgctctttacagtgcaatacggcaagcttctcttcacgaaaaacaggaatagcaaaaaacaaggaaagaataagagaagtgaagaaatagaaaaacaaaggagcatacctcagatcggaagcagcggtttcagttcagatctcgagcaacacgcgatcgtcgttttaataaacgcacgagtcaaataccggagggcaatttgggaatccaatccttga

SEQ ID NO: 24838 - DNA, 297 bp, Glycine max
  Peptide Sequence Number=SeqID_141616
atggctaacattcaaaacaatactccctacatcttcctaaaggctcattccactgtcctccctgatccaaacttctccttaaaccttcaatcaaaacccacaaactctttcttccaaaacttggtcctcaaatatggtgaccaacctgaatacatgcatccttatctcattggatcctttaactcttccctctctatatcatacccttctcaccatgccacttcttctgtcatttaccaaccatacaagtatgatatcacaatatcatccaagcaaggttccaaagggaggcaatga

SEQ ID NO: 24839 - DNA, 105 bp, Glycine max
  Peptide Sequence Number=SeqID_141617
atgattagacttaacggaggtggcacccttatgcctcgtgttcaatcaagaaatatggaccaagggataaaggctacaagtgcaaatggttatgcaaaaatgtga

SEQ ID NO: 24840 - DNA, 1002 bp, Glycine max
  Peptide Sequence Number=SeqID_141618
atggtgtgtgagaggcaaagatgtaattttttggaccagtttggtgaattgggaaatgggtttgttggtgtaagtgaaggtggtttggagttggataaaggtgggatttttagttttttaatgattgggaagggtatatgtgaagctgtgcttgctttccatctggagggtttggttgctggctgtttggggctttcttgtttctcttttgatgagcttggtggaatttgtgttgatttgaatgaggcattgatgatgggaaggaagtttgtgaatgctgtttccactaaacacgaagaagaagcaacgtgtaaggattgcttggaaaatgaggtttttgcaagccctgaggttttgtatgaattattgctcaagaggggcacttctctggatagtgggcattcgagatatccaattggatatggctcggatgtatggtcattggcttgtgtacttctgcggcttcttattggaagtgcgctgcctcggaataccttaaaaatgaaggaagagaatgacggtgatatctcagctagttacgtgtgttgggtggagaaagttagttctgttatggaagacaaactaggctctgaatatctgtcactgaggaagattctttgtaaatgtttggatgttaatccaggaaacctcaatttggtggatgtaaggaaatgcattcaggatatgctagtcaaacttcaatttgattttctgggcaacttgataagtagggacagcacttgtcactgcttggttctaggggagttgtgtttgttgcctaagcaaagttctaatggaccgattgaacatgagttgcaggagaaagaaagtgacagtcaaccaaattttcttcaaaatggcaaagacaaatctgatgaatttgctgctggctcacctaagggaatgactgaacacaaagatctgcggggaaaaataaaagaattacccctaaaaggatcgtttcccaaaaagaagatgaagcaattgtaccgagtgagttga

SEQ ID NO: 24841 - DNA, 972 bp, Glycine max
  Peptide Sequence Number=SeqID_141619
atggccaagcatatcatgagcatggatccaggggatatagagacagagcatctaaagaaggagtacgtcactttcatgaaaggggtggtatccgcgccattaaatttacctggaactgcataccgaaaggcattgaagtctaggtccattatactaaagttcatagaggggaaaatggaagagagagttagaagaatccaagaggggaatgagagtttggaggaagatgatcttctaaattgggttttgaagaattcaaatctttcaaccgagcaaattcttgacttgattctcagcttgctcttcgctggccatgaaacttcgtcggtagccatagctctagccatttacttcttacccggttgtcctcaagctatacaacagttaaaggaagaacacagagaaattgccagagccaaaaagcaagcaggggaagttgaactcacttgggatgactacaaacgaatggaatttactcattgtgttgtgaacgagacacttaggttgggaaatgttgtgaggtttctccacaggaaggctgtgaaagatgttaactataaaggttatgacattccatgtgggtggaaagtcctcccggtgattgcagccgtgcatctggatccttcactttttgaccaacctcaacacttcaatccatggagatggcagaaaaacgtaggacatgctagatatagatatgctagttttttggtgatggtaagaaatcattgtccggaatggcgaataatcaaaggatgtggcctacatgcacaatggaggatcaagtgggtccattcccatgcatctcaaacagtggcgagtgaaaatcttcatcgtttaagggtagtgacaagtttcacgaataggaaggtgataaggggtgaaagcgtggtggtaagagttggggtagtgccagccaccaagtatgtgtttgagaagcagttgaatttaaccttaatggactttcagtaa

SEQ ID NO: 24842 - DNA, 327 bp, Glycine max
  Peptide Sequence Number=SeqID_141620
atggcaaaaacaaaactgcaggtccatccaaacgttccctgcatgctgtttaccccaatctgtccacattcactctcatttagaccagttatacttccagattctgctcaacttgaattaaagattccagaggatgcaagaagcaacgcctgggtttcatttgatggaaagagaagacagcaactttcaagaggagattcagtacgaatatctatgagtcagcatccacttccaacagttaacaagtttgaccaaactggtgattggtttcatagcttgattcgctgcctaaattggaatgaaaggcttgatcaaaaggccctataa

SEQ ID NO: 24843 - DNA, 1620 bp, Glycine max
  Peptide Sequence Number=SeqID_141621
atgtggcggtgcatcgcacgtggtctccgtggacctgcttccaccagatccacctccaatcactcacttggatctcaactttctagattcttctctagtggggcgaactcctcgtacaccgtggtggatcatacttatgatgctgttgtcgtaggagctggtggcgcgggattgagagctgctattggactttcagaacacgggttcaatactgcttgtattaccaagctcttcccaactcgttcacacactgttgcagctcagggtggtataaatgctgctttgggaaatatgactgaagatgactggaggtggcacatgtatgacactgtcaagggaagtgattggctagctctatggcctacaggagaccaggatgccatccaatatatgtgtagggaagcaccaaaagcagtcattgagctagagaattacggattaccattttcccgaacagaggatggaaaaatatatcaacgtgcatttggcggtcaaagcttaaactatggaaaaggtggtcaagcttaccgatgtgcatgtgctgctgatcgaactggacatgctttattgcacactctctatggccaagctatgagacataatacccagttttttgtggaatattttgcattggatcttgtaatgaatagtgatggcacttgccaaggagtgattgccttgaatatggaggatggaacactacatcgtttcaaagctgcttcaacaattttggccacaggggtgagatcttctattctgcttcagggttatggtagagcatacttctctgcaacctcagcacatacttgcactggagatggcaatgccatggttgcacgtgctgggatccctcttgaggatttggagtttgtacaatttcacccaacaggtatatatggagcaggttgccttatcacagaaggatctcgtggtgaaggtggaattcttaggaatagtgagggtgagcgatttatggaacgatatgcccctactgcaaaggatcttgcatcaagagatgtagtttcaagagcaatgacgatggagattcgggaaggtcgtggtgtaggacccctgaaagatcacatctatctccacttgaatcacttacccccagatgtgctcaaagagagacttcctggcatctctgaaactgctgctatttttgctggtgtggatgttacaaaggaacccattcctgttttgccaactgtacattataacatgggcggtattcccacaaaccattatggagaggtggttaccattaaaggtgacaatccagatgcagtggttcctggattgatggctgccggggaaacggcctgtgcatcagtccatggtgccaataggcttggtgcaaattcacttctggatatcgttgtttttggtagagcttgtgctaatagagttgcagaaatccgtagaccaggcaagattcttttccagagagaagcaaaagcctctagagaaggatgctggtcagagaacaattgcatggctggacaaattgagaaattcaaatggttcattgccaacttcgcaaattcggttgaatatgcaacgagtaatgcaaaccaatgctgctgtgttccgtacacaagaaacattagaagaaggtaa

SEQ ID NO: 24844 - DNA, 1971 bp, Glycine max
  Peptide Sequence Number=SeqID_141622
atgaccacattagggagtttgaattccattcagtcccatgctccatcacggttgccatggactggtccagttccaggtgatattgctgaagtggaggcatattgtaggatctttaggagttctgagaggcttcattctgcgttaatggatgccttgtgtaaccctctcactggtgaatgcagtgtttcctacgaggttctctcggatgagaaaccgcttctagaggataaaatagtatctgtccttggatgcattgtggcccttgtgaatggtgggaggcaggatgttctttctggaaggtcttcaattgggactccctttcgttcgacagaggttggcatgatggaggatacgctccccccacttgcccttttcagaagtgagatgaagaagtgttgtgagagcttgcatgttgctcttgagaactattttattcccggtgatgatcggagcttggatgtgtggaggaaacttcagagactgaagaatgtgtgctatgattctggctttcctcgcggggaggattatccgtctcctgagatctttgcgaattggagtcctgtgtatttattcacttcaaaagaggacatggactccaaagaatctgaagcagctttttgcatgggcgggcaggtaacagaggaaggcctaaagtggttactggataaaggatataaaactatcatagatctcagagaagaggatgtaaaagataacttctatcaagcagctgtgtgtgatgctatttcatctggaagtatcaagttggtcagaatccctgttaaagttaggactgcacctacgatggaacaggttgagaggtttgcatcatatgtttcagattgcagcaaaagaccaatgtatcttcatagtaaggagggagtttggagaacatctgccatggtctccagatggaggcagtacatgactcgccctgcatcacagtttttttctaatcaagcagttatttccaatgacatgtcatcatattatacaattggatctggaaagctgcaggactcaatgattgccgagggatcctccctggaaaaagatactaatttgctgcaagagggtttgggtgcaacacatggttctgctagcagatttgactcatgttcctctttaaagaagaataatgaaaaaacacaaagtaatggagccttaagtgaacttagtcctgatgatattgcttcatcacaagccactgctgctactggggaaggatcttttccaattttctccagaaaaactcgccctttagaagctcaagttcctccttttgatatcttttccaaaaaagagatgtccaaatttttgggaagtagacagattccaaagccctcacatttcagtcatcagggtaaaagattggaaggcctgccagattcgaggaatcctgaacctaaacttgtggatcctgaaaaaagttccaatgggtcagctcatgtggattatccatctggtagcaattggaagttagtaaatttgaataattccagttctgttaggacaacagttaatggatttagtgaaggggaaatgtattacaggagtgatgccaatttctctaccattgtgaacaatgatattgataatgtcaatactaactctcaaaggattggagttaataaggataaggctgggttagccttatctgatgaagacttggggctcattgaaggggacatgtgtgcctcatcaacgggggtggtaagggtgcagtcaagaaagaaagcagagatgttcttagtacgaacagatggattttcttgtgccagagagagggtgagtgaatcctcattggcctttactcatcctagcacccagcaacagatgcttatgtggaaaactacgccaaagactgtgttactgttgaaaaagccaggagagcatctcatggaagaagctagagagggacaagtcctgttgtggggaggggagaggcatttagataagggctcaggctag

SEQ ID NO: 24845 - DNA, 375 bp, Glycine max
  Peptide Sequence Number=SeqID_141623
atgggagaagcttccatgatgtccaaggtgaaggaccgcagtttaatctggaactctgacttgattgagactattgaattggaaaatcttttgataaatgcatgcatcacaatgtactctgctgaagctaggaaagagagtagaggagctcatgcccgtgaagacttcaaggttagagatgatggaagctggatgaaacacactgtggggcacttaagtagtagagttgaagtggagctttttatttctagtaggaaccttgatccttttagattctgggagaacgagaaagtccggttggactacaggccagtgcatttgaatgtattggatgatgaggttgaatcattccctcccaaggctcgggtgtattaa

SEQ ID NO: 24846 - DNA, 228 bp, Glycine max
  Peptide Sequence Number=SeqID_141624
atggaggagaaagagttggaaagttgggcggtgacgaggtgtgtgttcctccgcaattggaagcggaaagccaacactctggcgttgccagaaaacacagacacgaagagactgcgtgccaacatgggacctcaccaacacaaagaaaagaaggacctcgttgggaatgttgatcgtttggatttggatttggatttggatgccaaggaatggaggaacccgacatga

SEQ ID NO: 24847 - DNA, 501 bp, Glycine max
  Peptide Sequence Number=SeqID_141625
atgaatgtttttgtggaacctgatgcgcatgatatatttgctagaattcctgggtttggatttgttcagaccttctatactcaggatacatgtgatctacacgagaaagttgattttgtagcatgtttggggggagatggtgttatactgcatgcttcaaatctgttcagaaatgctattccccctgttgtgtcatttaaccttggttcccttggttttctgacttctcataattttgaagactacaagcaggacttacaacaagttatccatggtaatagtacaagagatggagtgtacatcactctcagaatgcgtctccgatgtgaaatttttcgtaagggtaaagctgtaccagggaaagtacaaggtgatggagtcattgtggccacccctactggaagcactgcctattctacagctgctggaggttccatggaatatggccaatatactccttgtaagacttgggcaatccttccctcacgagctaacttttga

SEQ ID NO: 24848 - DNA, 111 bp, Glycine max
  Peptide Sequence Number=SeqID_141626
atgacgcgctggcttccaggttccaacaattcaacgttgcgtggtccttacgcacaaagtcgcgtcgcattgcgttatcgacttatcgttatctcaaagacaaatagataa

SEQ ID NO: 24849 - DNA, 2175 bp, Glycine max
  Peptide Sequence Number=SeqID_141627
atggcggaggagaagagggcgccgtcgtcgttcgtgaagaaaggcgaccggcaaatgttcacggtggagctctggccaggtgagaccaccatagtttcgtggaagaagctgttgaaggacgctaacaagcacaacggatccacttcggcgccacaacacgtcgcaatcgctccgggtcaacctgtggaggttgaagaaacagatccttctcagccaaaccgtttcagtgctgtaatagagaagattgagcgcctttacacgggtaaggacagtagtgatgatgaggatctgcttgatgttcctgatgatgatcagtatgatactgaagactcttttatagatgatgctgaactggatgaatattttgaggttgataattctgcaatcaaacatgatgggttctttgtaaatagggggaaattggaacgcataaatgaacctcctgtactacctaatcagcaaccaaagaaaaggcgcagaaaagatatattgaagaatgctggtgaaaacaatgatggtcatggatcaaataaaaatgtaaaagttggcaggccagcatctgccaaaacagcttcactacaggcaaagaatatgttaaatttatctgagaatttggttgcacctggtgaccatattgaagacttgaaacttccaaatcaatcggatgtctctggaattatttcgaaaaagaaaactgctgatactaaaccaatattgaacccttctgtctctttgaaaacatcaagtgatgatgctcctgctgtaacagatgcaaaagatgttgacaagcagaagataggagcttttcaatctaagaacattagtgataaatatatagatggaagtggatcgtttgatgcatctcatcataaatacaatgaaaaaagtgcatatgctcattccaaatcccaacctggaagaccctcaagtaatattgatgatatcaattggacaaaagaaaaaaatggtatgcgtgaactgccagatcttaacttgtctgagggaaagtctgctacccaagcaacaaagtctgaaaacatgcacaagaaagagggttctagtgttaggccaaaaacttcaatgcttgaaaaggctcttcgtgagttggaaaaaatggttgcagaatctaggccaccagcagtggataaccaagaggctgatgctacatcccaggcagtcaaaaggaggttgcctagagaaataaagctaaagcttgctaaagttgctagactagcggcaacgcacgggaaagtatcaaaagagttaattaaccgtcttatgagtattcttgggcatctgattcagctaagaacattaaagagaaacttaaaaataatgatcaatatgggtctgtcagcaaagcaggaggaggataataggtttcaacagataaagaaggaagttgttgatttgattaagatgcaggccccaactctggaatccaagcagcagctgaaaggtgaagcatctggtgattttcaagaatttggtactgatggaaaaccaataactaaaaggaagtttactatggatgctgcattggaggacaagatttgtgatctctacgatctttttgtagatgggttggatgaaaatgccggtccacagattagaaagttgtatgctgaggtgcttgcacagttatggcccagtggttacatggacaaccatgggatcaaacgtggaatttgcagggcgaaagagaggcgcagagcactatacaacaaacataaggatcaggagaaaattaagaggaaaaagttgctggcacctaagcaacaggagaacgttcgatttgatactaatacaattacttcacagcagaacctacgagagagatcagctccagagtctagcagtcatgcttatacttcagggaacaagcaagtttctaatacaagcaccccaagtccaatgaatggtctaaaacaagaaaaagcaaagggaagttcaagcagttccgtggatgatgtcagggttgcagatggtgttttgacaaagaaggtaaagagaaaaccagaacttgagttggaaggagcacatttaggtcctgagaaagtagcttccttgcagggagaagaaagacccaggtccctaaagcagtctacagggccacttcccaccaaatcaaatcttcagccaacatctctgcctgatcttgaacagtcaagctaa

SEQ ID NO: 24850 - DNA, 189 bp, Glycine max
  Peptide Sequence Number=SeqID_141628
atgaggagggaagtagtgcttcagtttaactctgagacaaagaccaataaccgtggccatgctacagtgctgtacggtcggcgtaaaaagaacactgagctgttccaaggaataaggatgttcgggatcccgaatatccctcacgaaatttgtcaaagccaagtcaaggatctcaacaagttcaagtaa

SEQ ID NO: 24851 - DNA, 375 bp, Glycine max
  Peptide Sequence Number=SeqID_141629
atgaagttatttgctcccctgggtgagctaccttcatcccaaatgccttgttttgctataaataggcgtgaagggaggttgagaatgaggtcccaaggtccagaggtcctgagagaagaagaaagaagagaaaaagaagctaaaatgtcgtcgaatcgtgactgcaatcaatttctacatcattctttggtcgttcttcaattgttcttcgttcttcatccgattagtgcttgctttaaggatttgaatttgatttatggacccttaggggtcctctctattgttttgtgcatcttcatctccttcttcgattatcggtatttgcttttccttaataaagttgtcgtcccttgtgacgggcgcgtggggtgctaa

SEQ ID NO: 24852 - DNA, 639 bp, Glycine max
  Peptide Sequence Number=SeqID_141630
atgaatcatcaacttatcgaagaccatatgatgctcttcccttggctatgccctggtggtgcattcactgaagtaactcctcaacaaggggaaaataataagccaaggcacaagcgaaatagaaagaatagaggaggagaaaatggcaccatcatcaccaagaagagaaagctcaccgtagagcaaattagtcttcttgagcgaaattttagcaatgaacataaacttgagtctgaaaggaaggaccagctcgcattggagcttagtttggaccctcgacaagttgcggtgtggtttcaaaatagacgttctcgttggaagactcaaaaattggaggaagagtactccaatcttaagaatgttcatgaaaccactatgctcgacaaatgtcatcttgagaatgaggtgttgaagctcaaggagcagcttttggaaacaaagaaggagattgagcagctactagagcgtggtgaaaaagccccaagcaacaactccagttcctcacagtcaatggaagaagctgtgaacccaccatttcttggagagtttagggtggaagaatatgatgatggtgatgtgttctacattccagagactcatcacatcaatgggatggaatggattaatctgtacaattga

SEQ ID NO: 24853 - DNA, 318 bp, Glycine max
  Peptide Sequence Number=SeqID_141631
atggcgttggaggggaggggggggggaggtgtggaggtcggaccaagagaggacctaaaggaggacgtgatagcgaaggacgttagcgagggcagtggggaagaggtgatcgtcgacaacgaggtaagcattggggacaacaagaatggaaaaggaagagtggttcgagagatccacgacgaggtgggtgatagaggcgaggagggagatgaattgggagagcttcgacatggtggagaggagggcggtgagattgttaatgtttggagaggaaggtttagagaaagaagtccatatggaaaaagaaaaaaagtgtga

SEQ ID NO: 24854 - DNA, 204 bp, Glycine max
  Peptide Sequence Number=SeqID_141632
atgtcggctgaaaaatataagttgggggctacttcacgaccgatgtcggctagaaatgctcgatcggagtcatccgatgatgcctcttattcagacctcgatcggtcatctttcctggccgacgtcgactgtcattttttaagatcaatatcggtgaataatatttttttgccgagatgggctaatgttttcctggtcgaataa

SEQ ID NO: 24855 - DNA, 600 bp, Glycine max
  Peptide Sequence Number=SeqID_141633
atgttaggaaaaccaaaaagaggcctgcgaattttgaaaataagggtttgggagttgtttacgcatagggaagaaaaaaggcatttggggaaggggcaactcgcccaggcgagctggttgtttaaggataaaggtatttcacagcccagatatgagcgatccctcgaccttgtgttccaactgatgtcgatcaataaaagcattccccagacgaaattagggtctgacaggtcccatattagaccccactcccagagaagaaaaaatgatagaaggtctcaaaaagttagcattagtctcccatatttgcatggaaaagataatgttgaaggctacctagattgggaaataaagagagaaaagttccattggctacccttagcttctaagggtctgccctctattggtggacttcccttgttagggaaagaagtattcacggggatcctgatgcaatcctaccccccaatggcattggatagaagactccaagaagattgggccaaagatgaaagagaaggccatagggttctcatgagccttacggtaaatttggacccatgggctaagtatgagcccaattatctttgtatatattag

SEQ ID NO: 24856 - DNA, 537 bp, Glycine max
  Peptide Sequence Number=SeqID_141634
atgtcatctttagaaatgcaaaccatcttagcaagtatagaagcaagcaattgggaatccaaaacatgtgaacacttcaacaacattgcaatatccaacgccccagagaatggcagaactgatggcttgggtctttactggatgaacagaaaggcaattttggtaccagttccacaccttcatcatcttttcgttccaccaacgcttcttctttgtggttcatcttcttcgttgcttcctcatcttcgtggttcctggttcatgcttgttcttcttcttcgttggttcatcttctcccagataatagttagagctagaggtttcagacagactttaggccgagcaataggaaaagccctggggaagagagaggctagtgatgatgataatgatgtctccagcagcgaaggcttaccacatctacccatagagcagcaacaaccacctgttgaagaaggtgttactgatgttgaggattttccaggtggaccccatgacacatcagttttgagagattttgaaaatcaattgctttga

SEQ ID NO: 24857 - DNA, 498 bp, Glycine max
  Peptide Sequence Number=SeqID_141635
tcgtttctgcgagcgaccgatgtagaaatcgcgggtttcgtagacggtgctggcgtaagcaccgtctttcatacttcattcagccttgatgggaaactagatgttattgttggagactacccagaagggttcatggctgtatatttctctaaggactctcttgaatgggatgaggactatcacaccttttcgtggacacttggatttctctcatttgcatttgcatggcatcttgatggcaacatatttgctactgggaaccaagacaaaacatgtcgtgtttgggatgttcggaacttgtcaaaatccgttgctgttcttaaaggcaaccttggagctatacgctcaatacgtttcacatctgatggacagttcatggcgatggtcgagccaactgactttgtgcatgtgtacgacgcaaagcatggatttgagaaggagcaagagattgatttttttgggaagatctctggtgtatcctttagccctgatacataa

SEQ ID NO: 24858 - DNA, 267 bp, Glycine max
  Peptide Sequence Number=SeqID_141636
atggatggcataatttttggtcctctccatttgtttgtcttctttacttacatgggattatgtgctggcaagaatgttgctcaagtgaaggatgacttgaagaggaattacgtcccggccctgattttagaaggcgtgtttttctgtcatggttggagcaacagaaggacacaccttggaagaaatggtttgcatcatttcattccacgaatgaaaaaggaggtcgatgttgatgaggagattggtggaaaaagaaaaattgtttga

SEQ ID NO: 24859 - DNA, 1221 bp, Glycine max
  Peptide Sequence Number=SeqID_141637
atgaagattctgaggttgccttgcattgaggttgcaaagtatggtgtacaattttacagtttaggagatactttatttggaatcatggttttaaattgtagtcagcaaccgcaattgcagctgcaatgtaaaggaagtaagaagcctgcaagtaagccaaagcagtattcaaattcttctgaacaacgatctgctccaacaacttcagaattaaatgttcccaaatccatctccagtaaccttaagtccttcagcttgaatgatctaaaagaggcaactaagaacttccggcgagaaaatttaatcggagagggaggatttgggcgtgtcttcaaaggatggattgatgagaacacatacggtcctacaaaaccaggcactggaattgtagtggccattaaaaatcttaagccagaaagcttccaaggccacaaggaatggcttcaagaagtgaattatcttgggatgcttcagcatgaaaatttggtgaaacttattggttattgcttggaaggtaaaaaccggcttctggtttatgagttcatgcaaaaaggaagtttggagaatcatttattcagaaaaggtgttcaacctatggcctgggttacaagggtcaacattgcaattggtgttgcaagaggattaacattcttacattccctggatcaaaatgttatctttcgtgatttaaaggcttccaatatcctacttgattcggacttcaatgcaaagctttcggatttcggcttggcaagagatggtcctactggagataatactcacgtttcaactagagttataggaactcaagggtatgctgcaccagagtatgttgctacaggtcatttgaccccaaggagtgatgtatacagctttggtgtagtcttgttagaattactaaccggaaggcgtgcggtggaagacgatggacctggattttcggaggagaccctggtggattgggcaaagccattcttaaatgataacagaagagttctgagaataatggatacaagattggggggtcaatactccaagaaaggagcacaagctgcagctgcacttgcattgcaatgccttaacactgaccccaaatttagaccacctatggtggaagttctagcagcattggaagcacttaattcctcaaattcatttacgcggacaccgaaacatgagagtcattcaaccaaaatatctggtggtccttcacaaaagtaa

SEQ ID NO: 24860 - DNA, 609 bp, Glycine max
  Peptide Sequence Number=SeqID_141638
atggtgaatggaaagattgatgcatctcacagtgagactgttatacagaacgtgatgaatacatctagggtgatatggaatcctcaagatgaacacgcaatgtcgtttaaggaaagaatatttattgtgaatgcaaccatattattcatactcaataccgatcagtggtattgcaaatcatgtaactgcaaaccagcagttactacagattctggtgtttactattgttcttcatgtaggaaaaatgtccttgatactaccccaagatataagctgaaactggaagtctttgatgggtttgacacaaatgcttttgtattattcgatactgattgtgagaagatcatgaatcaatcgtgtgttgatttgttgagtgagctgaaggtgaagaaaatatgtgacaatgaagatattatccagcagtttcattcttctggttcagttaatactcctgaaaagtcaaaatttccaattgactttcagaccaatattgatcgtgacattgagctctccaaatcttcaacaaatgaaggaaaaatgaacatgattgatggagacaatattaaaaaaaatactgaagtttcatcatgtatcaatgatgaaaattaa

SEQ ID NO: 24861 - DNA, 204 bp, Glycine max
  Peptide Sequence Number=SeqID_141639
atggaatcattgcatttccatgtagaggcatgggttggtggcactgcagaaaagtttgacatgaaagatattgtctatggagcaataggttgtcaatctagagagttctatttattttcattacaggatggtgatgttgatttgaacgcttctcctcagacacttgataggctgctgggttgtgtccttgcatttattttttaa

SEQ ID NO: 24862 - DNA, 324 bp, Glycine max
  Peptide Sequence Number=SeqID_141640
atggggcgtggccaagtggagtggatgactcagccttattaccaactactttctggtaccgacgtcaaaggataccgtgatgatctcatgcctgtggagatagaggagtatggagagtgctcaacacgaaagccaaccaaagtggttttaccatatgaagaagcatgtgcattaaataaaatatttttacacaaaattaaggatttaagaaaggataacctttatgatgtggacacatggctgactatgtggcatcgtaaacacagtacaacggtgtatcgtatccgggaagccgagtttctggtcaatggaagtcatcggtga

SEQ ID NO: 24863 - DNA, 441 bp, Glycine max
  Peptide Sequence Number=SeqID_141641
atggttaaccacaaggacgaaaatacaaaattcttactctgggaccatgaatgtgcaaatttgattggccaatcagccgatgaagtcaacaggctcaaaatagcagatggtgatgttgatttgaacgcttctcctcaggcacttgataggctgctgggttgtgtccttgcatttaaagtcaaggttcaaccaaagttcaagaatgttgttgttcttaaatattcaaatgaattagatttgatcaatgttgtgctggatatgcttcctgatactgagcaatttgtgtctgtcacagcagatcatgacccacttctaaggattccattaacacccacaaagcagctatcatctgatgaattggatgatgaaccaagaagctctgaaatttcacccgcccaacattctgctaacaaattagcaagacatcatcaaattgaatga

SEQ ID NO: 24864 - DNA, 132 bp, Glycine max
  Peptide Sequence Number=SeqID_141642
atggaaaactcctttttggtttttctaacgtttttctcgaataaatgttggtggcgactccacactttttctcccttggagacgaacgccttggcttacctattttgctttcatcatcccatcgtagggtag

SEQ ID NO: 24865 - DNA, 279 bp, Glycine max
  Peptide Sequence Number=SeqID_141643
atggtggttgggcagatcttagtaatggcaaagataaagtttggcactcccaatggtggagggatcttcgaaaattatttcagcagcctgagctcagctctattcatcagcacatggtatggaagcaacaagcatattctcatcttgagacataccttcgatggcttccctgggagtcttaaagccaaccacaatggacttccaaaatcgattcccaccctttctgggactctttcctttcctagttttcttcaagctgcgaaagtgagaaaatgttaa

SEQ ID NO: 24866 - DNA, 285 bp, Glycine max
  Peptide Sequence Number=SeqID_141644
atggaagatcgagacaagaatcgcaactccgtcgaagtttcgcttgtcaccgttaagaaccgtcgaagtttcgtgaaaaagagagctctcgattcagagaagtcaaagattgaaactccttcatcagcgattttgagagaagatcgagtaaagaattgcaattccgagagatggaaactccgtcgaagtgtcgcttgttgcaatttagaaccgttgaagtttcacgtcgtttctaaggttttgagtgaggaagtacagttaggaaattatttggcattttcttaa

SEQ ID NO: 24867 - DNA, 241 bp, Glycine max
  Peptide Sequence Number=SeqID_141645
atgtgcaaagaatacaaaggcacaggtgtcaatcggtactactacatgtgtttgaatgacctacttgcacttggcggtgggggttattattctgtgagggtggatcaagttcataccatgtcacggtgcatattgtcacatgttttggcttttgcacttgtttctgcgttgagtgtcttcagctgcttggttaacgttgcacaagctcaatctgcaaacaccaccactgacccttccgaag

SEQ ID NO: 24868 - DNA, 402 bp, Glycine max
  Peptide Sequence Number=SeqID_141646
atggagccacctccttctcatcctcttccccgtttgccaagcaccgctgacctcacgccccaacatgcggcgtttctggatcagcacttccgaaccaaacgcgacctatctcgcgaatcttctaatctccctctctcctcctcgctctggcaacagtgctccgaacttgagtcccgcctcctccaatatctcacgaaacgcaccatttcgtggatctctcgctccttcagcgtcagatcctcgcttcagcaactctccctcgcactccaaagtctctccctctgcacttctccacaggggattggttcgaagaggtttcggtgggtgttgagtgaggagattcctcgattggccaacgaaatgaaccgaattgagtctcttcggtgttatcttggtgggtga

SEQ ID NO: 24869 - DNA, 1923 bp, Glycine max
  Peptide Sequence Number=SeqID_141647
atgagtgatattgaagaagtattggtcggtgttgtgaaattccatcctcagtggcattgtcttctgaagtctgttgacactagagtagataaaatcttatctgctctccggccacaagctcttgcagatcatcgggctcttctgatctctcttgggtggccaccaaaactgatttcattgaaaaatggaagtgatcatatcacaagcctacctaatccattaattcttatgcaagaagataagagaagaaattactctcaaagttttatagctctttgtgctttgcagcatctgcaaaatagaagggaagaaagacagcttaatagtaatcttataaaaagagacacgcagaatatacagctttgggccattgatgaattagtgtctcctattgcgtcaaggatggaatgccatttcaccaaatggtccgagcagccagaatatatgtttgctttggcgtataaagttaccagagattttatttcaggaatagatgatgtcttgcagcctcttattgacaaggccaggcttatcagttgtagtgcaaaggatgcttgggtctctgcaatggtccaaatgctttctggctttctagaaaagaaagtttttcggtttctcactgaaagatacaaagtaaagcatttgaagcctgatgtatcgtcttcatggcttcaccttgtggatcttatcattgcatttgacaaaaagatgcaatcccttctcaatctggatacttgttttttggcagttcctgggagttttgaagggctctcaagaggcgtctcagttctatcaatattttgtaataggcctgattggctgaaggtctgggcaaaaatagagttcaaaaatgcatggaagaaacttaaacctgaactgatagaggagaaagcgtggattacttctaagaaatgtatatctgggattgacactgagcaggagtttctgctattgactgttgaggatctcaaagctccacctattgcagagttttttcttaaaattatttgggaaatgattgaacgctgccaaactatgccatccagtttatcacatgcacaatttattagatttactgcaggaagattcctctggtatttctttaagcaattactttttcggttcaaggcaactgaattgtgcattgatagttctgatgatgttgccatagttagagtgtgtggattaataaatgctgccagatatatttggattaaattgcaagaatggagtgatgttgcggactttttggagatgaaaattgttgaaaatgattctagcaagcccacacaagatgatacaatggataatgactgtttttttgacgaagaaataagaagcttgtctgaaatggaaaccaactggcttatggaaattatagcagttgttcttcgacagtttgaaatgctatcttggaagtatgttcaaaacaatgatagttttgaggatgaccaagattatacaaatccagtagaggatgttgatttagtagtctccaatgattttgttgaagctttagatgctttagatagttggcttcatactgtgaagataagtctcaataaaaaggatttcttggatttgtggagaagcattgctgaggggctagatcattacatttcatgcagcatcgtcagaagtgagaattggttctctaagatgggcgtctatcaatttgaagctgatatgcaagcactaatttttatatttcagccttattgtgctcgcccacaagcattttttccttgtattaatgagattcttaagcttttgaaactgaaaaaagaagagctaaataaggcccttgaaaaagcagtatttgttttaactttgcagcactcccttaatatggggtggatccagcagaaatttcgaaagctgttgaacaaaaacttcttgactgaccaaggaaatggagtataa

SEQ ID NO: 24870 - DNA, 1698 bp, Glycine max
  Peptide Sequence Number=SeqID_141648
atgggcatgttggggtgtcttttgtgcattgttggatcaactgttattgtgctgcatgcacctgaagagaaatctcttagttctgtacaagaaatatgggaattggccattcaacctgcattcctctcatacactgcctcaacaattgccgtgacattgttcttggttttgtattgtgctccccgttatggccagactaatattttggtttatactggaatatgctcgatagttgggtccttgacagtatgtggtcccagtggtcgctggtatctggcagacagtgggtctgtgcctggagatcttttacttataataggaaaggcacttacccatgctactgttggcctatgtcctgctgcatcatatagagcttctcctgattattttttgagtcctaatggtggaggaaggtactttcttgagctttgtgactgtaggacttctcttgcatatagactcatgccacagggcaatgctatattagattgttccctaattgcagcagctggccatgttattccccaaagttatgttcgaatatctgtaagccaatttatggatgaccttgttgtcgaagaactgataggcaatagatgggtttataaaaacaatggataccttatggtctcgtgcaatggaggactcaaccaaatgagagttgcgatatgtgacatggtggctattgccagatatttcaatgtcacacttatagttcctgaactggataaaacatccttttgggctgatcccagctatattctacccttgatacaaaagtacaaagttgttcacttaaatagaactgatgctcggttggccaataatggtcaaccgatagagattcagaagctgcgttgccgggtcaattttagtggtctgagatttacttcccagatagaggagttgggcagaaaggtgatcaggcttctaaggcaaaaaggtcaatttcttgtgctccaccttaggtatgagatggacatgttggcattttctggctgcactcaaggttgtaacagtgatgaggtggatgaattgacaagaatgagatatgcttatccttggtggaaagaaaaaataattaattctgatttgaaaagaaaagatggtttatgccctctaacacctgaggagaccgcccttacacttaaggctcttgacattgatcagaacattcaaatctacattgcagcaggggaaatatatggaggggaaaggagaatggcaggtcttgcaaaggagtacccaaaattggtaaacatcaatactcaaggcagtatggtcaggaaggaaacgctgttggagccatctgaccttcgtttcttccaaaatcattcatcccagatggcagcattggattatcttgtctcgttagagagtgatatttttgttcccacatatgatggaaatatggccaaagtggttgagggccaccgcagatatcttgggttcaagagaacgattttattgaacagaaagctcctagttgaattgatagatcagtacaataatggagtgctaaactgggatgaattctcttcagcggtgaaggaagctcatgccgatcgcatgggtagccaaacaaagaggtttgtaatccctgagaggccaaaagaagaggattatttctatgccaacccacaggagtgtttggaacaatcagcagatgaaccgttggcgttgagtagtagtacgtga

SEQ ID NO: 24871 - DNA, 444 bp, Glycine max
  Peptide Sequence Number=SeqID_141649
atgccattcaccaagcaagaaatgaggcttgaggatggggcagttgagtacattctagagatgtatgtgacacaagtggaggagtttagagaggcacaaagggtggccacaaagagagggttggagtttctaatgatgaacactactgaaattatgttgcttaggcctgatggacaccctaacaactatggacatgccaaggacaaaaatgtgacattgaatgactgtgttcattggtgcttgccagggcctgttgacacatggaatgagtttttgctctatatgttggatattatgggaactgtcacgcactatgaaatcttaagtggggcaatgttcacggccatgaagctcagttgtacgagtatcataattgaaagttttaaaggctctggtacgagtcccgacagtgatttcagtacaaacattaatgttgttagatag

SEQ ID NO: 24872 - DNA, 495 bp, Glycine max
  Peptide Sequence Number=SeqID_141650
atggagaatgctgtacatgagttggagaagaaatgggcacaagttcaggaaaatgcacttaaacagccttcccctgggcaaagggagaagacattggataaacacctgcatggtctaattgagcaactagcagttaaacaggcacaagctgagggcttacttggtgaaattcatctgaaagaaatggagctcgaaagattgaatgggctatggcgacgaacggagagtagcaattcagaggcgaacactgctgctaggaatcgtttcagtaaaggctcctctgataagttacatagtttgtcagattacgaaggtcatcagaggcttccttatcattctgctggccgaactgaaagccagcagaggcttatgctactcaggtcggcgttcgtgctctatattttagctttacatatactgataagatcaatagactcaaggaaccctgtcggtgcccccattgcctcacctcccctatgtgccagtacaggttaa

SEQ ID NO: 24873 - DNA, 276 bp, Glycine max
  Peptide Sequence Number=SeqID_141651
atggcggagatggtgattaaagacgaggtttacgacattgacactgctcacaaaatgtcaatgggaaaaggcataatgaccttattgtccaacactaatctcacaacgtggggtcctctgtttgtaaaaaggaatcccctacaattgaggctagggaaagaaagtgattcattaagtaacagatgtatccaaatgctgataaaagtttcccatggtgcaggacctatgccactttcccattctaaaaggcgttgcattcccaaagctaaacagtaa

SEQ ID NO: 24874 - DNA, 803 bp, Glycine max
  Peptide Sequence Number=SeqID_141652
atggaggcttggaataggttgcgtgatatattccaagataacaaacactcccgtgccattacacttgagtatgatttcacccacacaaccatggtggccttttcaagtgtctctgcttactgtcaacatctcaagtcactgtcgaatcaactcaagaacgtcggcttttcgatcgataacagtaggttggttctacaattggtgtctggtctcactaaaccctacaagggtgtggccatgctcatccgtcaaagtgatcccttgcctcggttttatcaagcacggtcgatgcttgttctcgaagaatctggcctcaagaaggcggctcggacctcgtcctccaccatggtggctcgtgactcggatgaatctcaagagatgtttgatcattcattagcacgccgcacaaataatggtggaaaacggtattcaaaccctggcaattctagaaagaatcgcaacaacattggtggtcgtgataactcaggctctggcaagggaggctttggtggcgggggtaaaggtggtggtggcagtaattgcgggggtggacagcagcagccccagaacaacccctggcctgcaggacagcaatggccttggccatggatgcagtgggttgttcctccttgtccgtacccagctgctccatgggtcaggcccaattatcagcaacctccgcgccaacagcccggtattcttgggtccagacctcagcaggcatacacagccacagctcctactcgaacagacatcgaggctgcaatgcacaccctcggtattacctctccgaatccgaattg

SEQ ID NO: 24875 - DNA, 570 bp, Glycine max
  Peptide Sequence Number=SeqID_141653
atggggaggggtaagattgagatcaaaaggattgagaactcaagcaacaggcaagttacctactcaaagaggaagaatgggatccttaagaaggcaaaggaaattagtgttctatgtgatgctcaagtttcccttatcatctttggtgtctctgggaagatgcatgagtacatcagcccctccactacgttgattgacgtcctggacagataccaaagagcctctgggaagaccctgtgggatgctaagcatgagaacctcagcaatgaaattgatagaatcaagaaagagaatgacagcatgcaaattgagctcaggcacttgaaaggagaggacatcacgtcactgaattacaaggaactgatggctctagaggatgcccttgaaaatggcctcagtggacaaaacttaaacaagagtttaacctcagaccttaatttcttgtttgtgccacagatggaagtgcacaggatgttcaagagaaatgacaagattttggaggagcaaaataaggaactcaatttccttctggttttattaattgagatagctgggaacgaatatggctga

SEQ ID NO: 24876 - DNA, 234 bp, Glycine max
  Peptide Sequence Number=SeqID_141654
atggcgcctttagaaggtataaacgactctgtcttttggccattgaataaaatcagcatggaatatgatgaaattaaggatggaaatgacttgcttgaggtgggtcacgatgatcttgataataatcttgttgttacattgcacaagcttatggatcagtattacttcaggatttctaggttgtctatcttaggaatgagcactagtgagattatagaaggaagcattggataa

SEQ ID NO: 24877 - DNA, 380 bp, Glycine max
  Peptide Sequence Number=SeqID_141655
atggcaagcaaaaatgaaaacattcctgccgtagtatactatgacgcctatgtagccaattgtgaagagggcgttgagtttaagggcggaaacaatgtacttgttccaacgaggataggcatgaccttcaatgttgttaccattagtgacgatgaggatattgatgacacgttcggtgtcgataaccaacttaatcttgtaaataaatcttgttttatggttaaagctatctttagaatatgtccattggatttaatgatgaaatctgtgcattttcagcgcgaaggagaatctggaagagcattagcatcaaggccacgtgctaagcacaagattagtgcgctaagcgcagcagtgtcttcagccaggctcagcgcacg

SEQ ID NO: 24878 - DNA, 177 bp, Glycine max
  Peptide Sequence Number=SeqID_141656
atgaggatccctaagtatttggacttggaatggttctctcaacaaggaggaatgcttcttgacccagctaggaacttgaggaatcgcttaggagttggtggactgactgtagaagacaaaatgttggtttacctcattacctacattcttactccaaggtcaagcaatcatgctcag

SEQ ID NO: 24879 - DNA, 4768 bp, Glycine max
  Peptide Sequence Number=SeqID_141657
atggggtcgtgtgggagatctgctgccattgatgatccctcagaaaagtttgtaattgagcagcagcatttgtgctcagaggttcaagagcaggttgtttctgtgcaggagtcttgtttagaagaagaggcttacaatgtggtggactctaatgttgagctctccactgtgactgatggttgtctgcgaggggaccgtgtcagttctgaaggacgtgttgatgttaccgaggggtccggagagggtttgggtttggcgagtgaatgcaaaaatgctgatttgttgccactggagaaatctactcaggatgattgtcagaattgtttgggtgtttcttgtgggagcattgaagttctctgtgtaaacagtggctcagagggaaattttcaggatgagggtatctttgatcagctgtcggggtccttaactgcagatgattcacagaggcgttgtgctcaacaggatgagcagaaggatgatgagtcagggtccttaattacagaggattcacagaggcattgtgctcaacaggatgagcagaaggataataagagtgacgtattgcctgctgcaggagatgatttggatgtcgtggaaggcaaaaatgatgagactggtgttcttgctgatgctttcagtcatgcacttgatttcagggattgcgaagtgtctttggagtcagaatccatggctgacttgctagttgattgcaaccagcaaagtgagcaggagaaaattatgagaaatccagatcccttgttgaatgtagttgaaaaatgtgacgctctaattggggaggaaactgatgcttgcaggaagatatctcctactccggctatggaagtgccatcaggtgcattatgtacagatacagaagtagagagcataaatgatcacccatgtgatcagaaagatggtgaggaaactgatgcttgcaggcagatatctcctactccgactatggaagtgccatcagatgcattatttacagatacagaagtagagagcataagtgatcagccatgtgatcagaaagatggtgaggaaactgatgcttgcaggaagatatctcctactctggctatggaagtgccatcagggccaccatcaggtgcattatgtacagatgcaaaagtagagagcacaaatgatcagccatgtgatcagaaagatattgaggatcagaatagtacttgtgaagaaaagtttaaagcttttgttgatgaagaagtcatcaacattaattcatgtataaaaatatcatcctctctagattgccaggagactgttgcgagctcacctgtagttggttttccttgtgagcctgccctgttggatccagggtgtgaaatgaagaatgacatgctgcaaatagatgatttctgtaaattgaaggactgttcctcagaggaaactaccaactctacctttagaaaaccattttctcctgaatcaggtctgccctctgttgctttaattaccaactgctctgcaaaggatgttcttgatctccattctaagggtgatgatgtttccattaataataataatgctgttaacaatccagggcagatggataatgatggaacaaaagctgttgaagttgattgtatcactgaaagcataccgttaccttctctaagggatagtcgaagaactaaatttggccgtaagacacaaaccaaaaaggcttcaagaaattgcaagaacaaaaccaaggtgacacattcaaatgggggtatgaagctaaacttagaggctgctagaaagaaaagaagttgtttctccaaaccagctcgttcttctgtctggggattgattgggaatattgaacagttttttgagcaagataatgagcttggagttggtgaagctgtgtgccaagaattggggaaggctagaagcaagcgtcaaagtgggaaagcggttaagaatggtgcaagtactacctcattgagttcagtacagaagtgttctgtttcaactactcgtgttcgtctgaagattaaatttgggaaagaagttgatttaagttgctcaaatgtcttgattccagagtcagttgatggtttggcttctgcttcttacttggtgtctgattcaggttctcagaaagtagccggcaatgctgatgataaaatttctgatgcggtggctttgggaaattcagaatctttcagtaatgacctgggcaaggatggtcttgttctaaatgaacaagttgcaaataaccccttagaaactactgaaataacagagaagtcatatggggatgcagaggaaccttgtcttgctgttcctcctgagaaggtggttgaagcattgattgaacctatgagtaataagggtatggatcctggaacctcacctgattctgaagttatcaattcaattcccgaagtccagattggagaaagacatcaagaagatgtacatcatgctgttttaggttcttctaaagaattaaattctaaattgaatgttaccatcagtaagagagggaagaagaaagagaaacttatttgttctggtaattgtatcactgaagatggatcacaaggtccacgtgggaatagtagagctaagcattcaaagaatcacagacgtaagaaaaattgcagggatgcatttagctctttggagttgcccactgagataagcaaatctgtgaccagtaaagaattgtccccagaattattgccccattctggagagaccgaacttggaggctccgtcgaggctttgaaagttaaaaatcatatggacgctaagacaagtaataaaccatctgttgaccatggattttcagattccctggtttctgagaaaatgctgtcatctgcaagacctttggggcgtaaactacctaaaagtcttagacctagtaaagttagcaagaccaaatctaaagcttctgactcatctggcaggaaaaagactactgctggtacatgcaaggagaaacagaaaaatccaattaataagagcaaagtcaagggaaaaggtgcctctcttaaagttacatgtgaagtggaagattgcccacatccagcaaatgctggaaatcataagctggatgctattggaaaaattattgctgatgacaacagagtatcggtcaatgtatctaatttggacatgctgtctggtgttggttttggggagcaaattctatcaccccgtaatgcatgggtgcgttgtgatgattgtcacaagtggcggcgaattccagctgtgcttgcagaccgaattgatgaaactaactgcacctggacatgtaaggacagcagtgataaagcctttgctgattgtgctatccctcaagaaaagtctaatgcagagattaatgcggagttgggattatcagatgcctcgggtgaagaagatgcatatgaaggttccaaaaattttaaggaattagaatattggccacctataggaggaaagttaggctgtggggatgaatgtctaaatcggattcttaatatcgaatgtgtgcaaggaacctgcccatgtggggaccgttgttccaaccagcagttccaaaaacacaagtatgctagcctgaagtggtttaaatgtgggaaaaagggttacggactgaaggcaattgaggatgtagctcaaggccagtttcttattgaatacgttggagaggtgcttgatatgcaaacgtatgaggcacggcaaagagagtacgctttgaagggccatcggcatttctattttatgaccttgaatggtagtgaggtgatagatgcaagtgcaaaaggaaacttggggcgtttcattaatcatagttgtgatcctaattgtcggacagaaaagtggatggtgaatggggaaatctgtattggactgtttgcattgaggaatgttaagaaggatgaagaattgacattcgattacaactatgtaagggtttttggtgctgctgccaaaaaatgttattgtggttcgtctaactgtcgaggttatataggtggtggtgatccacttaatgctgaattgatagttcaaagtgattcagaagaagaatttccagaacctgttatgcttaccaaagatggtgaaattgaagatgctgtacctacacccaagtattttaataatgttgatacagaatctgctaaacatatgttgaaagacagggatatattggaaaatcctacaactgctatagattcagatggttctccagagaaagagagttctatgaaccctgcctctgccgtttctctgttgcacagctcagcagaaatggaggattcaaagggcaaattaccatcttctgttagagatgaagaaatttctcaacaaatggaggatgtaacaagcaaacccatgccttctgtacaccaaggatatgaaaaggaatcagagtttgcagacaaaacttcttccattcaaagattagagactacttctccccctacaactgtcagcaaaatgttaccgaattctgctggtagtaatagggagtccaagtctgaaataattggaggcaagaagactcctaagttaaatggttctgttaaaaaggggaaggttcatgctaatcctccaaatggccttaaaactgaggtgacagccaatcgattacaggtgtcatctataaaacacaaaaaagtagaaggttcttccaatggacggtttgaagcagttcaggagaaacttaatgagttgctggatggagatggtggaataagcaaaagaaaagatgccaccaaagggtacttgaagcttttgtttctcactgtggcatcag

SEQ ID NO: 24880 - DNA, 165 bp, Glycine max
  Peptide Sequence Number=SeqID_141658
atggtgattggaaatagcttaaagtttggagaagaaaggtccatctatgaagatctccccaatgatttacctcccttagagccgatggttcgacgtggtgactctctcggacaggctagacggcgtgtcccgtatgttgtcatgaaaggtggaaaggcagtgtaa

SEQ ID NO: 24881 - DNA, 216 bp, Glycine max
  Peptide Sequence Number=SeqID_141659
atgcgagttcctaatgactgttcttttgagacactcaagagtagaattcacaacacccttcagctaaccaacgatcaattagtggatgaaatctactaccgacggccattcatagatgcaggatgtagcatggacaaactaaaggatttaatcaagcaagttgcacctatgggaattcccccttatggaattcatgaatcacaggtggtcaaatga

SEQ ID NO: 24882 - DNA, 1286 bp, Glycine max
  Peptide Sequence Number=SeqID_141660
gaatccattgaaggaggaagagtgggagatttatgtcgtcttggttttatttggaagtagtgattggagctttgttgaagctcgggttcggttacgcttgtatttgctgcatgctactctggctggtgttgaattctgctgtttcgatgagtttgaggtcaaaaaggacatgttatggagctgtggggttttgacccaatttttcaccatggtggagcctcttaatcaatcgactcctaagatgaaaaaaatcaaacacaagccgaattcgattcataactcgaaaataacgaggaaactgcgcatcatttgcaatgatcctaatgctacagactcttcatctgatgaggatgagcattttaggaatgtaaggaagatgaagagaactgtggttgagattgctcttccacctgtttctgtaaaccctgtcgttgcagatgaaactagtactgagagcacaaacaatgatgaattgaacaagatgaagagggttttgggtaaaactcccacagtcaagaggcaatcttgtgggaaatacaaaggtgttcggatgcggaaatggggcaaatgggctgcggagattcgtgaccctttcaagggcgcgcgaatctggttgggtactttcagcactgcagaagaggcttctcaagcctataatgccagaaggcttgaatttgaggccatggccaaggctctatctgatgagaagagcaacaatggcagcaacagcagcagcaacaacaatgttgttgcttctgctgaaactgtggctgccacagaaaataacagttccaactattgtgtttcttctgctgcaggttctgtatcagactccaagtctgcttctatggatgaatcagagagtgtgttgtcactcacatcaccatcttctgtgcttgaattggatacatctgctttcaatttgattgggagtggtaaggtttcaagcaatgaagttgttgagactaaaggattggaggctgaagttgctgagactaaaaatttggcagctgaatttgccgagctggaaatgctggaaatgccggatttgagtatgctgaatgtgccatccccatctgctgtcgctgctactgctgctgctccatctgagtttgaattggatttgttggcatttgttgattccgagtatggatttcatgatgagcatgactttgatgatgatcttgctgccctggaagactttcacatttgcggtttcgatgacaatgagcctagcgagcttcccgattacgattttgacgactttggtgctgatgagtttgctg

SEQ ID NO: 24883 - DNA, 2253 bp, Glycine max
  Peptide Sequence Number=SeqID_141661
atgctgcaaacggatcccgccggagaacccgcccgaggcggcggctctggtggccgcacggtggtggtgggggtgaagatggactccccctgcaaagaattgctcacgtgggctttggtcaaagttgcacaccctcgtgataccgtggttgctctgcatgttcttggaagccatgaaactgtgaatggagtcgggaaatcgtcgctgctttcgcttgtcaaggcatttgactctgttcttgctgtttataaaggattctgcaatttgaaacaggtagatctcaagctcaaaatttgccgtggttcatcagtgaagaaaagtttggttcgagaagcgaatggttattctgcaactcacattgtggttggaactactcatggcctgcataaaatccggtcatctaccgttgtagctaagtactgtgctaaaaagttatccaaggattgttgtgttcttgcggtcaacaatgggaaagttgtgttcaagcgtgacagctcaccgccgagtgttacagagttacaagggattgatcgtcataacagaaatggtttgatcggttcaattcagtggacactcggtaagagcacaaaagttctgagtgatgacaattcagggatggaagccgatgagaagaaaactggccaggtttcggatcacagtttggctaagttatttctggaatctaaagaaactgttcgaaatccgagctgttcaatctgtggtacaaccctggcattgccagactcttcttgctaccaatctgcagatggggtttctggtgatgatggtagagagaattctttggctatagtgccagtgcaaccctccgttgcagccataacggaaatgaaaccaggttggccactactacaccgcggaattttattggacaggcaatctgctgatagattattgatgcatccccagatctccgtggtccagtgggcaatgaggttgccttctagaaacctctcatatgctgtagattgtaatgaaaaacctaacatttgtgatcaaggtcaagatcagcatgccgctttagatagtgaaagcggcgctcttgttccagtagatgctgaattagggaccgcttctttgccagaacacaattcaggaaacattcccaaagaattggagggtcttcatgagaaatactcatcaacttgccgattgtttgagtaccaagaacttgtattggcaacatcgaatttcttgcctggaaacttgatcgggaagggaggaagcagtcaggtttatagaggctgccttcctgatggcaaggaacttgccgtcaagattctaaagccttctgataatgtgttgtcagaatttcttctggaaatagaaattatcactaccttgcatcacaaaaacattatttccctcctggggttctgctttgagaatggcaaacttcttctggtttatgatttcttatcaagaggaagccttgaagagaaccttcatggtaataagaaaatttcacttgtgtttggttggtccgagagatataaggtagcagtgggcattgccgaggctttggattatctgcattctaaagacgatcaacctgtgatccatcgggatgtaaagtcatcaaatgtattattatctgaggattttgaaccccagctctgtgattttggactggcaaaatgggcatcaactttgtcatcacatataacctgcacagatgttgctggaaccttcggttacttggctcctgaatacttcatgtacggcaaagtaaatgataagatcgatgtctatgcattcggtgtcgtgctccttgagcttctttcagggagaaagcccataagccctgattatccaaaaggccaagagagccttgttatgtgggcaactccaattctaaatagtggaaaggtgttacaattgttagatcctagtttgggtgaaaattatgatcatggggagatggaaaagatggtattggcagccactctctgtataaaacgtgctccaagggctaggcctcaaatgagccttatctcaaagctccttcagggtgacgccgaggcaatcaagcgggctaggttacaagttaatgctttggacgcaccagaaatgcttgacgatgaagcgtgtccacctagtaatctacagtcgcatataaatcttgcactgcttgatgtggaggatgactcactctccatgtgcagtgttgagcagggtctcactttggaggattacttgagaggccggtggagccgtgcatcaagctttgactga

SEQ ID NO: 24884 - DNA, 276 bp, Glycine max
  Peptide Sequence Number=SeqID_141662
atggcacaatacagaatattaacaattataattggcagcatattgtgcataattgtcaatgtgatcattcatcccatctgggctggtttcgaattctttgttttagtcacagggaacctcgaaaaactgaccaactccttgcaactgttaatggaaactacactaggaaagggaaaggtcatgaatctttgtcagatgttcgtttactctgaaagcgaagcagggctcccaagtttcccactagatataacttcacctgctttgtcatcacattaa

SEQ ID NO: 24885 - DNA, 447 bp, Glycine max
  Peptide Sequence Number=SeqID_141663
atgatagatggcatcttggaaaacaccaacatcccaagaagcatctacccaaattcaaggcctaatattagagggaagattgacatggcttgggcacattgtaagctcattcaggagggtgacaagattgctatgatgtgtatttattgtgataaaattgttaggggaggtgggattaatagattaaaggaccacttggccggtaaaatgggtcaagtttctttgtgcaaaaaggtgtctcccgatgttcgttatcaaatgaaacaaaatattgaagaaaataagagcaagaacaaaaagagaagaattgatgaagaacatgattttatccacttagtgaagaaggtgctttacaaaacacttttccacgatctgaccgttaggatctttgagaaaaagtctggagtgtgcgcaacgtttccgtttccgagagtgtggcgtccctaa

SEQ ID NO: 24886 - DNA, 650 bp, Glycine max
  Peptide Sequence Number=SeqID_141664
acgctgtcgttcctgcgcattcagctgacgctgctccggcgcgccgccgacgatccggcggcgcaaacgattatcgacgatttcgatcgcacgctggccgatgcctatcgccagctgagagaattgctggccaccttccgcctcaacattcaggaggcggatctgaatgccgcgctggagcaactgttgcagccattaaaggcgctaacccccgcgcggattcagttacactgtcggctgccctcgcaggcgctcaacgcccagcagcaggtgcacgcgctgcagatcgtgcgcgaggcggtgctcaatgccgtcaagcacgccggagggaacgagatcgcggtatgttgcgaggtcaacgccgcaggcgacaacgtattcagcattaccgacgacggttgcggcatcgccagtctggaagaaccggaagggcactacggcttgaccatcatgagcgaacgcgcggcgcgactgggaggaacgctgcgcatccggcgcagaagcggcggcggcacggcggtctgcctgacattctcgccctgaccttgcggctgttcactctgcgttacggttgccgccggcctgaaggccgcccggagaggtttgcggtgcagaatgccgctatttttgaagagacagtcccactgtga

SEQ ID NO: 24887 - DNA, 765 bp, Glycine max
  Peptide Sequence Number=SeqID_141665
atggcttcctccctcggcgacaacttcaaccttctctcgcctcaacagcaagagctggtgaagatgctattggataacggccaagagcacctgtttcgcgattggcctgctcccggcgttgacgacgaccacaaaaatgcgttcttcgaccagctgactcgactagattcgagttaccctggcggtctggaagcatacatcacaaatgctaaacggctcttggctgattctaaggctggcagaaaccctttcgatggcttcacaccttccgttccaacgggtgagactttggcgtttggtgatgagaactacatcaaatttgaggaagcaggtgtacttgaagctcggaaagctgcgtttgttcttgttgccggtggtcttggcgagcgtttaggatacagtgggattaagatttatactcagcttgcgcttcctgcagaaaccactaccagaacatgtttcgtacagaattacattgaatctatattggctcttcaagaagccagctcgcaaggtgaatcccagacacagattcctcttgttattatgacttctgatgatacccatggacgtactttagagctattagaatcaaattcttattttggtatgcaacccacgcaagtaacacttttaaagcaggaaaaagttgcatgcttagaagataatgatgccaggcttgcattggaaccacaaaacaagtacaaaattcaggtattgatggcttcttgttcagtcctgcagggtaacagtatgattgtgtga

SEQ ID NO: 24888 - DNA, 816 bp, Glycine max
  Peptide Sequence Number=SeqID_141666
atgttgagttgtgcactttacttcaattccgtcacaactgttaaaaaagtggatggagaaggacacgtgtcactatctggttattctagaactattctggaatcaggatgcttggcattttcagtccatttttttagcagttgtggtggattaggagtaaaatataaagatgccagcaaaacttcatttaagtcctcaactcgacttgaatgtatgatgcaagactatccaaaaacattgcccccatctgccagggttggattcacggtgatggaaacgtggcttgcttatgcacctgtgaagaataatgccgaggatgctgccaaggtgccgaaaggaaatccataccatagtgcaacttctggagaaatggccatctatcgtgcaaatagcattattctcagaaaggctggtgtccaagtagcagatccagtagtgcaggtcttcaatgggcaagaggttgaagtttggcctcgtatcacatggaagccaaaatggggtctgacttttaatcgaatcaagagcaaagtcagtggaaattgctccatttccctaaggtcaactctggccattaagggtccaaatatttttattgaaaatctgtccgtagatggggctctaatcattgatgctgtggatgatgcagaggtaaatgtgagtggttcagttcaaaacaatggttgggtccttgagaccgttgactacaaagatgcctcggagcctgaggtattgagaatccggggttttaaatttaacaaaattgagcagctggaaacgaaatactctgagcctggcaaatttcacttgaaggcttga

SEQ ID NO: 24889 - DNA, 240 bp, Glycine max
  Peptide Sequence Number=SeqID_141667
atggctctggtgatgggtccttccttgggaggatttcatcatcccctccctcttgaagaggatttgtcctcaaatctacagacccctcataatctgaatcagctacacctagacgaagatgctttgatgccacataatgtagctccctgtagagcttgtaggccttggatcttcttcatcaatgaagtcctttgcttcttgaagatcaatggcaacaaaatggagaaggaggaaaggtga

SEQ ID NO: 24890 - DNA, 186 bp, Glycine max
  Peptide Sequence Number=SeqID_141668
atggcaaatgaagaattgaagttgcaggatccacgatgtcggatacaatgtcctgacatcctgcccgagaatactggagttgctgtacaatgcaagataaaagtcaagtgcagaaatttttcagaagaagatagatctcctccagcatcaagccgttgcagtccagaaacgcaaattgctatataa

SEQ ID NO: 24891 - DNA, 155 bp, Glycine max
  Peptide Sequence Number=SeqID_141669
ggcagaaacatttatcaggctggaggggtagagaagtgaatgtgcaacgggatgggttgaggttgagtatatcttggattctatatctagatgatgcaaaggcccaagctgttcactcaacagaggcaatggagcctgataggggggcacatcag

SEQ ID NO: 24892 - DNA, 1099 bp, Glycine max
  Peptide Sequence Number=SeqID_141670
atgccctcccctttagaggactacacgtccccgccttcagagggctacacgctacacgccctcgcctgcaaagggctagatgccctcaccttcagaggactacatgtcctcgccttcagaggactacgcgccctcgctttcatggggatacacgccctccccttcagaggactacacgtcctcgccttcagaggtctacacaatcttgctatcataggagtacatgtcgtcgccttcagaggactacatgtcctcaccttcagaggattacacatgctcaccttcagaggactacacattctcgctttcagagggctacacaccgtcaccttcagaggactacacaggttacacgccctctccttaagaggacttcatgtcctcacctttagaggactaacggtcctggcctttagagggcaacacgccctcaccttaaaaggactacaggtcctcgcctttagaggactacatgtcctcacctttagagtactacacgtcctgaccttcagggggctacacgtcctcaccttaaaaggcctacacgccctcgccgtcagagggctacacaccctcaccttcagaggactactcgtcccttccttcaaaggactacacgtcctcaccttcagaggactacacgtcctcaccttaagagtgctacacgcccttaccttcagaggactacacgtccccgccttcagagggctacatgtcctcacctttagaaggctacacgtcctcgccatcacagggataaatggcctcaccttcagagtactacacgtccttgcttttcgaggactccacgccctcgctttcgtggggctacacgccctcccctttagagtactacacgtcctgaccttcagagggctacacgtcctcaccttaataggactacacgccctcgccatcagagggctacacaccctcaccttcagaggactacacgtcccttccttcagaggactacacgtcctcaccttcagaggactacacgtcctcaccttaagagtgctacacgtcctcaccttcataggactacacgtcctccccttcataggactacacgtcctctcccttcagagggctacac

SEQ ID NO: 24893 - DNA, 231 bp, Glycine max
  Peptide Sequence Number=SeqID_141671
atggaaggcaaaccccaagaaacagcctactcttcacagaaaatgaatccagcccttgatgtaatatgcagaacttttgtctatgttcaaatctcctctcagacttggttgatagtagtagtagggagggtgttggaagaggaacaaggatgcgcaataaatgtaggaatctcatctccaggcattagaactgaaacaccactggcatatacactcatctgcaaaagttag

SEQ ID NO: 24894 - DNA, 345 bp, Glycine max
  Peptide Sequence Number=SeqID_141672
atgatcaagggaagcgtgagcgagtttgccggaaaagccgatctgggcctcgacgtcggaggggctgcgtcggcgggtggtggcggagggggagagtggcggcgaggtggggcggaggtagcgctcaaagatggccatgacaaggaacatggagatgagaatggcggtggcgacgaagccgaaggagacggcgttgacggagctgtcaaagttggtccaatgctcgtctctgtggacgttcagaggagcaccgattggtggccacccattggcaatggagaaagagagagaagggagaagaagagaggagaggaagtgaactttggaatttggataggagtatag

SEQ ID NO: 24895 - DNA, 4149 bp, Glycine max
  Peptide Sequence Number=SeqID_141673
atggcggatgctgatgtggacctttcgggattgttcaccggtaatgccgacgaagacgacgacatgttttatatagatatgcagacggtccagaaggttcttgatgaagacgacgattgttactttcaggaggtagggtttcttctttgccaaaaacagagtgaaattccgaatgctgtgattgtgttcaacattttggatatcaggcagagtagtcccgaggattcttcatcaaaagatgtttcacctagtgaatccggcattcatgacacttttcagatacaaaatgggtctcaagtgcaagaagaacctcatttttctaggttgggccttgcagattcagtcacgagctgttctccattcttctcagatgtgtcagattctggggtcagatgttcagttggtgtatctgattctgcagcaaattctatgctagattgtgaacgtgaaagtgaacgtgaaaaccggggacctcaatctcaggcttgctcttccccaaaagcttttcctggtaatttcagtgactcattctctccaggtgaaagtcatgaggttttctgcacagaaaggaccggagtttttaaacacgagatacctgcttatagtgtagaagcaagtttccccaaggcacagtcaaacaaaatatcaatttgtggagataatttgaatctgagtatgtggattggtgaaaatgagagtcaattcaagcatgtgggagaggatgttgaatctgaacatgcttcactcagttctattgttgacaatgatgatgtaaatgctgaagacatcattaccggagtttctgggcaacaggaaaatgactcatgtacatcttttgaagcatcatttatggatgctgatagatctttgcatgtcactacctcaactgattctactattggtcaaggttcccatgtttccagtgatttcattgactaccatgtatcttcaaactgttaccagggaacatatcatggaccctttgttgctgactcttctcttggttttgtgcctaatggtatttattctcaattgtggccagatgaagaaatgatgaataacattaaggctgaaaatgtggagttaaatgctgatattgcatgtatgagtaatggcttgccctcaagcactactgggtggatgccttttcaggatagtcaaattatgttagctgataatggttatccatcatttcattctggtaaagttaatgttgatgacatgtcatcactgtctctttcagcttgtgcttcatacatgtcatatggagaccattaccaaaacaattttcactgtgatgatgctgagttcaatgtaggccaagaggtgaaagaaacacctggtattttttcttctgtagggtgtcaggcttaccaatgttttgagaatgagaataattttgcagttatatctgggatatccaatcaatatcaagatagcattggtggaacggctagttttcaaggaaacttggacaatttgaatttaaaagctgcagatatatcttggacccatccccaagcactaattaccaatgagcagcagtttggtagtgttaagagcgaaggagggattcaacataactttattaattctcatctttcaaaaggaagaactgagaatttctatgttgaggaagaccctgatgtttgcattattgaagacatcagtcatcctgctccgacgagtcgatctgcagacattgggaattcccttaatatatctcaatcttctagatatgttgattcccagtcttacacggttggaagtacaaggatgaaggcatgtgatgaacggaatatattacgagttgcattgcaggatctatctcagccaaagtcagaagttagtccaccagaaggattgctggcagttcctcttttaagacatcagagaattgctttatcatggatggttcaaaaggaaacatcaagtttatattgctcaggaggaattcttgcagatgatcagggacttggaaaaacagtatcaactattgcattaatattaaaggaaagacctccattacttaatgggtgcaccaatgcccgaaaaagtgaattggaaactctgaatctggatgtggatgatgacgtgcttcctaagactggtagagtaaaggaagaatctaatatgtgtgaggataatccaagtagatatccaaccaagagcatgagtttgttgaagcaagacaagggaaggccatctgctgggacccttattgtttgccccactagtgtcctgcgccaatgggctgaggagctgcgtagcaaggtaaatggtcaggcaagtctctctgtgctagtataccatggaagcaatcggacaaaagatccttatgaggtggctaggcatgatgttgtcctaacaacttattccattgtcagcatggaggttcctaagcagcctccagctgacaaagatgacgaggaaaaggaaatttttgaagaccctgccacagcaagtaggaaaagaaaaagcccttccaattctagtaaaagtggcaagaaaaaattggatggcacaattcttgaaggtgttgctcggccacttgcaaaggtggcatggtttagggttgtcctggatgaggcccagagtataaagaatcacaaaactcaagttgcaagggcctgttggggtcttcgtgctaagcgcagatggtgcttgtcagggactcctatccagaatgcaattgatgatctctacagttacttcagatttctaagatatgacccttattctgactatgcatcattttgtactagaattaagagccaaattaccaaaaacccagaaaatgggtatagaaagttacaagctgttttgaagacaataatgttacgccggaccaaaggtacacttcttgacggggaacctattatttccttgccgcctaagtatatagagctgaaaaaagttgatttttctatggaggaacgtgatttctattccaaactagaggctgattcacgtgcacagtttcaggaatatgctgatgctggaactgtcaagcaaaattatgtaaacattttgctgatgcttctgcgccttagacaagcttgtgatcaccctttgcttgtcaagcgatacaattcaaactctctatggagatcttcggttgagatggcaaagaagcttcctcaggaaaaacagatctctcttctgaaatgtttagaggcttccttggccctctgtagcatttgtaatgatcctcctgaagatgcagttgtttcagtttgtggccatgttttctgtaaccaatgcatctgtgaacatcttaccggcgatgacaatcagtgccctgctgcaaattgcaaaagtcgactgagcacatctatggtattttcaaaaaccacactgaacagttgtctttctgaccagagttgtgataattcacccagtcgctctggttctgaagtggaagaatctgagccttggtctgaaagtaagccatatgattcttcaaaaataaaggctgcacttgaggttttgaagtcattgtgtaagccacagtgctgtacaccaaaaagtacttctgagcatggcactttcagggaagataatgattgccctaggaacccctccattgctaacaatgggaaatccttaaaagattctctggagagtcaaaatttgtctgatgagagtagaagctctaatggttcagttactgttgtaggggagaaagctattgtgttttctcagtggacgaggatgctagatttgcttgaagcgtgtctcaagaattcttcgattaactatagaaggcttgatggaacaatgtcagttgttgcaagagataaagctgttaaagattttaacacttgtcccgaggtaaccgtgataattatgtctttgaaggccgccagtcttggtctcaatttggtggtagcttgccatgttcttatgctagatttatggtggaatcctacaactgaagaccaagcaatagatagagcacatcgaattgggcagactcgtcctgtgactgttttacggttaaccgtgagagatacagttgaagatcgtatcctagatctgcagcaaaagaagagaacgatggttgcatctgcatttggggaggatggaactggtgatcgtcagactcggcttactgtggatgatttaaaatatttgttcatgatgtga

SEQ ID NO: 24896 - DNA, 250 bp, Glycine max
  Peptide Sequence Number=SeqID_141674
atgggttgcaccttcaacggcaatgcgatgaacatcatcggcgtcgtgtggtgggtcatcgtcgtcgtacggtgggtcatggtcgcagtgcgccggtgcgatggttcctttatgcggtggaggttggtgagtggtgaaaggaaacgagatagagaagaggaaggggggaagtctatgttggcaaatgctgccagaatcttatttgctgaggtggaccatcctgatcttgacacgtggacccatttggcta

SEQ ID NO: 24897 - DNA, 147 bp, Glycine max
  Peptide Sequence Number=SeqID_141675
atggcgcttaagccacgcaagcttccaaagactaagataaagttggcgcttaagctcaagaaagtggtgcttaagcaatttgggaacaaagaactctttgaagagcttctagggctgaatcttccatctccttccatttttctttag

SEQ ID NO: 24898 - DNA, 288 bp, Glycine max
  Peptide Sequence Number=SeqID_141676
atgcataaaccggaaaaggcactagactttgctctcaaggagacttcacccaacatagatgcagagaatcttggaaagtacaagggccttgccaagcactttgagaaaaagtccaatcctcattggaatcaggtttttgccttctccaaagaaaggattcaagcttcttttctggaggtggtgatcaaagacaaggatgttgttgtggaagactttagatgcaaatatgtaggaagagcaaaattaacccctacatacatagcagtatcacatgcaggaagcaattaa

SEQ ID NO: 24899 - DNA, 360 bp, Glycine max
  Peptide Sequence Number=SeqID_141677
atgggggctgtcccaaaggctggaggattcccaccacttggtgctcatggtgtaactattttaaagcagcccagaacccctcctaccaataaccccgctatggatgctgattcagatcatgtattgaagagaacaagaccttttggattatcagatgaaatcagtaatctaccagtaaatttgcttcccgttgcttactctggccagagccatggtcagagctcctattcctctgatgacttgcccaagactgttgtgatgactctcaaccaaggttcaattgtcaaaagcatggatttccatccacttcagcaaattctacttcttggtaagcctcttttggattataggactggttag

SEQ ID NO: 24900 - DNA, 573 bp, Glycine max
  Peptide Sequence Number=SeqID_141678
atggcggaagcaactcactctagggtttcagcagaccggattgaggatgcaatcgcgaaactctcagcttcacaactagcaatgaacacaaagatcgacgacctcctccaacgaatgaatcaattagaggttggccagcaaccaccgcaatcattgtcgtcgtcttcagtaggacaaacaccgcaaatgcataacgcagtccaccgcatgaagctggacgttccaaggtttgatggttcggatccaacaggatggacattcaagataacacaattttttgagtaccacgcgacgccagatcaagagcgcctaaccatagcatcattttatatggaaggaccagcattggcctggttccagtggatgcatcataatgcacaactttcatcctggccggcattccttcacgcgttacactctaggtttgcatcatcaacgtatgaagacccaaccagattattatgcaagcttcaacagcgttcctcagttagtgagtacctctcagagttcgaatcactcgcaaatcgggtggttggtctaccagcaacattcgttctaagttgctttatctaa

SEQ ID NO: 24901 - DNA, 723 bp, Glycine max
  Peptide Sequence Number=SeqID_141679
atgatcgtcaacgacgatgaggagttcgaagaggaagaggaggacgcctctgccagccaccagatcttagacaacgaggaggagctcgaagcggtggctcgctctgctagctccgacgacgacgataattcaccggatgaagccgcagaagacgacgacgaggataaacaagatgagagtaatgttgatcatgaagttagcaagcgtgagaaggccaaattgagagaaacgcaacaattgaaaaaaaacgaaaagttcaggagatattggatgcacaaaatgcgaccattgatgctgatatggtataataatagaagaaagggtagattgagctatctcctacagcaaactgagttgtttgctcattttgccaagggtgaccaatcttctcaaaaaaaggcaaagggaaggggtcaccatgcatcaaaagtaactgaagaagaggaagatgaagaataccttaaaggggaaaaagatggcttagcaaatacacggctggtgactcaaccatcattatccgatggccaaaatagtatatacaaagaaggaaaaacctattctaatatttacaaagaagagtggatccaacctttacccatgggctcaaacatctaccctaaggttcatgagaaccctaagaccttctttagtagctctagcccaatcctcttagagtcttctatccaatacccttggggggtaggattgcatcaagagtcatga

SEQ ID NO: 24902 - DNA, 789 bp, Glycine max
  Peptide Sequence Number=SeqID_141680
gtggagtggcccatagatgtatcatacacagatgacttttccttcaagcgatggaagtactcaagctacaacttcacaatgactactttttggtcaccctatctagttagagctaaacaagtggattcaaatggtggtctctacaatgtttatcttgatgagtttgatgaaaaatggactactcaaattaaagagtttgactatgtcatcatcaatgtagggcaatggttcttaaggccaatggtgttctatgagaaacaaaaaattgttggatgtcaatactgttctttagaaaatgtcactcacttatcttggcactatggctataaaaaggcttttgggactacatttaaagccatcattaatttagaaaactttaagggagtaacatttcttagaacatttgcaccatctcattttgagaatggggtgtgggataaaggtgggaattgcgtcagaactaagccatttaagagtaatgaaacaaggttagagggcaacaatttggagttacataccatacaattggaacagttcaaaattgctgagaaagaagccagaaagaaaggtttgaaattcatgttacttgacaccacacaagcaatgttactaaggccagatggccaccctaataaatatgggcactggccacatgagaatgtgacattgtttaatgattgtgtgcattggtgcttgccaggacccattgacacatggagtgatttcctactagaaatgttgaaaatggaagatgtgagatctactagtaaagagaggtttcatttgtag

SEQ ID NO: 24903 - DNA, 834 bp, Glycine max
  Peptide Sequence Number=SeqID_141681
atgcctccgcggcggtgcacggcggcgtattcggcagtggcgcagatgggcagcaacacgagcgagagcgacgcggaggagctggtgatgcggtgcctctcgtgcgaggaggagtacgacgtggacgactcgggaacctgcagggagtgctaccaggaggccaacgaggccgaggaggagctccgccacgagatcgaggagctcaaatccaaagtctccttcctcactctcccctctcccaatcttaacgcttccaccgccgatgtcgtcctcgttcccgtcgacgactccgacgacgctcccattcccgctcacaagcatcttctgattagattcaagaatcttgtagttctcaccacattgaattggactcagttcggatatgttagtcgctctcctgttttcagagcaatgctcaagaatgatatgacagaaaggcggagtggcaccatcaagatttctgacgtatcatatgatacccttcatgcttttgttaattatttatacactgctgaagcgtcccttgataatgaattggcctgtaacctgttggttttaggagaaaagtatcaggtgaagcatctcaagacatattgtgaaaagtatttgatcgccaaaatgaattgggataaagctatttctaactatgcctttgcatatcaatacaattgcaaacaattacaaagtgtgtccttggcagtgatcttggaccacatggactcgctcactcaaaatgaatgttatgcggagctggtggacactaatcctcgtcttgttgtggaaatatatgaaacatacattggcaggctattaaatactgcaggcgcattttag

SEQ ID NO: 24904 - DNA, 417 bp, Glycine max
  Peptide Sequence Number=SeqID_141682
atgggtaaggatatggtggaggttaactttcacaagagttgcctcacaggtattggtgtgaatgataggacaacacaacgttatgcttctcttctaaattttcggaccatgggtattccgtttgtatatttgggaattctcggggggattcctcggattaagtgggagaaggaaaatggaggtggagagcctttttttagtgagggtagtttgtcatgtaggattcttgaatctaagtatgctcatgtgtctaagatgtttggagaaaatcaatcaaccaaacattctattggtggagggatgtggtcaaagtttgtgggtaggggagtcaagggggatgggagatgggtgagggaatttatttggagggattggtttgagtgggaacaaccaatgcaagaagagtttatggagagg

SEQ ID NO: 24905 - DNA, 345 bp, Glycine max
  Peptide Sequence Number=SeqID_141683
atggggaagccctcaaataagtctaaggagacacaaaagctaacaaatgttgaatatgctcctcctgataccattgcaaggaatcagaggggtaaggatcgatgggtctatttaccagattcggctggaggtagcaaacgtctagtgttggtggcgatgcaatcgctgcaagatgagggccaaatgcgcgaagagggtgatcggaatgtattctcaccggcagaggcgcgaagggtgttaaatattggcaaaagactgggtgtaactttgtgtggatatgatgctgaagttattgccaagattagaattgatggaacaaaatggaagctgaggttgcggaaatag

SEQ ID NO: 24906 - DNA, 210 bp, Glycine max
  Peptide Sequence Number=SeqID_141684
atggatgctgaaaagaagggaaaggatgcagaggaaacagagccatggcacaaacccaagaatgggagcgtcttccctaaagagagagtttctgtgaagcagatggtgtacaaaaaagtgaagcaggttgtggtggattttgttgagtccacggctaagaagggctcgatttcgccagctcctgaggcctcaaactccaaccatgaatag

SEQ ID NO: 24907 - DNA, 240 bp, Glycine max
  Peptide Sequence Number=SeqID_141685
atgagcgaaacaacagctatttgggtaaattgggttggaggtgaaacaaaggttgttaagctagatgatcgcatgcgacacacaatgagagcactagttgtcgatgaggtcaccacgacattggaagagaccataaacggcgttagaggaggtggggacgatgaagttattgtggttggcgaaggcgatagagttgacgagggaagtgagaagcgagtagacggtgtttttatagattaa

SEQ ID NO: 24908 - DNA, 1176 bp, Glycine max
  Peptide Sequence Number=SeqID_141686
atgtctgtcggccttatccagctcagttgcagtcccttttcatcaccagtattgttggtgaagaagaaggatagtagctggagattttgtgttgactatcgcactctcaattctttgaccgtaaaggattactttcccatgcctacgatcgatgaactcctcgacgagctaggcgctgcctcatggttttccaagctggatctccggcaaggcttccaccagattttgatggcggaacaagacacggccaagacagcctttcgcacatacctcgagcactacgagtacaaggtaattccattcggcttgtgcaacaccccctcgatgttccaggccaccatgaacgagctactgaagcctttcctccgccacttcatcactgtcttctttgacgatatcctcgtctacagcccctccctcaaggatcacatccattatctcactcaggtgtttgaatgtctaactcagggtcatttattcctcaaggagtcgaagttctatcggggtaacgcttcaatcgcctctgctttgactaccctattacagaaggataactttcattggagcgagggtgcccaatctgcttttgataacctcaagcaggccatgactcaggccccagtcctggctctacctgatttctcggtgccattcacactcgaaactgacgctttcggcattgctatgggcattgtcctcatgcaacatggccatccattggcatttttcaacaagatcttctaccctcagctgcaacgtgcttccacgtatgtccgagaactgcatgccaccaccaccgtcgtctgtaactggcgccaatatctattagggcacccattcatcatcctcatcaatcataagagcctacgcgagctcatgaaccaggtcattcaaacgctggagcagcaggtctatttgtccaagcttcttggttatgattatttgattcaatacaaagccgacaagaccaatgttgtagttgatgctctatcgcgcctacctcattacacgcatggccagtgcctcattctttccatgccctaccccatgtttctcgaggctattcacgattacattcgagccaacacctccttgcaagaccacattcggcaggtgacctctgccaccaacccgcaacttgattacaggttccatgacgtgctcctttatttctag

SEQ ID NO: 24909 - DNA, 576 bp, Glycine max
  Peptide Sequence Number=SeqID_141687
atggtgttgtgggcacagacagagcaacacaagaacaaggtcagtgtcactgtaatccctgctccgaggaaatcggtgaagcgaatgatggcggaaacccttgtccgtttcattgctgctctgttttcttgcaaaggaaacctatctgaagaggactctcaagtccctgtttctggtcttcgttgttatttctcaaaatgcaacaaaaaagaaaaatcgaaacgcctgcctccagatctggatcttgatgttctgcggtggcgctgtctggatcttccattgtcgtgcaaaaatgcccgtacgccatctcaggctcgacttcgattccgatggagaagaacaagacccccttcagttccaactccatttcgagccaaagccacaaccacattttccattgaaattttcgacgatgaggactttatcaatgtcctctcctgctgcctcggactgtctctcaaaagagtggctcagttcttgcctccaaactatagaccttcgttacaaccttcaaacacttcgacgtcgccgcaaaagctaaacggtgtatcaggcaatttctctttgcgagcatga

SEQ ID NO: 24910 - DNA, 165 bp, Glycine max
  Peptide Sequence Number=SeqID_141688
atggggatggatcaaggtgcaggaatgagtactaaaaagtacgagacaaaggtgaagaacaagaagaatgcatttgcatcggtgattcctgctccaaggaaatccgtcaagagaatggtcgacaaggtgtttgccctaactcctacgtatcctaggatgcaatga

SEQ ID NO: 24911 - DNA, 978 bp, Glycine max
  Peptide Sequence Number=SeqID_141689
atgggttgctgcgttagcaaatgcaggcccgaatacaaaccctccccagaacaagaacatcacttcaaattcaaccatgttcaagacaagcttccaatctctcaagctccaccacttccaccaaccctttactcctcaacaaaaatctcaccctccccaccttctccaacctcttctacttcctcaatctcatccttcacatgcaccacttccaacaccatctcctcagcctcttccctttccaccgcttcctcttccttgagctccaaggacaggtccttctccaacgagttcctctggtcgtgctacaaggacaaccctcacatcatcactcgcatcaactcactcagggattccacctctctctccttcatgccacctactaaacctaatagaaaggttgtaaacataaacccttcaccacccaaacccaacttagcaacactgaagcagtctccaccacaaaatactgttgggtcgttttccatgccacagaaaagggtgcgatcaaattcgccaacgaacctaacacgacagaagagtttccgaaaggatacggagaggtccgttactattaactatgcttccaacatgcagagtaggacgctaattaggtcaccctctcccagcagaagattcaacggagacaaatgtggaagtgctaatttgggtataacgatcaacagttccaaggttagtagtgttagtggagttcattcgaattctcaccatcattctgttttgccttctacgaggaaagagagtgttaaagcggtgagtcccaataataataattgttcacgaagagtacttcattctggtttgagaaacactcatgagactcgcactttaggggttggtcctaaagttgatgaaaccgtggttaaggatgtggtgtctgaccatgacaaggacttaactctgatggaggatattgacaaccctcttatatccttggattgttttatctttttgtag

SEQ ID NO: 24912 - DNA, 1458 bp, Glycine max
  Peptide Sequence Number=SeqID_141690
atgcaatatgcagtactgtttcgttggtttcttgatgatgaagagattagaacacgagttgaaaaggaacccgaacacttttcaactacaatgctttcaatgtacagagcctcaaaccttattttctgtggggaaaatgaacttgaggatgtcaaatctttcacgagggatctactaaagagaagcttgctaactaaaaacggtgaaacgcagaggaaattgtcccaattccagcaaatggttcaacgtgaattgaatattccgtggctggctcacatggatcatttggatcataggatctggatagaagaaaatgaagaagtcaatttcctatggaaaggaaagacctcgcatgttaggtgggcccaaaattgcggtctaacgaatatgggatttggaagagagaagaccacatattgttactatgctatagctgctgccactacctatccaaatgacacttacgtacgaatgttagtggcaaagagtgctgtaatgatcacagttgcggatgatttctttgacgcagaaggatcattcaaggagttgaacgatttcatgaatgcagttagaaggtgggattctaagggcttaagtagccagctgggcaaagtcatatttgaagctcttgataatctcgtgagtgaagcttctggaaaatatgtcgaacaaggagggattcatgatatacaaagtagtctacaagatctatggtatgaaactttcctttcgtggctaacggaagcaaagtggaacaaaaagggagaggcaccatcaattgatgactacctgaagaatgggatgatctctattgccatacacaccatgattcttccagcttcatgttttttgaatcccagcttgtcatacgagaatctcaggccggctcaatatgaacccatcactaaactactaatggttatatgtcgtctattaaatgatatacagacctacaagagggaaactgaagagggaaagtggaattttcttgggctcaatttgatgaagaacccaaattttgggatggaagattcaattgctttggggagagagatcatagatgaaaggacgaaagagttcattcagcatgttctagttaatggtcaaagtgatttgcccaagccttgcaagctgctgcatctgacatgcttgaaagtttttcatctgttttacaactctagaaatgcatttgactctaacacacaactgcttgaggatattaataaagcaatttatcttcctctacggagaaacacaaagaccaccaagattgatctctctcagctgcgttcaatgccaaaaatgaaagataaaagtattcagaggccacggttcaattggtcctttaaacacaatagaagcttttgtgtgcatcaagtaatttctccacctgctttaagaaatggatatgggataatatccttcaatccgaaagccttaataccgggctttatctaa

SEQ ID NO: 24913 - DNA, 1443 bp, Glycine max
  Peptide Sequence Number=SeqID_141691
atgactagtttatacaccttggttctcctactttttctttttctatcttatagacctgctctttcattttcttctagacataggcaatattggggtggtggtgggaggatattgagctctggtgagcataatggtgatcttgtgactaatttgcctggtcagcctagggtgaatttccagcactatgctggatatgtcacagtcaatgaaaccaatggaagagcactcttttactggttctatgaggctatcacccagccaaaagagaaaccattggtgctttggcttaatggaggtcctgggtgctcttctgtgggatatggagcaacacaggagattggtccatttttagtggacactgatggccaaggcctcaaatttaataacttctcttggaacaaagaagccaacatgttattcctggaatctcctgttggagttggcttttcatactcaaatacaagcagtgactatgaccaattgggagatgaattgacagctaatgatgcttactcttttcttcacaattggtttcaaaagtttccatcatatcgagggaggacattttacatagcaggggagagctatgcaggaaagtatgttccagagctggctgaactcatccatgataggaacaaggacccctccctctatattgatctcaagggtattctgttgggtaaccctgaaacatctgatgctgaggactggatgggtctggttgattatgcttggagccatgctgtgatatctgatgaaactcatcaaacaatcaaaacaagttgtgactttaacagtactgatccatggcacaatgaagattgtagccaagctgtggatgaagttctcaaacaatacaatgaaattgatatctacagtctctacacctctgtctgctttgccagtacagcaagttctaacgatcaatccatgcaaacttccacgaagcgttcatctaaaatgatgccaagaatgttgggtggctatgatccatgccttgatggctatgctaaagcattttataataaaccagatgttcagaaggctcttcatgccagcgatggtcacaatctaaagaaatggagcatttgcaacgacaagatattcaatgactgggccgattcaaagccatctgttattccaatttacaagaagcttatttcagcaggacttagaatttgggtttatagtggagatacagatggtagagtaccagtgctttccacaaggtacagcttaagctctcttgcgttgcctatcactaaatcatggaggccatggtatcatgacaatgaggttagtgggtggtttgaagaatataaagggcttacatttgcaacgtttcgaggagctgggcatgcagttccctgttttaaaccaagcaactcacttgcgttcttctcctcctttctcaatggagaatcaccaccttctacaaaataa

SEQ ID NO: 24914 - DNA, 855 bp, Glycine max
  Peptide Sequence Number=SeqID_141692
atggagtctccttcatcctccctcgttgaaaagattaaggggaaaatattctcatcaaatgttgatccctatacttctatatgcccctcagcttatgatactgcatggttagcaatgatacctgattcccacaattctttcaaacccatgttcaaaaactgcttggactggcttctcaacaaccaaaatcaacaagggttttggggtgagtgtgatgcctttggaaaacccacattggaaacacttccggcaaccctagcttccattgttgcactcaaaaagtggaacaccggtgcattaatgatagacacaggtttggtcttcattgaaacaaatattgaaaagctgctcaaggatatcgacaacaattgtcctcgttggtttaggattgtttttccagccatggttcaactttcagagagtgttggtttagaaattgtgttcccagatgcagtgacagggtctgtgtcaaggatctttcaccgtcaacaatatcttcttaacaaggaggaacttgtggggaagcattgcttcccaccactgttatcatatcttgaagctttgccacctacatatacaataagtgaagaagatatacgtagcaatctcagtgatgatggttcagtgttccaatcaccctctgctactgcaaaagctttcatggctactgggaagattgagtgtctggcctatttacagtctctaattcaaagatgtcctgatggagttccacaaacgtaccccatggacgaggaacttataaagctttgcatggtaaacaaattacaaaggctagggttggctgagcacttcgttgaagagattgatgaaattttggccaaggtctacaggtaa

SEQ ID NO: 24915 - DNA, 252 bp, Glycine max
  Peptide Sequence Number=SeqID_141693
atggagatgaagcgattgatggtcatggtttcttggttcacggctggagttgaccaaaaaaaaggaagagaaaaaattgttaagctagccctcacaagtgactgtggtagaacaggagtagcggagcttatccagcatgggggtgtcaaagaagaaggagaggtcagtgtggctaagggaggtgaggagggaaggggggatgttgtggttaatgacgtcgaaggcgccctagtgatgtcaagcatgtggtag

SEQ ID NO: 24916 - DNA, 189 bp, Glycine max
  Peptide Sequence Number=SeqID_141694
atgggtttccgcatacacggtatttttagatgggatacagtttctacaaacaaagcagccagcaagaagcttgaagtaccaaaaggctatcttgcagtctatgttggaggtaagatgagacgcttatattggggattaagtgaagtagttcagttggaggtgtcgatcaaacttgatagtggttcctag

SEQ ID NO: 24917 - DNA, 429 bp, Glycine max
  Peptide Sequence Number=SeqID_141695
atggattcaggtggtctcttgcggtgtgaactagaggttctgccccacgtgccaaccaatttcatttggccaaaggagtacttggtggatgcacaacacgagctccaagcaccagtggtggacctttatggctttctcagaggggaaaacgaggctacaaaacatgctgctaagctcataagtgaagcttgcttgaaacatggcttcttccaagtgatcaaccacggggttgatccacacctcattcgtcaagcacatgatcaaatggacactttcttcaagctcccaattcataggaaattgagtgttcataagacacccggttccatgtggggctactctggtgcacatgctcatcgcttctcctcccaattgccatggaaggaaaccctctctttcccataccatgacaacaccttagagcctgtt

SEQ ID NO: 24918 - DNA, 276 bp, Glycine max
  Peptide Sequence Number=SeqID_141696
gcattatcgaatgggagatacaaaagttgcctccatagggcagtggtgaacaagtacaaggagaggaagtccttggcgttctttctatgcccaaaagaagacaagttggtgagagccccaaatgatattgtgagcatggatggcaccaaacactatcccgattttacatggtcacatttgcttcacttcacgcaaaaccactatagagcagaccaagctacactaccaaacttcaccaagtggttgttatcctccaaaaccacacacactagctag

SEQ ID NO: 24919 - DNA, 993 bp, Glycine max
  Peptide Sequence Number=SeqID_141697
atggagttttatgaccaggatttcttggaggaattaatgactctaagaagagaaacatgggacaccaatccaagaacagaagaaaaccagttctttgatggtgggagttttgactgctttgatcaaaactctctaccttaccttccaaactcttcttgtggtcaagaagttcctcaaacttacaataacgactaccccttcagtgaaatctatggctgcttacttgatgaatcatcaccacagattatggattcattctatagcacccttgatactccactcaatacccctccatttcttggtcaagaggattatccaatattgtctatgatggaagaagaggagcagggtttgcttggggaagagcttaagaatttggagctgcaaaccacatgtaaaatggagccaacccaatcctctgaaatgccggttttcaacatgggaacgggtctggaaagaaagaaccgatcaaagaagcttcaggggcaaccctccaagaatctaatggcggagaggagaagaagaaagaggttaaacgaccggctctcgatgctaagagcaattgtccccaagattagtaagatggatagaacatctatacttggagacactattgattacatgaaagaacttctggagaagatcaacaatctgcagcaagaagtagaagtagattcaaacatggcaggcattttcaaagatgtaaaaccaaatgaaatcctagtgagaaattcacccaagtttgaggtggagaggagtgtggacacccgggtggaaatttgctgtgcagggaagccaggcttgatactatctacagtaaacactctggaagcattaggcctagagattcaacaatgtgttattagctgtttcaatgatttcacaatgcaggcttcatgctcagaggaatcggagcaaaggacgatgctgagttctgaagacataaagcaagcgttgtttagaagtgcaggatatggaggaagatgtttatga

SEQ ID NO: 24920 - DNA, 141 bp, Glycine max
  Peptide Sequence Number=SeqID_141698
atgccctcctttcgcgatttggagcagaaatgggcaccaaaggttgaagctttgtttgaagcttcaatggagagtgagggagaaagaaaggcaacttcctcgcgtttctctgcgtccgtcggggccagttttcgaaagtaa

SEQ ID NO: 24921 - DNA, 735 bp, Glycine max
  Peptide Sequence Number=SeqID_141699
atggagcacatgaagattaaggaggtggcatgtcaagccaaagtgattggcacagtaataacatttggaggcaccttgcttatggcactgtacaaaggacccgttcttagttttatgcgatcttcaactagccatcctagccaacctgagaatgtggccacagaaactggtaaccattgggtcatagggacattgttcctcctcattggttgtgctggcttttctgcattttacatattacaggccataacattgagaaaatacccagcagagatgtctctggccacttgggtttgctttgtaggagcacttcaaagctctattgttgcaatcttcgcagaacgccaccaccctcatgcttggtcccttggttgggatgcacgtctctttgctcctgcttacgcgggaatagttacgtctggagttcagtattacatacaaggcatggtctcaaaaattatgggcccagttattgtgactgcttttaatcccctgcgtatgatcattgttacggccttggcctgcatcatcttatctgaacaactcttccttggaagtattattggagcaatagttgtggttcttgggctttatctagttgtgtggggaaaagctaaagaacgtagaggtctgatgacaccgtcccctgcagaaaataactttccagaagaccaacgacagctaccggtcacagctccaaggaatgatagcattaacaataataataaggcttaa

SEQ ID NO: 24922 - DNA, 1147 bp, Glycine max
  Peptide Sequence Number=SeqID_141700
tttgctagagattcaaaatgctcaaggactagctgatgtattgatggaaatgcttagcgccttgagtcctaaagaccgtgagctcagtgcaaaactgtcatggcaagttgtcatttttcatttgtttcttaatattctgggcaaaatatgtcagggtgtgaaggaggaagtgattgttgatcttgttgaccagtgccgttcataccaaaagcgtgtcatgcttcttgtgaacaatactacggatgagcaacttttaggtcagggattggcactgaatgacagccttcagcgagtactctgtcgacatgatgacattgtgaaaggaactgctgattctggtgccagagaagcagaaacttcagttctaccacttgtaaatgtaaaccacgaagatgatgaatcagaggatgattttgctcaactagcccataggtcatcacgtgatactcaggcacagaatcaaaaaccagcctatgacaaggcagaaccagggaggataaacccactcattccaccaccaccagcatcaaagaagccggtctactctggcaccggcatggttgactatctcagtggtgatacatacaagacagaaggatctcctgaaaactcagaacccacttcatttacagctccccttcattctagccctaatccaacctcgtcaactattccatctctgtcttcctctcatcctcatgctgtgagtactacctcatcaccaatttttagcagcgagcctgtgtatgatgaacaaccatcttctgaggacaaatcttcggagtgtctgcctgcagctccctgggatgctcaatctcctggcatcattccgcccccaccttcaaagtataatcaaagacaacagttttttgagcaacaaggtgtatctcattcaagtagtggatccagttcctcttatgacagcttggtgggacaaactcaaaatctctccctgaattcatccaccccaaccaaacaacagaagccagaagatgcccttttcaaggatcttgttgattttgccaaatccaaaacctcatcatcttccaaacccaatagattctttaaggatcagagtctcttcaaatttgctggtcgcaaaaagggaataggtgattatagcatgggcaattttaagctcttgtag

SEQ ID NO: 24923 - DNA, 2286 bp, Glycine max
  Peptide Sequence Number=SeqID_141701
ttgcttaatctcaaaattcttgatgatgaattgcaagcagcaatgattttatcacgggatgatacaaaagttgtgctagttgcatggtttctattaatgatctcagcaatgtcgcaaacaattcgtcctagctgccaaaataaatgtggaagtgtgaacattccatatccttttggtacaactgagaactgctgcttgaacagaaacttttatgttgcttgtaacacaagtcacaaccctcccaaaccatttctgtggaatgtgacaaaaaatattgagattttagaggtgtcgttgaatggccatttgaggataaaatcccctgtagcttatgtttgctatgatgaaaagggtgtgctagtggattccggaaattcattcatgactttgcaagcattccacttctcatactctcagaacaagttcattggaattggatgtgacaccctttcaaccatcaatgcaacaattgggaaaaactactcagctggagggtgtttttcactttgtagtagtgtagaaagttcagccaatggatcctggtttggcattggtttctgccaaacctctatcccaaaaaacattttggcatatcaagctcgtgtcctgagatcaaatttgatgcatagtgatatgaatattccttgtgcctactctcttttggttgaagaggactctttcaagttctccacggatgacttcatcaaacttcagaagacaaaaacagctaccacagtgcttgattgggctgttggaaatcagacatgtcaagaagctaagaagaatttaactagttatgcctgccaagcaaatagtgtatgtattgattctgacaatggaccagggtacctttgcagatgcttagaaggttatgtgggaaatgcataccttcatggtggatgccaagatattgatgagtgcgccaatccgagtctaaatgactgttcagatatttgccttaacctacctgggagctataattgctcttgtcccaagagcaagagttatgagggagatggcagaaaaggaggtagtggctgtgtctcgaatctaccacatgtggttaatcagattgtgataggcactggcataggccttatgctgttgttaattggtagtggctggctattccatgtgttccgtaaaagaaaaatggtgagactcacagcaagatattttaagagaaatggtggcttaatgttgcagcagcaaattgcgaacatggaaggatcatctgagagagccaaaattttcactgcaactgagctaaagaaagcctccgaaaactttcatgagagcagaatcattggcagaggaggatacggtacggtttataggggaatacttccaaatgacaaagttgttgctatcaagaaatcaaaactagtagaccacagccaaattgaacaattcatcaatgaagtggttgtactgtcccaaatcaaccacagaaatgttgtcaaactcctaggttgctgtctagagacagaaatgccactactggtttatgaatttgtgaacaatggcaccctctttgaccacattcacaacaaaaacaccacacttccctgggtaacacgtctaagaatagcagcagaaacggctggtgtgcttgcatacttgcattctgctgcctccataccagtcatccatagggactttaagtcaactaacatactgttggatgacaaatacacagctaaggtttctgactttggaacctcgagattggttccacgtgacaagtgtcaattaacaacattggttcagggaactcttggctaccttgaccctgagtactttcagaccagccaactaactgagaaaagcgatgtgtatagcttcggtgtcgtgcttgcggagttgctaactggaagaagggcactttcttttgacatgccagaggaagagagaaacttagccttgtatttcctttcagctgtgaaggatgattgcttgttccaaattgtagaggattgtgtgagtgagggaaatagtgagcaggtgaaggaagttgctaacattgctcaatggtgcttgaggcttagaggtgaggaaagacctaccatgaaggaagtggcaatggaattggatagtcttagaatgatgacaacaacaactacatggattaatgccgcatcaaattcaacagaatatgtgattggtgaaagatcaggtcgaacagaaacaacagactatgctaattgtcattatactacatgtgctgggcatgaggatgacaccatttgcaacgatgtgatgtcaccgttatgggatggtagatga

SEQ ID NO: 24924 - DNA, 1632 bp, Glycine max
  Peptide Sequence Number=SeqID_141702
atgggtgtccaatattcaaagctgctgttgcagctgctacttgttgcgttctttattgcagcaactaaaactgaaccacctttgtcaaagccaaactgccaacaaaagtgtggcaacgttatcattccctttcccttcggcatgacggaagcttgttccctcaacacctcatttctcatcacttgccaccgaaacctttcaccacccaccccattcttgcaaaatgattatcatcaaattagcgtgctagacatctcactcgagtacggccaattgagcatttcattgccagtggccagaaattgcctcatcaataatctaactggggaatcatttattgcaatgaatctcggaccttttcacctatcatccaaccaaaacaagttaattgtgtttggtgctgacgcggctggaatggtatataatctggaaaatgcatcaggaatactgtaccctactattgcatgcatgtctgtgtacgctcctgcagcctcagcacctgacaagtcatgctctggcaccttatgttgcgagactccaatacaacaaaggctatcagaattcttctatgaatcttctacaaatatcttccgcagaaataacaccaagagacttgagtcctatccatgtggttatacatttctggttaaggacggagcctacaagttccacatcacagacatcttcaaccttagcactaacaacaaatttcctgttgttgcggattgggcagtggggactcacacgtgccaagatgctatgaagaatgcttcaagttatctgtgtaagtcaaactatagtgaatgtcgcgacgcagaggtgggacctggttaccattgtaaatgctacagtggttatcggggcaacccttacgtctctaatggttgccaagacgttgatgaatgcaatgagaaaacccacaactgtacagagggatcaatatgcagcaacagtccagggatctacagttgttcttgtccaaaaggatatgaaggagatggaaaaaataatggaacaggatgtcgtcccaaagtcagcagtagccgcataatcataattgctttgactgtgagtgtaagtatcttaacacttcttgggggaaccttttatatgtattggacatcgaagaagagaaatctcatcaggcttagagagcaatattttcaacaaaacggtggcctgttattacaacaacaggttgtcagatatagtgggtcaactgaaatgactaaaatcttcacagtggaggaactaagtcaggccaccaacaatttcgatgaaagcatggtcttaggccaaggtggccagggaacagtttacaaaggaatattatctgacaatagaattgtagcaataaaaatgtccagaattggtaacccaaaccaagttgagcatttcatcaatgagatgatattgctttctcaaatcaaccatagaaatgtggtgaaactattgggatgttgtttagagacagaagttcccttgcttgtttatgaatttgttcccaatggtactgtttacgagcatcttcacaatcaaggtcaatctttaagacttacatggaaaacaagattgcaaatagcaacagaaactgccagggccctggcatacttgcattctgctaccacttaa

SEQ ID NO: 24925 - DNA, 696 bp, Glycine max
  Peptide Sequence Number=SeqID_141703
atgaatggagtatgcaaacctgaactcaactcccaagacccagcattgtgttttgccaatcttaacgataaagcaggaaatttaaatttagaccagatgcaacagaaagctgttaggcttttggttccttcagcaagatttgaagcttcaaaactgaaggttgttctattggaagatcagataaacaaacacgctagtattattccaagaacctacattctatcccattgtgactttacagctaatctgactttagcggtgtccaatgtgataaacctagagcagttgagagggtggtatgagaaggatgatgttgtagctgaatggaagaaagtgcaaaatgatatgtgcctacatgttcattgctttgtcagtggtcccaattccttcctggatctggctgctgaattgagatatcacatattctccaaggagatgcctttggtactcaaagcaattcattgtggagactctgcacttttccgtgagcatcctgaattgctggattctatagttagagtatattttcattcttgctcagaaaaatacaacaggatggaatgttggggacctctcaaggatgcaatggagggaaaacaagcagatcagttccaagggtcaataagaagagatagtcctgaaaagttgcggagcccaaagtccatcttccaagctctttttgcttttcttctttga

SEQ ID NO: 24926 - DNA, 1008 bp, Glycine max
  Peptide Sequence Number=SeqID_141704
atgcttgatccgagaacacaccaccccaccaattctttcgaattgtacgacgcaacacgacacaaaccccacacatgggatgttacgaactccggtttgtggccttcgaaaccggctttggaggaggcagaggtagatgattccgggatttgttcacctcccatgaggaccacgagccccccacgccgaaaaaacaaccaccgaagcctctcgccaacgtcgaggacgcaagccatagtgagagggcagagggagctcatggaaatggtgaagaacatgcccgagtccaactacgagctctccttgaaggacctcgttgagcaccacatggttgttgatgctactagacatgaaaaaaacgcggtggaagagagaaacttgagcagcgtgtacaacaagagagaaaaaaatggtggtagtagaaaggttgataataataataataacaaaaatatggcacaggtgaagaggaacgggaacattgatcgtggagggttctacctcaaaatggggcttccttttccttttggatctaaggacaagaagaagaagataaagaagaaaaatgagcccttggggaatagttgtagttcgagagttacccctaaaccttctgatggatcagcaaagggtggtgttgttgataaggagtggtggaagaagagtcctttagcgtgtaaagagagtgatagtggtgaatcgagtatcaatagtgacagtgggaagagttctggtagcagtagtagcaatagcagcagtagcaggagtaacagcaggcgtgagaacagtggtaggcgttgctggcctttcattcgcagacccaaaaatcgaacacaaaaaaatagtcagatgaatatttggaaactttttatgatggcttggatcccacagttgaagcagttgttacttcaagttatagatttccgagtgatctatgagcatgaattaacatgttatctgatggaaacaaatgtacaagtcaagaaccaagtggatcttcttatgtaa

SEQ ID NO: 24927 - DNA, 303 bp, Glycine max
  Peptide Sequence Number=SeqID_141705
atgactctccccactattagaggctctaaaggcattcttgccattgtaagaggaaggaacaaggaggaagagagaagaggtagtggagctaaggaagggaggaatacaattgttatgatgaatcctgctgaggaaagggagtgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24928 - DNA, 570 bp, Glycine max
  Peptide Sequence Number=SeqID_141706
atggctatcttaactgctgctagcccatttctttctcataaagcaacttccaattgttcggtttcattgaaattcttgaaaagggggaaagtgggaccactaataatgcaagcaaaggatgctttgaagatactcaagaagcgtttggccagtaaaaatccaaaaatacagcttctggctctttttgtattggagactcttagtaagaattgtggtgaaagtgtatttcagcagatcattgagcgggatatcttacatgaaatggttaagatagtgaagaagaagccggatttaaatgtgagggaaaagatactgattttaattgatacatggcaagaagcttttggggggccaactggagtttatcctcaatactatgcagcatataatgaattgaagtctgctggagttgaatttccaccacgagatgagaatagtgtaccattcttcactcccgctcaaactcagccaattattcattctgctgcagaatatgatgatgctactattcaggcttctcttcagtcagatgcatctgaccttaggaaattagcagggtatttatcataa

SEQ ID NO: 24929 - DNA, 444 bp, Glycine max
  Peptide Sequence Number=SeqID_141707
atgtcaaatactgagattactgttgctttgacagatgaaaaagggaagtttgatgagttggttgaggataagggtgttaagatattgattgatccaaaggcccttatgcatgtcattggaactaaaatggattttgtagatgacaaactaagaattgtggcactgtacctgtatggggagaaagggggtggagataagaacgggaaaggaagtgaggttgataggcaaaaaattaagtatggcagtgaggcagtagtggatcttctaagccatgaaatagttaaaattgctattcaacttgctgtggatcctcacatagacatacaagtacaactaatggatttctattattctgcctgcgagaacaagggaaatgagagctttggtgctcagaacaaaaggatactgaggactgacatggtctcaatatacagagttctctga

SEQ ID NO: 24930 - DNA, 1142 bp, Glycine max
  Peptide Sequence Number=SeqID_141708
gaatttttggaacagtgctggcagtgttgttcattgggtttgtagcatggagttatcaaactattcaacctcctcctccaaagatatgtggatctcttaatggtcccactataacagcacccagaatcaaactaagagatggaaggaatttagcatacaaagagcatggtgtcccaaaagatgttgccaagcataaaatcatctttgtccatggttttgatgcttgcaggcatgatgcctatgttgccaaaacactatcacctgatgttgctgaggtattaggggtttacattgtatcttttgatagacctgggtatggggaaagtgatcctcatccaaatcaaacagttaagagcctggcattggatatagaagaacttactgataaattgggattagggtccaaattctacataataggtttttctttgggtggccaggttgtttggaggtgccttaagtatatccctcacaggtttatggatcttctcctcacttatatggtgttcaactttttcacttctacccgatgtgggactacacctcacacttgtaacccaacacatcttctcctcaagtgtgagtctcttccacatgtgctcatagccccagttctcaattactggtgggctggtcttcctgcaaacttaactaatgaagttttctaccaacaaaaactacaagaccagtggacagttcgtgtggctcactacataccatggctaacttactggtggaacactcaaaaatggttcccatcttctagtttaattgctgacagtatagatcttctttcccttcaagacagagaacttttgcctaagaggtctgatcgaaagaatcatgtggctcaggtaagacagcaaggtgaacatgaaactgttcaccgagacttaattctcgcatttggtagctgggaatttagtccattggatctggaaaatccatttccaaataatgaaggttcggtccatatttggcaaggagatgaagatttgatagtgcctgttaaagtgcaacgatacattgcacaaaagcttccgtggattcagtatcatgagcttcaaggtgcaggccatttgttccctcatgttgatggtatgagtgatactatcattaagtcacttttaagtgggaaataa

SEQ ID NO: 24931 - DNA, 528 bp, Glycine max
  Peptide Sequence Number=SeqID_141709
atgaacctgcttggaaagaagaagctcagaagaagcagcacaagaggcgagaacgctagcaaaagtaacctcagtagggaaaaaaccagacctagtcatgcacaggaacaaggaaaatgtctcgttggggaaacccaattgggaataagcggtaatgagggcgttccaggagccgccatctggttggggcatttcgtcgaacagttcgcgggcgtcgcggaggcagtggcatttggcgtaggcttcgatggcgcggttgaggaggaaggtgggggggttgggggagaaggtgagcaggtgggactcgaccttgcgggcctccacgacggcgcggtgggaggagcagaggcggaagaagagggcgtagagagagaaagggaagggcttggggaaggcgaagagaatggaagtggcttttcggatgcgacccgctttgaggtacgtgaggatcgtgttgatcactgcattggtggcgggttgggtttgagagtgtggatgtggtttcaggttttgcttgcggaggagctg
